United States Patent 10,329,575 (REGULATORY SEQUENCE FOR PLANTS) - sequence listing, part 19

SEQ ID NO: 29959 - DNA, 3000 bp, Unknown
  misc_feature (1)..( 3000): 2750-1469P.txt file - cDNA_ID_3024281; gDNA_ID_2214537; Annot_ID_185125
acaaaaggttcacggtctggtctggtctgcaattttgtatgaaacaatgacttctacagtctgcaatctgcggcatgtttagcctacaaaacctacgattcttctaactcgtcccgtgacgaccggacacaacccacctatgtgtgaaattaaatcaaatgttcattatattatttcctaataatcgagaattttatttgtcttattgatatatatatattaaatcaaaaatatgtaagaacaacctgtaactcaattacatatcaaaaaaaaaaaagacaagtggtttgtataaatgtattataaataattttatgcatgtatcatgtatgaatatgagttggagtaaaagacagagaagacagtatctacttgacccacttaacacaagccgatgttctctcccttccaaacattgttctctctttaagcttgccctaaatcttgtgtgatcctgtgtgtgattttcttatattattatctttaaacacttgattttgtttaattcttaattcaatgctcacatgctattacgtagtttctcgttggcgtttaatgtacagatcgtaaccttaattaagcacataatcggagacttgacgttaaataagtttttaattcgactatcaacaatatatatgaccacgtttggtgcgttcgtttcacggtaaattcggaacgcaccaacattattcacaaactcgtgtttgatatctgtactttatacatacactgatgactgaacaaaccattttttcaatgaaagtatgggtaaacgcacttaggcgagcaatttgagaaatgttgactactatcataatgtggttattggaaatttatgaatatgttgagtagtattcaggttttatattgcgcactagtaatgttttggtttctcttatcagtaatttatttttaatgcataaagtgttaaaaatgaacaatcaaattacatttgacccaaaaaaaaaaacaatcaatttattaatttaccgtgatctattagctagtggttaagttgaagataagaattgaagaataagaattcgagtctttccatcatgattttttttttttacaatatatgctttagaaagttgagctcatcctctcttaacaaaaaaataaaaaataaaatcaagagggtaaaaacagaaaggagtctacctaattagtcacctttgaatttatgatgattaatatttggcttaatttaataatattaattttacttctctcctttcactattggttacaaaaaaataatgatagttttccaaaacatcaaacaaataacaaaactcaaaacatcaaataacttggaacagagaaaataccagtgataactactgtttcgactaaatattgtcatccaacttgaatcatttaattttaacatcatatgtaaagtagtttaggcgaatcacttactccatgtataacttcatgtaatttaggcaaatcatataacatcaaagatttgatttagtgtttggtcccttggaactaccttataaacaattgaatccaatcctacaaaatcgaaacaacatgttttgaaacccgacccggacgatgaaccggactacattctgggtcaccgggtcatcgggtcaaccgggttggaccacggattaattagttaaaatttatttaataaatttaatattaatagaaattttagagtattttatataaaaaaaatttagtatttataaatataaaacaaaaataatcatatcatatttaatcaaatataaaattatattatgtttaataaaatataaaattatttatacccaaatatatagaaaaaatcaaacaataataataaagtggttaaaaatttgaaatccaactaaatgtctaacaccgtaacaaatatattaagagatcatcaatgacagaaataaattaataaaacatcgtgaattcaaacaactaatctcggttgtctctctcaccattcgattcaattttaaggcggtattgtaaagtcttcaccaaaatctaaaatatcaaatgaatttaagaactgaaaaaacttttaaaaataattgaataaagtctaaaatcccatattttattgtaaaatcaagagaactttttaaaacccacacccggccggttcaaccggttcaccgggtcacgggttaattgcgagtttttgtgggttttttcgattttgaacttgttgggttttagcactaaacccaaaccggaaaagtgttcgggtcacaggttaaccggtcgggcgtaaaaacactggttatagctaatattatcgaatgttgacaacaagtaaatgctatgacgaatattttaattaacggcactgtttaagctaatatcacgtggagaaaggcatgtgctagctattcgaacatatgattaaatgcaaagtcaactattaaatccttttgcccgtactctaatttgcacgacaccagccttttttcctttcctaataaattgccttgctgtgaaaaacatttgccttaatttgcttatatagtaatttataactatctagcacactttaaaaacactgaattgtttttatcatttacacaaaattagtatgccacattcgataatcacgtatgatttggactttagagtataattttttttgtaatgcgtcgccatttccaataacataacagagctctaatcctcacagtcaaaattaaagtccgtacagaatttcatttatttcatacaaaaactatataataaaaatgatttaatattttttttcttggtttggtaaattccatctccctgaccaatatgtaaacttggactgtctctctccaatgaaccttcgcgcagacataaacagctcacttccaattattattacaatttttattcttttacaaaaaacaaaacaagaactgcattcattaacatgtctactcaatcacctctcagatcgattcttcttcttcttcaatcattctccccaaaacattcatcagctcaaacaccaaaatg

SEQ ID NO: 29960 - DNA, 3003 bp, Unknown
  misc_feature (1)..( 3003): 2750-1469P.txt file - cDNA_ID_3024303; gDNA_ID_2214538; Annot_ID_185170
atagatttagaaaaatatttgagttggtgtgatttcctgtgtttctctatgataatattgagcacttcatcagtgttgttcttactttctggccatagaaacatgataaagactatttgcatgtggagaccgggtgcttttttatgaagatttgggtgttttgttttggacctaacgttttaggcaattttgtatggtttgattgttcggctgtagttgtacatgattttctggttcagttagcttcttcaagtcagtagcaacccgtgtttgtaatgtagcagatgaaagcctagcaatcaaaattacacctagacagataaatcttggggaagtaactaaaattagagtatttaatgattgatgattcatgttctattgactcttttctatcaaatttcggatgatttttagctgttttggtgtgtaatacttccctctgtgatgtaatatactggaggtagctatctagattattttggttcaccagggtttgagctaatagccatcccgattgtattccattcctctttgtccttatgttttacttgaaaaacattttgtatagcctggttttactttactttgaagtgttgtttcgtgcttggaagagtgccgcaatatagttctcacttctcatatgatcattaaatgcagatatggcctcctatgatggtaaaagatgcaggatctcggcttcatgctctgttaagggaagtaattacgcaggttagtttcatctgttagttcaattgtttgtagattatccaaatttctttttgaagttacaatcttaaaagtattacattttcaattgttacccccaccttagacatctctcagtgagagcatagaaaatttgcagagatttggcagtatccgattgtttgtattgtcacacagcctgaaaggatcactggtttagttggattttaattctctgttctctatatggcagactggtcttgagaagaatttacttgggaaccatccagtttctcgatccaccgaatctcgtagcccaccaccggcatttgcttcggatgcattaattaatatatcatcatcttctcatacacaagaagggaataaccttcctgatggttattcagtagctggaaatggagaatattccaaatctgcggtttcagagatagttgagatagatgttcctgcttctgctgggagttacatgaaaagctcaagccctggagtaagatattctcttaaaaacttggtgttttcacaaaaactacgtacagtttctgttttcctttatgagttgtcacagttttatctatttgttgctgtcgtatatagcttgctgctgctgctgcacggaaaggagtacccgctgtagacaggcagaactccgagactctatattatgcagacgatgaagacggcaatcgtaaaaagtactcaagaagaggtgggagaaaaaccttatcgttcttacctctcttgtctgttttttgctttactacaagacttacgctagagttgtgcttctcctttcctcttattgtttttgttttctgagatgcatgtgtctgccttccattagacaaactccacttttgtatgaatctatagcattgtcgcgatgactttgactgattctcattttttttttcatgtaaggtcctcttcgtcacaagtttctacgagctttactacctttctggtctagtgcattaccaactctacccgtgacagcaccacctcgtaaggatgcagcaaaggcagatgatggttctgaaggtcgtgtaaggcatcaacgatcatcaaaaatggatataaggaagatactaattttcatagctctcatgtaagaccttgtttacagtgtaactctttcttctgctgctcgttatatgtcaaatgtttggtgcagaatcaatcagtattatccatggcctaaatctatgtgaccaatgtgcagagcgtgtatggcaacaatggggattttatactacagactcgcactacaggcaattggtcaagaactacccgatgaggagcagcgatgaggtaatatcgtatcagacaggggaataaagctgccacaacatatatcatacattcctgctttatccaaatcaatttgccctggtggatacccttttggacgactagaaaatgttatttacgagctgattttgagaattgtgggctgcggttgatttgttagagcgttacacatcggttctttgtgtcggtttccttgttttgtgactggtctaaagttctttgtctctctgcttctggttcagtcgacatgttttagttgtagctattgtttttggtagacgaaaacgcattttatggatgctttgatgttcaatgttttgtgggctgttgagtagtgtctctcttaatttgaagtcaaaccagaattagaatctgcgtctctgcaaccttatttttatatactaaactcccattttcctctggaaatcgactaccggtagcgtcggaaagtccttgtaaagaaacagagttttttgttattttagatacacacgtgacggtcttaatgatgcaaggattaagatttgcgtcaaagaaatcgaaggcgatacacacgtgacggtctcatttacccagaatgcagcaaagatccgtgcttgcatcatctacttaacatttttgaagtacattttaaggaatccaatcgggtcgggtttttttaaaagtttttgacccggaaattagtccttcggattctaataatttgatactttccaaaacaaatctctttgataaatcgcaaatcttgagttcaaactttctttaattttcgtcaatcgttattaatatatcttttggcaagatttccctacaaaaaaggaaccacattaacaattgcgtattgattttgtttaaatttgtaaactaacaacatgcatatattctcaagatattttgttcagataccaaaatatcttgaacattctaacgtaaatgtgttaacaaaaatacttttatggttatataatg

SEQ ID NO: 29961 - DNA, 3000 bp, Unknown; identical to SEQ ID NO: 12237
  misc_feature (1)..( 3000): 2750-1469P.txt file - cDNA_ID_3024323; gDNA_ID_2214538; Annot_ID_185160

SEQ ID NO: 29962 - DNA, 3003 bp, Unknown; identical to SEQ ID NO: 26234
  misc_feature (1)..( 3003): 2750-1469P.txt file - cDNA_ID_3024331; gDNA_ID_2214538; Annot_ID_185157

SEQ ID NO: 29963 - DNA, 3003 bp, Unknown; identical to SEQ ID NO: 25840
  misc_feature (1)..( 3003): 2750-1469P.txt file - cDNA_ID_3024339; gDNA_ID_2214538; Annot_ID_185153

SEQ ID NO: 29964 - DNA, 3000 bp, Unknown; identical to SEQ ID NO: 12234
  misc_feature (1)..( 3000): 2750-1469P.txt file - cDNA_ID_3024343; gDNA_ID_2214538; Annot_ID_185151

SEQ ID NO: 29965 - DNA, 2046 bp, Unknown; identical to SEQ ID NO: 12244
  misc_feature (1)..( 2046): 2750-1469P.txt file - cDNA_ID_3024350; gDNA_ID_2214539; Annot_ID_185177

SEQ ID NO: 29966 - DNA, 3000 bp, Unknown; identical to SEQ ID NO: 12267
  misc_feature (1)..( 3000): 2750-1469P.txt file - cDNA_ID_3024365; gDNA_ID_2214539; Annot_ID_134451

SEQ ID NO: 29967 - DNA, 2571 bp, Unknown; identical to SEQ ID NO: 12259
  misc_feature (1)..( 2571): 2750-1469P.txt file - cDNA_ID_3024365; gDNA_ID_2214539; Annot_ID_185198

SEQ ID NO: 29968 - DNA, 3000 bp, Unknown; identical to SEQ ID NO: 12250
  misc_feature (1)..( 3000): 2750-1469P.txt file - cDNA_ID_3024373; gDNA_ID_2214539; Annot_ID_185194

SEQ ID NO: 29969 - DNA, 3000 bp, Unknown; identical to SEQ ID NO: 12251
  misc_feature (1)..( 3000): 2750-1469P.txt file - cDNA_ID_3024376; gDNA_ID_2214539; Annot_ID_185193

SEQ ID NO: 29970 - DNA, 3003 bp, Unknown
  misc_feature (1)..( 3003): 2750-1469P.txt file - cDNA_ID_3024380; gDNA_ID_2214539; Annot_ID_185191
tctctcaagctaaattatttcaacattaaccaaaaaacaacattcatcaagaaattatgcaataaacaaattcataagaaaaccaaatagaaaatagttggatacttggatgattagaaaatcaaaattgaactatacgtatcaaaacgtttgtttatttgtcaatcctcttattaatgagcttagactcaaattccagaccaacgacgagtacataaagtaagtaattgatggcaaagatttctgaacaggcctactctctatacgataaacatgacggcccaatcatcgccaaggcctaaacctctcaaaccttagaatgaacgaaaataaatcaaattttttatttaatatatgagaacaaaagggtattcaacaaaattgcaagaatttgggtccgttacaaaactatattggttcatgtaactgtagtactgtattggtcacccgttaacaatattatcccccaaatttcaacagatcagtgagatatcaatatgagaaatcagaagaagaaaaaaaaacacacaaccataattaagattaacgaaatggagaaatatatataccttggctgaagacgtttagaggaaaatgaaaacgatggagtttggtatcaaacagtgaagattgaaattttgattctgaatgcacgtttatgtgatttctatggctttttataagctactactcttagaatatgtctaatctcatttgaccaaaatatccctctcttttgtattcaacgtttttcacttttcttagtaaagaaaacatcattgtctttcttaaaaaaattagatcattttccttagtgctgcaagtcaaatttaacaaggaaatataattcaataacattcaaaaagtaaggaaatcacaattttcttgtgacttaactttttaaagtttaaagtaaaaaatctaataataatatttatcaagaataaaaaatctaaaaataataagaaaacatttaacataaactagacatatactttagatctaaagaaaatatacaaatatcacttttgattacatttacatgtattaaggaaatagaaccattaattttgctcttaactattatttttaaatattcacatatagattttgtttttccttaattcagataatacagcgcggacaacagtcaaaagtattagtaaataacttactaatgacacataacttttgtttaacttaaatttttaaaatatgatgatatcactagtcaaaattgagataatttactactaaatacgcaaaagaaattacttaatttatagggatttagtacctagtaagtcattactagtcaaaataaagataataaattactgaaaatctttgttctaaaacatggccatggagaccgaggtctctagacgtcggaaagcatgagatggtttgaagccgccgcgatgtaacataacttattattttttgtttgttacatgttagaaactcacttttctatatggatcaacaatatttgagtgcaaaaaatcaaagaatatgaaaataaatattacaaaaaattcgtagcgaccataaattaggtttggaggattagtattcataagaagaagatggatactaaatgaccaatataccattcttcgaagataaattgaaaaaatttcaaactgttgattgttgaatttgagattcgaacctgtcacctctgacatgatatattaaacaaaccactacagcaaacaaaagtatcttgaatctacagtaaaacctctataaattaatacacgataaattaataacctctacaaattaataaattcttccggtcccgagttgggatcagtgtaaaaattgatacaaatcgataaattaataagataatattttttttgaaaatcctatgtaaatatatggtcccatcaatattataaattaataattgtataaattatgaatatatatatatatatatatatttatatttatgaatatatcatgtaaaacttagtaaaatatgactttagtattgtttttctttaatttatattaattctttgtaaaatttaattctaataattttactacgtataaaaaagttttttttcttaaatctaataatggttttctacttgtaattgatttttagaaaaattattgattgtatagagaaactaccttttagatcaaatttttgtaaaaaattacaaaatttgtaaaatatctccataaattaataattattaatttatcgataaattaatattttctctaaattaataaattttcttggtctcgacattattaatttatagaggttttactgtatatattattatatttctaacctaatcccagattgatgtttagcggtatttaaaatcaggctaaaaacacatattttttactagaatataaaatagataatattgtgctgatgctaatcaaaattaaaaggtaacaaattattaaagacatatatttaacttaatttaaatgtacatctgcggtgctagcactagtttatataataagaacaaaaaacctaatgatttaatttgaaaaataaatttaagaatatgaccttcgagttctaagaaaattagcttgttaatattttttttattagaaatgaaaatttatcttagaataaaaatctcctcaatatctattttcaacctctttcaaagatttgaaaatattttttttttaatattagtaaataaaactaattaaataaaattagaaatcaaattgattttacttaaaaacactttaaagtttaaacctctaatctagcttttatttttgtaccgccattaaaaaataacgaacccaaaccgaactcaaacccagacccaaacccatgcccatacacaaatcacgaatgcctaggcttacttgtgaccgaaaccgaattgaatcatatatagtttcaggtcacctgttgcacaatctctgctcagccctaaaagcttactcctttcaactttctggaggccttctcgtagcctagcgtcatagatg

SEQ ID NO: 29971 - DNA, 3000 bp, Unknown; identical to SEQ ID NO: 12253
  misc_feature (1)..( 3000): 2750-1469P.txt file - cDNA_ID_3024388; gDNA_ID_2214539; Annot_ID_185188

SEQ ID NO: 29972 - DNA, 3000 bp, Unknown; identical to SEQ ID NO: 12246
  misc_feature (1)..( 3000): 2750-1469P.txt file - cDNA_ID_3024398; gDNA_ID_2214539; Annot_ID_185180

SEQ ID NO: 29973 - DNA, 3003 bp, Unknown
  misc_feature (1)..( 3003): 2750-1469P.txt file - cDNA_ID_3024414; gDNA_ID_2214540; Annot_ID_185221
tcttggctcatatcgattcctgaagaacatttgttggaggattcttcgtttttcacggtgagatttggggagattgaagagaaggagaagaaagaccagacgaggattagtgacatgaaagctccgccaaggaagagaacgacgtcggagatacatacaaccggtctggttcttgttccggcgtattttgccattggagatgattggtaatgtgatgatgatgtctcaggcgagaccattaacagaatcttagagatgattacaaaaaattcaaaattttgggaactttgttgtataaaggcaataacttatttttttgtttttctatatgtaacattaatgtcccattaatcactcgctcgatatattactttatttgtatcagatttttatttgacgtaattgtgtttgtgaaaagtaaatgttgtcaaaaaattgaaattgaagtgtactcacattaatagttttcgtgtttcgattggtaggtttataactgctagagataaggtttttatatgtcagaattgtcatgtgatagtgcttttgttctggtagagaaacttgaacaacgtgagtgtgacgaaccggaccggtttgtttcaccgacactgattgtaaaataagattggtgttggtttctacgtgtcggtaagccggtgttccggttaagcaagggcacgtgagtttgctgcgataattttagggtgcagaagattactatctcacccgcaatttcagcttttaatgttgaaaattgcactgctttaagtttattttattttattttatttgagttgggtgttttataattgaaaataactactatattggaccgatatactaaagaaaaactctaaaagctagcttaagaaattttatattgatgacagtcacgaagagcgcatctttatgcccatcacaattaatgaggaggcacaatatacgaagccattatacaaaaatatttaatattcaatttcggtaaagattaaaacttagtatatgattaaagctactcaaaccgacaaacatttacatagtccaagcctttaacgtggatcaggattagatcttaagaagagtcagattgaatctatgtcatgaatatgtatatagtacgtagttatatccctaatgcatagtcataggcatttgatatcataaaagtataacacagatcgtatagaattataaacactaactaataactttaacgtcacgatcctactttttttatatttcctagaaaaggatgataattagccatgttcatcaacgctagtaaataccgacaatagataggttgacaaaatcgtgaagaatatgacgcaagtatagttttcggaaacactaacataaaaaaactgtcgcccaaaagtaccagtaatagtaccaattcacttgccttagttaccattatcaaaaaaccgtggtattgtcatctgtgattatgcaattggataatgttgatattctacaagagttagcgagtctagcaagttctcatattggagacgggtttttgtttccgtttgcatgcaacctagatttttttaatagtaaaatgtggtatttatatttatatttaaaaaaatattattttgtctaaagaaaatcaaatatggagctatatatgatatctgattcggaaaacttttttttttttgtatgaaagttacgtttataccgttttcatacagaattttaggaaaaatgatagaagaaaaagactgaaaactataagaaaggaaacaaagcaaagaaaaacggaaaatgctttaccaaaacatgtcattattgtttctaagagagagaatcttttaaaagaaacgactataaagagattccattacgcacacctgacaccaccaactccaaggcaggcaccaaccattgagaaaataacaaattgtaacttttgcctttcttaactcatttggtttagcatttggaaggaagtgataatcgcgaggtttgagatatttatatccaaaagacgcgatatagtctcttcttgggttttgtatttgttccttagttctttgcttcgacatccgatattcatatagcacaatcaaatcaaacaggcttagattttctagcaaaagtaacgttaacctttggttaaaggttgtcttcggttattgaataaaccaactgagatctcggttaacttgaactgaactgggattggtggcattagagtttttagatggattttggatagtatatgggctcgactctagaagctgggccaagttggttataacttgcaacataattgggaagaatatcagttggactacacttcactattagtgatgagtagaaaaatattggtttagtacagtttttacgttggttagatcaagagttaattgttggtgtagattagagatcaaggtcattagaaattgaacatggatccctaatctttataacaaaatataattaagagatcaattttcaagctctagttacttttttctatttttcttatctttatcaaatgaaaccatatagtagattgtttttgtttggaatgcgttttcaatattagtccaattatattttttagtccaattaaccaacaaaatgtctgtaatattagaccccaaaaaaaggggaaatacatttttattaaatacaaaagttttttaaattattaaactacatgaatttagatatttgtaacttataagtattccataattatccgatggtagaaaaatcatatgagattctattttcatctaatcatctggctttcaaatagacacccattatcacaataaccatccaaattgaatctcttatcgctctattatctcattacacattttcttataattttctcatattctctttttttgtctaattataattatttgtttcattgatttatcacaagagtcttcgaacaagagaaagaaaaagaatcccattttttaatactaaagtcaatcacctatcatttgattttgatcttgtacaaaataaatg

SEQ ID NO: 29974 - DNA, 3000 bp, Unknown; identical to SEQ ID NO: 12273
  misc_feature (1)..( 3000): 2750-1469P.txt file - cDNA_ID_3024418; gDNA_ID_2214540; Annot_ID_185219

SEQ ID NO: 29975 - DNA, 3003 bp, Unknown
  misc_feature (1)..( 3003): 2750-1469P.txt file - cDNA_ID_3024425; gDNA_ID_2214540; Annot_ID_185217
taataaaataagtagaataaaatgaaagtagtgcttggtacattattatgatttttatttattgaatgtttttgagaaaattcatttaagagtgagattaatggagaatttaacacaacaaaagacttttgattttttctcaattagttttgctagttgaaccaatccaacaagttaactcacaaaccaatcaataatttcttattttattttatttttatgaagtttggtgcattaatttatagaagcaacgagacatgcatggctatgtcctagcgaacatagagtagtagtttatacaagtataccaaagctaaaccagtctcgtgaactatatatatacgtcaacaccgaaactttggaaatgtataatacttgtatagttagtctctgtgtctgatattaaattgtacataaatttctttatgattacagtttttttttcccccgatttatttgacacggtttgggttatatatatgattagtcacacaccgacttgtaatatactctccaatacacgcttttaaatttggtgcgttccaaacggatgataagaacaccatgtcacactaatcgggtagggacgtccactaaccatattgacagttgtatcaactacaactacaccatatataacggtagatccattgcattcgtgtggaatctatagtgtttatatttgcatatatcatgtcaaatgatattttgctaatgtaggtaggtgacgccatagaacttttgaatatattaatatggaatcaatgcttttaagaagtggatggtgattatcatttatcactctatcatcccacgtttcatacacgctgcgacttatattttgatttacttttcttatgggtttggtccaattccaccgctaaacactatgcacaagtgcaaacaaatatttaattaaattcaacttccgatttaatcggtcattcaaatgagactaatgagtccaccaaactccacaattagatacccataaataaaatagaaaattcgaggttatcaacgtgcgataagatccactttttgggttatataataactaaataaatgaacaaaacaaaaatagatttgactaaaatttggctataaataaatttgagtttcaaagaagccaaacccgtcaacacatcttctttaagcatctctctcccttcaaagaaaatatcacaaaaatggcaaacgtctccgctttgctcaccatagctcttctcctttgctccacgctaatgtgcactgcccgccccgaaccggccatctccatctctatcacgactgctgccgatccatgtaacatggttagtctgattcacatgccatgcatgaatcaatttccatatataaacacaaaataaccaatatcagagcttctaaatttttaaaaatatttaacacatcgaataggtttaataaattttttgtaatgtatgatgattactttggcaggagaagaagatagaaggaaaattagatgacatgcatatggtagacgaaaactgtggtgcagacgacgaagattgcttaatgaggaggactttggtcgctcatactgattacatctatacccagaagaagaagcatccttgattttcacttactcatttctaacaaacttttgctcaagattatgtaatttatgtcatccttaattagtatttgtcacatacaagatcaagatagttatgattgtgattatttatatgtattttggatgatatattgtagaactagaagtttgacaataaaaagtttatagtgtcgttgtatgtttaagaagtttgacaataaaaactttatagtgttgttgcatatatgtgttgaaaactcattaaaaacacacacacacatgaagtacgcgtatatttataaataaactataaaattgagagtggattcatggaatcttttttattgaaaatacatgttggcttgtttgattagttgagagactgctaaacatttatttcatataactagcaaagatcgatatatcgtcgtgtacacaaaagtactactgtatatgtttgatcgaatctgaagaaccaaatttatattttcagactgattgtgtatatggtctcgtaatatacaatcatatgataattagccatcactaatgtagtcatgtctttatgctgaaagagtgtagagactctgccgtcataatgcagctgttaactacgagagcgaagctaaatatttttgaaaagctcccacttcaatcgaacggagggaaaaacctcttgcgcatggaatagagtagtcaacaatcatttgtaattgtaatagaaaaaactagtttaattagaaattgagcatcaaatttaaacagctctgtaaaattttctaattgtaataagaaatttttgttatatctgtcttaaaatatacaccaaaggtagacacaatatctcctacaagtgcacattcaacttctagatatagacaaagttccaaacttataataagtttttttgcaaagttattggttataattaagtttaattggtttatcaatgggtaaagtatacagtaaactgattaaacctagctatgtgggttatagatctcgaactatttactcgaagtacattaagttatagaactttcatttcggagaaaataaggataaaacttttattttatagacatatgaactagagttaaaatatatgagctctatctactgatactttttatgagaaaatagaccttttttctaaaattatctttgatgaaaattttgtttggtactccaacatgtgtacaaaagttgcgctagatcaaaacatatgtaagtaacacaacttatgacattcttgattgcaaaattagttaaaatctagttgtttttatattattgttgacacaaaaaaaaatgtcagcatatgaaagcctccgtctgaagcagaaggaacgactctggtctaaaactctaaaaaccctatcttcttcgttctaaacccaaaacacacacaaaacaaaatg

SEQ ID NO: 29976 - DNA, 3003 bp, Unknown; identical to SEQ ID NO: 26245
  misc_feature (1)..( 3003): 2750-1469P.txt file - cDNA_ID_3024468; gDNA_ID_2214541; Annot_ID_185248

SEQ ID NO: 29977 - DNA, 3000 bp, Unknown; identical to SEQ ID NO: 12283
  misc_feature (1)..( 3000): 2750-1469P.txt file - cDNA_ID_3024477; gDNA_ID_2214541; Annot_ID_185245

SEQ ID NO: 29978 - DNA, 3003 bp, Unknown
  misc_feature (1)..( 3003): 2750-1469P.txt file - cDNA_ID_3024481; gDNA_ID_2214541; Annot_ID_185244
tttataattcccatcagcttttttctcgccatctccattaacaacattttcttcactagcctttttcccttcctctacatcctcatcatcatcatcattatcttcgtcatcatcatcatcttcttcctcatcactaatatcactatcagagtcagaatcaccagctacttcgctgacaacaccaacactaccggtctttttgtttttgacaatatcttgtcgataaatattaggatgctctgaatcacatatagagagacttgccattgaatcatcaactgacgagtcaacccctacatttgttgatgtaccagggtcatcttgctcatgctccatctagaaaaaaaaatgccaaagcaaaagttttgatgagagagtagtgcaaaaataatgaaaataacctacaagagagtaaggatctaaaactatgatgcaacaacaacaacaacaacatcctccaagctaacacagattaataaagaaacaattctcaaagcgaagacattccatgccaatagaacattacattccgattaattcatcatcgaaggaaaaaactaacaagatcatcaaaaactattacagagattctacgcgaatatataatgacattgagctggcaacgaacagatttgtgagtaccgaattggaaccttggagaagaagtggtgatcggaggaagatttcaatcgattacgttttttgatcgtctatgaattgctttttctttatcagaagaagaagaagaatcgaggagaaagattgaacaaggcaagaggaaggaggaggagctcagcggcgtcaagggtatagtcgtcattattgtctctaattgtttctttttttttatgacatcccaccaggccactcaccgaatctcagccgttggatctgcttaccaagtcgccggattcaggttctttttttttttttgtatctatctgattattataaaaaccaaaattgcataaggtaataagaattatattcgttaaaatattttgtaatcaatttcgaataattgaaaacattgattgatagcactcttctgttcaactacgaatgtgacaaagatagttaactttctcttgatttctaggctaaataattaaaaaatgttactacattcttatgaaatctaacagatattgagtcttatcaatcacgcacaatatcgagaattaaaaatacaagaagctggttaaaagcataaacatataacaattggcatctgcggttgaaaaatgtgggcctgtgttccaaacgtggcccaaaataaaataatcccagcccaaactaatatggacgtggcaatttcgcgtttaattacctgacgctgttagcaattttggggtagtgatttttgtggtaaacatattttattaccaaattaactccaaaatttgattttaaaaataaataaaaaactgtagcctcgttttatttttcttaaagatcaaatccaaatccaaacaagattttcagaaataaaccaacaagaaacactgattcttttaaaaaaaaaaagaatctctatagaggagtattttggagtaatctcatctcataaaaactagtgacttgatcagcaacaggcaacagcccacataatggcttgtcctggtggaatcctcattagcattggaaacaatcctctccataaggccaataatccttcctctgcataaatccttctaatggcatcacccatccctttatatctcaccccactttcacagtctcaggttggtttgagccatcaacctcgttttgaccacatcaaatggttcgagcaaaatgtatggctcaactttgaatttgataatatattaaattaaacaaaaaattcaaatcagaattttaaattgaataatttatatataccataaatctatatatacatttttgcagccattttgtgaaataaatcatgtagttggacttatttacaatggctgccactggattttgatgtttgtttttgataattagaaagaaaatcttcgaattaaatatttgacatttaacaatctttccaaaatctctccacattaactacacgattattttctaaaataaaacttccaacatttaatatcatttaattactacaaaattatcatttttgatattgcttttctccatgactataacaattgagttataataatcaaagcagaaatataatttgatagcatttaattactacaaaattacaaaatatttagacaataattcataaacatatcataaataagatcaacattaataaaataaatggttttgttttacgggacgggttgacggaacgagtttaataggacgttacttaataataattgtaaactataaaataaaaatattttatagttagatacaatttgtaaacttttatatactaacattaaaaaataaattgtttccgcggtataccgcgggttaaaatctagtatatttacattatttacaatattattaatataattaattaattaattaattaaatatattgggttatcgaaaaccgaaccgaacctacctatttgggttgagaaaaaatacaaccgaatggtttggtttggttcggttcggctctcttttctccaaacgctttttctttctctctcacttgaaaaatctcccggagacctctctccttctctcgcagccgacgatcccatccaaaaaccaaaactcgctctccggtgatcgtctttcggtcagattcttataagcgtgcttgattttcaaatcaagtttgtttctttatctccagagtttatcatctcttatgtgactgtgttgtatagcttcttctctataactcctttgtgctccttctctgggaaatttctctatttagagtgctttaggattcgatttcgtgtggatctgctttcaattcgtttattcgttgcgttccactgaattgagtttgtatagagtattaattctacttgaatgcttaatgtttgaattgatctctgttgcttgcagaaaatg

SEQ ID NO: 29979 - DNA, 3000 bp, Unknown; identical to SEQ ID NO: 12288
  misc_feature (1)..( 3000): 2750-1469P.txt file - cDNA_ID_3024485; gDNA_ID_2214541; Annot_ID_134476

SEQ ID NO: 29980 - DNA, 3000 bp, Unknown; identical to SEQ ID NO: 12284
  misc_feature (1)..( 3000): 2750-1469P.txt file - cDNA_ID_3024485; gDNA_ID_2214541; Annot_ID_185242

SEQ ID NO: 29981 - DNA, 3000 bp, Unknown; identical to SEQ ID NO: 12287
  misc_feature (1)..( 3000): 2750-1469P.txt file - cDNA_ID_3024497; gDNA_ID_2214541; Annot_ID_185239

SEQ ID NO: 29982 - DNA, 3000 bp, Unknown; identical to SEQ ID NO: 21341
  misc_feature (1)..( 3000): 2750-1469P.txt file - cDNA_ID_3024505; gDNA_ID_2214541; Annot_ID_185235

SEQ ID NO: 29983 - DNA, 3003 bp, Unknown
  misc_feature (1)..( 3003): 2750-1469P.txt file - cDNA_ID_3024521; gDNA_ID_2214542; Annot_ID_185276
atgcatgttagctttccataagttcggtttaccttagtttatgtctccgttctactgcagacgcaacaaggagctgatcgaagtactcagcaagccaagtaacattgcaaaagaaatcgagtttccaaccagatactctcagtcactgtatagtcagtttgttgcttgcctgtggaaacaaaacctatcatattggcgaaacccacaatacactgcagttcgattcttctacaccgtggttatctcgctgatgcttggaacaatatgttggaaatttggctccaaaaggtatgagtaaagtggcacattgctatcaccaaagagtgatgattcctttaaccaatgatacatttcttcatatatagggacactcaacaacagttatttaatgcaatgggatcgatgtacgctgcggttctcttcattggaatcaccaatgcaaccgctgcacagcccgttgtttccatagaaagatttgtttcataccgcgagagagcagcgggaatgtactcggcacttccctttgcatttgcacaggtcacagatatgtttattatctttctatctttctcatccccgcttttgagtttaaaaacctaaaaattgtatgagtttgcaggtgtttatagaatttccatacgtgttagcacaatccacaatatacagcaccatattctatgcaatggccgcgttcgaatggtccgcggtgaagttcttgtggtacttattcttcatgtacttttcgataatgtacttcaccttctacgggatgatgacgacagcaatcaccccaaaccacaatgtcgcctcgattatagcagcacctttctacatgctctggaatcttttcagtggcttcatgatcccatacaaggtacattactaagcttatcttttatttctttagaaatactaatgttttgaatgatttgactacagaggattcctctgtggtggagatggtactactgggcaaacccggtggcttggacactgtacggtctattggtgtctcagtacggtgatgatgaaagatcggtgaagctatcggacggtatccatcaggtgatggtgaaacaactgcttgaggatgtgatgggatataaacatgacttcttaggtgtctcagctattatggttgtcgccttttgcgtcttcttctcccttgtgtttgcattcgccattaaagctttcaatttccagagaagatgatggattgattaccacttaccaactctcatattcatatatacacgtatacaacaatcatctattgtttatttgtatattggggcttttatacccaagaaggcaggggactgcctattcttcctctgtcattacatgtatgggatcaataaaagcttgtgttgtgttttatgttccttgtcattttttctgagaaatgtgtattggtcatctataacaatcactgatcatgaaccagtactgtaatagagatatatctctagtttactggttgtacacatctttgctagtatatatttggccaagtgcatatacgcttattcactcactagaaagatttccccatgtgtaacttatggtaatttttcatgtaaatagagtttcaagagctatatgtcgtctccttccaatcactaaagttagtgacaaacttagtaagtaggtttagtttcttatgaagtcaatttgtccaagcttgaatattagatctttgcgcattccgattaaccttcattttttatgtttttcgggtcgagataggcgtaaccatcaaaggttcattctggtttgaggtactcccataaacatttcgatgaaactccaatcctgcctccggttggagtctagtccacttgaccaccttcgcttcctagagatctccaaccctctatagaaggattacttacgcttcttgaaccaccattccaagcaacaacaaaccaatggaagcaacgacgcaactcactctaccaagatcatttccaacatcggcttgtacatagtatagcaccaaaacaaacacattagtcttactacttccaccaaaagtagagagaaatagagccacaaaaaaagagttaatctagtaaaatacaacagaaaatctagtaaatacgacataatctagtcgatctttcgtaaaatagcatagaaaatcaattaaaatcttataataaatgtgattagtacggacaacttcctaggatagtgatgattattctgtactaatacaaatttcatagttattaataaaagaagagttgaaaaaaaaaaaaaaaaacgaaagaagtcagtgacattcgttacatctccattggcttacatattcacacagacaaaaaaaaaaaaactccttccattttacctttttcctctcccaacaaaaaccctaaaagatcatctctctctgcagattcagtttctcgccatcgacgacgacgacaacaaaatcacatatcttctctatcgatctccaatcatcatcttcttcctaactacaggtccagcttcttctcttcgatttccctacgctttcgtctctctctcaattcgtgatttgtattcgtttaaatcgtcctcgtgatttcgtgaaatttcgccgaattctggaatcttctccgatatttcttcaatttgcttccatctgtagaagaatcagaagctttggtctatgtcggtcaatttaagaatctgttcccaatttttcttcataattcactttcatcgttttacgaattggaacctttcgaatgtttcatcgttttgttagtcactggaattggcttagcaaaaaagctgagtctctatagaagactgaatttgcttatttttctggaaaaaagtatcaattcaccattttatttacctaattcatagttttggtagctaagatatgtgttgtgttgtagttttaaaggttctaaagaagtctcatgttagcttttggagtatcaaattaactatttgctcgtttcttggtattttttaggtgtattgatgttctttgcagagatg

SEQ ID NO: 29984 - DNA, 3000 bp, Unknown; identical to SEQ ID NO: 12294
  misc_feature (1)..( 3000): 2750-1469P.txt file - cDNA_ID_3024525; gDNA_ID_2214542; Annot_ID_185274

SEQ ID NO: 29985 - DNA, 3000 bp, Unknown; identical to SEQ ID NO: 12309
  misc_feature (1)..( 3000): 2750-1469P.txt file - cDNA_ID_3024529; gDNA_ID_2214542; Annot_ID_185273

SEQ ID NO: 29986 - DNA, 3000 bp, Unknown; identical to SEQ ID NO: 12297
  misc_feature (1)..( 3000): 2750-1469P.txt file - cDNA_ID_3024541; gDNA_ID_2214542; Annot_ID_185268

SEQ ID NO: 29987 - DNA, 3000 bp, Unknown; identical to SEQ ID NO: 12298
  misc_feature (1)..( 3000): 2750-1469P.txt file - cDNA_ID_3024545; gDNA_ID_2214542; Annot_ID_185267

SEQ ID NO: 29988 - DNA, 3000 bp, Unknown; identical to SEQ ID NO: 12299
  misc_feature (1)..( 3000): 2750-1469P.txt file - cDNA_ID_3024551; gDNA_ID_2214542; Annot_ID_185263

SEQ ID NO: 29989 - DNA, 3003 bp, Unknown; identical to SEQ ID NO: 17203
  misc_feature (1)..( 3003): 2750-1469P.txt file - cDNA_ID_3024608; gDNA_ID_2214543; Annot_ID_185308

SEQ ID NO: 29990 - DNA, 3003 bp, Unknown
  misc_feature (1)..( 3003): 2750-1469P.txt file - cDNA_ID_3024612; gDNA_ID_2214543; Annot_ID_185307
gagaaatcttgcgtagagttcttctgaagatggctgaagaagctgccttctttggcgatatcgtcccacctaagctgaaaataccattcatcataaggttgattagttgctccgtcgttatgactacttgccatcgattcagaagtctaataattatgtttgcggtatgcaggaccccgaacatgtctgctatgcacagtgatacttccccggatttgaaggttgtaggaagcaagttaaaagacatattggaggttagactctctcctatacacaatgatttcacactttaatctataaatctcaaaagagtttctttggtggaactctcaggtccagactagttctctgaagatgaggaaagttgtgatcagcctatgtaacatcattgcaagccgaggagctcgtttatctgctgcggggatctatggaatcctcaagaaaataggaagagacgcaacaaaagatggagaagctcagaaatctgtgatagcgatggacggtgggctattcgagcattacactcagttcagtgagtcgatgaagagttcattgaaagagttgcttggagatgaagtttcagagagtgttgaagtgatactgtcgaatgatggttcaggtgttggagctgcattacttgctgcttctcactctcagtatctcgaacttgaagatgactctgaaacaagttaattttaaaagccttttttttgtgtttaaccttcttctttgttttgccgttagggtttaaacaaataaaaaaaagtaagaaggtaaaaatgcccttttgggaaattttatttttgacaattttcaggaacaataaaacctggattcttcatcaaagctctgggaaattcaaacgaccagccaatgttgtagaactatacatatatattcgagttctttctatgaacgttcattttttcccaaaactagtaatcagaaattctatcaagtcttttctttcgtattcttaacttgaaacacaaatcaagcatttgaaacaatgtcttctctatatttccgagcaaaagaaatacttggtataaaaacgatattttttttctcgaatttaatttaatattatatttttaaaatattaattaaaaccatttagactaaaaataatgaattaatataatacatttgttttaagattttcgaatttactagcaaagaaactccgaaatttaggatttgaatagatgtaacatatggtacgaacaactagaacattttatttttgaacagacaacaatcaatttactgcatatcaaatttatttttatgtaaatctgatatgtaattagtctgctaccaattttgttttttcccatggttatcattacaaattacaatttataaacagtaaacaaaagggtctattcagtaaaacggttttgtccacctcatccattaacacttctttcttatcttctccacttctctcctttagaatttactcgaaaggttggaccaagaacaaaaacaagactaatttcaagtgtttatttctttggtttcaattttaatgtaatggtttaattttggttctttcctcttttaacagttttgaatatattaagttgtagttcaacgaaaagatcaaatacaaaatctcagatctctcattaaagatttaattttgtacataatcttcttttttttttttttctaaaatttttgtacataatcattccaacatttttgttcttcttaaaagaaacaaaatcgaaatgcttcaatattacacaaacaaaaatgttgggatgattacagactacggaccataatttcttgtttttgctcttggtccaagaggctagctcaagccttgaagaggtaacttgtattttccttgtgttagttccaagatcatgaatatctcattcccatcttagctataaattactaaaaatttttttccgtcaactatataaactactaattacaatttttaaatctggtatgtaatttgtccgcgacaaaattttgtttttcacatgtgcatatcggcctaatgttttcacgttcgacccgaattgcccggttcaactgattaacctgtgattcgaatacttttctagtttgggtttaatgttaaaatctgacaagttcaaaatttaaaaaacccacaaaaagtcaccattaacccgtgaccggtgaaccaattgaaccggccagatgtgggttttaaaaagcttccttgactttagaataaaatataagatttaaacatttattcaatcattgaaaaagttttttcacttcttaaactcatttgatgttgtagattttggtgaagacttcacaatgccgctttaaacaatgaatcgaatggtgagagagacaaccaagattagttgtttaaattcacgatcttttcttagtttatttccgtgattggtgatctcttactatatttgttatcgtgttagatatttagttgaatataaaaaaatgtaatcattttattataattatttgattttatatatttatatatttttagtgtaaatgattttatattttattaaatgtgatgtaattaatttgttattatatttataatttttttaaaatttttattaatattaattaattgatccgtggtccaatccggatgactgggtgacccaaagatagtccggtcactatctgggtcaggtttaaaaacatcggtggtagcattggtaattcaagtctatttgaggtgatttcgtgaaagagattatttttctcgcaacgacaccgttttctagtcatttctgttgtacttctattctttcttatcttctccttcctctggtctttcccttaaaccctagaaatctctggtagtcaattggtctatgaatgggagaatcttcaaccaccgttatccaattgcgcttcgtttgaaaaattcacctatccccaccggatttttttttattttttctcttctgtttactccgaatcatgtactgtaacttaacaagaagccaaggctttccaatg

SEQ ID NO: 29991 - DNA, 3000 bp, Unknown
  misc_feature (1)..( 3000): 2750-1469P.txt file - cDNA_ID_3024633; gDNA_ID_2214543; Annot_ID_185298
gattgcacttttagagttgattcaaatcacttgaaaacgaaagaagatcctcatctatcttgtgtcaaaatatgaggatgattgtacagtaggaagtctttcatctaaaaccaaacttttgacgcttttatgtaatcttacatctccaaatacatgtttgcattctaaaacggtttgttttcctcaaaccaacctaaaacctgtagagactcgaaatagacttgaaagctttaaaactacactttgacaaataaaagactccaaaacaaaacaaaaaatagttataaaccaataaaaattatgatcaattctcccgaacttgaatttttgcttgtcttcaagcaagaacgaacaaaattcagagatcaaaagaaaaggtttgaaggtggaaacttacatattcttggaaacttctactttgtactcttcatcaactcgattccataacctactttatgtacttgaccatgagtttaatcaacatcccttactctgtataatatcccaagatccaaaggaattttcaatattccatagttgtcttcctatatagatttagtgaaaagtgtgtgctctcggcgaaggaatatcgatcacgaaccaaacaatacacgcatttatctaggctttttaacaacgaacgtgattttaccgtaataaatcctaagagaagaaaaccaaaattcagaaaaggaaagaaaaataaaaatagaaaattatgtgggttgcctaccatgagcgtttgtttaaggtctgtattttgaccatttaacacaaaatattaagtaaaatcaacttcatccccattaatctcataaaacacaatatctttattgatataatgaaacttaggatttttaatctcatgaacaatcttgttattatgaaatacaacctctagataagattctttcaagagatctagatatataattgagtccctatataatttaaatatttaaggtcgagattataaacatttaaatataataatatttaatatcaaaacatatttttaataatgtttaataattttttgtgttcttaaattatctagatattgaaatttaggctgtgaatggtgaccaaaaccgtatcgcaacagtgttgtaacagtatcaaaatctctacatatacatatatatttatgtatttttgttattatttgaaccgcatcgcacttctcccgcaccgcaaaacgcagtcaccatttaaagccttatatactataactgaatcatacattttaaggcttgagatgcatgtacttttgattggcttggtggaacgtggttggccgaagtcgtaactcgtaagcactaagcagtgcggtgtttgtcttcaatatatgtaggataagaggtcacgagctcgttgaattttaaaaggtcaagagctactattaatatctttattgacgtcagccagacaaagtcacaatgttttatgattttttgtttctattttggtacaaactattcatgtttttgttttggtccaataattatttttgatatcaaaatatcagaaaaagattaaatcaaacgactactctatgatctatatcaaagggctaaaaagatcacgcgttgcagatgaagacaaagtgctattgacggtggagtatacccgccgcaatttcttatgtattttttttatttttttgtcgtttccttaagtatgtaacacttcaccaaatctattaatttggaatataatatttacaaaaattgttagttcatgatatattctttttttctgactaaatattttaagtataacgtagtaaaatgttaagagtcaacatatcttttgaaaatctatatatatggattaggataatttttctcactaaaatcacataaacgttataaaaacgacaattaatccaaaggaaaattaatactaacattgtagaaagccacaaaaaagaaattgaaatgtgagtagatgctgagtcagaggtttggtcaatacacaacagctaattgagataatattatacacgtcacgatgacttgttttttctcctcccaacttgttaatttctttattcttaaaattaaaccatcgcaaaaacagaagaacacagctgtttttctcgactcccaatttctattttgctgctaaggacatttcatttcattatttcccaattcaggactccttagattttcctaaatttgttttcctaacttgctctctctcattctaacattttctcatttttttagattatcttgtactttttagtagattattttatcaggttttacaaacatacattgacattctaaaaagggcttctaaaaattcagtgtggaatgctgatatactaaaaaaaggtcatgcaaaattatctacgatttatctaaaattagataatttgccatatataactattaactaataatcgatcctttgattttttgtttagataaaacgaaacagctatatcttttttttttgttatcggattttaatcgaataaaagctgaaaaataacagttatatcttcttcttttttaactaatgaaacagttatatcttaaacaaacaacagaaacagtaaaatattaatgcaaatccgcgtcaagagataaattttaacaaactaataacaattgagataagattagcgcaaaagaaactctaattttagagcgtgtaaacacaaacacgtcttgaaagtaaacgtgaattacacgcttctaaaacgagcgtgagttttggttataacgaagatacggtgaagtgtgacacctttctacgttaatttcagtttgaggacacaactcaagttatgtttgatatctaaggacttgcactgtctccaaatctgcaggaaggactttttgattggatcaatataaataccatctccattctcgtctccttccaacaacatctttcacacaacaattcacacaatttctcgtttttttttgtttatcatcaaaagttttaatctaaattacgtatcaaattccgagcaagatg

SEQ ID NO: 29992 - DNA, 3003 bp, Unknown; identical to SEQ ID NO: 25863
  misc_feature (1)..( 3003): 2750-1469P.txt file - cDNA_ID_3024644; gDNA_ID_2214543; Annot_ID_185286

SEQ ID NO: 29993 - DNA, 3003 bp, Unknown
  misc_feature (1)..( 3003): 2750-1469P.txt file - cDNA_ID_3024675; gDNA_ID_2214544; Annot_ID_185354
gtcccgtaaaaaaaaaccgcagtacaccgctaatttaaatatataatgaaaataaatgttttacgggcttgcaattgtattttagtttgtcaaacaatattttgttttaaatagttgtcgaaatctagttcaaattttggagaaataagtttagtgaattgataagaaatgtatttaggtgtgttttgcttattttaagggattgcaattgtattttggtctgtcaaatattttttgttttaaatagttaccgaaatctagttcaaattttggagaaatttgcatgatatatgagattgaaatatatttggaatgttttttatttgttaattaatttattgcaaaaaaaaaatcaataattaaaagccaatagcagccattgtaaataagttccaactccaggatttatttcacaaaatggaagcaaaaatgtatatatagattttgaacgggtcagcttcatcgttgctgatttttttatgggccgatcactattttagtggaccgtctttgcattgggctgattatctcttaatgggctgtcttcgtcttgaaacgagtcaaaaggaagggtgttaattccatctccaacatttcattcatctatcttacacacacacaaaaaaaaaactgtgatttgttcaattttttatattttaataggataaagatctatttaggagtttggaggttagttcctattgcatacttcatcttcggtaaaactaaaccgcctagaggtatcgatctctggcttgaagagagagttctcgaggaacattaatagtgtgtagaatggtttatgtaaactgagaatcaattgtgactacccttggttaaaccggaaccttcttctataaaaagaggttttcattgtaacaaacacttaaaagaataacagaataaacacaatcttaaatcatcgtttgtatcataaacgtcattaatctcaactaggtcgtctctataaatttgcatctatctgtcctatcgtatttcatatctcaaattagttttttcttggatttataattattttcaatatttaactataaatctatattattggattattattattattattagattttgtttgttattgttcaagaacatgatgatctgagcacgagtttagatatagaagctcttagaaaaaaataagctgagctgagctaacttatgaaatatccgaactcattatgagctgactaatatattgaagctaactcacagaaaaagctatcaagaaattttaatatgaaaaaactaaaaaaataaatgaaagtaatatttttttctgaacacaaaaatgaaagtatttactatatatatactcttgaccaaaaagagaaatgatatttttactcacgacattacgtcgattagagaaagtgtggcgtaaatcacgtgagatcaaaataggaaactcagcaagaaacctattattcacttatattgatatgacctgcagtgaggttacttatttgatttaaaaaaaaaactgatttatttggtgtgcataatgttttttgttgttcactgcgggccggtcgatgttttttaactaagaaaattaaattttaagttcttgctaaaacaattttgaattttatattttatttattttgttacagtatttaatattatataaatgtattttgagtggtaattttaggattttacatgcgctataccattccaaattaatatcgacccaaacttatctcacagtataaccccattatgtgaaattaaatatcactttattatttttcattccaattatacttttatttaaaacacatattcatgagtcacccatagtatgtttgcttatattgtgaccataatattcctttcgttgtgatccatgttgccaaaacagacatcaattaatgaaattgtgtgtatttcgtccatgtttactcaaaaaaggtcaatatctttaatgtgatcagcaatgtgacttacgaattccccgaattccaccaaaacacctgattgcatcacttttttaatgtttctgaagcttacaaatatcatgggcaaaactccagcaaagccataaatggttggagaagaaaatctagttacatctaagggatggtccgataggtacacaaatgcctctatcatagaacttatttcatctctttcactacttttaaataaacatctaagaacaccttctacgtcgaaaacctacaatgtggcttaaattattgtacgtaggcaatatatcttctgaatttgcattctccgaccaatctatcatctgctggaaatgaataacaagctccactgaaatctcattgaaattagaaaatactctatccactttcatcattgagctgccgcaaccttgactaaaagcaaagaaatcgttttccaaatctcgagcttaccatatattcgatacattcatgagataaagcttcattgaagccaacatccttcaagcctaatcaataaaggccacacaagttgtagttttgtcctccattgataaaacaaattttatgataataggaataaggtacaaaaatatattttttgatgcaatacatgttgccaaaacgtatatcaaccaacgaaatcttatgtactttgtccattaatcagtatgattcacaacttccttaaattccaccaaaatttcggactttggcctattcaaacccattaatgactgtttaaaagctttggcctaaagattaatgttaagatgttgtcatctttggtttccattgatttaatcatttctttctttattatgcacacttggccaagtgttatcattttgagcaaaaccaactataccggttttctcctaaccggaataaaccgaagtaaaccggatatcacatcatccgttcactctctttagctcttaaggcgaaaaaagcttatcttcttcatcatctctttcctcaatcggagtgagcgcaaaaaatcaaaaattcgccgagagcacaaaccctaatggcttctctctcaatg

SEQ ID NO: 29994 - DNA, 3000 bp, Unknown; identical to SEQ ID NO: 12339
  misc_feature (1)..( 3000): 2750-1469P.txt file - cDNA_ID_3024701; gDNA_ID_2214544; Annot_ID_185342

SEQ ID NO: 29995 - DNA, 3003 bp, Unknown; identical to SEQ ID NO: 26256
  misc_feature (1)..( 3003): 2750-1469P.txt file - cDNA_ID_3024705; gDNA_ID_2214544; Annot_ID_185341

SEQ ID NO: 29996 - DNA, 3000 bp, Unknown; identical to SEQ ID NO: 12352
  misc_feature (1)..( 3000): 2750-1469P.txt file - cDNA_ID_3024711; gDNA_ID_2214544; Annot_ID_185339

SEQ ID NO: 29997 - DNA, 3003 bp, Unknown; identical to SEQ ID NO: 25870
  misc_feature (1)..( 3003): 2750-1469P.txt file - cDNA_ID_3024719; gDNA_ID_2214544; Annot_ID_185334

SEQ ID NO: 29998 - DNA, 3003 bp, Unknown; identical to SEQ ID NO: 26258
  misc_feature (1)..( 3003): 2750-1469P.txt file - cDNA_ID_3024722; gDNA_ID_2214544; Annot_ID_185332

SEQ ID NO: 29999 - DNA, 3003 bp, Unknown; identical to SEQ ID NO: 25875
  misc_feature (1)..( 3003): 2750-1469P.txt file - cDNA_ID_3024730; gDNA_ID_2214544; Annot_ID_185330

SEQ ID NO: 30000 - DNA, 3000 bp, Unknown; identical to SEQ ID NO: 12343
  misc_feature (1)..( 3000): 2750-1469P.txt file - cDNA_ID_3024738; gDNA_ID_2214544; Annot_ID_185328

SEQ ID NO: 30001 - DNA, 3003 bp, Unknown; identical to SEQ ID NO: 25877
  misc_feature (1)..( 3003): 2750-1469P.txt file - cDNA_ID_3024743; gDNA_ID_2214544; Annot_ID_185326

SEQ ID NO: 30002 - DNA, 3003 bp, Unknown
  misc_feature (1)..( 3003): 2750-1469P.txt file - cDNA_ID_3024747; gDNA_ID_2214544; Annot_ID_185325
cttgaagacttggttcatttaggagaatgactttttaacttccacgcgcttttacgcgagtggtggatatttttggataatgacttgtacttatttaattatactttttatttagtttttttctcttgtgtatattttcttctatatttgatcttatcttatcatgattattaaataaatattcattatctatagattgaatataacttgcaatgaaataatttcataaaaaaaagtaagactgactaattttctcataatatatagtttatgaccataactggtttttagactaagttaagtaattatgagtttgcagctaattatataaaatttaatttcagtataactaaataattaataagaaaaaaaattatagcaatgtcttaacaaataaaagaagttttgtttaccacatttttattttgaaatttcttaacttttgtaatttttataaatcattaaaaaaacttttattttctttcctcagttgtgaccttctaaaaaattaaagacagattctgtttatggttataaacttacgatatataattttatttgtaaattgtaatacacaacaaacaatcttatttgcaatatgctgaaattatgattatttttttgtatctacagtttttttagttaaacaattgtttgaaaagcataccttagcctaatataaaaccattaaacctttgaaagatcaaatggctttcactttcatatgaatatcttatttctactatgtcaaataattgagtatttctttttccttttgtttttacttgcgtgagcaaaatgtaaaggcttccaaagtccaatttgtttttgtttactcgtaatatttgtcaacgtttctactcgtattttatttaatgaaattcaagtgactaatatatacatatgccactggaaaatttgcaatttgtttttatgcttttggaggctgcgttgatacctaacctacttattatagaaaatagacaatgggaagaatcaaatgacatgatcttttatttaaaaacatatgtagatcgtttgaatcaggctgcatgcattgctacctaagtacctaacctacttgcgttgttattgttgttgtgtacttgtgttgttttttatttttcttgttggattcctttgaagcactattttaaatttgtaatatacattattattggataacgatttttggtatttaaaacaatctatcatagatttaagtgaactagattgttttaaataccaaaaatcgttatccaataataatgcatattaattagattgttttatgataatttctcaaataattttttatattaataagatttgaaattttgacaaaaaaataaatagatttgaataacttgattaaattaaaaatgataaatagaagataatattgtaaatattaacatatgtaaattaggagaatggatttaatacattaagtgttacctaaaaatttaatccattctcctaatttacatatgaaatatttatattcttagcataaaaaaaaagtccgactatatttcaatttagatcattgtttgagaaaaatttcactttttaggtaaatgaccaatcacgttacaacatatcagtatcaaatccacataagacatccatgtgacacattgcatatgcaaagagaaaacgagacaccaaaattttgtacaaacaataatcagtcaatccgaggctactatattaaaaaattcaaaaaaaaaattgtgatttaatgatattttgaaagtttaagttttttcgtcctaaatttgaaaactgacacatttttgatatttttacctttgatacatccgtagaaaaaatatttacctactaaatattttcttatatgtagcttataagtataattatgtgaataacactaactaaaatagatattagtttatttaagtttgaaaaaaatgtgacggttagcttctcatagcttgagttttgtggaaactttactttattatattaaatatcatcatatcacataatatgatagtaacaaactaattagtaatgtaccatcaacttttctagtagtaagtactactttgaggaatcttgcactctgatgatatcaggaatatgatcataaacttcagagcatcaactcctagaagaaaccgagtgaggtggtccaaatcaacaaacctgaacacacaagaaccttgaataagactttccaaataaaagtagaaaaaaaaaacagagaattagaaattcaaaaaccatactcttattttctgggacaagggtttttttatacccgaacaatttacaaagtgtattttcataccaaaacaaatttgaaggatgaattcatacccaaactccaaaaacatttgaattttatagctaaactttacatttagtgcttaattcaaaatcgtaaataacgagtattagtcaactgttacagttgctgagtcaaatgacatgtatttgatgttatacttcaaaacgacatcgtgttaaatgttagaattaaagttatacaaaattttgtaaaaatcagatattgaagccacgacgtttcactcatttaggcagcttattaacatttgatcgacaactatcatgagttcgagacctaatttttttgtacaactctataaaattttaattctaacacttaaaacgatgttgttataaactcttgaccaaacctagatatgaaaatacgtttttcccctgatttgatgttagccccacgaaactcatgacccgaacctagatagtttgcttgtcttcaagcaaacgctgtccagatcaaccaagtgaagggacttattttcttttttccaatgattcggaattcaagacccactacactattgggtcttcatataataaaaggcccaataaaagtctccagaggaaacaaaactaatcgaaacgacgaaacagttaaggtaacaaagtaaacaaacacgattcccaaaacacgaagaaagataaagcaaagaaaaaaaaagaaagatg

SEQ ID NO: 30003 - DNA, 3003 bp, Unknown
  misc_feature (1)..( 3003): 2750-1469P.txt file - cDNA_ID_3024762; gDNA_ID_2214545; Annot_ID_185395
agaataccatgaatagacaaaggagaaagcttccaattcgaagagatggtgaagcccaaattcaacgtgagggaattgaagccaatcatgttgcacccgaaatagttggaggcgatggagttgcaaagcgtggagttgcagaagatggagatataggtgatggagttgtagaggagatagtaaatgaggagggagaaggatatgatctcatgattctagtgttgatgaagatgattgtccggttattgtcgaagataatagcgggtacagagaggcagaacaatgtttggctgaaaatttagaggaagaagaagatgaatttgttgatgttgaaatctgcaataacttagaagaccattttgggtttgatgcgtgttaagatgatgctgttaataaatctgatgaaagcggagatgatgtttgggacagcgagaagattccagatccattatcagatgatgatgacaaatatgaagctgagaggccattcactcatggagaccattccgatgaaccgctagccttgaataatacaatcaacaatgcagacgaattcaagtatgcactcctcaggtattctctaaagactgaatacgatatcaaaatgtttaagtcatcatcgaataggcttggggcaaagtgtacacaacacatcaaagaaaagtgtccttggatagtgtattgttcttttgagaagaggaaaaacaagcttttgataaggagattctataataagcatatttgtgtaagatccggttaaacaaagtttttgaaaagtggaactattgcacaactttgggaagaaaggcttcgattgaatcctaaaattaaatctcaggagatggtagttgaaattaagagggagtttaatatgattgtgactgtgcatcagtgtaggagagcaaaacaattgctaagaaataaaagaaaggctagtcatgaatcacattttgcttgcaatgattctataggttatatgtttgttttgatgcattgaaaacagcttggaagaagtcttgttggcctattattcgtttagatgatgcatttatgaaatgggatatcaaagggaaaatgttagttgcagttggtaaagatggggataacagaatatttccaattacttgggcagtggtagaggtggaggatattgataattagatgtgttttgtgcaactgttgaaaaaagacttgagtcttggagatggagctgacattacaatgatatttgataaacatcatgtaagatttttggttctcgtaagttaaatgcaagattttatgatttcttgtgttggatattgatattatttacttgtggtgacaagatttattaaatgcagttcgtgatgagcttccccaagctgaacacagaatgtgtgcaagacacattttggaaaattggaagaagacaaacaaggatattgaatttgagcgtctgttttggaaaatagcaaggtgttacacatcacaatcctttgcaatatagataaattttgatgactttaattttgactataaaaataatattataaatgacaaatttaattacaatttattatattcatatttcataaaaaaaattatattatttatttactatcttcaaaaaaataaacatttaagatagtacttatttagttattgaatgtagcagatttatagttggaatatgtaaactgcaatattttacatgcatgccatttcaatatgtgtaaaacattttgacagacgatgcatgacacatatctctctcacaaatttccaaagtccttttaaatttttccacaacttctatttatatatatttgattatttattctgaagaatacttttagaattttatttatcttcatatttatggataattttggtatatttaaaaaatgagaaatgaaaaaatatttaacaatgtggataaagatcttctagaggttctaggtttaacagaaaaaaaaacaaaatcgtggcagttagctcaaattgagttccatgttgataattaaggttttcttaaaccagataaaaaagtttgggttagaaagatctcacataataatatatttatttaggattttggtgctttgtggacggatcacagagagaaaacaataagttttcaggaacagtgtggttctatacatcatcaaatacagagttgccaactatatgacgcgaatctctgtagaagtctatctctactccatacctaagtcgaaggtctactctggacgataaagtgtatgatttgtcccgaaaactaagatttagcctttttacggacagttcaaacctggtgaatatggtgtctttcccaaccgaatggtcggcgtttcaacatatttggaggattttcaaagcgacaaagaagaattcataagcttctttttattattaatctctcacaatgcaaatgtaaaagttgataattcggtatgaaaagttcgaaccgtttcgtatcatttatgtaaacaatattcctcaaaattggatcttttgaactctaaataaaaagataattaaaaaaatgttcatctatgatgagctacatatattatattgtattagcaacaaacctcatgatacgttcaacgtcgaaaatacacattctaagtaatagaaaaataactattaatattcccatccatgttgaagaaaatataagaaaagctaagaaactcaaaaagaagaaataaaaacaccatagaaaccggaagtgtctaaaattccaccacaaatctctaagtgactttctcaaaaataaagacttcgtcaacacaaactttcttttgatagaccacaaaaatttcttatgttgtctattcttggtatgctttgatagagacctctcctcttcaacactcgctctctctctttctttcctttttttcctctatcatttcatccatctcagattatcttcgtttttcttcatctccagagactctccttccatctacccttagagggcgcgcctcccgtgcgccttcttaactggttatg

SEQ ID NO: 30004 - DNA, 3003 bp, Unknown
  misc_feature (1)..( 3003): 2750-1469P.txt file - cDNA_ID_3024770; gDNA_ID_2214545; Annot_ID_185392
aaaaaggtattacatgccaagttcggcctcacggtctaaaagctgtcaagtcatatagttttaaccaaaaaaaaaagagagatgcaacacgaggacttcccgggaggtcagccatcctagtactactctcgcccaaacacgcttaactgcggatatctgacgggatccggtgcattagtacctaaaggtcaatgtagaaaacacatccactataaatatgaaggttcttggtttatagttttctttgttttcatgttcatcgctttaaaccatgttaaaggtaacatattatcttttgattcagattttttatttgcaccaagaaaaaatatctattgattatttatatatgaaaagctggtgttaagtttttaatctcttgttctataaatgtttacataatactttatctacattttaaatctattttttggttaattaaacatcaaaccttttgggcgtaaacaagtctctagcttgatcaagaaacaaaattttcttattctgtttgccagacctaatgtaattcactactctcacacattttcttcaaaagaaatctttctatttctacaagatcatatatatctcatgcaatgcatataatttatatatatatttgaatatctggaagttcaagcccgaaaaccttacatctcctagtggcgggatcatattaaatttatttcctttggagaagagatctctcactcgaatgtcgaaactaggagatttaccactaggtcaaccccacattggtttaatatatatatttttttgtctacatcaatatagtagattaatgtcattttatggttaaatatttctaaaattattcgatcaggatttttgtttatgaatataaagatacaaaccaatgtttattaaatttttaacaatttattgtccagtagattttaataaacttggaggaagaggataaagaagactcacttcattaccacatgaagatgatcgggctacatcgtcgggttgataagcatgagtcgtggcaaagcaatacacattcttaagaacctacacatctgtgaggattttcattcgtccatcaaactcatctccaaagtttagaagagaaagtttagaccggaattattttcaccatttctaagatggctcatgcttttgcattgattattggtgaaagtaaaccggaagacggaagactctttccctgtgcatacacatgctctattttatttttattttggctcaacattgataaaaattgattttgtttttagttagtagtttttttttcttgtcgtattttagttagtagtttagaaactatcattcaagaaatcaaaatttgctttaaattgataaaattgacaataaagataaatggtgaactaagtctcaaaagtcaaaactatcattcaagaaaatatcaaaaaaattctttagattgataagaaacagcgtaggagaatgagaaaagtggatggaacaaatacttcaagtttacttaactgtttgaaccaaaatttctgtttaaaaagaaaaacaacatcgttttggaattttaacagaaactgttgacgactttactttgtttaattagtctgtcacttgacttaacaataccctaaatttggtaaagtcaaagaaacttcataattaataataaaattaattaaaattggtaatttaattcacccaaaacaaaattgacattttttttcaaactgatgttttttgtcgtcaaacttttcattaaaatccaaagaggattacaaggtgataaagagcccaattacacaaaagataaactcaattagcccaaaattacaagaagaaacaagagaacataggtctaaaagggacacgtgtgaagatacgtgtattgatgcatgctggaagtggaaaggcacagccaccaccatctccaccgagctgaaccaccgatcaatccttcgactttcaccatagaaaagctttttctgaccaaggattttaccgatcttcagcttcaaactccaatcaccttgctttgctaccttttgctaaactctccgattgtaaaaaacagagattagcaagccatcagatctatgaaacacgggaagacgcagcgggcgagagggcaaatcagtcgtaaacacactctcttgatatgttctgcaccagccaacgaaatcctctcaacacgatttgaaaccttgaggtgataccttcttccaattccgattacggccacgattaggatatgaaggatttattcttctcatgatcgaaatcgagcagccaatgatcttaaaaactctcaattaaacgttcggattttgattcttctttactggaagagaatttagattctgcaaaaggattgaggaaacaaaatcaaaatagccaaaacggctaaaagagaactcacgcttaggtgagaaggtacatatccggatttagccggcaaagaactgattttaattggaaaacaaaaaatacataaagcttcctctctctaaaggatatgagagagataagagagagaagcttttttaaaggttgcggtaatggaccgactttcaaactgatgttttaaataatatttttctgctaaataataaacaaaaacatataaataaaaaaaatacacaaccacgaacgatcgacaattgggctcaatcggatggaaaacccacatagcattcatttaattcatataaaaaccatttcagcgagaaaaaatgtaattgggcttttccttaccggatttgaaagtgagcccaatagatataaaccctaagaactcagtaattaaagcccaaaacgacaaaaccccgttttcttcgttttacttaaaagaaaacaaagctcccgccgccgccgttatcacgacgaccaccgtgcgataccctaaatttcaacgttgattccactttgtcaagtttgtatctttcccactttgattccgatttgttaaagatttgcagattaaaagttttctttttgaagaaatccatgagtgcccaaatg

SEQ ID NO: 30005 - DNA, 3003 bp, Unknown
  misc_feature (1)..( 3003): 2750-1469P.txt file - cDNA_ID_3024860; gDNA_ID_2214545; Annot_ID_185365
cgcaacagcaagcgtccacatgaagcaagctccggattcgttgctgagaatcgatttgcagagatggtgtcgaccgacaccagtacctgtgtcgatcgacaccccaaacgggctgaaccagaactgtgtactaaagctgcttcgcaagttcagatcactgctgctattctaggacctgttgtcacgacaaccactgcatctctacaactgcatccacctccgaggaggcaacggtactcatatcttcctcttaaacctacagatatcatcaatttgactttaaaatttccaaagactgtttcacggtttagcaagccacgagtttctcgtcgagcgcttgtttgttcttttgatgattgtgcaggtaaaaggagtattccacccatacttgagtctcaccctgctgatgttccgcacttctttggtcaacctcacacaccaactgcctataagccacctcggatgatgagacgtctttcaaagaagcatttactgccaccttttgatccacctgatataaaaaatccaggaaagtcaagctattgagtctaaagaagcgtttagtgggaggcaacccacttgtatgattttctttttcttttctttttcgttttttttttctcgcttactccggatttgaatgccacttgggacagtgacgtttaagtctggtggaggcgcttactaactacgttttctttttgagtgttattcttatacatatttttctttttcagtcgttttattgagtcaaaattttgttaggaattatgatctctattctttagattatatcgtggttgattaatgctgcaggttcgactcaatccgactattgtaaaatttagatggcaaaccaacaaacttgaggatatcctagtttccaatacaaccactaaggttagagctaatctcactgctctttcttttacctcatcaatcggttagtattcatagatattgactccttatcatacctgatattgagaccaatgtgataaagaaaagtattcctctccccttataaaaataaaataaaatgaatgatgaataagagattgataggactttcagatagtgtataggggtaggaatgtttcctatgaccccattattatacattatttggaatgatcaattacaaaggttggaaaaatgcctagggtgtcgatccagtatgcgagttcccctttgtttactctctaaaaagaataattctggggagagaaagaacaccaaaaaaagaatataaagaacggtcgatttatcatggtatagtacaggattgaatctagacggatcttgaatgttagcttgtttgatgagacccagcgatgaaagcctaggggatatagttgtggaacttatgtatggaatctagaatgttgtgtaagcttgcagagaagtacatgttggttaggatttgattagaactgctagacatatggatttggttaggatgatcaaggcaataagctagagaatgttgggagttcctgtgttttcaaacctcttccatgggttcggcttttgtgttttgcttgagggcaagcaaaagctaagtctcggggagttgatataaccctatttttactgcttttagctatgatttaggtataggttttagagtccttttgtgatatgatcatggatagcattaacgatatggagcatgaaccggagcttgaacgtgagcttgtagccgaggaaggagctaagcttgtagctgaggatgagcttgtagctgaggagaacttgtagcggaggatattcttgtcacaccggccgtcccaatgacttgttctagagctaagctattcgaccaagccattgccgggatgcttaaccacatttgggaccgaccaaatgacttgagccaagtcactacctctttggttttgattcaagctcaaggacctcatcaagatggataagtgattcatgagtgctctttttccctgcctttggttttgtcccactgggttttccaaaggaaggtttttaatgaggcttatgttttcacttcatataatccattttgatgattcaaggcccaaacccactaaaataaagagacaatttcgtggccttagtagttgaagagtttattttgattttcaaaaattgtttttaatttctgttgttttctaggcagccttggagcatgttccaagacttgcctcttcatcttctcttctccttctctttatatactcttgtatttacttttgagaacttatctttcttttaatcaaaaaccttttctaagaagatcatcttgttggtgtgtatatccagcaaaatccttagtctcttttagtgcgcatatccaaaggatctaagtctcgatatcttgaagcccttccgcaagcttctgtgatatccatcgattcatttaaatctatccatcatcacggcatcacagccacctctatccatttctcaacctaagagtgccgagtccttgggaggatctcatcatgtggtatcagagcacactctgaaagttgagttttccatcgttatcattttgtatattttcatctttagatctgtgtccgtctgtcaccttgatttaattttcataattatttggtgcatgctaaaattgcgaaattaactgtcacgggtttgaaaaatactctagtattttttaaaattgtttctggaatttttgggaacgttatgataatatttagcatccgaacaagtgaaactgtcgtaattagggttctagggcatctgaagggttatttcgtgtttgtttaaaaagaactagttactggtgttgttttgttgtctctattgcagaaagaatggctgaatctgaggaggaagagactagccacaatcgaaacaacaaacttttggtggaagcctttgagaaaatgatggataccaaactgaatgcttttcgccaagagtttcatgagaaactagagttggggcagactcgtcctcgagaatgaaggagagttaatgagccgcttgagcaaagagatg

SEQ ID NO: 30006 - DNA, 3003 bp, Unknown
  misc_feature (1)..( 3003): 2750-1469P.txt file - cDNA_ID_3024864; gDNA_ID_2214545; Annot_ID_185364
cgatcagcgatccaactacctccttttgcaagagaacactttgctattcaccctgcatactatactcttgtttcacgaggaaagttttgaggacattctgatgaatccccactagatcatctagaagtctttgaagacttagtgtcctcaatcaaaggagatggtgtacaagctgattatcttctttgcaaactcttcccacactctctcgcgggcagaggaacatcatggttgtgacaaatagaagcaggttcattgaaaaattggactgacacaaagaacgcattcatgatcaacttccttgatgattcagtgacagaattattaagagagaagatctcttcattttctcaagctccaatagaaagtttaaaggcagcttggatcagcttgaatgagattgccaccgcaagcaaagaaaatcatgtttcagcaatctctgctcctgtccaagccccccccccctccccccctcaaccctccttagacagccgactcgactccatgcttgcgcagattcttgagagctaaacaaagctcgtggttgatcttaatggcaagtttgattatgtgtacacagatcttaataggaagatcgacaatttgagatctcatatatctcagccttctcctacctcagcatttgtctatgtagtcacactacacagtggaaagaaaccaaacccgatccttcagcgagaactttcagaaaagacttcatctcgtccagttgcagaaaaaacttcagtgtcaatcgatacataagggtgtcgatcgacaccaattgatcttaacgactctgttttacctttgtcaagtggaatcaataatttcacagaggaggaggaacttatacccgatggtgtcgaacgacaccattaccttcgtcgatcgacaccaacaattctcaaggagaagtcaagctgtgacaaacccatatcgaccagagtcgaccccgacagtgtcgaccgacaccaccttggtgtcgatcgacaccaacatcacatagacaggccactattgatgtttgaaagagcaggatcgatatcagacagtattgtcgaccgacactcacctagtgtcgatcgatattggacttagactccacctatctgccttgaatctccgcctattgcttacacaccaaaaattccttgtctactgcctcgacagtccaagcaagagattcctgagatgcgttgcatgagtatcatggatgaggttctacttcagttgcctccagttgaaatagacaagttgtcaccccctcttcagagtgctatgatacgagacgatgctttagagaagcaggatgacaagacaaagacagtggttgtctctgaacaggtacttcgcaacagcaagcgtccacatgaagcaagctccggattcgttgctgagaatcgatttgcagagatggtgtcgaccgacaccagtacctgtgtcgatcgacaccccaaacgggctgaaccagaactgtgtactaaagctgcttcgcaagttcagatcactgctgctattctaggacctgttgtcacgacaaccactgcatctctacaactgcatccacctccgaggaggcaacggtactcatatcttcctcttaaacctacagatatcatcaatttgactttaaaatttccaaagactgtttcacggtttagcaagccacgagtttctcgtcgagcgcttgtttgttcttttgatgattgtgcaggtaaaaggagtattccacccatacttgagtctcaccctgctgatgttccgcacttctttggtcaacctcacacaccaactgcctataagccacctcggatgatgagacgtctttcaaagaagcatttactgccaccttttgatccacctgatataaaaaatccaggaaagtcaagctattgagtctaaagaagcgtttagtgggaggcaacccacttgtatgattttctttttcttttctttttcgttttttttttctcgcttactccggatttgaatgccacttgggacagtgacgtttaagtctggtggaggcgcttactaactacgttttctttttgagtgttattcttatacatatttttctttttcagtcgttttattgagtcaaaattttgttaggaattatgatctctattctttagattatatcgtggttgattaatgctgcaggttcgactcaatccgactattgtaaaatttagatggcaaaccaacaaacttgaggatatcctagtttccaatacaaccactaaggttagagctaatctcactgctctttcttttacctcatcaatcggttagtattcatagatattgactccttatcatacctgatattgagaccaatgtgataaagaaaagtattcctctccccttataaaaataaaataaaatgaatgatgaataagagattgataggactttcagatagtgtataggggtaggaatgtttcctatgaccccattattatacattatttggaatgatcaattacaaaggttggaaaaatgcctagggtgtcgatccagtatgcgagttcccctttgtttactctctaaaaagaataattctggggagagaaagaacaccaaaaaaagaatataaagaacggtcgatttatcatggtatagtacaggattgaatctagacggatcttgaatgttagcttgtttgatgagacccagcgatgaaagcctaggggatatagttgtggaacttatgtatggaatctagaatgttgtgtaagcttgcagagaagtacatgttggttaggatttgattagaactgctagacatatggatttggttaggatgatcaaggcaataagctagagaatgttgggagttcctgtgttttcaaacctcttccatgggttcggcttttgtgttttgcttgagggcaagcaaaagctaagtctcggggagttgatataaccctatttttactgcttttagctatgatttaggtataggttttagagtccttttgtgatatgatcatg

SEQ ID NO: 30007 - DNA, 3003 bp, Unknown
  misc_feature (1)..( 3003): 2750-1469P.txt file - cDNA_ID_3024891; gDNA_ID_2214546; Annot_ID_185442
tgtatggaccaaaactttgcaatggctagtcgaagctgattcatcactaaaccgtttttattatacaaggaactgacaccatcgaaactcttgcagatgttacccaggattgaagcatttggctccaatgatttccaattggtatgacaaactgaccacctcctaagagctctcatccttcttagaatgtaaaatctgatatatatctatttgcagaatcttattgcctccaagctgggagtccagaaaatcgctgggatcacggccttggacacaagagagaaaaaaacctacgaacttgttccagatatggaggtcagtgtactaaccttttttgtatatcttctgggttctaggtccctctctttagtgaaaacaggaaattggttcaccataatcgatattgttgttggcattatactgcagatatttgtagagacagactaagttataagacagcctccccgagtggtgttcttcctcgacaggttttgttattgcacctcctctgtgttgttaattgtttttgtttcttagtagaaaataatttggctcctttgtagaagaagaaaaaaactaaacggctttaacatatggactacgccgtttgtatcttgttgttacaaaccattaaacgttactgtttgatcaatatgttaattcagaactgtttggtttaaagcataagtattgaagtcgtcaaatgaacaacttgcaatcttttgctttgtatgagatacaaataaaatcgtggtccgtttataaaatagctttctccaaacaatttcaattcccttttaactaacacaacaaacgacccggcccgtcaaaagaagaccaacagacgatgaaataaaaggaaaaactcaattttctaaactatttttgggggtcgtaaataagtgaaaagcctgccgacgaaaaaagaagaagtgaaaaaagaagtgaaaagcccttgtcttatttgtcttttactatttttctgatttaaaataaagaaacaaacatttacagtatttgtttataacgggggctaagtagagaatcatgagaagattaaaatccctaaaagttttgggggaaagaagaaagaaggaagacgatgatgatgctcagaatccgaagcagagatggactggagagagtcacagcggagggagctcatatcactgtttcccagctcaaaaccttgatcgcggatcagcttcagatccctctccataagcagaccttatccaccaatcgtgatctcctcctcgccaaaactcccgctgatctactcgccttcaccgacctcacggacccaaacctccccctctcctctctcaacctcggccatggctctatgctctacctcgcctacgatggcgagcgctccattcctggagctcctcccgttactcctgccggatccttcgggaggaagatgaccgtcgatgacttgatcgcccgccagatgcgcgtcactcgtcaggagacgtctcactgcgactccgtctccttcgatcgcgatgccgccaacgctttccagcactacgtcaatgagtctctagcttttgccgtcaagcgcggcggctttatgtacggcaccgtcaccgaggaaggacaggtggaagttgatttcatttacgagccgccccagcaaggcacggaggctaatcttattctgatgagagatgctgatgaagagaagcgcgtggacgcaatcgccatgggcttggggatgaggagggtcggtttcatttttaaccagaccgtggtgcaggacaagactgaatacactctgtccaacgccgaggtgctacaggcggcggagcttcacgccgagagcgagctgaaggagtgggtcacggcggtggtgaagcttgaggtgaatgaggatggtggcgccgatgtccatttcgaggcgtttcaaatgagtgatatgtgcatcaggctgttcaaggaagagtggttcgagacggagattatgccggacgatgatccaaagctctctaagatgaagaaggaggtggttgttggtgtgaaggatcttaaggaggtagataacgatttcttcctcgttctcgtcaggatcttggatcaccaggttcgtgtttttctctctacccttcctttgcatcaatcatcattgttctttgtactaatgctctgcttgggcaaataaagtaattgaatctggagcttttaagtcttaggttaatgaagcttgtcagtgtttgctttccatgagataattgaaaattagcatttcgtcaatggtccctgtgttttaacattaggctgctgtgatcaggggcctctgtcatcaacattcccaatagagaaccggagcagtcgagcaacgatgcgggctctaaaaacacatctggaccgggcaaagagcttgccgttggtgaagaagatgtcagattttcatctgcttctctttgtggctcagtttctggacgtgtcatcggacgtccctgctttagccgagtgtgtgcgtctgcagtcgcctgtcccagagggctatgcgttgctcatcgaatcaatggccaacacttgttaatttttgtgtcattgttttttggttcttgatacagtatatcatgttcgttttatggtccagaaaatcttttttactagttgacaaatgaaaaatctctagtgtactcgtgatgtatttgattcaagtttgggggttaatttaagttatcaacaacttgtagaaacaaagttaattcacagagtaataaatcattctaataggtatgctcaggggcaaattggcaaaacataaaaataaaaagagagctactaaagttttcgagcgaaagcgaaaatgaaaattttataattcgagcgaaatgttaaaaagctgaaaattgggggaagaagagagaagagtttcatcgtcactggaatcaatagagtcaattggcgggagaggttagtctcgaaaagaagtggaagccctagggggaaactttctcgctcactcgctcgtctgcaaacaccatg

SEQ ID NO: 30008 - DNA, 3003 bp, Unknown
  misc_feature (1)..( 3003): 2750-1469P.txt file - cDNA_ID_3024895; gDNA_ID_2214546; Annot_ID_134600
agctcacacgtgggttttctctgactctcttccttcttcttgtccttttaaattgctccatggccatgaccctcattcttctcttaggttggtttgctctgcattgtacaatgacgctgatggtgagcgtaaatatcttccccagtttttcaagtttgtcgttgcaaacccactctcagtgaggaccaaggtgattatactagtcaattacgtatcagcatttttatttgtcatttgttttcagtcctctctttatgcttgtctaattgttgctatttctgatatgcaggttcgagttgtaaaggtaggttcgagaatctccacttcactctgtgagtgcttctttagaagctttagtttttttccttgtacctcttaatttggtgttttgcatggatcatagatgggaggtttttctaaatatcatgattggcagttataccgccatgtcattagaattggatctcttttcttgacttattattcgtcaatgatcccctggaaaattgattacttctgttctggtcctcactaagtaatcttataatcctcgtccacaatatcttgaacaagtggttttgtgacactaagcaggattcactgttccgcccttttctgctgtctgtgtagtttaacctgtatttatttgtttgtattggttgtaaaatcaaaatacaagctcatgtgctgttgatgtctgggacaccaggagacgacatttttagaggcttgcattgagaaccatacaaaagcaaacctctttatggaccaagttgattttgaacctgctaagcaatggagtgctgtaagattacagaatgaagactcaacagaagatcctccaaccaggtctgtcagattttcccagaatcgttatgtgcatcataagccactcattctatcaaatcgtcctaatttgctgttccactcactctctgtgtctcagtggtcttagtggactgatacctaaaccgccagttataatccgatctggcgggggtatccacaactatctctacaagttaaacccatctgcagatgtttccgggcaaacaaaattccagggaagtaatatcctgggtaaatttcaaataacatggcgcacaaatttgggtgaacctggtcgcttacaaacacaacaaattctcggcgctgtaagtttacgctttctactctgtgacaacatgacatgaatttgtgcctatttgttgattgtttgctgttaggattttgttctaagtctgaatgtatttggtttccttagggctttgagatattgcttcctggggaagccaatgcagggtatcagttagattaggtggcagttagaacaactaggaaaactcaggttgcaccaatatcttcatttagcagtcttatactcactaccttgcattatagacctgacaaaggtttacttaatttaaaattttctgtatctccttttatgcttcatatgagatgctcatctcatcgtctaacaaacttccctctaatttttttttttttttcagccagtaagccgtaaagagattaatatgcgagttgtagaggttccagctgttatacacttaaatagaccctttcgggtaagacaactgtttttttctctctaatgtttggatacccaaagatttaattgaacttacacgggcttcacactgagtgtaaactgttttccataggcatacttgaatctcacaaaccaaactgataggcaactgggacccttcgaggtctcactgtcacaagatgaaacacaattggagaagccggttggtattaatggtctccagactctggtaacatatctgaactttctgttttcctaaaccatgtagttagaactttgccgtacacggtgacagaattgtgaatcacgtcttggctatgcaatgtgtatggaccaaaactttgcaatggctagtcgaagctgattcatcactaaaccgtttttattatacaaggaactgacaccatcgaaactcttgcagatgttacccaggattgaagcatttggctccaatgatttccaattggtatgacaaactgaccacctcctaagagctctcatccttcttagaatgtaaaatctgatatatatctatttgcagaatcttattgcctccaagctgggagtccagaaaatcgctgggatcacggccttggacacaagagagaaaaaaacctacgaacttgttccagatatggaggtcagtgtactaaccttttttgtatatcttctgggttctaggtccctctctttagtgaaaacaggaaattggttcaccataatcgatattgttgttggcattatactgcagatatttgtagagacagactaagttataagacagcctccccgagtggtgttcttcctcgacaggttttgttattgcacctcctctgtgttgttaattgtttttgtttcttagtagaaaataatttggctcctttgtagaagaagaaaaaaactaaacggctttaacatatggactacgccgtttgtatcttgttgttacaaaccattaaacgttactgtttgatcaatatgttaattcagaactgtttggtttaaagcataagtattgaagtcgtcaaatgaacaacttgcaatcttttgctttgtatgagatacaaataaaatcgtggtccgtttataaaatagctttctccaaacaatttcaattcccttttaactaacacaacaaacgacccggcccgtcaaaagaagaccaacagacgatgaaataaaaggaaaaactcaattttctaaactatttttgggggtcgtaaataagtgaaaagcctgccgacgaaaaaagaagaagtgaaaaaagaagtgaaaagcccttgtcttatttgtcttttactatttttctgatttaaaataaagaaacaaacatttacagtatttgtttataacgggggctaagtagagaatcatgagaagattaaaatccctaaaagttttgggggaaagaagaaagaaggaagacgatg

SEQ ID NO: 30009 - DNA, 3003 bp, Unknown; identical to SEQ ID NO: 30008
  misc_feature (1)..( 3003): 2750-1469P.txt file - cDNA_ID_3024895; gDNA_ID_2214546; Annot_ID_185441

SEQ ID NO: 30010 - DNA, 3003 bp, Unknown; identical to SEQ ID NO: 30008
  misc_feature (1)..( 3003): 2750-1469P.txt file - cDNA_ID_3024895; gDNA_ID_1971751; Annot_ID_175318

SEQ ID NO: 30011 - DNA, 3000 bp, Unknown; identical to SEQ ID NO: 12395
  misc_feature (1)..( 3000): 2750-1469P.txt file - cDNA_ID_3024899; gDNA_ID_2214546; Annot_ID_185437

SEQ ID NO: 30012 - DNA, 3000 bp, Unknown
  misc_feature (1)..( 3000): 2750-1469P.txt file - cDNA_ID_3024903; gDNA_ID_1971751; Annot_ID_175314
acaaagatgaatatagtaaaagtaaaactacaccaatctcttattgtgtttgttcttcttcttctttaggtctgttagccatggaatctttaattttgggaatatatatatatatatatgttaattagtacaaaccaaaaaagtattgattttattttatttaaactgggtgagcataaattagtaatgttagtataacatcctcctctacgagaaaagactagtatagtatattgtttctccttttaacagattttatacggattcttctccaactagtcagtcccttagaccactttttttctcttgacgaatcaaaacaaatttacactacgctaaaggggactaattaaggttaatgggtagatatcatatcgattagttgtgcattaaaagccaaaggggaaacacagacaagaacactacgctaagctagatatatactattttgttttctctgttgatgatgagatgacattaattaataaagacagatcaagatgcgagacaagcttcccagaacattcgattttgatccatctcactcaccrccgcagcagaatccacagccagattttcacgttggcttctcccacatcttatgtagctattcacttctccttctccgtcttcgtcttcttcatctccggcgtctctttcttcatgattcaccgtatcgtcctgcaggtcaaaacctaacaaactcgttctctgactcacgcaagacgtctcgcaagaactggcactagaagactcatgaccaagatcgtaatccttaacgcatttatcatcgtcaacgctgtcgtggccagcttcggaatctgcagatgcttctaaaagcaagaacggtgacacatcaaacacgttgttggttgtgttcatctttatttttctggtcttctgttctctaattctctttatttgtctcctaactataacagagaacttagacaagaaacacgagcagctacgtattatagtaatatatacattcatatacatgtaagcagaaagtggccattattattgacgacaaatataaaaatgttttcttttcttttgtttttgtttatgttttaagagcaacttttgtaacagggatccattggttccagaagatggaagttgtatgcaaatgacgtgagagcctgttcttctagaagggcggtgtgtaagtataaacaacgtgcgttctttaccaaaaattaaatagacacgtacaaaaacaaatatcaattgccaaatttgaaaacagagcgtatttatgcttttttcaacaggtcttctagaaagagcagcaaacatcatcagttccaaaattcagacacaagtccaagcgtgaaagctattacacttgtgttgtctcaggctattcattttctcactcaacatagagattcatgaatcaaaatcatttcatctactactttatatagttatcagaatacatgtatattctttttcatacgcgatactcgtattaattgttctagccttggtactctattaggtcttactagattttaacccgcggtataccgcgaagacaatttattttttaaagttactatatataaaagtttgcaaattatatttatctataaaatatttttattttatagtttacgattgttattaagtaacgtcctgtcaaactcgtcccgtcaatccgtcctgtaaaaaaaactcactgattttatttatgatatgtttatgaatcattgtctaaatattttttaattttgtaataattaaatgctatcaaatatctctgcggtttgatgattataatcgaattattatagtcatgtagaaaaacaatatcaaaaatgataattttgtagtaattaaataagattaaatattttgggaagttttattttagtaactaatcgtgtaattaatgtggagagattttgggaagattgtcaaatatttaattcaaagattttctttttaattatcaaaaacaattattaaatgtcagtggcagccactgtaaataaattctaactctaggatttattttacaaaatggctgcaaaaatgtatatatagatatctaaaatatcatccatatctatagcgttagactaaccagtgttgcatatttatataattctgctgcaaagaaaaaaagaaccacgtaagtaaataaatggtcatgtaattttggtgctagggagacaaaatacggaaatggcggtcgctttcgtttagaaataaagggaatatggatggggcaacgcgtggattaaaccagaaacctttgattttatttgttgactttggggatgccgcctacttctttaatcaaagttaatgattaattaaatttgatatgtatcttttgtcacacaagcaattaaccagtttacttatctcgttacgcaattaaacatgatcattcaaaatgaagcacctaacgagtagacccacatgaacaagttgcctaggttatatttttaagaaaagtagtcatacagtagtataattttacattaaatcatgctttgattaaaagaattaaataacgggatataatcatttatccaaagaaacacaaagagagagagatataagtaatcattaaggtttttggaacgagaacgatcataagtgcagatacaaaaaggattacttatcagttatcatacctaatttgtttatacgtgaaaaagatttctaaaatgtatattcaaccttgtctaaaaatatttgaaagtaatagagatattggtgtacctcatctggtggccccaatggttgtgaaatgggcagctccatagaataaaaacaaaataggcccattaatgttaaaagggggcccattaggacccagtggtaattatgaaaatatggggaagaagcagggtcaagtgaagatggaggcgccaaagaagcgagagtggataagaaaatcaaaaaaaggattctctttttctctctttcttctcacttctctctgtagttagtgtgtctctctcgccggccgatatg

SEQ ID NO: 30013 - DNA, 3003 bp, Unknown
  misc_feature (1)..( 3003): 2750-1469P.txt file - cDNA_ID_3024907; gDNA_ID_2214546; Annot_ID_134592
acgagatcgacaacgacccggactgccgtgagatcgagaaggctcttctccggctcggctgttccacggcggttccagctgtctttgtcggaggcaagcttgttggctccaccaatgaagtcatgtcccttcaccttagtggctctcttgtcccattgatcaaaccctatcagtccatcctttactagcaaaattaaaccaactcaatatataatatctaattattagctagtgagaataaacacagttacagctagagtgtgagctagctagatattcagtgaggacttcgtctgaattaatgtttatcgtttgtatgttctattgtttagcttctctcgtgtttcagtttagttaatcaactggtgtatgttgatgtatgactctctgtttatgctaatgaaaatagtattgaaacttttacattttttcccacacaattagtaacgatctcttgtgtatgttgagtaatttagggctttccatataataaggcaagaaaccgtttatacttgtctgtttttaacatggtatcagaaggaggctacacacaaaccattttcttatttagaaatattcacatacactgacagtagctagaataaaaatgtgaatggccaacacatgcatgaactcgtcttctaattatcaagatgtaatgtataagttggcttcatcattattagttagacctattgatagttaacattatatcgggcgatatacagatttagcctttgtgatgttgtgtttagagcgtacttttgaatcaaggataaatcagtgcccattagagtatatataaatcgaatgtgaaaaatattagatcagaatagacttaattagtctccaccatacaaatttggtaagaagaaaaacaatgataagataccagtggcctaatgcaactaaagcagtttgaggaagaggatggaagatctttcgcggtccaagtatatcatggctacacaaaatcactgctctttttgcgttcctttattcttgagtatcttcacgtttaatttactattattttctaatgaaaaattgtacacctttttatatatatgaactctttgttttttcgttagttgctcgtgtagtaaattaaacatatatgctcataatcaataaaaacatacaatgttagaagaaaaaaatacaattttttttactaacgaatcatatgaatagttgttttatatacggtacattaacgatcctctcatcagctttatagataacgaagcatattattctccttagttccgctttttatcacttgagattaaactctactcacaggtttaagcacgtaaattagttactaaataatggatttgacatttacgctttgcatgcttatatatgttacccataattatttccctttagttacttaaagttaccaaaatcaactacttcaagattctccaatcaaaagaagcgtgtaaaagcctctatagttatatagtagtatatagaccttgaagatttctttttgaagaaaatatgattatactgagttcaaaaggtcgaaaagaaataataaaggtagaatccctttacatgatgtgtggaacaacttttcttgacctccaacttcttgggatcgtgggaaatatataggagaatctaatcggaagttgtacagaacgtgtaagaactaagaaccatattcactttgttgtcattgttataagattcaagattctttgaccggcgcgtgaaaaaagcatccacctataggctcaagattcgtgtccaagaaaatatcgagaaccgatgattacttggaaagtggaccattttttaaaaaatcaaaaattaaaaaaggaacgtagctcatgcgaatagtttagtccaccaaagtgaaatggtagaacatttggtttcagtttagttgtgtgtatttttattaaaggcttcagaatcaatttcgatttttgaaaaatgagtttttatagccatgttagtatgttacgaggatggaaaagcaacctagctagattatcttgtgatatgtgttattgttcaagagaagtaggggcagtagttgtcgagatcatgttattagtgtcgctggaatgttagatattgcccatcctgtctctttttccccatcgtgccctaaaagtcaaactatgcatggtattagctaatcttgaataggtttaattcagtacggaaactctaattgaaaactaccttcatggagtaatagttatcgaggaacgatgatgaggtattagtggagataagcagatttggactcaatatcaaaaattaatggtgggatccatttccgtttcacctaatatacatagtggcaaacaaaaaacaaatataagaagaaaagattcagtatcgagcattctagctatgtcggtaacgtgacaaagtcctttttttcgtttgtctgtttctttaaagttaatcaaatcggccaacgctgcctcaacaacgagcttcctttttctaacgtccctaatttgccacgtccattttctggactagtcccggtttaaaaaatcttcagagatgtattcgtggtcaacttcattaactctttctcttgagcccttcattagttatgatcttatttactttttaaaaatctaaccaagtactgtatattatatatgtggtagccaaaatattatgttaaattctaggctaatccgatatatcaagaaaaatcaatatataaaaatggagagctatttttcacgagttaagtgagagagatgagtaaagaaaggcacgggaaggtgaagagagtgtaggtttccagcttcttccccaagaaataaaatgtatttgactttgtctaagcaaatatgtcgtcactttaacgtcattcattacctagaatgcaattaagatatggcttttacataagccaccaaatttggttttgttgccccaaaatatcccaagaaaagatcaacttcttcttcttaccaaaactgtcggcgtcgtctcctctaagctcctcccatg

SEQ ID NO: 30014 - DNA, 3003 bp, Unknown; identical to SEQ ID NO: 30013
  misc_feature (1)..( 3003): 2750-1469P.txt file - cDNA_ID_3024907; gDNA_ID_2214546; Annot_ID_185430

SEQ ID NO: 30015 - DNA, 3003 bp, Unknown; identical to SEQ ID NO: 30013
  misc_feature (1)..( 3003): 2750-1469P.txt file - cDNA_ID_3024907; gDNA_ID_1971751; Annot_ID_175308

SEQ ID NO: 30016 - DNA, 3003 bp, Unknown
  misc_feature (1)..( 3003): 2750-1469P.txt file - cDNA_ID_3024917; gDNA_ID_2214546; Annot_ID_185419
tcttaacttgaatatcgcttcggtttcatgagtgagaggcaaatgatttgcttggttttcaggtggacgatgtgttcttcgatgttgagacatatgttccgtcattggtgaagcaagcttctagccaagcgctcacggtggccacggaggtgcagcgcaccggcgttgtggacactaccaagagcattgcaagaagcgtccgggacaagtacgagccagcggcagagtattacgcagcgacgctgtggcgtttactgaatcaactgccgttgttccctgaagttgcgcatttagtgatccccacggcgttttactggtcagagaagtacaacgatgcggttcgttacgttggcgacagagactactttggggcagagtatctacccatgattcctattgagaagatctctgatattttggaacaagatcagtgtcgagctgattgactatttactcttctgaagccaaagattccttcttctatagagtatatatactgtatgtactctgtttttctttcctttctgcaatttgctatcccaagagatgtaatctttcttcaatatttcatttaaacaactttgccttttaataataacaagaacaagagacataaaggaaactgtcctcttcagtctcaacttttataaaagacacaagacccaaaaagtagtatctgtttactagtaaggagagtgtctgtttttcttgcggttccttggcggcttaacaaccaactcacttgaagtccaagaccggttaatctcggtagcatcctcatccgacttccagcaacatagtcgcccatcttcacccccagtccatccaaataaccctgcagctcctccatactcgcctggcatctgcagaacgctccttactacatctatgtgacctccaccaagaatagcttcagcggtaccgattgatccaggctgtttgtagttcaccggaaaataaccaacggttcctgcgcacgttccaccgatcacccataaatcttcacctcctggacaatgacaatcaacaaaataatcaacctgcaaaagagtaatgggaaagttcaactctgtaagtaaccattaggtttctggttagtgttaatgttttactagaagggaaagaatgagattgttacattatcttgagtccaactatctgatgcgagttcccgagctttctctaggttgacttcacagcttccgtcttcccaattccaaatactagaaaggagtaaagaaattaaaaacagcacaagtaacagactacagttggagaggagggcgtgaaagagtaccttagagtttctatatgagtgagacaccagagctttttatagccatctccgaggaaacctattttgccaattgaagttcccacgttgatgacctaaagagcgaccaaggcagaaatggttcagaactctcatctactatcttgatgcagcaagaaggctgataccttaaatctaaaacttacagattccagatgatcatcgtcattgatatcaccttcagtgttaaaaagacatatcaatccatccacggaagcggaaagaagcttgttgggcttgttaggaacaaagtgtacctataattaagaacagagttgacatctataaactaacaacaaactagttcctttcccgcttgagcagaaagaatgagagagcaacaaacctgagtgacgtcgtccatgtgggattcctctaaacaagcaacttgctttgagtttctccagtcccacaaaagaacctgcaccatcgcttcagattgtaacaagctgaaacatagaaaatgctcaaaactagccttttttctttctcaaagtgtactcctttttaaacatttagagaaacaaaaaaaaaaacacgattccacaggattgagatgcctaacctgctctttgcatccaccagccagaagattatctgcagcacctccataggagaagctgaaaatctcctgatcattcccagtatcaatacgcgaaacctgaaacacccatgatcaacttaaattcaatgagttccgaaaatggaatcacatttacgacagaatttatataaaaaaaaaaaaactcacctgttggaaacttcgagtgtcccaagatctaatggtaccatcggaggaacaagagtgcaaaacgtgaggagacgccgccgagtcggaggaaaacgcaatctgattgacggtatcggagtggcctttacattcgccgtagtactgaccagtcaccggcgagtaaagcttgacggtgttggttgataaggaaaccgcgattgctgtccaatcgattctgtcacaaaaccagagttgggttcactttcagtaaactaattagtatggttatcgaaaagagagaacagaaagcttttactttgggacaatctggaagacgtagtcagagccgaagttggtctgaatagagttcttgagcccaaatttcttcacgttttgagccggagaagaatccgaaagctgacgattttgaacctccacttccatctccgacgacacttcttccatttgccgtttcagcgaaattgataagggttttaacggtctagggtttgttcgttgatcaaaacgaaacgaggattagcacttacctctctaagtcatagagaaggttataactctataggtcaaaatttaggcctgttttaaccttttcggcccatttaacgcacggtccaatacgattattagcccaaggaaacaacaaccaactcgctcgctcaccgtgcgcttcttctaaacatgtccatagaaacataaacatactaaaatgtgaaaagattaaattaaaaaacggatagaaacatatagaaagccacgtgatggtagcaaacagatttagtggttacaaccagatatcatttgatattgagatttatgaaaatgtcctttttcaatggctccgatcggtcagtgatcggatctaatattataaaggtgtgttgacccataacataatattattactaatacaagtaacatg

SEQ ID NO: 30017 - DNA, 3000 bp, Unknown; identical to SEQ ID NO: 12375
  misc_feature (1)..( 3000): 2750-1469P.txt file - cDNA_ID_3024925; gDNA_ID_2214546; Annot_ID_185415

SEQ ID NO: 30018 - DNA, 3003 bp, Unknown
  misc_feature (1)..( 3003): 2750-1469P.txt file - cDNA_ID_3024937; gDNA_ID_2214546; Annot_ID_134573
cattttggacactatcttatagattcgatctattgtatttctaaagcatatatgcacccaatttttaagaataatgaaagaatactcccaccataagcatttagcttcatctaaggatcttcgcaccaaacaggaactcatgtgataggtacttatgcagtagcagaagacctagcaaacccgactgtccttactatttcacaggtaacccaagtttgacatcttctattataaaagaagttaaacattctctacacaattataatattattaccatttgcgtcattaatggctctggattccgtgcagcaaatatggagaacttgttgtctcaatgacagcttaagtatagatgggggctcatgttcttcaagcttgttaaaaaatgcactcggcaccaggcgatacacctcaccatcacatgttcgacctgtcctccctctacgttgctcagcctataacccacataagaagctaaatttagaacatccagtcatccactattattccataaatggtaaattctagcaatacctgagatctagagacccaaacaagctgtactgcgtctctttttctggacggatcccagaacacttgcagagaccggcacgagtcaatgacatatgctactttgggtattgttaccgaagattccgcaatgtttgtagccaatattacctgagaacagtattttggaaaatttatataactatgacgtcacaaaatggtagttgcaactcattgcatcaatacgagtttgatgtccccccaataataatgctcatctctcaaggacaaagaaacatggaaaggtaaaagagaaaccttgcggcgggatctgcatatcttcatagccgccaaggcttgctcggtgtcaatgcttcggtgcaatatgtgaacctcaaaagatgcaaaaaagggttccaattgatgatactgctgctcaagggagtagtatgtcggaaggaaaaccaaaatactcttctcaatgtctggttctttttcatgaatatataagataagatcatgaataagattttgcagttcaggtttgatttcagtatcagctgaagaaggacttggaccaggacagtaagctgacaaatcagaactcacaccaagcaatcctgcaacctgcttcacaaacagtgtcatattaattagcttggaaatacttgccgtcagaaaagaagaaaatcaattggataataatatagtttcataaagagcaacaaatctaaaaaagtttaacctgctcaagatataatactcttcgctggaaaattgttctctggtcagggctaggaatagcaactacttctacgcgttcacccctgcctagttctttaaagtagtctctgtaccttgttatatcagcagttgcagacatcaagaccaccctgtaattaatcaaatcacctctttaataaccatgacctcaatacaaacgttatcgatgataacacggttgaagtaatgaatcggtatagtatagaactgacttatcttctatcagcaaacacaaccacgcgaaacaatttaagaaccttaaagtaattacatcatgttgtagaaaagggttataacctgaggtcattattcttcatgagaaactgcttaacacagacaagaacaagatctgactccacagatctttcatgcacttcatcaagaatgataaccttgtactttagtgcattcaaccccttgtctagcatttcatccaacagaactccagcagttttgaacagaattttcgacctgcatgcaacaggataattgcataaaagtcatcaataagggggaaaaagccaaatattgtcctgaaaactcggacacagtagaagaaactgaaaggagatattgttctataagtcaagaagatgaagataatgatagttacccttcggtcaaaatcttagaatgcccaatgtggtaaccaatttctccacctaaatcggagttgcgagatttagcaaccatcttagcaacagctacaaccgcaaatctcctaggctgtgtacacaaaatgggagccatgtttgcttccagaaggaactgtggaacttgtgaactcttccctgaagcaaagaaggacaagtaagtaaccacactacgtatgagatgagtcgaaaatccagctatccattacaatcacaacagttcaaaggcgcagggaagctaaatatggcccaacttgtactatttccgtttaacgcgttaagatagaaacgaatcaaatggactatccactcacagaaaacattcaaaatctggtgtcatacaggaagaaaccccaacggagcatttctgtaatcaaaatgacgaagacgacaaaacaaaaacaaaaaccccaacggaaatgcagattactaactagagtaagtcgtctcggaacgaaggaagaaaaatagaataagagaaagaagaaggcgagcgcaggtaccgcatccaggctcgccgacgatgagagtgacgcgattctcgaggattttgtcgatgattctccttttcatcgccataatcggaagcgaagcgaagttggaggagggtaaaggtaacgattcagaagagctggaagacgaagtcggcgaagaaaccgccattgttgtcgtacgcggagcactgtctctcttcctctacacacagagtctagtccagtctctggtatttctaatactgccaatcacatccttcctctctacgcttttaggggggttttaggggagcgtcgatcaggtgcgacgagcgtacgtttagctcgctcgttgatctctcaagtctaataagttgactaggtttgactagtcaaaatgtgtgcgggtgtatacacacactggagagcttgccgcgaattacctaggtcccactaaggaaaggacatatatatatcatgggcaaaaaagtgccgccaatcaaaacacttgaaaaaaagcaggaaaaaaacttacaaatagaaccggcccactcatagcccagtaataaaaaagtccattaatg

SEQ ID NO: 30019 - DNA, 3003 bp, Unknown; identical to SEQ ID NO: 30018
  misc_feature (1)..( 3003): 2750-1469P.txt file - cDNA_ID_3024937; gDNA_ID_2214546; Annot_ID_185408

SEQ ID NO: 30020 - DNA, 3000 bp, Unknown; identical to SEQ ID NO: 12371
  misc_feature (1)..( 3000): 2750-1469P.txt file - cDNA_ID_3024941; gDNA_ID_2214546; Annot_ID_185407

SEQ ID NO: 30021 - DNA, 3000 bp, Unknown; identical to SEQ ID NO: 12370
  misc_feature (1)..( 3000): 2750-1469P.txt file - cDNA_ID_3024947; gDNA_ID_2214546; Annot_ID_185404

SEQ ID NO: 30022 - DNA, 293 bp, Unknown; identical to SEQ ID NO: 12369
  misc_feature (1)..( 293): 2750-1469P.txt file - cDNA_ID_3024953; gDNA_ID_2214546; Annot_ID_185400

SEQ ID NO: 30023 - DNA, 3003 bp, Unknown
  misc_feature (1)..( 3003): 2750-1469P.txt file - cDNA_ID_3024970; gDNA_ID_2214547; Annot_ID_185468
cacaacgagcagcaaccaggagaatatcggatcatcaagcgtaagcttccgtaaccaagttcttcagtccacagtaacgaatcagaagcaagattcacccataccggtagaatcaaatcgcgagaaagcagctagcaaggaagtagaagctggttctcaaagcaccaatgaggggattgctggacaaagcagtagcacagagaaaccaaaggaagaagaaagtgcgaaacaacgttggagtagaagccagagagaagctgcattgatgaagttccggttgaagaggaaagatcgatgctttgacaaaaaggtaagagacacacaagcttcatcataaaaacagcatctgaaacaaatacaagatcaaactgattcaatggagatgtataaaaatggattacaggttcggtaccagagcaggaagaagctagcagaacaacgtcctcgagtgaaaggccagttcgtgcgaaccgtgaattcagacgcgtctacaaaatcatgaagagctctttcagtttttcctctgatttcttttgttgattttataacagaaacttatttagcttttgcaatctttagtgtgctttttttttttatgtatttgattggcttcttcttctcagctaatatgagatactggggcaacttttgtatatatgtctgcaaatgatcaggctaagctaaaacagtaattccaatttcgttaagttgagaaatatttcttgttgtgatcatatccaggccgcttctctctcgatacataccaacaagaaacagattctataaaacttgatttatataccattgctatagtctatgtattaaaactcatcacattaattctctcacagtcagagaaacaaaaaaaggaaacaaaagctatcgaaagaaaaatcaacaaagaaatctttttttgtgaccgttaaactaagattttgtgaccgttaattgtgattatcagtttccttttctttgcttataaataaataattagtgagagtctcaacgcttcttctaaaacattcgacaaatcaaaactctctatctctcgcttcttcttattcttcaaccctagttctcttctcaagacaattttgtcttcaaagaggagactacaaagaggaggatatagccaagagaggggagagctttatggtggtggatgatgtcacgagagggctaccaaagaccgacgggctcaaatctgactttggaatgggctttgctctatgggccctttttgctactaaatccaacaaggtattacttttttcattctttttttttttgttttatttaccttcaaaattatttttaagtaaaactaattagtttcaccataacatttatataactaaaatgtttatatattttcattagtttaagtgtaaaatgtttttacacctatattttattataactttagattttttttatatagataagtgttaaatttttaaattttgtgtaaactaattggatacatcatccaaacccctaggaggtgtgccaggttcaatatatggtttacacattatttaactttttaacacttgttttgcttttattaaaaatgtttttaaacttacatattttcatattactattaaatctttaaggtatttttatttggataagtgttaaatttttaaattttgtgtaatctaattggatacatcatccaaacccctaagaggtgttctaggtttaatatatagtttacacattattcaactttttaacacttgttttgctttcgttaaaaatatttttaaacttatatattttcatattactattaaatctttaggtttttttttatttggataagtgttaaatttttaatttttgtgtaaactaattggatacatcatccaaacccctaaaaactgttctagattcaatatatggtttacacattatttaactttttaacacttgttttgcttttattaaaaatgcttttaaacttatatttttatactactattagatctttaaggttttaaggtttcatttataggtttaatatatggtttacatattatttaagtttttaacacttgtttttcatttattaaaaaatgtttttagacttatatttttacattactattaaacctttaatgtttttttgggataattttttttttttaattttgtgtaatctaattgaatacaagattcaaacatgtaggtggtgttttaggtttaatatggtttacaaattatttaggtattgaacacttgtttaaaaaaataaaattaaatcttagtttaagtggtaaattttaaacacgttgaaaactaattgcgcctaagcatctcgtacttagttggtccgtaagttttggtgttcgaagtttggaaagttttcacgtaatttaacacttaaactttaaaaaatcagttcatttaaaactttttgaaaattagtttaaatggtaaattttaatcacgttgaaactaaccgcacatagatatctcatatttagttgatccgtaagctttggtgtttgtaatacttataattagtttttgaaaaatgttgattgtttttactaaatttaagaaattaattcactaaaactttttaagaactagtttaagtgataaagtttaaatatgtcaaaactaaccgtacataaacatcatatccttagttaatctataaagtttggtattcgaagttttcacataactaaattttaaattatgttttggaatttttcttcttagtcaattcaataaaccctcaaaagtgaaaacccaatcattttgctaaaccgcttctgcgaaccaatatatgaaaccgattaaaaaagccactagattgattggtttaaattaaaaatttcaccggtttgacaagatacccaatcattatacacaggtaaaaaaaaagcaaaaaaaaaaaagacagcaaaaattacggaccataaaaaacggccacgtgttcatcatgttcaccgtcaacgaaagagattccgattaagagagatg

SEQ ID NO: 30024 - DNA, 3003 bp, Unknown
  misc_feature (1)..( 3003): 2750-1469P.txt file - cDNA_ID_3024977; gDNA_ID_2214547; Annot_ID_185466
gacttcttacattatgcaaaccatatatgtgttcaaatattgatatttgaaaggatagagtatgatgtatatgacgcatttcgttttatttacatgatcacccaatcgatggttacataattaagatttgtcccttcgtaatgattgtgtccctataagctggcaatatatatatagcaatcttttgtataactaggtgtcctaaactagagcatagcggtctgctaatttcggctaaggcctgaatcgttaatgatggaatcagaatgtacatctcatggaagtcgatatcgttcaacttatagagataggcacatgttaggtatctgaatgctttagtatcaaaattagaagctctcttccattgactaatttcgtaaaacatatatacgaagctatcagaatcaatgtttcattgtacggattactatgttatgtattaacagtcagttactatatttaagcagatcataagaaatgaataaattttccaaatatatatatttaatcagctaaactggttaaaaagaaactgattcaatacataatagatttgaagtcagttcaaattacgttaacggaagagtgtgctttatgttgctggtctactatatgtatacattccaaagaaatgaaatttcgcacagttcaaaactttatgaatcaagccataaaatgtgacactccgtaaactccattatattacatatgagatagtgtgaattctgtatacatagatttactgggctttagaaatggattttaagcccacaaatagtcttgcttcatttcaagaggtggccagtagtaaaaaataataatattaattttcctttttgataaaaatgatttactcttttcaattaaagtcccatctgccaacgaagattccaccacgtggcaaaggaaacgttgacggtcaaaataacgggaatccgtatcattcgctgtcacgttcatacgccacgaccaatcaacagcgtttataacggattttcagactttaaggaaacaaaatcgctggacacgtcacgcgtcaatttttgtactgtaataaaaacatcactcagatcaatgatcccatgcacgcgggaccacgtacgcgtgataaagtcttgtgatacacaccgttggatgataaagtgcaatccatctaacggtgattttgttcaagttgagaataaaataaatattttagttagaatactttttaatactatataataatattgggaaagtggctgagcataaacatgtgcatgcctgcctgtatcttgcagccttcatgtggatttatcagtgcgacactatccatcatcaaataactcatatctacactttctttcttatatatgtgaaatttatacattacattttgtaaaataaatatttatattccaaaaacaacgtagtagacgtgcctcaaaatcaaagagatgtggaacggctttagaagcaaaatccaaaattggaaaataatgataattattgccacaaaatattgattacgaaggtgatatatatattaatcactgattgatgttgttaaggaaaagaataaagttttgggctaccaaattttcgaatgttgaaattgacttttacatcgtgatctgacaaacgcatgtgttgattcaattgttcataaatcacaatacttcaaaatttcaatacgtatattttttcatttcactaatcactaatacattggtacgtttctatagattttgccactagcaagttttagcaaaatctgttatcagaatgctttaagttgagaaaactgctaatgctattaaaagaaacggctaatgattggtagacgcatcgatcgatcattcgttgagagttttcaacaaggtctaaataaactatttaaataaaatatcatagactataaaatggaaacgaaaaaaaagagcatatatttccacaattaccgttagtacttaatagtagtagtagtaaacagtgacacatgatacattttgacggctctgatcgaataaaaaagaaagttgtactaacagactttattaaaagacaagctacaatgattttttttttttgtaaggataatattttttttttataagaaaactgagaataggcaatttctgcaaatgttttgaggaagacaacctgtcttctgtgttaaaaaccaggtctgccctacatttataattatttcattgtttttttataataaagggtttacagttaaaattcaaaaatacaaaacatccaaaaaattcgaaaaaaggaaagatagaatttagaagattgtgccacaaagtcaagacccacaaaaacatttttgttttgggttatgtactgcacaaaaaaaagtgtaaataatttaaaataaacccaaaataaaataaaatagagaaaaattcagcagattattctcttcgatatgtattaaaaaattctcacagttatttttattaatgcttggagacgaatggtcaaagtttggttttatttttttgataataatgaaagtttaattatcaagaattttgcagaaatcaagagagaaggttgaagacagcgaagcaaatgtttatgtacacaagagacgcataaatatataaaatacagcgaaaaaggtaaaattgggtctctggcttttcctcatattttcaattgcttctctcttctctcttctatagccccattgtcgtgggttcccactagcagctttcttgtcttcctccattttcttttccttcattctactaaaacagaggtttttgcctcttcctctcttgtttcactctttagggtacacacaaattcactcttttttcttctttgtttgggaggggaaaagttacagttttttcctctgttttggatcaaaatttcgtttttttggttgtgttaagaaagcaacagagagagagagaaagattgaaactttggatgtgaatttagggttttgtgaattggggaaaaagcaatccagagatggctcaacagagacaatttcagatg

SEQ ID NO: 30025 - DNA, 3000 bp, Unknown; identical to SEQ ID NO: 12400
  misc_feature (1)..( 3000): 2750-1469P.txt file - cDNA_ID_3024981; gDNA_ID_2214547; Annot_ID_185464

SEQ ID NO: 30026 - DNA, 2765 bp, Unknown
  misc_feature (1)..( 2765): 2750-1469P.txt file - cDNA_ID_3024985; gDNA_ID_2214547; Annot_ID_185462
gtttgaactttgatgtttacaaaaaaaactcatttagtaagacacataatgttgttctactgaggaaaatattatattttcatgcaatggtttcggtttgtcacaaaactcattttatttaaaagccggatgaatttaatgggcctaatataaaaggcccaataagccactggttagagtatatgtggactggtttcaccaccgccgcaaaaagggagactgagataaattcgtacagcaatcggagttactatgtggacagtgaaactggcggcgatgccggttcaatttctcatggagcaatctccgttggctatttacagccaccaccaccgcataaagtaatgatcaagaattcttctgaaattttctgagctcaatttcttattctgtgaattgatttgtggcaagagcgactccatgggaattgccgaattggagccatctcgtctctgctgcttatgcaacaggtaacttttcaattgctagtttgtcgtttgtgtttttaatttcggttcggtttacatggttttgaaaaattcaattgatttcggttgggtttgaattggaattaaaggagaaaaacactgaaatcacgcactcgaggctttttttgaaaggagcgagtgtgtttcaaaacaagccatttggtgggttagaacccacagaaaacgtatacacgcgctcatcacgcgattggtgagagtgggtgtgaaatcgcccgagaggtgagagtggagtatgacatggaacgctctgattggcttataaaataaaaatagtagagatgttgctcctcccttcctatgtttatatttatttacttctcttttccgaagtatcaaaactgttctcaaacaaaaagcttggaacaaaattaaaaccaatgcaattcatatagaagagctaaagcgttttgtttttttatggctaagattttgtgaatggtcttctcattttcaaggatgttcaacttcaacaacatagcatggaactttctttgttgatgttaatctctaacatgtctggtggaaaaaaatcacatactcagagggagtgtatcacttgccttgattatcctcattcttttggtgactttactcctggtttctgaggaaaacccgcttcatgattctctttttgatgtataacgtcagttttcatcttcttcaggtatttatttgctcttcacagcttttagtattcatttcttggctatgtcttatactattcagtaacattatgatccaaagcttttgaaatctaaagaatttatagtctggttttgtgatactttttagtttcctattcatgttccccattcataatttcttgacaaggttggtatggaagattttctccaatgagacattcttatgcatgttcctttttctgtaatgtgatgtaagtagattgcattttgtgagaatatgtggtagcagagcaagtttctgaaagtatctcaaatttgcttactacaatctttgcttttgttttttcttagttagcagaacaagaccatagcattcataggagactcattgggacgacaacagttttaatccctgatgtgtatggccagcggtggtcccattccaagatgtaaacctttcaagcatacatacgaaaaggagattgtcatagatccttcaccgatcagtccacactttttccagcctcgtctgcctggatttcacagccacctcgtaatctctctctcctttactctctttctctgatatgcatgaatttgtttgtttcatctctctctggatttctttttttgcagaacattctgataagttcagagttgttctctcttatcacattcccatggatttcttctcaggcacatagatggaacaacaaatgagagcaatgtggtggtgaaactgagatcaaacgcttctgatataatctgggaagtgaagatggagggacgaagactcatccaaggctggctaaagctccccaccagccgagtcggcgacgtagttgttttcagacatgatggagatttgttgttcattgtcacttcttttggaccaagctgctatgagattcggtatgaaccgatgcaacacctgttctccagctgtgttcttcttctaaaacgagccaaaacagattcttgacactaactctcacaccatacaatctcaacaagtataaactggtaagtaagtgttcatcaatgtttcaacattgttgtcggagtttgtaatgttttcgagttctttatgggcagcctactaccggggacaattctgatggcggatggtgtcgagaaagtgaggaagataacgcttgtggatcgatacggtgtcaaaagggagatgagtcttaaaccagaggacagatatggaagaatgagttctagccatgatacttccctgtggtccatagatcttaaagggaaagtgaatggtgcagtagagacctgcggtgtcactttccatcgcttggacacttactaaaacttcagtgatcaacacattttagacaactttgatccaaaagcctgcggatgggcttacgggatggacatcttcgacctgaaagaatggtaaaatgcagataagctcttcttcttgacaactaaaacttatgacatcgaaccttgtaagttagctcttcttcttgacaagtgtctgatactcatcattcatctccaaaatgctgattaaatccagcattctcataaccaggccgcttctatctctatctcccacagaaagactagcattggtagcctaatgtcaatg

SEQ ID NO: 30027 - DNA, 3003 bp, Unknown
  misc_feature (1)..( 3003): 2750-1469P.txt file - cDNA_ID_3025009; gDNA_ID_2214548; Annot_ID_185499
aggtttggtttgtcttcaccagctttctttagatttctcttcatagtctccgatctttacaatctgggaattggttttcgggaactatttgataaatgctcttagaattccggtttaggggaatctgcgtttattgtgttctcattctgcattcgaatcaatctgttcataattgaagatatactagctatctgatttatgaaaaagttaaaaactttgatgttgagaatacaaagagacttactttatatttggattttgctgtttaatgttgatagcttttgattcttgaatgcttttatagaacaacttcactcacaagacaatgttgatgttgtgttataactttcgataagatttgaatgttttgcatatagtgctcaatgtctcatgatgactcttgtgttgatagctgattttaacaactttgtttagtggtggaaacttatgattttttttttatgttaaccaattttgacagagtcataggagtaataaactgagtgaccgggaacttattcaaataatctgcaagaatctgttctatgggaaaataacctacttacactcggataaaggaccagaaatgtcaccaaccatgacagcaaatgaaaacacacttcttattcgtaagataccaattgctaataccaggtatgttttcaatttccaatctttggtgttccagtgtatgtttctgttacatcaatttctgttacatagtgtggtccatctcatagccgatacacactgtcatagtctttgtgcattgaattaattgaaataaactatagtgtctgtggcaaatgttactatatttgtgtcatttcttttaaccacttgaatcccctgagatctttgtgccccttcatatgatttatgaaatccatttgaattccatggttaaggtttgtattcattggagatgctgtcgtcttaaaggatccaaacgattcagataagtatctggtaagaagattagcagctgtagaaggattcgaaatggtatcgggtgatgaaaaagaggagccttttgttcttgagaagaatcagtgttgggtaacagctgaaaaccaggagctcaaagctaaggtacatacataactaaatgatcttatgcaaaaacccaactatatagtctatagtctctttctgttcactttatccttacatgtgtgtttttaacaggaagcatatgatagtagaacatttggtccagtttcaacagcagacattgttggaagagctatatactgtctgagaacagccgtcgatcacggacctgttcgaaacaggttaaacataatcttgtctcttaaatttgcatttcagtaatcttgttttgtttttgcttactctaatagttcccttcgatttcagccaaactgcaatgggacaagattctccaatcctggccgtggaattggacgtggacgagatggctaagaaccataaggcatagagagacgcactttcttgtgtttgtttattattgtcaaagctaaaattgccttctttgattgagatttgagaaaacaataaatcattacaacaatgaaactaaaatcctaaattacactttccaaaacaatcttgaaaccagttttgtttgtaccttgaaatatatatttttgcaccaaatcttgatgtagcataaaaattattataatttttaggtaatttttcaaaagaaagtgaaaaaaagtggtggtccaggagagatcgaaccagcgggccatagtggatctgagagacttcgaactatgatccatccactgctgtaagagggaagtagtcgctgctctgtgaaaccagcctcacgcattaccctccgactttagaatccgcctgagtcaagccttcgcctgacccacacagattactcacagcttggactgggcagctcagatatatgtcagcatcaggtccgacccgaggaattgaaccactgttccaccaccttattgtccccactcgggtcacaagctctcgttacttagctcgacttacagttgttgtgttcttctgatatataaacaaacgcaaaactgctgagttttccgatgtgggacaaaaaactgtcatttgttttgatttatcaatttacttttacgtgggctaaacctttcaggcccattatagactgatgaaaagccctatttaacgcaaagagctctaaaaatatgaagagacagtttttgagataggagaggggaaagcaaatgcaagaagaagaagaagtgtctctatgtgctctgtctgaatctgttaacggcgttttcaggaactttgcagctgacttctgactacgttcctgataaattcttagtcttcctctctctctcatagtcagaattgtttagtatctctgttttcgggcatcgtgttagaataatttggataagctttctatctgtttggaatagcttgccgttttgttattgttgtccaccacttgttcgatgaaatgactgtgtgaaggttttaattgcttttcgacggtgttatttgcctctctatggataacgaagttgcatttcttgtcaaatttcaatccaaaacaaaaatttgcatttttgcttatgttaaattttcagaacccagtaagattatgttgcgaaaaatcaggactgttttagctacctagattatgttaggtatatactatgaaaggtttaatctttgcataaatttggtgtgttaggcattactttctgtgacatttgatcagatatctaagaaacattgagaatttggttgaacacatttgtgccctgaagatgtttacgaagctatttcggtgtaggacttacttaattttctttagttcacgcgtaattccttaggcattggctctgtgagttaaggttttgaatatgttagaagttggatccgaggtaaagactgctgtgtgctttagttcatcacattattcagcattaagggtcagattttcaattatgcatcgcgtcattagaaagtgaaaagattttatactttatg

SEQ ID NO: 30028 - DNA, 3003 bp, Unknown; identical to SEQ ID NO: 17112
  misc_feature (1)..( 3003): 2750-1469P.txt file - cDNA_ID_3025011; gDNA_ID_2214548; Annot_ID_185498

SEQ ID NO: 30029 - DNA, 3003 bp, Unknown
  misc_feature (1)..( 3003): 2750-1469P.txt file - cDNA_ID_3025066; gDNA_ID_2214549; Annot_ID_185527
ttctcaccacgttttgtatctttccttttttgttttggtttaaagcaatatgagaattttacatgctttaggtgttttttttttctttttacagcaagaaaaaatgaagagtacaacccaaagtttacagagtaatggtacaacaattaccagacgaattatcttcttacagcttggttaaatcaattgctaaagcacaaactaatggcgtgtatatatattgcatatttagccaaatagtaagcttgaagattctaagactttcaaagtaatcccttgctgagttgctattatgctgtatatgtacaatagtatataataattaaaactttaacgaagacaaactcatgtgaaaatgtaataatcagaagacaaaatataagttaataatatgtcatatatataataatagaaatatatgttcttttcgaattaaaattaaaaggtcttaattttttacaattgcaaaaactttaaactgaaaaaatgatttaatcttctggaatgtacattatataatatccgccaccctacttgctacccctagctaaaagccaaaccgatggaagactcgcttgcattaaattatgcactagcttaatctacttttaaactctcttataatacatttaattcctaatttctatcgccattttatatttttactgatatcaatattcgaagggtccatgcctatgattccatgtcatacataatatttcctttcatacctacattcattttaatgaaaaccttaaatatatatccaaaagctatacatttatgtaaactaaactggtataataatttttgaaatatgtgtatgtctactgatttactatttgattagttcgtagtaaatatattataaattgtttaaacataaaaacaaaaaaaatcatgtaactagataattttcttgacgaagattcgaattaacaacacaaaaaagttcattttctgatatcgcaatggtctaattaatggttgttgaatagtttatcttttccacgtttcataagcttttttggtacgcgacatccatattgaaaaatgtctgtctacactgagctcaatccaatgaaatttgttgtgaatgagatatatgcattcacggatttctaaaaaatatgaagtccatgacatccattgaaacatttgacaaaataaaaatataaaatatgaagtcattacaacgtagagtaaggtttctaaaaaccccactctcgtttcgtagaagccccactaccacctcactttaatttcattcattatctcatttacgttgatactttaaattcatttttccatataaacttgtaagtatgaaatttgtacttagtatatattttatctatctttccatgatgaacttaaatatattacagtttgcctagcctttttagctcagctatatatatatatatatatgctaatgttgttacgatgtttattgttttgtgtctatatcttatttacttttttgaattattaataaaatggaacaattatacatatagattatagatacatatatctaaatataatatattgtatctatatatattaatacaaattttaaagaactggcgggtttctaaattctaacatatgtactgtaagttcagcttcttactaagtcataggaacatggagagcgttggcaaaatcatggtcagtttgttttgcattcataattgaagacatagtagtatcatgcaatgaagatatggtgggccaaatatatcataaaaaaaatagcgaaacaataagagaacgttcgtgaagctgaagcatatgaaaaacacgtaaatatatttatgacgagtgacatagtaagcatacgtgatattattatttaattagtaatataggccaccaatcagaattctttgtctcaacgatgaataaattaactataataatccaaatttttaacattgttttaagaatatccgttattcaattagtctacctataacaatgaattattatggatcctttatcgctatgccttgatcaggagaattagattagttacactttcgcaatttttgtagcgatggattggaacaaaaaccaaaacaaaatatagactatttacacataaattatacatgaaatcaacttaatttgttattctctaaagtttagattgtctttataaaataccaatcatatacctaactaaaactaatgaatctttaacgtgcatgagatggtgcatgtgcaaataaaactataaagaaaaccatgatatattttttctaagaatgatagtttttgggaattttagactttcggtctatatttttcgtatgtccacaccaattgttgatattgcatttaaaacattaattattattttttccaagtataattgaactagtaaccatgaggtccatgacatccatttgaaagatgtcaattcgtaatattgtttcaaaatattttttcgtttataatacataaactttaatttttcctgtaaaagatatcaactgttcttttcatttgtgttacaacccaataattattaaatatttgaaactttagtatttagaaaaaatacataaaactaatagatagatattttattttattttgaaacaaaaagctagaaatggagagtgagagaaaggtccaaaggcacggctaagaaaacaaaaccgtggacaccctgtcctcaatttgacaagtctttgtctcctccttaactctcttcttctctctctttgtcttattctagtttggtctcaactcccaaaaacgatgacgtttcattcctatatagtcgtcctctcttcttcttctcctcctcttatctctactcaacaccactcaatttcatctctctttttcccttccattgttagtataaaaaccaagcaaacccttaatcacttttcatcatcatatatcaccttaatccacatgcatacacatatctagtctttttgatatatggcaattgtatcctccacaacaagcatcattcccatg

SEQ ID NO: 30030 - DNA, 3003 bp, Unknown; identical to SEQ ID NO: 26266
  misc_feature (1)..( 3003): 2750-1469P.txt file - cDNA_ID_3025078; gDNA_ID_2214549; Annot_ID_185521

SEQ ID NO: 30031 - DNA, 3003 bp, Unknown; identical to SEQ ID NO: 25892
  misc_feature (1)..( 3003): 2750-1469P.txt file - cDNA_ID_3025082; gDNA_ID_2214549; Annot_ID_185520

SEQ ID NO: 30032 - DNA, 3003 bp, Unknown
  misc_feature (1)..( 3003): 2750-1469P.txt file - cDNA_ID_3025086; gDNA_ID_2214549; Annot_ID_185519
cagagagagaaatagagttccttcttcgatgagaaaactcgcgacggagtaatcagagattcgtaatccgtcggaagaaacttctcccatacgatatctgatttcaccgccgattcgaagatcttcgaaaccgcagcagcgacgcaagcgtcttcaggacttgtgaaagagattatgtttgaaatgcatccctcaggcaacgaatcgagagtagaagagacgatcttttttctgctttcgcttcgatttttctcaatcagtgtccgtagccgtatcatcgtctccgtcgatgcccctgatttgtgaacaatgagcgcgtctacttcccgctcctttgtattttggggtcatatgggccttttacaatagagaagcccataaaagagagccgttgatttgggctttccggcaaacactcgtaagaaccttgtgagtgatcaaaacactatctttcttctcaatatactgaaatcgttcatgtgagaattatgaacattataacatcaaaaatccaaattcagaaacattactatccacaaattagaggccaagatatacaacacagttatttaacttggtttgacatctatactgaaaccaaaacataacccgaatcatccaaccgttcttccacgggaagccggtttacataaacataccatgataccaacatcctccacttgaaagaacacggttggaacttaacttttgttgttcaccacataaaacctaacataaccaatcaatacaataaacaaccgaatatacttttatgaatttgaatttacctcttcggtcttcactccaccaataataccaatagatgagccgataatcgggttgttccgccgcattacttcagaggattttagcaggtcggatttcaattccttgaatgatcaagccacacttccgattgagctgcttagtctctaaagcactcatctcaatttcatcattatccattattcctccatcattgaagaactccccaagctcaatctccatccacccatcttctctctgcttaggtttcacaacgttcctccttcccctccttatagcttcactaaagcatattaatcttctagaaggctcctgtcccaccactcctaccgcagcttctatggccacattctgaaagccataacatttatccactcccttgaacacaatataagccgagtaacgagttcttggagataatacacgagtattcgttctgccacgaatctcgaaccaacatacatcgcgaagtttcgctactttttcaaaccttcataacacagggcaacaattgtccatcatcatcccaacgagtcattacaaccaaactaacgcaaagataatgaaaattagagtacctagattcaggaattggaatccattgccaatactgaggattatctccccatatgattgagaggttcatcgcagataacatcagacacctcttcccactcgctttctctaaccatacgctctttgatttccaaaataatcaaaatgattcaatagcagcaaacttcaaaattacaccaaaatagagatacaaattgcaactttaaggcgatgagatgagacagatcattcattattcataaattttgctacctttttgtcatcgtcgaatagaacaggatcgttacagagagagaaatagagctccttcttcgatgagaaaactcgcgatggaggaatcagagattcataatccgccggaagaaacttctcccatataatatctgacttcaccgtcgattcaaacgttttcgaaaccgtagcagcgacgcacgcatcgcgtggatttgtaaaagagattatgtaggagatgcaatcttccggaaatgaatcgaacggagacgactccgatttaactctgcgttttctccccatcgatcgacgcttgtatcttcgtcttcgtcttccacggaagctagtgtaaaatctcaagtcgttctattaatttacgaaagtacccctaaggattacgaaaatttcaagtcgttctacatattgacgaaaatagccctgatttgtgaacaatccacgcgtctacttcacgctccattgtttttttttggtcattattgtggattcgttggttaaggatttggttttgaaaatatccaaattccaaactaacaaaccaattaaaaaaaggtcaagtcaggtatgcattatggatcaacggtgggaatattatttgttttgaatttttataatatagtctgactcgttattccagaaaagtaaagcttaagctaacgaatacgaaagaaaaaattgataaaaaatgaaattaagtaaaagcaaacaatctatttttcatttgaattaaagaaaaaaaacaaacacaaaacacgcttctcttgttgagaagctagcaaaacaacactaaacctgaaacaaacgtaaatccgccgcaacaacccagttttttccgacggcgtacaagcttcctccgccgtaacgccgtcgtttaataccaagaagcttgattaggtttccgtagtgtgtgatttgtgagattcgttaaaccctagctctactactttataattcctgtgatgatctttagctagattgagagatcgaagtgatttgattactctagtgatgtatttgatcgtttgattttgggtttgaattttcccctttttagacgtaatcggaaatttctatgttcggagagttttgattctttctgtaattaactttactttttcgttatcgtttacttgtatgtaatctctttgtgtgtctttcaagttgctgaagttttttcaatactttgatttttaagctaagcatctttatcatctctctgtttatctattgatatagctatgttctagggtttgtttccattatccttgatcggttttggttggtttaatgtatagaacagtgattttttcctgttttgatggcttacaaatagtgattttatgtctctgatattgaattttggcttcagttttaaggttctgaacactgatg

SEQ ID NO: 30033 - DNA, 3000 bp, Unknown; identical to SEQ ID NO: 12421
  misc_feature (1)..( 3000): 2750-1469P.txt file - cDNA_ID_3025107; gDNA_ID_2214549; Annot_ID_185509

SEQ ID NO: 30034 - DNA, 3000 bp, Unknown; identical to SEQ ID NO: 12422
  misc_feature (1)..( 3000): 2750-1469P.txt file - cDNA_ID_3025110; gDNA_ID_2214549; Annot_ID_185507

SEQ ID NO: 30035 - DNA, 3000 bp, Unknown; identical to SEQ ID NO: 12429
  misc_feature (1)..( 3000): 2750-1469P.txt file - cDNA_ID_3025126; gDNA_ID_2214550; Annot_ID_185548

SEQ ID NO: 30036 - DNA, 3003 bp, Unknown; identical to SEQ ID NO: 26268
  misc_feature (1)..( 3003): 2750-1469P.txt file - cDNA_ID_3025134; gDNA_ID_2214550; Annot_ID_185539

SEQ ID NO: 30037 - DNA, 3003 bp, Unknown
  misc_feature (1)..( 3003): 2750-1469P.txt file - cDNA_ID_3025140; gDNA_ID_2214550; Annot_ID_185537
gtttgttcttagaatttgctggaaaatatttatttttttgttcgttttagatcagtttggtttctctagggtttaggcttgatgggtgtgattgattgtttttgattatggtgtaaagattcaaaactgagtggtttttgtttttgttttggttacaggtttgacattggcaccactcgttgtgagagtaaatccaaatttgaatgttattctcacagcatgtatcactgtttatgtgggttgctttcgttcggtcaaggatactcctccaacggtaagacaaagacgcaatcagattgtttttttttattagtgaaacaattttccaaattcgatctaaattgtttctttggtttgaaatggtgtaggagacgatgtcaaaagaacatgccatgcgtttcccattggttgggagtgctatgcttctctcacttttcttattgttcaagtttctctcaaaggacttggttaatgctgtgctaacagcttacttctttgttcttgggattgtcgctctttcgtatgtcttatctaaatcatgccttttgtttttttatttgtttatctgtggtcaagtcatgacacggttatgtgtgtttgcagagcgacattgttaccagccatcagaagatttttaccaaatccttggaatgacaatcttatcgtctggcgttttccttatttcaagtgtacgtaactaagattaccttcagtattctttggtagccatttttctcattatataagttatgggtttgtttgttatcgtttgcttagtgctagtctttgaatacttatttggttgatgtaatgatcattcaagatcctaggtgtttgtctcattttcaaatctgtttttacttttcttactctatccagttattgttctatccttctggttgagatgtgcttattttctttgatgtctaacacctttttactaaacagctttggaggtagagttcacaaagtcccaagttgttgcgggaatccctggaacattcttctgtgcgtggtatgcgtggaaaaaacattggctggctaacaatatcctcggcctttccttctgcattcaggttacttcccttgcactttatgggaatacataaactctgaagcttcactgttataacataatatttaagtttaaagtgaactggagtcactgttgttgagtgtctctttttttactaattaatgccgttgccaatacagggaattgagatgctctctctcggatcattcaagactggtgccatccttttggtaagaactgcatcttttgaatgctattcttgaaaacttgtttggacttctagatgaaaagaaaattcgtttgaaaatgactcaatcattcggtgtttgttatgcttgacttgcaggcaggactatttttctatgatatcttctgggttttctttactccagttatggttagtgttgccaaatccttcgatgctccaattaaggttagtaaaaatgcctcaaaagtacacaccataccaaattgattctgatttgttcttagtcaatttttcagtaatctcattgttacatatttctttcagctcttattccctacgggtgatgctctaagaccctattctatgcttggtcttggtgacattgtcattccgggtatgttctctaatgcttaacccaatagctatattcagcttatggttatgcattcttgaatcatatttttggatatgatatgaatataagatattaatttttgttttcctttaggtattttcgttgcactagctctaagatttgatgtgtcaagacgtagacaaccacaatacttcacaagtgcatttatcggatacgctgttggtgtgatcctcacgattgtagtcatgaactggtttcaagcagcacaggtcagtttttgtgtcttaattgttgtcatctatttattgcaaccttattttgggatttctctctgataggtttttgtttttgttttgcctttgtttcagcctgctttgttatacattgtcccagccgtaattgggttcttggcttctcactgcatttggaacggtgacatcaaaccggtttgttttctagtccttctagatttcgatgtatctattgttgtaaacgcaattatgcaacccaaacagaagaaccttcctgttaccttctgtttgcttatcgtgtttttggttgtagattaagatgtaaaggattagtgagcttatggtcttcttcttcttctttgttttgttgctgttgcagttgttggcgtttgatgaatcaaagacagaggaagcaacgactgatgaatcaaagactagtgaggaggttaataaagctcatgatgaatgaggaaaaatcgagaaagaagggcagaggagaaatatatacacataaatgtgtcttaatatatggaacaagaaggaaaacaattttgtttccaaatgatcatcaatcagtcccttctaaccccttttttgtttttttagattttcaaactttcttttggccaagacttgtgtaagttactataagttacaacaaattttctttgacttttctttctgttttatgttaaattcgttaggagactggaagttatatatcatttcgaacagaattcgaaatatgagctttttagctattgtagacaacgtggtaaggatatgaacagtgagaggcaaagaatagcacatgatgatgataaagttatgaacataatctgtgctgagaaagggacatttttgcttggggagctatttggagacaaaaaaaagctagatagaaactctacacttaatgttttttttttttttttttctgacatctagtacaattattgcttggagagcaagttgtgtgtttaataatatataacgtatatgtaagttgaataaaaatgtagagaaaaatcttaatgttaaaaaaaaagagagtaggtttggggtttaagtttgtgattaggtctagagctaaagccaaggaacaagcacgtatcaaagatcaaacaaaatg

SEQ ID NO: 30038 - DNA, 3003 bp, Unknown
  misc_feature (1)..( 3003): 2750-1469P.txt file - cDNA_ID_3025213; gDNA_ID_2214551; Annot_ID_185570
attcaagagtagagtgacacgaagctatgatgcatttattcatagagggagagatagaacatctggtgtttcctggattgaagtcttatattgtgcccgtttgggatttgtaagtgtagttgtcgctaggaaatatatttgttgatgctaaggtcatacagtcgtatagataatgctactgttaaacgagtcttgagttgtgtatttgagatttccattaccgactgagacgattggtgtgttaactttctctctctttccttccttttatgcaggaggacttatcaaatctttgatatggcacttagggtccacaagaacatacaacagagagacatggttattggtcggaatcttggaaactggattctccgggggcttgaccggatgaagccatcggctcaggttctactaccaaagaatacagagccaagcatagacaaggcgaaaagagtattacaatcaacccgtcttaaaccacatgttaacacgcagactcctcagaaccgtgaggttgataggaacttgttcatgtccttgaggaactttcggtccaaataccccattgcttcgatgatgatgatcaaacctccaagatccacgggaactactactcagtacaggccttacagtgttggtgaatccagtctgattaaaccaatttatgctagaggcgggttcaacagcgtcatcaggaaggacattttgcagtggatggtgcagaagagataaagccgccaaaattcatcaaaggcccttctgtttcttagattacaacatactcagaaggaaacacttgtctcaaccgtatcactttgtatgagtttttaataaccggtggattgataggaaaatctcctggacaactaaaaattgtgactagtattacttacttgactaacacgtctatctgttcttcttcttcttctaattacaaccaggaatgtcttctgagagattttgggttctataatcaataacaaaacaatcaggtttacttttcgggttttcactctcgattggatccaattggcctatagactgactcgttgtctcatatcagtcctccaattttgctgaatcattctttttagttttttactactgaccgaaactgaacttatctaatttcgtgacagacaaatgagtacataattaaaatttaagattaggcccaataatctgcattcagcattattctgaagatgtctctactgtagtggttacggtttttacatgaagcctgctatatatatactttatcaaatatttcagagctcaagcagagagcttccttctctggcaagcacgaaaaggccaccatctcctctagaaatcctgagatccttgtcgagataagtggtcaagagccaagagctgcctcggtttcctggaaacggaagcttgagaggtggctgaccagagagtgcccgtgaaatgtttgctgccacatcttgtaaggggttcaaagactgctttaacaacgaaaggctaatctgctgcccaaagacgcccacactctctgggagatctacacttgatttgatcaccgggggttttagcgtgccttctttgaaagaaacctgacatttaccaaacattaagacaaccagatggtgataccaatacaaattcaatctacaaagaaacctttttaacatagctttgttttaatggtaaggtttgattgactggaatgtaatcaaaagtacaaactgttaatgcttcagtgaccttaatactcaaactggtgtttgtaagtttagttacctcaattcttgaagggcttcgaacttcaaatgaagcagtagcactgaaggagaagtctgcaaaagggctggagagtgtagtggagttgtcgataatgagattgtttgtgtctattgactgacttatgcttttaactttcaacaaaggtgtcgaacccgcagctagtagaggaatcaactcagagaaagcagtgtacctatttcataacccaagaaaatacacaaaattggaacaacagtaacaattcctggattattatcattcttcatcaaagatttcacaatgtctcattctcaattcacagtgttgaaattctcagcgacaactaaaggttcctacatcatcgaaacaagatcatttaacttacagcaaaacccagttgccgtcgagaagttctggattctctaacggagccggagtaggattcagagcttccagttgattcacaagctccaaaacctccgctcggacttctgacccagctttgaaacctaattcagttccgtacaccgaatccgccaaacaccttttcagctcccaagtcgggtcagacaccgcacttccatttccagcgtcggcttcagtttctcctccaatttctcctccccactcgtcttcgttccttggaggatccgattccataaaccgggtcccggattcctcaagttcgggtccggatttctcgccccattcgtccgtaatcacattcacggtcacattatctggctgagagtcgggctcatttgcatctccaggtttctcaccccattcatctgtaactgcagacgcatctaggtcggattccgattcagattccgagggcagagaagatcggattttagaaaaccggagtggcttgggacgataaccaaaagagaaagagagagagttaagttttagggagatagaaggagagaaggtcttgcttggatttatggaggaaacatagaggagtgaagaaggacgagcgacggtgaagagcgtagccatggccgatctttgtgttcgagcttggtgagaaaatttcggaaaacaagattactcaagtcttagaaaatcacacgaaatttagatgaccccagaaaaaacgcaattttaaaacttcaaaaaaaaaaaaactttaaactaatgggcctgacccaggcccattataacgatttgtattcgtctctttcccttatccccgtagtgatactttgtctgagtgagtgagtttgaaatcaatcatcaatg

SEQ ID NO: 30039 - DNA, 3000 bp, Unknown; identical to SEQ ID NO: 12439
  misc_feature (1)..( 3000): 2750-1469P.txt file - cDNA_ID_3025217; gDNA_ID_2214551; Annot_ID_185569

SEQ ID NO: 30040 - DNA, 3003 bp, Unknown; identical to SEQ ID NO: 26271
  misc_feature (1)..( 3003): 2750-1469P.txt file - cDNA_ID_3025237; gDNA_ID_2214551; Annot_ID_185555

SEQ ID NO: 30041 - DNA, 302 bp, Unknown; identical to SEQ ID NO: 12432
  misc_feature (1)..( 302): 2750-1469P.txt file - cDNA_ID_3025241; gDNA_ID_2214551; Annot_ID_134665

SEQ ID NO: 30042 - DNA, 3000 bp, Unknown; identical to SEQ ID NO: 12447
  misc_feature (1)..( 3000): 2750-1469P.txt file - cDNA_ID_3025245; gDNA_ID_2214552; Annot_ID_185593

SEQ ID NO: 30043 - DNA, 3000 bp, Unknown; identical to SEQ ID NO: 12453
  misc_feature (1)..( 3000): 2750-1469P.txt file - cDNA_ID_3025259; gDNA_ID_2214552; Annot_ID_185609

SEQ ID NO: 30044 - DNA, 3000 bp, Unknown; identical to SEQ ID NO: 12460
  misc_feature (1)..( 3000): 2750-1469P.txt file - cDNA_ID_3025263; gDNA_ID_2214552; Annot_ID_185606

SEQ ID NO: 30045 - DNA, 3 bp, Unknown
  misc_feature (1)..( 3): 2750-1469P.txt file - cDNA_ID_3025263; gDNA_ID_1563873; Annot_ID_148440
agg

SEQ ID NO: 30046 - DNA, 3003 bp, Unknown
  misc_feature (1)..( 3003): 2750-1469P.txt file - cDNA_ID_3025271; gDNA_ID_2214552; Annot_ID_185604
attacatatggagctattgttaataatcaagatttcctcgtacatgtgtccttaatatttgttcaggcacctaaatgaatcaaagattgaattgaattagagagctaattagagatttttaaggaatgtaaaagatttacaaatctgtttttttaattctaaagatttttaaagaattatttgggtagaaattaattacaaacccaaaacagaaagcatcattgtcttttttaccaaaaaaaaagcatcatcgtctctaatatatgaaaccaatagtcaatgacccatcaccattgttgatcgattccttattattgttaggtttcagtttcttaatctcactccagttaatcacaaactccctgattcaacctctctttgcttctaccattggttgtcctttttccaccactaattctctggccaaagtcttgatgtttccccagagatgtcaccggtataacactccagtttcaggaatatagtgatgcatgcgaagaattttaaaagaatcaatttggtcattggtgtcactaaaatacatttatcttttcgggtgtcactaaaatgcatttatcttttcggtcaaatgttctcaaaaatactctgaagttaaacgtgtttgagctggaataatttttaggtgagcgaccttccgaaaaataattattgtccaaaaaagaaatatgtacatcaaagagtgtaaaagatttatcatgtcatgttactatattagcagaagatagtgtgttctttttaaaaatttattatcatgtcaaaatttctccatatacgggaatgcatcgggacaatttgtaagtttcaatttgcactgttatttttagcgctaataattccgacgaatattgatgtcactaagaatagtatcatacaataaatgagtagatattttatcagttaccattatctaaagtacccataaatgatgctaaacttttttttctttttcctacttttacgtcgtttataactgatgtaatttaattgatgccagatcctctttttcgagattccttgaacctcataattctatatatttcccaaattttcagatttatcaactaaaactactctacatattaagaaaacaaagaagaaaaatagctatggccaaggcagcttctacacttgtttttcccatcattttccttgttatgttcgccttaagtacgcattttatctttagaattattcgtcaaaatattcaatcatcttcttttcttcttataaacatagtttttattgtagctatattaattgggttataccctatatgatgtaatccattgctatctttttcttaagtgtacatttaatttcgggctttcttcattgacatatactcttagggttatattagttccttgctatgatttctttatctcaagctttttttcttcaaaaattttatattcacaatattcattggcatatgccctaaatgttgtagtccattgtgattttagccatgcataaagtatcgtttgtatcaatggtttgctcataccaatatcttaaaagttttcacatatgatctactataatttgtagcgtcggctctattcattagcatgtagcagaaatattgtaattcagtgtaatgacatctcctaagttctagtaaatattttgttatctaaatatagaacggttttgttggttatagttgaacaaaatatgggatgcatggcggttcttggctcgtgtggtgtcattacagattgcagtgggtcatgcaagactaagtttggacaagatgctagtggcgattgtgaccgtgacggtggtcaaggaacatgtatgtgtggttatccttgtccacatgataagctacatatgtgagatctacaatactttgaaatctatatttcttcaaaatgtattaagtagaaatcaaaattgaaaaaaaaataaaatcaaaacagtttgtgctatggtctctcataatctttcagatggaacttttgatatcaatgaatgttagataacataacaaaatgcttgagaactgaaagccaaaattgggagtataatccggataaataaacgaatctgatctgaactaaatcaaaacaaaatactcaatctgaaaagtaaaaacgaaccatatatcttaatctaacttatatgattttttttttctatatccgaaaacccaagtcggaaaaataacgatattataccgaagtttttcaaaaatttcaaaaattaagcttatattttgactaaaatatgaatccgaacataaattttagtttgaataccattattcattttatataaagaatcggacaacttgaactgaactctagaacacccctagctaaaatgcatctttacattctttatgtttttggacaaaaaaatgcatctctcgctctcggacaaatgatgcaagaaatacttgtagtagtactctttttggatccattattgcaaacttaatctcgagtaaaatgaaattattgataagattttctctaacgtttcaagatcttgtctataataattatacgttaaattattacgattattttaaagtgtttgacggttttagaagctaagtcaaagtttaacatttggattcgaaggaaaggaacatattttctgaattttacaagaaacagaaaggaatattttctattttcaactctactactaatatacaaatacaactatataataagattcattgttgatcatgtgattaatcaacaaagctactgttgcgcaattaatattcgaatctctaaactcatgtgatttaaaccaagattaaaaactatatattataaaatttaattatttgttacctaactttaaacatattttgtcttaaatccaaatttaattagcttgttcacaaggaaatgcctcaaaagaggaaagacgattgattcatctcaaccttctcgtcttctttcggacaacaatgtcacaaaaagtctgatcctttctctttagatttggcttcgagaaatg

SEQ ID NO: 30047 - DNA, 3003 bp, Unknown
  misc_feature (1)..( 3003): 2750-1469P.txt file - cDNA_ID_3025283; gDNA_ID_2214552; Annot_ID_185601
ttatgactaagagctcaactctcccaccaatgatcaatgctatggaagcttaccaaattatagagttctcagatgcagaaactaatccagaggatggttagtcaatcttcactactaatgaattttcgcgatatttttatatgtttcggtatatttattttggttttatttgcagtcgttgcggtccagaatattagagctgcttatgaattgagtagaatagactggcaaggagatccgtgtgttcctcggttgttcaaatgggaggggataaattgcagctacacaaatacttctattccaccaagaatcatttccttgtaagactatttaataacagatttgattactattaaaaatcagtgtttaaatctctaaaattgtgtgttatgttcttataaccagagacttatcatcaagtggactaaatggggtcatagcacctagcatacaaaatctaacacatcttcaagaactgtgagacaacaatatatatccttttaaactgcatttattttgttagaaccttttatatttattattaattgttatcgtaatcgattgatagggacttatcgaataacaatctaactggaggagtgcctgaatttctagccaacatggaatcattgttgatcatgtgagtttatttcatggtaaacaataagtgatcatgatttcttgcaccagatttatggatgatgtttatatatatcataatgttcttatctgttttgacagaaacttaggttggaatagcttaaccggtccaattcctcgagcccttcacaatagagaaaagaaagggctaaaattggtgtaagatttctccttaatggttttttttgttcgtgatgattttgcgtattcaataacattcttgttctatagtgttcaaggaaacccaaatctatgtctctctggctcatgcaagaacacgaaagtcctagtgccggtttttgcgtctcttgcttcattggcggctcttatcgctttgttggctctcatttttgttttgagaaggaaaaagcccgtatcaaaaggtataaataaatagattcatcaatcaagaagtacataagggcttaatactctgtaaagttcatggtatgtagtaatggcattacttatatggcctttccatatacagttgctacacgggagttaccaagaaagtcatcaatctttgccaaaaagaaaaagttcacttattcggaagtcgttgagcttacgaataacttcagaagagttcttggagaaggaggcttcggagttgtctaccatggttctttgagtgataccgaacaagtagcggttaaagttctttccgagtcatccgttcaaggctataaggaatttaaggcagaggtatgtcaatattttgcactagttaactgaaaaaaaaacttgctggtattgagagtttaatataatatgaaatggacccaaaaggtggagcttcttctaagagttcatcacataaacttggtaagccttgttggttactgtgatgaaggaggccatttagcacttatatatgagtacatggctaatggagaccttaaacaacatctatcaggtaattaaacactaattatacttgacatgtctttattcgtctttgaatcaattaataatgtctttaacttgttataaggatttagcatttttatttacaggagaatcttctggacctactttgaaatgggctagtagactcaaaattgctatcgaggcggcacaaggtttaatcttgctaactttaacatttccagtcacctttttataacattgtgatgacattataaagttcttcaacttcatatatcttccaatccctttttggcctaccaactttgctataatcactcactcaacatggatacaattttttaacaataggtttagagtatttgcatgttgggtgtgagccaccaatggttcatagagatgtcaaaagtacgaacatactattagataatcgtttcgaagcaaactcgcggattttggactttcaagatcgttttctgtcggagctgaaactcaagtggcaacggttgttgcaggaacacccggatatcttgatcctgagtaagttctctaattcatagacagctacataatgtaacttgaacttgtttttttccttcattaagttccataaacttcaacttcttgcagatattacctaacaaattggttaaacgagaagagcgacgtctacagtttcggaatagtactcatcgaaatcatcacaaaccgatcagtgattgaactaacccgagaaaaagctcatatagcagaatgggtaaagattcttataagcagaggagacatcgaaaaaatcgtcgacacaaaccttaatggagattacgactcaaacacagtctggaggattcttgaactagcaatgtcatgcgtaagccactcttcatcagatagaccaaccatgtccaaagttgttaatatacttaaagagtgcttgctctcagaaaatttaagaacaagacagattcatcaagataatgacgatgactcaaagaactcagacttgactttaaatttcggaactgaagtaacccctcttgcacgctagtctcttacacgaatctctttttttttttttttcaatttatgttaattatagacttctttttcttgttttttatatgaattcattctcttatatttttttttcaaatttgaacagatatatagataaaacaaaactttaaaaggaaaaaaaaacgaaaaagattttgtaattttgttttgtttttgttccatcaccattattgtcacgtgcgtggcacagaaactagaaatatataaaaatatatatatatttttttccggtggtatagatctgaatcagagaattggtaagtagtaagaaccctagctttagattcgtcagattctgattactcgaatcaaagcagggtttttgacactaaaaatccgatctcgtgaagtgtgttttgcatcgaatcggaaaatatg

SEQ ID NO: 30048 - DNA, 3003 bp, Unknown; identical to SEQ ID NO: 26276
  misc_feature (1)..( 3003): 2750-1469P.txt file - cDNA_ID_3025297; gDNA_ID_2214552; Annot_ID_185596

SEQ ID NO: 30049 - DNA, 3000 bp, Unknown; identical to SEQ ID NO: 12449
  misc_feature (1)..( 3000): 2750-1469P.txt file - cDNA_ID_3025301; gDNA_ID_2214552; Annot_ID_185595

SEQ ID NO: 30050 - DNA, 3000 bp, Unknown; identical to SEQ ID NO: 12474
  misc_feature (1)..( 3000): 2750-1469P.txt file - cDNA_ID_3025327; gDNA_ID_2214553; Annot_ID_185633

SEQ ID NO: 30051 - DNA, 3000 bp, Unknown; identical to SEQ ID NO: 12471
  misc_feature (1)..( 3000): 2750-1469P.txt file - cDNA_ID_3025329; gDNA_ID_2214553; Annot_ID_185631

SEQ ID NO: 30052 - DNA, 3000 bp, Unknown; identical to SEQ ID NO: 12469
  misc_feature (1)..( 3000): 2750-1469P.txt file - cDNA_ID_3025333; gDNA_ID_2214553; Annot_ID_185629

SEQ ID NO: 30053 - DNA, 3000 bp, Unknown; identical to SEQ ID NO: 12468
  misc_feature (1)..( 3000): 2750-1469P.txt file - cDNA_ID_3025339; gDNA_ID_2214553; Annot_ID_185625

SEQ ID NO: 30054 - DNA, 3000 bp, Unknown; identical to SEQ ID NO: 12481
  misc_feature (1)..( 3000): 2750-1469P.txt file - cDNA_ID_3025345; gDNA_ID_2214553; Annot_ID_185620

SEQ ID NO: 30055 - DNA, 3003 bp, Unknown
  misc_feature (1)..( 3003): 2750-1469P.txt file - cDNA_ID_3025428; gDNA_ID_2214555; Annot_ID_185699
tggaaaaatctaaggagactaagatcgcggctccactgtcctccaagaaggctgaatcaaggactgttcctgaggcttgtaatgtaaaatgtgaagacgcaaacgcagaaatgaagatggctgagggaagcctaaacgcattaagaacagaaaaaggatcagttgagagcaattctaatcttcaagaagaatcaaacggtgagattattaaaccttgtgaagctaaggagaatagagaacagcctgcaaagaagagctttacagaagaggaagctgctagaattatccaatctatgtaccgtggatatgacgtgagaagatgggagccaattaagaaattgaaggagatagccactgtccgtgagcagatgggagatgttaaaaagcgtattgaggcgctagaagcttctactgatcagcacattgaagagaaggagattgttgttaatggagaactggtgatgaaccttcttttgaaattggatgctgtcgaggtaatgcatgaaagactaatttcattggttggccgagatagtttatctcagtatgtactgctgtgtaggatttttgctgacagtttcctatactgatgtttatcttccagggattgcatcctagtataagagagttcaggaaagctttggccacagagctctcaagcattcaagacaagcttgactccttgaaaaatagttgcgccagtgcagagaaagaggctgtaaaggaacaagtggaaattaaatctcagcctagtgactctccagtgaacttggagcactcccagctcacagaagagaacaaaatggtatctgacacgaatttagagaaggtacttcgtctgtctcccgaggaacatcctatgagcgtcttgaatagaacagatgaaaaacaggctgaatcggctgctgaaacagaagagggatatggattgtttgaaaccctggcaacggattctaagcaagctactgaaaatgcagcggctgcttcctcgacaacaattccagagaaaattggagaggttgagactgttgttccgggtaatccaccgtcagctgatggaaacggaatgacagtgaccaacgtagaggaaaacaaagccatggtggtggaaagtttggaggagccaataaacgaattgccgcaaatggtggaagagactgaaacaaactccatacgggacccggagaatgctagtgaagtctctgaagccgaaaccaactcatcagaaaatgaaaaccgaaaaggagaagatgatattgtattgcattcagaaaaaaatgtcgagctctcagagctacctgttggagtgattgacgaggaaacacagcctctttcgcaagatccatcgtcatcatatactcgtgaagggaatatgactgcaatggaccctaaaacagcgagccaggaggaaacagaagttgatcactcacccaacaactccaaaggcattggccaacagacttctgagccacaagatgaaaaagaacagtctccagagaccgaagtcattgtgaaagaacagcctctagagacagaagttattttgaacgaacaggctccggaaccggaaatcactgaacctgggatatcaaaagaaaccaaaaagctgatggaggagaaccagcgattcaaggaaacgatggagacgttggttaaggcaggcagagaacaactagaagtcatatcgaaattaaccagtcgggtcaaaagccttgagaagaaactgtcacataagaaaaagacacagatcagacgtcgtgcaagcaaaccaatgtccgtaagtccaaccgatgccgtattatgacccccataaacattgatatgtctcaattcctcatatattgtatccatctccatcctattgagtacagaaaagagaacgagaactcaaaaattgtcttaacgaaaatccaaatatttgcctctctgttttcttcgacgttcatggataacctccttaaacgacccattcgctctgacagattcgactaaattttgtgtcaaggcccaatatataactatataaggcccatacaatgatcaacccattagttatttcaaatgtttttattatttatttcaaatttttgctataggtgtaaatttcatgtattattactttaattacatttaaaatttgtatctttcaaatttgttatgggagaaagaaagagaatgattgtgtggtttgtgcggacatagtgatccttttcatgccataactcactcttcgttttcttctttctcatcgtcacgttaggttgtctctgagccgccaaatattcatctcttgtggtcccgttcacgtcccaacgccatttacactcatctccgtaacctctctcttatgtgctttctcattacaaacaactaaaattctcaaagattaacatgtgcaagagaaataacaagtaatgatatgatctcattctcacctaatctatggttgaaaaaaaggaaatggtgtcagtattagtcataataaagccttggagttgtagactatagcatgaaaggaccaggaatcttcaagcatggttattttctgatacgaatgatttatattttaatcgtttattaacacccatttaacctcataatgactctattagcctactctcaatccccaaatttactagcataattaactaattcaagggattatcttcacccacttgtgtgcatccatcaaaagttaatttcttatcttagaaatacatttcatctaaaccaaacaaatgatatacactctcatttctattcattagtgtcatttctacaattgtagcagtatgttaactactgtaactattgtgatccaaatatacagtaaaaggttgcacctctactgtaactattttaacaagttcgcaaaatgtacataggagaaataggttgatttccatggagaaaagaaaatagtaaaaggtgaaaaaggttcactcacacgcatcctctgtctctgagagatatatttccccttgcagtaaataaaaatctatg

SEQ ID NO: 30056 - DNA, 3000 bp, Unknown; identical to SEQ ID NO: 25910
  misc_feature (1)..( 3000): 2750-1469P.txt file - cDNA_ID_3025432; gDNA_ID_2214555; Annot_ID_185697

SEQ ID NO: 30057 - DNA, 3003 bp, Unknown; identical to SEQ ID NO: 26293
  misc_feature (1)..( 3003): 2750-1469P.txt file - cDNA_ID_3025436; gDNA_ID_2214555; Annot_ID_185695

SEQ ID NO: 30058 - DNA, 3000 bp, Unknown; identical to SEQ ID NO: 12502
  misc_feature (1)..( 3000): 2750-1469P.txt file - cDNA_ID_3025450; gDNA_ID_2214555; Annot_ID_185690

SEQ ID NO: 30059 - DNA, 3003 bp, Unknown; identical to SEQ ID NO: 26294
  misc_feature (1)..( 3003): 2750-1469P.txt file - cDNA_ID_3025457; gDNA_ID_2214555; Annot_ID_185682

SEQ ID NO: 30060 - DNA, 3000 bp, Unknown; identical to SEQ ID NO: 12508
  misc_feature (1)..( 3000): 2750-1469P.txt file - cDNA_ID_3025463; gDNA_ID_2214555; Annot_ID_185675

SEQ ID NO: 30061 - DNA, 3003 bp, Unknown; identical to SEQ ID NO: 25784
  misc_feature (1)..( 3003): 2750-1469P.txt file - cDNA_ID_3025467; gDNA_ID_2214555; Annot_ID_185674

SEQ ID NO: 30062 - DNA, 3000 bp, Unknown; identical to SEQ ID NO: 12524
  misc_feature (1)..( 3000): 2750-1469P.txt file - cDNA_ID_3025514; gDNA_ID_2214556; Annot_ID_185739

SEQ ID NO: 30063 - DNA, 3000 bp, Unknown; identical to SEQ ID NO: 12531
  misc_feature (1)..( 3000): 2750-1469P.txt file - cDNA_ID_3025559; gDNA_ID_2214557; Annot_ID_185756

SEQ ID NO: 30064 - DNA, 3000 bp, Unknown; identical to SEQ ID NO: 25915
  misc_feature (1)..( 3000): 2750-1469P.txt file - cDNA_ID_3025563; gDNA_ID_2214557; Annot_ID_185761

SEQ ID NO: 30065 - DNA, 3000 bp, Unknown; identical to SEQ ID NO: 12532
  misc_feature (1)..( 3000): 2750-1469P.txt file - cDNA_ID_3025599; gDNA_ID_2214557; Annot_ID_185754

SEQ ID NO: 30066 - DNA, 450 bp, Unknown; identical to SEQ ID NO: 12545
  misc_feature (1)..( 450): 2750-1469P.txt file - cDNA_ID_3025650; gDNA_ID_2214558; Annot_ID_185819

SEQ ID NO: 30067 - DNA, 3000 bp, Unknown; identical to SEQ ID NO: 12565
  misc_feature (1)..( 3000): 2750-1469P.txt file - cDNA_ID_3025661; gDNA_ID_2214558; Annot_ID_185809

SEQ ID NO: 30068 - DNA, 3003 bp, Unknown
  misc_feature (1)..( 3003): 2750-1469P.txt file - cDNA_ID_3025665; gDNA_ID_2214558; Annot_ID_185807
aaaggtcaccactggggaaggaaacacggaactccgcagacaaagacagtttcatatcagaatcgtccagctcgagtttttcaatgttcaatacttgaacagttgattgtttgcaaggattcctaataaaccattgtttcattgcaaagtaattctgctcgtctgtcagtacatggaaaacaaagtttttactgtcctgaaacatcaataaccaaccaagaattagaaatcagagttctatgactgcatgaaaaaaaatactaagtaaagaaaactggatttaagacgcacccttgcatgtacaaccgttgagttgatcacaacggacgatgctagtatattatcggagatgataacaaagtgaagtaatgagggatctgaaaatttctcactaatgggatcctcaagtgaatctgacttgaaatgttccacagttagtcgcattgacaagcaatgaagactcttaggcattgtctgtactgcaagctggtagaggaacacactctgtttcatgtggaaactagcttcatcctcagtcaaatcaaggatctgtctcaatttcttgtcaacattgttacagtcgactggaaaagactttgcctttgcaattacagcttccatcttctgcaactttttatcaaccctgacacaacagtgttaagagatacccagtaagtacgtttaaagaaattagcataggattctacacatcaaagcttctcttgagagagaacaaacaacatccatggcgtcctcctatcatctagtacattagtttactaaattatacattggtttaagatattgagaccgataaggcttcaaaatagtgatatttctggatgtgctgcccactggataggtgaagagagaatgttatgataaatattttctataccataaaccatctgaaagcaagtaaaccactagaaaacaggatgtccagacaaactgaaggcaaactaggagagattcatgtgactagaatccaacaaaatcttttccagtaaggaactaactttcagtacaaaaatgattaaacccaaactggtagagaacttactgtggtggaaggtcagcatcttgagaactttcactaagaatacgctcaaactcttggatattctgtttcatatcccgagtcaacttgctttgagaaggcattttagcaatactgggatagtatgctctagccacaaacagctggtccttcatttgcttcaccttggcatctttcattggttccttattttcctccctccagaggcagtagctcccatatttcacttcacaagttctccaagtttcatcaccacttactattttcctctgaacacctgtatatgaggcttccgattttgttttctgttcacagaagaaagcagagtaaggttaacgttaaatgattggtgagagatataaagatgtctactaaggaaaccacttaatatatttgtacatttgcagggcttggattggcaacaacagttggggacactggtaatcctgcagattaatggagagaccagacgtaaagtatcagaccagaatcaatataaaataatggaagaggaatttcaagaaagtgaagcttgtaaagcagacctctttttttagaatcagtgccgcttgttgcattcacatctctggaacccacgtttatgtcgcttttctagcatgtgatacaataaaacaaaacataagtatagaaattgttacaaacagtttaaccatctcacccaaggaactaattcttgaccttgcccaagacaatttgagatacattaagcaacataattcatgaaagtatttcaactttctagtctcatgagatagtcaaatataaaaaaaataaagagatcattcatctaatttctctaccctttaagcaacatcacacaaaatatacggcaactgattaactacaaccttttgacctatagtttgtttgtagtgccagtaaagtttccagattcactggctaatattagcattggcatcttgcatagctttccatgaaacgaaaaggcatctaagttttttctaatgttagcattgacatcttgcaagaatactgtggcaaacctgatacaaagcctatacatttacaaatagccctattatctgtaatcaaactacaaagcctatatattttacaccacttgaaagacaagatgtgaaacattaatgccaataattatgacagaaacatacttcaatagttgaaaattaaacatatatagaccagatctgaaatgtgtgtgtcaattagagagcagtgtgtaagataatgaagtgcttccaaccaccataaatgctttgactctatgggtacatgaaaagatctaaaatttctgtcaaaaactactaatctataacataaatggaacaggtcaaggcctttaatccacactgaaacaagtggaaccaaccttgggaagaactggattgattttttgaagaacctcatcgacccgttcggatacatctctctgcaaaaccaaagaaagaatatcaaaagcagcaaaaagattttggtataaaaaatgagaatcgaatcaatcaaaggagagtgacattacctgtgtatgcttagtagcattgattctggtaaagctctcaaactgattccaaaagaaagaagattcagaacaaaatcaaaacacaccaaaacaaacacacaaagaaacgagaaattgcttactgaagaagccggttgaacagtgacaaatcctgaaaaagtgaaaaagatgagattagatctgaaacagagatcggcagaaaaaaagcaaagagagtgttagagagagaatgataagagataccaggagagtgaaagccattgtgaagaccgagtaagaaagcaagaggaacaagcatagaaagaataacaagaaccaaaactccaatcaccagaactttccaccggcgttttcctccgccaccacctcctccaccaccgcctccgcctttcatattcccgatttagaattgaatgaaatg

SEQ ID NO: 30069 - DNA, 3000 bp, Unknown
  misc_feature (1)..( 3000): 2750-1469P.txt file - cDNA_ID_3025669; gDNA_ID_2214558; Annot_ID_185806
ggtgatcgtcataggtccaactcctcccggtacgggagtgatagccgaggcaacacctaacgcttcctcgtaacatacatccccgacaagacggtaaccaaactcacagctactatcctgcaatattataacacgtcatgcttcaatgtctaatcagaaacaagaaaacaatctgaaggaaaaacatttcaagctctaattcagtttaacgttttctatatcagattggattcaagctatggtataagtcttttttcattggaaagtattaagacttttgatcagttaaggaaaatagtttcgtttttacctcgactggagttgttccaacatcaatgacaactgctccaggcttaagccaacttccacgaactaaattaggtatacccgctgctgctataacgatatccgccttcctagtaatgtgctctggatcctttgtaaacgcatgcaccgtgcttactgtcgcgtcatgcctctatccgagaatttcagaaaacataaatgcatagttaattcccaaaccaaaatgtttaagcataagaatccacttgaactataaagaagaactaatacctgcaataataaagacattggtagtccaacgatgttgcttctgcctatgaccacagcattttttcctgctatttcaacacccgttcttatcaacaactccacacagcccttaggagtgcaagatacaaacagcggttccctccctctcattgcaagattccccacgtttaatggatgaaacccatcaacatctttctccaatctcaccatattcaagatttttgattcattaagatgctgtacaagatatcttccattaaatgattggactcatgagaaaaaaaaaaaaaaaggaaaggaaaccaacaaaatacaagaacgttctcctgaaaaagagctccacaagtaagatgctctatcgcataacctgtaaattaaatgctttacctaccaacgaaaaggaaaccttaaaggggaaaatgttatgcatgagtccatggtcgatgaaaatatatgaatcaagaatttctacatacaagtatgaaaacaaagtaaacgtaactacttgacctcctaacatagaactaatctttgacatcaacaacactaacatcccccatcacaacgtccaaagaaaaaaatgagaaacatacttggggtaaaggaagttgcacaagaattccgtgaatagacgtgtcttcattgaattttctcaatacactgataatctgtccttcagtacaatcctctggtaattcagccaaaacagatttaatgccagtttcttcacaagctttaattttgttgcgaacataagtttgcgagtctctttgttcaccaaccaaaacaacagcaagaccagggacttttccaacagcctttttcatcttccccacttcactaataatctttgttctgatttcctcagcgataacattaccatctatcaccacagtcttctgttcagtctctgtataaatgcatacacacagaaatcaactcatacaattagagaattttcttgtaacatatatatatagccatgaaaatgcaacaaagagtattaccaaaggaaacaggaggtggaggatcagagtaaggaatccaattttcaggcaagtcaagtgacacgagaggaggagacactaagatggaactaaagcaatgtacatcccttgttgccaaacgaaacgccttagtatgcgccgaggccaaagctttcctcgcgatcattaacatactcaaaactaaaagaacagtcactgattcaaatcaagcacaagaaaaaagtcaatgtaaaagtacagaccagacaagagaaccttagacaggtcagcctaagctagaataaaaccataatttgatccttttagctccatactcttcattacatccacacaaacaaataaagaggcgcataatacagtaaaaacaaacttgcaccagattgaacctaaatggattaaagatttcaccagactatcataagctttcactcagctaaaattcatcttcttcactcagctaaattcatcatacatagaattcttaacaaagaagaaatcggaaaataggaaaaaacagaggagagatttaccagtggtatataaagcgtcgtcaatggcgttgaaaaatatcgctaggcataccggagtttaggattcaacgagtgacaatataaaacgatgatgattaacaaaaaaagtaaaaagaattcaccaccgtgtgagaaaagacacgtgttatgatctggagatagatcttgcaagtgggttaaataataaacggcggagacatagccacacgtgtgaaaaaaaaagaggtgtgtgtgtgtgtgtgtatgtgtgtatgtgtgtgtatctctctctctcttcctccaagtagcaaaaagcaaaggggaaagagacgatgcgatcgggctaagtgcagaaacacttatacttgtgcattctgcaacacaacacacacacagagaattcgacgagagtatgatttgagtgtatcgagaacagagagagacattgatagagagatcgttggcaacgttttggggatccaatgcgttcgtaattgggaaagacatttcattcaattctaaatcgggaatatgaaaggcggaggcggtggtggaggaggtggtggcggaggaaaacgccggtggaaagttctggtgattggagttttggttcttgttattctttctatgcttgttcctcttgctttcttactcggtcttcacaatggctttcactctcctggtatctcttatcattctctctctaacactctctttgctttttttctgccgatctctgtttcagatctaatctcatctttttcactttttcaggatttgtcactgttcaaccggcttcttcagtaagcaatttctcgtttctttgtgtgtttgttttggtgtgttttgattttgttctgaatcttctttcttttggaatcagtttgagagctttaccagaatcaatg

SEQ ID NO: 30070 - DNA, 3003 bp, Unknown; identical to SEQ ID NO: 25918
  misc_feature (1)..( 3003): 2750-1469P.txt file - cDNA_ID_3025677; gDNA_ID_2214558; Annot_ID_185798

SEQ ID NO: 30071 - DNA, 3003 bp, Unknown
  misc_feature (1)..( 3003): 2750-1469P.txt file - cDNA_ID_3025683; gDNA_ID_2214558; Annot_ID_134823
caatttttaacggattgttaatgatataggaaactttttttttttggcaaactaaaaataccgaagatagatttgtgtccgaactgttaactaagattttgtgaaaagactcagccatttaattggttgagcttagctttttctaacacgcagaagtatgtagtgagaacagttgtgacgaatctatcaaggatcaatcaagatcaatcacaattctacttatgtaaactatatattctgtaattagaagtctctagaacatctagtctgtatataaacaatgtaaatcatctcaatacaaatcatccaattctatattctttatatggtatcagagcatcatcgatacctaaaaataaaaaacctaaaaacagccgcctctctcctttctttcttcttctcccccgttgatttttttattcctctgtttttcaaacttcaaccatgtcgaatgtttcttctgaaaccgtcaacctcaacaacacctccattgttcacatgaacatgtcgaatgtgacaaaacttacggcctccaattacataatgtggagccgccaagtccacgctctccttcacggctacggtctcactcaataccttgatgcgacaaaagctgctccagctcgtgagattaccgtcaacgacgttgcctctgtgaatcctgagtatgaagcctggagtagacaagatcaattgatcttcagtgctctcatcggcactctctctctcaccgtccaaccaacggtgtcccgcgccgctacctctgctgatgtttgggccactcttgctggtacctatgccaaaccgagtcgtggccatatcaaacagctccaacaccaaatcaaacaatggaagaaagacacccgcaccatcgacgagtacgttcaaggctttatcaatcgatttgatcagttggcattaattggcaaaatcattgaccatgaagatcaagttgattacattctcgggggtctgccagaagactacaaacccattgttgatcagatggaaggacgtgacacaccaccaaatggatgtttaacaaacagttgtgacgaagatggatgttttatccaaatggctttgaatagtgtatagaacaagcaacaagcccgattcggcccaaacccaaccccatttaatcatatgtggttttagtagtttaaataagctactttgagtctttgacaactgttcttcatatccatcataaattgtgtagcattttacattttacattttacgtttgaaacttaatcataagttttgtgaatcaaagttaattgataaaaaatcactcttaatacttttccacgtctacatcactgtcattttcatttcagacttgaggcattcatttttcaccatgtttcaggaaatatactgcaatttcttacacgtatagagaggtccttaataagtatgagtagctatatcgtaatgtatttataccaatgtactttatgctcacacgtgttcggtgtacatataatatgttgcatgtggcatttcggtgcctaattatcaagtttttaccgaaaataagggaaaagtatataatcatgtagcctttcagacaccgacaaaaattttaaacagtaaatacgatttttctgttcttcttaaacagaaaatgattaaacatgaatgaaacttttaaaagcttattttgacgacgtgttctttagccaaatagacgacatttaaacacatcaccggaccggaaaaacaccagttgaaaataaaataaaaaatgtatttgtaaaagtctgttattacaagaaaatatggtcgatcgttccatgtttaattgtgtttcttgacactttttagttcttataaaacacctttactacataacttgataagttggatgagaataaagaattataatagattctcataaaaataactttataagatatattctctcttatatatatatatatatatatattatgagatttcctaatctaaaataaaaataaatgtaaataatatatataaatattactaaaactaatatatgttaatattttaaatctttctacaatctttatgatttttatattgttcgacgatcatctcaaccattgactctcgatctccaactacagataaagtaaaattttaccaaagaaaagtctagtgactcatcataccaataaaaaacacacaacacctagttttaccaaaataagactagaaatagtactatagtagttatgggacgatggagtgatggttttgcaaagcaaaagccaataattgtacatttcaggccgaaaccgacaatgaccccatcctacccatgtgtcatgcattcagtatttattatgtgtatcagtcaaattttcacataatgacgaaccatctacatacaatctatggcgtggcctgtggagggcaggacaaaccgacataatattgtgtatatccactgaaatttattattaaaaaaaactaatacaatgataagtactagtattagtgataaaaaaaacttatacaacgttgttttcatcttacaattaaagatattcataaacgataaatctctacttcgaaattttttaacatctccaaatgtttgttcaagctagtagtagtccacataaagtcacgttggggtttcaggctttcgttaaagattcacaccgtcggattgggatttccagacgtcacagatagacttatcttcttcgttaaatttagaatccaaagattattgtctgcacactcgttattatctaaaacagccttttttagttaaattgacgatattttagtgacattccaattttaaaattcgtatgggtctacattaaatgagtacagcgaccaactactccttccctcatagtagtatttaggtattgcattcacattacataagatgtactttcctactctatataaactctcactcccctaacactcttcatcatccatcacatctcctcttgcaaaccaacgtaaaacactaactaagagatcaatatg

SEQ ID NO: 30072 - DNA, 3003 bp, Unknown; identical to SEQ ID NO: 30071
  misc_feature (1)..( 3003): 2750-1469P.txt file - cDNA_ID_3025683; gDNA_ID_2214558; Annot_ID_185793

SEQ ID NO: 30073 - DNA, 3003 bp, Unknown
  misc_feature (1)..( 3003): 2750-1469P.txt file - cDNA_ID_3025714; gDNA_ID_2214559; Annot_ID_185851
caagcctcgaagttttggtttaagagccttgagcttcttagtgaaccggaacagggacgacgtggacatgtgtataggctctgtttctctccaaaaattttccaccaaaggtttaaactcctccatatcggccacagcattcacaaacttaaaaggcttatttcctctcacttgtgcaccagagttcatatttaaattgatacgacaccgtaaatggtcagaacaccctcccgcttcaaaaacattataagattgtgggtagaccatcttccaagcctcattcaccataactctatccagttttttccaaattgggtcattatctctcttattgcaccaagtaaaaaggggcccgtgagatgccaagtctgagaatgagcagtagttcaccaaagactgaaaatctcgcataccggaggtaactgctgggtgatcttccattcgagagtgctcatccatatccaaaatctcattaaaatctccaaaaattatccatggtttatcacgaatgatcggagagtccatatggtctcgaagatcattccacaaaatctttcgttcctctgcaaagtttgaagcatatacaaaagagtagaaaaattcttcttcttggctttctagtttcaccgaacaagttatcaactggtcactcttgtaaaacggagtaaaccttacattctccctccacactacccaaagacgacctcttctattaaactcatagttagttagcatggaccaatccttgaacaacttagaacccaaccactgtgaattttcctccttaactctcgtctcaatgagacaaccaaactgaaaattctgctcgtccacccatttctgaattacggaatgtttatttgatttgttgaggccgcgaacattccaaaagaaacccgacattaatgatgttttggagggagccctttactctgatctttaggattattcctagtagaagggtttgataatactttatgtgctgactttgatcccctaggcaaagaatgacgcaaaatcatctccttctttgctagtcgattctgattttctaccttttcctgaggcgggtcttgagttgagttttgtgtttcctccgcttgtttctcaacactatccgctgttatgatgtcctctccactttcatccttaccattcagagcagagtaactatttgatagaatagagacctccccaaattgtaaaccttcttgctttttcggtggactacgaccaaatttaggggtaatccatgactcagctcctttctcttcttccttaccatcttcagagattggtatgattggtatattctctgtcacacattctgcagtcacagaggctgcagtctgagaattagacaagacctgacccgtctctgtttcttcaacatgaattgggtctggatttggcgtgtctcgagagcaggtttttaaggcagagagacaagagtcacggaggtgaccccatttatcacaacaactacatcttggtggtaaccaagggtaggagtattttatcactgcagctagttctccctcctcctcgccggtaaacacaaactccttaggtaactctttcgttaggtccgcttccaccagcaactgagcttcatcgaaactcgaacaagattcagtcttggggtgcaatcgaattggcttacccactgcactagccaaaaactcaagacctttatcagtgaatagtgatggaggaacatccgttaaagtgatccagagctgaattgacttcatagctggctgagtttcttccgcaaaaggagaccactttgacaccaccattggcaaatccatgatattccacatgcctctgtttaaagctcttcgtcgcatggcttcgtttcggatacgaaactttatcgtcgagtcattgacggcataaacatcaatcagatttgacttgtcccccaatctccaaattttattaacgatcatgtgaattttcccaacgtgtggggcctttgcattgagaaagtgaccaattagaaaatcttcccatagtggtttagcaccgagaaagacctcttttggtactaccaccgtcgcttgaccatcaacttcttccgatacgaacttttgttgagtgaaggtgtgttttcgagcagcgtttacccacgatttcttcgcaggcggatgtgacatcctttgagtcgtctctaaagcactctgactgagtgcaggaaactggtctgaatctgagacaagtaaaaccctatatgtgctttggtttgaaacgatgagatcaccgtcctgtctctccaaagagaccggagaagatacaggagacccctctcgcaacggaacctctccggagaggcctggaggagccgccgccggcagcatgcttgtgagaaacgtaagaaaaccctagaacgcttcttttttcgcccctgccacgtcagctgtccttccgacctagtaaagacaccccttttttaaaactggatttccacgaccacaaggttaagagccttgcgctctaccaactgagctagatgggctttgtggtgcttgtaatgggtttgtctttccttgcggaagaagaatcgggtcaaccattctcatccttcctctacatcaaaaccctaatttctatattacatctctaacctcattcatatttgatatataacaccattcatttccttgatctctcactcatcaccctcacccaccaccaccatcaaaccctagttttgtttttcccccaatttcgtttccttgatcgtggatcattcttgctcagatctctgttagcgtctttgaatggtagaaacaactccgatcaccagagaatatatgctttcccattgcacaaccgcaagggcgagctttttccttcgtcgtctctccgccgcatcttctttcaaatttggcttctccaaagaaggctggtactaccgttgcatcggcgtcgacccttgaactcctcaacacggtttgtttttttaataaacctttctgattttgaaatttgataatg

SEQ ID NO: 30074 - DNA, 3003 bp, Unknown
  misc_feature (1)..( 3003): 2750-1469P.txt file - cDNA_ID_3025728; gDNA_ID_2214559; Annot_ID_185841
cattttagcaatcttgtttatgtcaaagctgttgacttatctctaccatgttatgcttagatatgcaatgcggttgctgtggcaggatatcttaatgcaactctagtaattcccaactttcactatcacagcatatggagagatccaaggttttagattgctttcttctgaaaatcttgtttgtgcaaatcaaagccatcttttgtagattgctttctgacagaggtttttctttcagtaaatttggggacatctacgatgaagagttctttgtcagtaccttatcaaatgatgtgcgggtggttgatacaattcctgaatatctaatggagcgttttgaccataacatgacaaatgtctataacttcagagttaaagcatggtcacctattcaatattatcgagactcgatcttgccgaaacttcttgaggagaagtaagttacaaattgttctttagaagtttgttttcatgtggtagagttagttacacattgttggtagggttaaaaatatagtaacaggataaaccaccttttttctagcggaagatatgttttggatctgtttagcacttgtcattgaagaactgttctctttgcatggcacaggattatacgaatatctccatttgcaaatagactttcttttgatgctcctcaagctgtccagagacttagatgtttggcgaattacgaagccctgaagttttcgaaaaccatactaaccctaggagaaacactggtgaagagaatgaaagagcaaagtgcaaaccacggtgcaaaatacgtgtctgtacatctgcgttttgaagaggtttgttccatgtaaaggagagacatctatagaatccccactggtctttatcatggttgtaaatttttgaatggagagttttgtgtctgagttgaaagattaaataagctatatctacatgttgcaggacatggtagctttctcctgttgcatatttgatggtgggaaccaagaaaaacaagatatgattgcagcaagagaacgaggatggaaaggaaagttcacaaaaccaggccgtgttatacgacctggtgctatcaggcaaaacggaaaatgccctttaactcctttagaggtatactatcaccacaatatattagcattctcggatattttcttaagctaatcatccatcagaatagttccacaaacccttgtgagcaatagtgtgacttgttctgtttggattatacttttcttgtaaattattcaggtgggtttaatgcttagaggaatggggttcaacaaaagcacatatattttcctcgcgtctggtgaaatatatgatgcgaatcgaactatggccccgctactagagatgttcccaaatttacaaactaaggagatgcttgcatcagaggaggaacttgctccatataaggtttgcttctttcctggtgtttgttccagagtatatttctcgtgatgaatgataaatctgacttgaaactctgtgttcagaatttctcttccagaatggctgcaatagattacacggtctgtctccacagtgaggtatttgtgaccacgcaaggtggaaactttcctcatttcctcatgggtcatcggagatatatgtttggaggacattccaagaccattagaccagacaagcgaaagttagcaatcctctttgacaatccaaacatcgggtactcacttcttctactcttcgtcttcgataaaccctaccaaatctccacatgaataaaatttgaattgttacctttttattcaccataccagtgttgcactcacctgcaaaccttacaccctgttactgtgttatcacttattgctcaaacgatgttttgccccgcagatggcggagttttaaacgtcagatgctaaacatgaggtctcatagtgactcaaaggggtttgagctaaaacgacctaatgactccatttacacattcccttgccctgactgcatgtcccgtaggaacaaaacaacaaccccagaatcgagaccacctcctgccacctgaaaacacacatttgattaccggccttccagaatctgcttctacaggctacgttcattccttgtaattctaattctttcaaatcagacacaggaccttagtgactcggcctgcccagaattttagggaagacagcgtttgaatgggccgtggaatcatctatttattctccggcgaggagtaacagccacaacattgtttgatacctttgacacattgaagctgatgtatctaacaggaaagacgagattgaagttttaacacattccctagctgctgctgggcaaagaataggacagcgtttggattttggtgtttttttcttggggtgttttggtggtttgaagaagcgtttgcgttttgtacattttgtgaacgcaggctttgtgttaggagatatgtagagagagacggacaagggggagaaaagaagctgccctaaaagttttgtacattgatttggttagagatcattgtctcttcttttcttttcttttctctgatcatagggttttttaattgtttcatcatcatattcttatgattcttttctttcacaagataattttttcaatagtgatttaattcatttttgcttcttccagtcgtgttcatgtttttcatttgttcttatatcagttttaaatttattcacttcatgtacaatggggtttgcttcatctctaatccaacaaatacaaacaaacaaaaaaagaatcaccttcctagtttatttctatgcgctacttaagcgcgtgagaaagtacgatccacgtggaactagcttctttcgccaacacaacacagagtttggctcacgaaaaagtgtgcgcgtggggaagaaaagggtctcatatataattggagtgtaaaatgtttgacctttttgtttgggtttatctcttttagactcaacaacagataaatttgttggtttcaagtattatcaatttcccggcgaaatctccaccagagttatg

SEQ ID NO: 30075 - DNA, 3003 bp, Unknown; identical to SEQ ID NO: 25926
  misc_feature (1)..( 3003): 2750-1469P.txt file - cDNA_ID_3025732; gDNA_ID_2214559; Annot_ID_185840

SEQ ID NO: 30076 - DNA, 3003 bp, Unknown
  misc_feature (1)..( 3003): 2750-1469P.txt file - cDNA_ID_3025736; gDNA_ID_2214559; Annot_ID_185838
tctcgaggaaagtctctttgttgtgcagaggttcccaccattgttgaccatcctttggaacgacgccgtttttgtgacggtgctcaagttgggtcgctttttgtgttgcttgctttttgtctcttcattactctaatgggccgtaacaactgcgtagacttgggtactttttttatatcttattattggtcaactgattttagtaaatgaagagaaaacaacccaagaaggagtgcatataaatccatgtttatagtaaggtataacaaacattcttctacgagttaagaagctcaaaaaatggatgaaaagtatacttaaacctatatctaagttctatatagattggtttcctcggtcgccgatcacgaactgaagagccattatatctgaaacgcattgttttatattttctcgatttctaactaagtgtaatttaaatatttctttttttctattataagtgttgttctcacttttctatgcaaacaaaaatatatttaatagtttttagctaattatattttactttcttattggttagattagttataactaatgatgtttttataggaaatagataaattaaataaaatttatatattttcttaatttacttgtaaaaaccttaaattacaaatattaagaaacaaaggaagtatgattcaacactaaagtcaacgttttattttgagtatttcttctataccaaaggtcaaatatcttcaatacttataactttcatcattcaattgaaataaatgaataaactaattgcgctttgctacgccacaaattctaattgcaaaatcaacttacattgattaaagagttgacctcacttgaaagtgataatgtatcaaatgaaaaagcttcctatcttgacggaagataatgtacgaaacacgataaggacataaaacacattcatatttttttcttatttaagaactacactaaatgaaataatacttgtggaggcaaattattctgaataactcttccataggagctccaaaggtattcgatctctggacctatcgatgtggtgtcttctgaaaacacttctacgtacgtttgcgttagtagtggattaaaacttacgtggatctcgcgggcttgatttatttacgtggatgatatgtggttagtacttagtaggacttaatgacgtgaattgaccttgttatatatggtggccgggtacaacttacaaggctaatacatattatggctctcagtcacacatttgacgtttctttagctttccgaatcgttagatcctccaacactcaccatatatagacgatcacgactatctccccgattaatgtcagtgcgggaaaccatactacgaaggtctcgtcttgcatgaatgatcacgtcacgtgtcatacgattgattttttttttttttttgaatatcaggagattctgggtcgaagcccgtaattcccctggttcgaaaccacgacatgtaatattagtttcgtcacaaacgtcaatcgaatcggcgatttttaagtttcgcctacgatctttaccaattgatatgtctttatacaaaatttagtttcgacaataatgactagaaatttttctcttaagatttcttaatcgttaggtgatgatcgcgattacaaataaaatgctaattaatggtcgagtcctaccatttctttccccacctatctaagtttcatcccaattccaaattcaactcgtagacatatgccttactctatgatttctctatcatttttcgaaaatatgttttcaagttgacatcattgtagagttagctaatgggccttcgacattaactcctgaaagccttatatgggccaatctattgaactttttctccttccattttgggctgatttattaagttcacaacacaccgattaggacgtgcttagtttttacttttctccttccattttattatccatcacataaaggcatgtttaagagatgaattttacataaatccttttttctctgcaaattcaagctcttctttaaaaaaaaaaaatcatttcatttcctctagtaagaattaaatttatatttagcgtgttcttttagtgaacgcagccacaacaatagcaaagaagaaaaacagttctacggtgagaagaaaatatagtgataagagagaactatcacaaaagatgaactacgatgaagattgaagtgtcgctggttaatttcagcgattcatcgaatgcagttgcaactcaatcggcgactcatccaaagttgttattttaagttctaatgtcgttttacttacctgctacttctcatgacaattcgtcttactccgttgttgccgttgtcgcaacgttcagtaaaagcacacgctaattaatttttaaaaaaatgaaaaaatagctatattcacacctataatccaatccccttaatagaaacgtaactacttttcctttttttctttttttctttgtcaaccattgaaaatcagcctaactttaaatataattaatattacaatggaaattaaccaattaattatagaaatataattaatattacattgattaatatatttttttaaaaaataaaccaattaaaatggtataatagttacaaaatcttaaaaatagagttaatttcagctaaaaatttaatttctttttggtttgaggcattttgagtttgagtgctgagagagttgaagcggacggggaagaacaagcgggagacttgatgcttgcaagcaaagtgttcctcctaatttttacatataactaaactcttaattaattagaaaagcaaaagaaaaaagttgagaactctctgtttttttttcctttctttttaatttcactttgattcctaattttttttgtttgttcgatcttcaaacccaacactctttcttctctcgatccttcccattttccgatcctcggattcatcggaatcgtcctttgatttgctccgaagatcatcccgactagctgaagccacatg

SEQ ID NO: 30077 - DNA, 3000 bp, Unknown; identical to SEQ ID NO: 12573
  misc_feature (1)..( 3000): 2750-1469P.txt file - cDNA_ID_3025741; gDNA_ID_2214559; Annot_ID_134852

SEQ ID NO: 30078 - DNA, 3000 bp, Unknown; identical to SEQ ID NO: 12586
  misc_feature (1)..( 3000): 2750-1469P.txt file - cDNA_ID_3025741; gDNA_ID_2214559; Annot_ID_185835

SEQ ID NO: 30079 - DNA, 3003 bp, Unknown
  misc_feature (1)..( 3003): 2750-1469P.txt file - cDNA_ID_3025755; gDNA_ID_2214560; Annot_ID_134870
agaaattctctccaaaatttcttatataaggtattttggagatgatttcttcactaatcaagaaacccacatattttttataataaaatttatctctctaaaataagagatttatgtttagaaaccattggtggagttgctctaacattttgcaagttttcgctaacagtttctatcatttctaggaaggtcaattttaaccctttcaatcttgtgatcataggttttataggtaagtttgtaagaaaagatataaaaatatgaaatactttaatattaaaattaatttcaacacaaaatactttcaaaatttagtttcttacacatcataaaataagaagatagatatctataataaaactaatctttttttatctattattaattacaatatcatatccatgaatcaatctgttatccatacatttttagagcagctcacgtgtactaacctacaaaatctcttttaatctaccactataaaattagatatttagttgttttgtgcgtaattacaattgtcattgtgataggaggggacatatgttatcggtcgattggtagtaggcaaccatggtaatcttcatttacaggttcttgtaaagaaaatgttgatttgcttgagtggtcctagttttcttctttggattaaagttagtttgcctactatatggtttcgatttcttccgatttcggtttaattttttttgctttgtaactttagtacttatgttttccttgcataggcctttgatcccagagaactctcgttttccttcggttttgtttccgagtactttaattttgcctattcgtttaatttttcttgtttggattgtgttgtagtttggtttttcagcaaatttcagttaaaaaattcagatgacaaaacaaaagaaagtttgtattaagaagaaaaataacaattatgtgtattggctgaaagataatactctttttgtttcttattattatttttttctatcaaatatttttcttaacaattatgtgtattggctgaaaatgttgtattattttctaatgcaacatttattaaatttcaagaaaaataattaaatactattggtttagaacaataagaaattgtaaatcacaaaaaataatacatttatacttaacttttactattttttttatttgttttaaaattttagaaaatatattattaaaaagaaatagattaataattaagttcatttttaattggttgatgttaaaaggaatcaattatggattttctatttttttggatggcatttgtggattttgcctctttttgaatagtttgtggattttatcatttttaacctacaaaaatataatttaatatgtgttttatcgtcatatttaggttagttagttgtaattgttcttaaaatttagtatttggtataaagtatatacttttaccaaacaaatccaaaatttgtatattttttaatattaaaagtggtaaaccataaaattttagtaaaaataataattttaaaaaaaaatcgacgaaatagggcaaaatcaacgaatctctgtaaacagtaaacttataggagtagaaactaaatttttattttaatatagttagaacctgcataggtcggaccctaaaaatatgttctggatttaattatttagaaagaaaaatatagaaaatgtatgtatgtcaaaaagtcttggaccataattggcggagagagaacctggggacggacaaaaaagtgacaatttgctccgacattaaagataattaatgaaatcaggtataattaaatgaacgcataaataaatgaagagagatgatgatatatgtataatcgtaaacgcatagagtagagaggacacatggagccacccttgtggtgtccgacaattacttttaataatccttccttttaatgaacttctattattttgcttagatatcatttttttttcttctatgtatgataaagttctacatttctggtttgtaatcttctaatattttgatagtagagagttggaataccataacatgttggaaatgttttccattttgaaaaccaaaacttttttttttaaaacaatttttagctatcgttatcaataagttcatcacttaaatgtttttgggaagttcacagtattttggaagatattctattaaatatcaactatttttctagttttgtgtgctaattttttcctcggttatctaatgttgtggttgattttattgcaaaactatgtctaagtttgtatggttagaacatcatttgagcaatataattaagtttgtgcaaaaaagaaagttgatcacttagtattaatttttcattatataatttgatcaagatgcttgcttaatccgatctagataataaacaaaattatctaaacagtatgaaactacaagttcctaatagttaatgttttgacatttacaaagcaactaagtaaaatgttattaatgaattggttactttttttttggtaaaaagttaaattcatatcatttttaaatttttgacagaaaatacagaaatcacagaacaaatgaaaacacgctattgaaaaattaaaaacaacaatattattcaaaaagcttttggttgctactgaatgaattggttacttgtttagattgggtaacaaaattctaaccaaaactagaatcactaatactcattctttaccaaataatacttcaaattcaaataagagtttgattgtgaaagctgtatagctgtacgtatcatgtccatattacagttgtaagccattgttacaaaactactaaaaacaaaaataaataatagaaaggtccgagaaacttgaataaaaatttagaatttttaaaacattattatcgtaaataaaaagagaacctcccaagaaacaagtcgtccttatataaagccaaccacacccctttagcttctctcaccatcatcatcatcatcatcatcatcatttctctctatctctttctaaaacacaaccatg

SEQ ID NO: 30080 - DNA, 3003 bp, Unknown; identical to SEQ ID NO: 30079
  misc_feature (1)..( 3003): 2750-1469P.txt file - cDNA_ID_3025755; gDNA_ID_2214560; Annot_ID_185870

SEQ ID NO: 30081 - DNA, 3003 bp, Unknown
  misc_feature (1)..( 3003): 2750-1469P.txt file - cDNA_ID_3025760; gDNA_ID_2214560; Annot_ID_185868
aatctgttttattttcattccaagagaggaaaatcgtgaggctgatgccttagcgaaacaagctcttcgtaattttgttgagttgccttaatggccttaataaaattaatttctttgccaaaaaaaaaaaactgaagccggacattaaaactctttgagatcgcactaacttggtaatcaacctttttaggaaacgtcaagcagaaacgaaagataaaaaaaaaaagattaataactctgatattcaccagcttataataccattaattgaccgataactaacataatattctaagggtaaatacctaataatacactaattttgcttagaacacgtcaaacaaacgctttttatttatttttattgataataagcagtattattggttcctaatttaaaaaaaaattgatgaataccttcaaatcctagaaagtaaataaatgaaagattctaaactattattaaagagttttttataatcttgctgattagtttttcataatcttgtaaagtttctcaaacaatctctctattttgataatacttttcatgactttactttgtaaaaaaaaaatgtaaaaagtcatgaaccaataacatagtaatttacatcattaacaatcagagattcttttgtttgaattaaataacacaaaacttttactgactttataagagtatgaatccaataaccccaaatttatgaagattttagattaccttttataaatcttaattgaataacacaaaactttaacataccttaaaaaaatcttgattgcataacaagagatttacatgacactttaagtaactaaaactcttttcaaatcataaacaaataacaccacctaaatcttttacaaggattctattatctcggcaattatttgatatattttacccaaataatcaaccctgactaaaaataaatacaagccaaattctcttctttgttttttatcacacgcctgtaaagaagagaattacaaacatcaaccttctaagcttttgctaggcttcaaaggctatacatgtatgactatattatagagtactctggtggctcaatgcctactcatttatactatactctagaaccctagtccctaggatctctaagaatcaatgagcaaaaatttccttgatctttcaagcatatccatttccttgtttgggatcttccttgatattcaagtctatccctttccttgttcgagatcttccttgatattcaagcatatcccttttattaggatatacatgaatatatttacttagatatagtcttattaagatcaggcaacatgtatgtgtataaataatcttcttcttctattgaataaaggaacgcattacaaaatatttcatggtatcagagcattctgacctaattttttcttcttcttcttctttcctgccgtgctgtcacgtaacttgaccaccgcattttctaaaatcttctaaattcttctatttcgatactaccttctatattttttacacccaccatgtcaacagaagaagcttcttccaggaatcaactcgtcgtcgccaacacgaaaccttccaatccctattcactcagctcatcagacaatctctgagccttgatttcttctgttgtgttaaaggaagacaattactcagaatgggcaatgatatatccctatttttactgtttttaactatgttttaggtataggttttagagtctaattgttatttctagagtcttttctagtctttttcaggtctttacatgtttggatgcatttggagataattaagcattctggagatcaacagacaacctaagctgcagaatcaatccggagacaaaaatgcacgtaggtgtcgaacgacaccacccctggtgtcgagcgacaccaatacctgacggcaattttgagacgcaacttattaatgttttgaagattttcaaattcggcccagaactttctcctctgtttaatgaaggcccatcccgtgttttagacatataattaggtttttaggatcattgtttagacctaagcttggagaggctattctcctcatcttttttgtactttgggagcaaaaccctgtggagactcctttggagaagatcttttactctttctcttgctattattgatttcttatttagactatgatttgtgtttctttgattatgtctgagtaatccacttgttaggtttagggtttctcattagggattcatatggtttaatagatctccccctgctaggttatctgtagaattcttcatctttaattgttcttaatgctagatctagattgatcacctagaacttgaatccaaacaatagatatgcccgccataggtatctgtagttggatctattatttgatgagcctggtttataggtgtgtaataagaatcggcctatctactaaggtgaacaatcgaactcgttaagaatgcatatttaggttaataatctctcggcttctccggttattcttagctatagatatagggagtttcgcggcacgcccactggttattccataattagagtttgagtttaaaaatggttcgataacaacctagctattattagatctactaaccaatagtttcctgagaacaccctaagcctgacgtttttactttcttgtcttacaacctcacaatctgctattgcttccttttgtttctttttgttttcattactatcttacttagcttaattcaaaatcttggtctattgtgtgatccgagagttttgtggaattcgaccctaaagtactacaatcgatctgttatttgagagagtggtcttaaggcaatttgacctatatcaaatttggcgccgttgccgaagttctctacgattcaccattagattaggattagaattttgtctaagcatttatttttattttttttacttaatctttctcttttttttttttcttgtgtgtttcaggtctttgtctaatcacaaaaccaggaacaagcgagaaacatg

SEQ ID NO: 30082 - DNA, 3003 bp, Unknown; identical to SEQ ID NO: 26305
  misc_feature (1)..( 3003): 2750-1469P.txt file - cDNA_ID_3025817; gDNA_ID_2214562; Annot_ID_185906

SEQ ID NO: 30083 - DNA, 3000 bp, Unknown; identical to SEQ ID NO: 12619
  misc_feature (1)..( 3000): 2750-1469P.txt file - cDNA_ID_3025821; gDNA_ID_2214562; Annot_ID_185905

SEQ ID NO: 30084 - DNA, 3003 bp, Unknown; identical to SEQ ID NO: 26307
  misc_feature (1)..( 3003): 2750-1469P.txt file - cDNA_ID_3025825; gDNA_ID_2214562; Annot_ID_185904

SEQ ID NO: 30085 - DNA, 3003 bp, Unknown
  misc_feature (1)..( 3003): 2750-1469P.txt file - cDNA_ID_3025833; gDNA_ID_2214562; Annot_ID_134889
agttcaagtagccagcataacaatcatgaaacaatatggaactcttctcttttttctctttttcttttaagtgttaagtctgtcatttttgttggttgttctctagtcaactcaattcaataatcaatatcataagaaaaacacatggcttagccatatttatagggttataaaaagcatttatcttataatataagttatcttctttgctttcatgtagaaagtatattctcttataatttgtttggtcaaacacaattgaataatatagtaacaggttgccaacaattgcatcagtgtcggctactgtggcttcttcttcaccactggcaaattctaatgtaactttttttatccacattgtaatccaaaacggatatttatataataataaggtgaaaaaagccaaaaatggtgagagtgtttttgggaggaagagaagacaaacgttgttgtctcctttattttggaattggaggacaggccatgtgatatgcgttgtgaaaccccaccactcttttagtctcttcatcgccaaaactgactacattcatgcacccattttttggttctttattattcttatattctgaacataatatatagtaatgcaaagatataattgccagttttaacttagtaattttttggtatgattttttattttaatataaaaaagtaacgtagtaatttatgtaagtgtcgtgactatgcatcattcacatttaattcttatagtatatgactattttattttgtcattttattattcttaaacaaaaaatgttttgatatgttctaaatttccaattcaccaagataagttatggatctatcaattttcaataatttacttaataggttttgtcacaatttcattcatataatctgaattttcagtagtgagaatgatgataaacggattcggaaaaaagaaatatgatgagaaaagtggatgtcaaaaaaatattttcagttactattggggtgaggaaaaaagagaatcttctttttttttttttattatactcacaattaggaggctttaaaaaacaaataaaaatacagacgaaaaaaataaaagtagcgttgacgacttaaaaagaaaaaactaaaattgtttaattggaagaaataaactgtaaggctgtgaaatgtagttacagcatatggtagattcttaaatgaatgaaataatatgataaggatttatcggtggttgtggttgtggttgtatttcacactaacaaaaaacttatataaacaagtttaccaaatatgctataatttttctaagaaaacgaaaaccaatttggataattggataaaaaatattgattagtgggagtactgaaagtattttttctctttaaaagatttacatagttttggataagaaatcaccacttctactccaaaaagcgaacatgagacactagatctccatggtattgcaaaacttgtcatcaatactccaaaaagcaaacatgagatgctagatatcctggcattaccatcagctcattttcgttatgtttcatgtttgtaatgatgcctcatgtattatactcaagatattggagaaggtggcgttaagttcaggtgcacttttggcgttatgtgttattagatggtaattgatttgatcaagtaaaaaatgtattaggctattagccacgacagtatatatgcagactatatgaaggaagaatatcacatcggtggctaatagtgaaaatcaccttttaggttattctgcttgtttatacagagcaaaagcatgcctgctaatctgcttatacttgttggtggctttgaggcaaaacttagggaacaggtcagacttacaattagaggcacttgaatgtagtttattgagtctaagctgcactagtttgtggattgagtttaagctgcacagatttcccactttggttctgtttttagtctaattttcctcctgcttggtttctcgtttctcatgtgtgattctgttctgtttgattccttgtaggtgtggtcaagtcttcatcagcttgcctcgtgtttggttctgttcttttctcaaacttactaccactggctgtaagatttactatccaaatgtgctatttacaaatgttaagatttgttgttttatgcttaaaatgcttacgtctagatggtgtttgtgtcaataattggtatcgaattcagatatgcaagttctctctatgtataactgtataactccctctttttgttactgtttctagtggtttcattcttaagacacccacattaaaaaggatcaccaatagattatatttatagcaaagacacccattaaaggatgactaatgaggatcgcctaatgttacctttagaaaaccatcagagacataataaaatccttacacatcaactagttcataaaagagacaaatttagcatgtactcttgtcaaatacagactgattcaatcttagtagttcccatattttattttattttaagatttaacctattcccataaaattattacctgaaaaagaaaaatcatcatagaagtacgaataaatgagagctgacaattaaagagcattacctactttttctgtcctcatctatctcctccattgattacgcttcttgattgaagcaccccacagagagagaaaaaaatagcatacatacattctctagttccttctctcttcttcttcttcttctaccccgcacgaacgtttctggagtatctcttttctcttatctttcactccattacagagcaaagcttgactctttaagttcacatggtgtgttttaaagttccttcttttttactcaatttcgaagctttgtgtctgttttatcaaataatgatgagaaattgagaatgtgggtttttgtgactctttgattcgttgtttagagaattgggttttgggattttgtgttgaattgctcagttttgaagtcatgcagataatatgttcgatgatattcctgttagtgatgatg

SEQ ID NO: 30086 - DNA, 3003 bp, Unknown
  misc_feature (1)..( 3003): 2750-1469P.txt file - cDNA_ID_3025833; gDNA_ID_2214562; Annot_ID_185900
agctaggtggctaaagacagatgcactcggaaccaaaacaaacaagatacccgacttgaagagaccacattttaaagcatacaagatcaagagaggtgtttgagttgtgtctacgttcagacccaaagaaaattgaaagaaaacgatttctggcctaaccatctagcaagtgatatttaggatcggatgctttgtaacttaaaggaatttgtgtgcattgtttcttaaccattgtgatagtttaccaaattgattttgaatttggctaagttacgttagaggcttttaccacactaatcatgaattagcctaattgttagaggttcattatcttgaaaatatgtagatcgattgcatgatttctaacatcttgattgttcaatttatctatcttgtttatttgctcattttagttcttaattttgttagtttagttttcaattatctactatatatagtttaattgctttcatttatcccttcttttattctatgcatgttagggtattagtgagaccgtagattctcataccgtcttatggcaaatgatttcatcataatttaatgtgttatactgttatggcattttcccgtggatttgattcaatctttagttactccaatgacataccacgcatatgcgtaatgtgtatttatggttaaaattacatcacatgagagtatcggacaatttacaaaaatgtatacgaggtagtgtataagacggtgtatgggataattcatatggttcagtacaaaataatatactaggctgtgtgcgtgaagggatgtatgagatggtataaacagaggtgtataagatgatgtacaaggccgtgtacaagataatgtgagattatgtaaaagatagtatacaagatggtgtgtttaactctgtacaagtggtgtttaatactgtgtaagggatggtatatgagacaatgtataaatcaatgtacaagatgagacgagctgtgaaatttatgtatttactctaagatccatgagagtttcttcttcatgtctcaggtgaggaggttggcgaaaggaaggttaggaaaagtgaagataaatttgattttgttacaaaagtcaaaaacatttgcctatataacttaaatatggagcccattatcattattcgtagttagtagagcttgttcacgtttatgttacgatcttgtattgatagaagaatgttttcacttgtcttcgactgaatcagtgttgccttctctcaggttatatctttcgtctatgctttcgtcaaagcaaaaaatccctaaattagatgaattttatgccttgactcaaggcataaattcatcaaatgtggtatatagagcgtatttagcttcatatatactattgagtttccagagtcgtacgagcgctatcaagtatcagaagcgaataaaaataaaatatccttacgaaaaaaaaaatcgtctacaaaaaataaacatcattgtcatgtaagaaaaagaaaattgacaaactaaatattagttcttaaacagttgttgacccttcctctccactaaatcgttaaccaagctttcaaaatcaatgtctctaaccaattctctttcgattgataatatagccaactcactcaatctttcttgtgacatagtcgaccgaagatacgatttgatcaacttcagctttgaaaaacttctttaagcagatgcaaccgaaactggaatcgtcaacattgttcctataaagcaatggtaccttcaatatgagacaaaaattatatattaaatctgctttgaaagcaaagtgaaatttttgtctccaattataaagtaacataactattctaatgagcttttgctatttggatctaatgttatcatattattacctctacaacgttcatccttttctagcgcttgttgttgttcatcttttgcatgcggatcatatatgcgtgtaatctggtcgttgtcaaatttttattaattagcatttcaagccattgccattgtcaacgaatattcagtatttattagaaaaatcaacagaaatttaatatctatttagttttgttgaaatttaaagatataaatcaatatttactataaatttaattttagtaatatttttccgatttagattttgttattcccgtttttttatattgatcagttttagcgttttttagcggtgaacagtagactcaactcggattggactagacgggcgatcccggtagaacaggtccgaacgcccggtctggttcccaaacactgcaattaccgcatcttgtgttgtggaccggaccgactatgactgaatattgcattcattttgatcctaaaaatgtcaatcaatgctcatttatttattatatattttggaaaaaagtgagaaaaaactgaaacggtgcgacgttattaaatcttttaaatccccccaccaaagcatctgcttcttcctcttgtctctctctctctctctctctctttcatcttcaaactctacaaacccagaaaccaccacacagtaattaatgtctctttctttcttcccatgtgatctttaacagacttttcttcttattctccatctctgaagttgtggggattcatcaagacttccttatctgtttcttttataaaacaagagagagataccacttttggtgttctttatttgcaactctttcaggcaaacactctttgtctcttttcttatcttattattgtttctattttttgttgataatactttcgattttttttggctctctgttctttctagatcgtttggttttattgtctataatattcattttgacaatctatgtattgatatgagaacattacttcttagtctctttagtttttttttttgtttttgacccttaagcttgatttgttgtttttagcttctggtgatttgtttgatcaaagaaagcttataagtttttttttctttttcaggttaaagaaatcgataggctctgttcttgattgtggtggaagagacatg

SEQ ID NO: 30087 - DNA, 3000 bp, Unknown; identical to SEQ ID NO: 12606
  misc_feature (1)..( 3000): 2750-1469P.txt file - cDNA_ID_3025837; gDNA_ID_2214562; Annot_ID_185899

SEQ ID NO: 30088 - DNA, 3003 bp, Unknown
  misc_feature (1)..( 3003): 2750-1469P.txt file - cDNA_ID_3025847; gDNA_ID_2214562; Annot_ID_134886
ataaagttcttaataacatttatggagaatcatcaatcctatcaaccatgaaagctcacttgatccttcaagtttaaatgatttctttgatttaactgttaagttagttagaatttccttcggacaagttaaattgatcaatcctagtggtactacatagtatatacccttagtgactacgcatatccactataagagaatcctagaaaatactagtatgataccaaatacattcacgatgtagcttacgttttggcagcttgctttcctttgccaatggccgcaccaaagtatctctgcaggaatagaattcatatgatgacagggaaaaataacgtaaaatttcatacttaaagacacatatctacgggcagaaataacttacatatgatatgcctgatggttcaatcatgtacaattgaggtccatctctatcataacctccaagaataaccccacagccaaaaggcctacaaaataaaaaccattttcttataattcattcaagtaggagaaatgcgtaggtgactaccaaagacgtagatgaattggacaaacctgagccaccaatacagggtacacagatgtacataacttgcaacacgctcagaaagttccttcacaggtacagcatcgccataaacactaaattatcacaagtgaaggtagagttggttacacagtcggaaaaagttatgcaaagccatgtaggaagaaaggagaacatacacattgacatcttatacccatatatttagatttttaatctaacaaaatgcagataaaaaatattttgaacgtttaactaagagaaacatccccttgagaaaagctttaggagttgaacagttctttcataataataaatcttagatataagctactgatgttttcattgatacctctcatagcttcgtgcttcagacttagcacgcgcaacaatttgcctcccatcagctgcaagcccagcaacagcctgacatgacagaagtagaaatacccataatcatgaaacaaaacaatatactacgagactagacacaatagtagttacaaaaaacttgaaagatacatatcctcagcagaaactaatttcctatagtttaggagaaaaaaacataccatgccagcatgacgatgaacagaatggattctcctgttggaacctggtagcatcatctttgatgcaataagtttctcaactccctaaaaaccaccaaatgataaacacttagcaagaccattcctttatcaaaaatctgcgtaaaatcttacaaaacccaaaactaacaacagattcacaacatatcgaacaggaaatgaaactaagggactgtaaaatgtgtcatcttgggtcaaaatttacacggtatatattacatcaaatctacaattctgataacaaaaatgtgaatacttcattccaaggttaaatcacagcacgagagactaaacccactgaagaaagtgacaaagtagtataaaaatcaatagaggaaggaggaagaatcaaaccataacaatcccatctttgcacttgattccaacaacagtcctgcgaagaaaaaaaaagggaaagacttttaacaaaccctaattcgtgtcgataaccaaaatctcaaagttttcagaagctaaatccgatctactaaagggcgaagatcgaagaagataaagccaactaacccactgttgtcgacagctttagcggcgtactcgatctggaaaacacggccatcgggagagaaagtggtgacggagagatcgtacccagttccaatgctactcatcttccttgattttttttttctctgactcttttctgatttcttcttcgtcgagtgatttaagctgagatcgaagaaaggggttttctttgttctcaagccagagacaagccaaatctttggagctccgtctgactccgggttggatattaaaacgattcgggttgttttgtcgggtgggtcgattcggttattaacgggctttattaatattatgatttggcccattctttggtaatcttttaacggtatcgtgaatatttttaagtgattttcctcttttgtataattttgaataatcaaccacatgaggaagaaagaaatatttctcttactcaacaaaatatatgatcatacaacacttctttatgaactcactagaggtaagactataatatgctctagcattgggacacacaaactttgggatgctcaacattacatgtttttaaaaccaagacagtaaattacctataattgtgatggatacaataagtttgttttttactacatctctagccaaactgagagacatagttgtggcgatcaaaaaagtatgacagttttgcgaaaactggatcttgtttaatatcaaatctttaagtgaaggtcatgatgcttaactacccattaggtgacccttccaacaacaaagtagtgatttttgtcctaactcctagatgattattaattacaaaaacagtaaataaaaagtactactatttctaaattttcttataatgctaaaactttttctttggttaacttaattaaaaagtagtttaaaatccatggtaaacacaaagctaaaccttttttaccgttttatatcactagtaatcccattctaccaactcgttgaatacttagtattggtacgcatggtaagatcagtaacttatatgaactaaaccattcaaagcatgtaaatggttgtcggcaaaacaacaatactatttcttttcacaagggaatatatacatcacctccctcttaagtaaagctagtcgaattgaaaacacaataaggcccagtggagaacaaaacaaaagaagaataaaaaagagaatcagattcgaaattattgttattgggcctaatgggccttttctttttccttctttataattccacacaacaatcctctcattacacacaccaacgttgattcttcttcttcttcttcttctctctttctcatctaaaccaaaaaatg

SEQ ID NO: 30089 - DNA, 3003 bp, Unknown; identical to SEQ ID NO: 30088
  misc_feature (1)..( 3003): 2750-1469P.txt file - cDNA_ID_3025847; gDNA_ID_2214562; Annot_ID_185896

SEQ ID NO: 30090 - DNA, 3000 bp, Unknown; identical to SEQ ID NO: 12604
  misc_feature (1)..( 3000): 2750-1469P.txt file - cDNA_ID_3025851; gDNA_ID_2214562; Annot_ID_134884

SEQ ID NO: 30091 - DNA, 3000 bp, Unknown; identical to SEQ ID NO: 12613
  misc_feature (1)..( 3000): 2750-1469P.txt file - cDNA_ID_3025851; gDNA_ID_2214562; Annot_ID_185894

SEQ ID NO: 30092 - DNA, 3000 bp, Unknown
  misc_feature (1)..( 3000): 2750-1469P.txt file - cDNA_ID_3025855; gDNA_ID_2214562; Annot_ID_185892
tcatatcaaatactaattgacgtatttaagggtcacacggttttcaaagttactaaattaatgatttatcatgagtgtatatactatatagtaaaaaacttatgtattgattactatctatattattcaaaaggaaagattccatctgtctgttgttataccacgttcttccaaaaaaacaatttatttaggtaaataattaatcaagcattttcatattatattcatgggtgttctaatttatatataaaagattattcaaggattcttgatatttaaattcatctgattttcttcactttgagcaacaaacaatgggagagataatgaacgttgactttgtaaactgtttgatcttaatcctcctctgcctcctttcaatcctctgttactctttcttcttcaagaaaccaaaggatggtttcaatttgccaccgagccctccctctctaccgatcattggccatcttcatcatctcctctctctttttatgcacagatctttgcaaaaactctcctccaagtatggacctctcctctatcttcacgtcttcaatgttcccatactccttgtctcctctccctcaatagcctatgagatctttagggcacaagacgtaaacgtttccactcgcgacttccctacgaatgaggggtctctcttcctcggatcatttagcttcattaccgcaccttacggagaatactggaagttcatgaagaagctcatcgtcacaaagctcctcgggcctcaagcactcgagaggtcacaacgcatccgtgcaaatgaagtagagaggttttactcaaacctattagataaggcgatgaagaaagaaagtgttgagattgctgatgaagctatgaagctagtcaacaacataatctgcaagatgattatggggaggacctgttcagaagaaaatggtgaagcagagagaattagaggcttggtgaccaagtcagatgccttgttgaagaagtttttgctggcggccatcttgcggaaaccacttaagaagattgggatcacactgtttaaaaaggtgttcatggatatttctctcaagtttgacgaggtgttagagaagattcttgtggaaaacgaagagagacttgaggagaatcaacaaggtactgacataatggataagctcttagaagtttatggagacaaaacttccgagtataagatcactagagaccatatcaagtccttgtttgtggtaaatattcatctcttataacaaatttagcgaacaccaatggtttttcttgactaagaaacgtttgatactacaggatcttttctttgcaggtactgacaccgcaacacacactatagagtggaccatggccgagatcatgaacaactctttgattcttgagagattgagagaagaaattgattctgttgtagggaaaacaaggttgattcaagaaactgatctaccgaatctcctttacttgcaagcaactgtcaaagaagggctaagattgcaccctacgatccctcttgtgttgaggacgtttcaagacgggtgtacgatcggaggcttttctatacctaagaagacaaaacttgttgttaatggttatgctataatgagagatcctgataactgggaagatccactggagtttaaaccagagaggtttctagcttcttcaagatcaagccaaaaagacgcaataaaagaagaagttctaaaatatctttcattcggaagcggaaggagaggatgtcctggagtgaatctagcttatgtgtctgtagaaaccgctattggagtgatggtgcaatgctttgattggaagatcgacggacataagatcaacatgaatgaggttgctggtaaaggaacgttgagcatggctcatcctcttaagtgcactcttgttcctcgaagtgtaaccccattaacttcaaagtaggcaatctacttcttgactttgtgttgttttttcttaatctcatcgtttcacatcttcaccagtttattggttacctttggtttaggtcaatttggccttatgtccactttaatattgtatgaaacttaaaccttttgtatggttcataattttattttcttaagaataacgaaaatgaaaaatgcttgctttacttttaagatttaaaagcagagcacacacgctcctagccaaacaacaccaaacatgcattaccccccatcaatctcaacgcttttcctcctcaatccgggaatgcaaccacgctggttctctacgagcggctaaagtggtttataaattataattgtgtcttcgccacaaactttagattgcagcttcttctattcttttacagttttttttttcttgcatcatttttacagaatttatgtgagcaattcattttcaaatttcttatctttcttttaataaaattattaagagaaaaaacttataaaatgtttattaggttttcattattttatatcatataaggctattaaaattttaaatcctcctttttaagacaaatttctgattttgttctcaattttgaaaaggtctatctctaacttaatttccattttatttattatctataccatataaatttcttcaaatctcaatcaattaaaaatttctattttgcttaaaaattaaatgattgcaaatttataactaataatttctttttttaccatatccatgatataatttattttaaagttaaaaaaatattttgattcatattatatgtgtatatatatatatatatactgtatatgtatatatacatatatatctgatcggactattattatctcttacctactcggcccaatagtaatatttcacaaatccagcaacaaatcttacttcttccaccttcttcttctcttcttcttctcttcttcttctacttccgcaaaaaccctttgagaaagagaagcaaaattctctaatcgttctttctctgccctaatccacgtatcgtttggtgttcttcttcatcgaatcgacatg

SEQ ID NO: 30093 - DNA, 3000 bp, Unknown; identical to SEQ ID NO: 12601
  misc_feature (1)..( 3000): 2750-1469P.txt file - cDNA_ID_3025859; gDNA_ID_2214562; Annot_ID_185891

SEQ ID NO: 30094 - DNA, 3003 bp, Unknown; identical to SEQ ID NO: 26309
  misc_feature (1)..( 3003): 2750-1469P.txt file - cDNA_ID_3025914; gDNA_ID_2214563; Annot_ID_185927

SEQ ID NO: 30095 - DNA, 3000 bp, Unknown
  misc_feature (1)..( 3000): 2750-1469P.txt file - cDNA_ID_3025923; gDNA_ID_2214563; Annot_ID_185924
aacagctcgacttgtcgacaaaataatatgaaaaaccgagttaataacttttgcatattccgaaaacttcggttgcttttagttgtgcgatctcaaattttcactgatttttgaatagaaaacggtttatatggaagtatatatatcatgtaacataatgttagcagaaacatattgttagcttttagtcctacaacacaaaacaggctactgtcaaggttaggggttacccttacgtattttagcgagaatattttaccgaataataccatttataacattgaaaaattaatcattaaatcgtatggctataatcaattctctacaaatctcatcgttttctgttttcctattgataattttcacaatttataaactacgtcgttttatctgtccagaaaaataaaacatttatatacaaaaatgtattgtatgaaaatttaaaaatatattccaaatttctactgcttaaagaatcccaaaaggaacaaaagaaaaaacgagtggctatctcaagagattagaatcgttcttgggatcaggctttattcaaatggcattttgtggaaaaggctatatatgacgtaattaccattaacctttttgaatggttactatatattatatacgaactcttttacgtgtaaattaaactgggataacaaagtccatttcatgtgaattttaattaagttaaaatgtagatgatccttatttttcctgtcccaagatggtttcatcattagtctttgatctgtaaaaaaataaaatactaaaccgaaatttaaaatgcccttacaagcgatgttaggacacaatagacggtatatggccagtgcccctccgatagagcacaaggccaagggaaagcaaatattacacaccaaatctttatattttatgttacgtatcatataatacaataaataaataaaagattatatgattatgttcgtgtaactctaccaacaaaaaatctccagttgattataaagctaacattaaactcctttctaaagccacaactaatttatttggttggtttagaataatgttattatataagggtgtagaccaaaatcaatctcttgaaggagcgagcaagctagggttaaagagatcgatgttggtctacatcgctgaccttaatattcataaccatataaatattatatattttaaaaaatcataaacgaaagttacataaccaggtaagagtaagatacggtatacggtattaccgcgattattgggctgatctggacatgttattgggcttattgaacttcaaatacaagtgatgaggccgcatattctattttcctttttggtgttatgatcgactaaacaaagaaacttcatacgctaaaactgtataacttccaccaacgcaaacaagagccaaaaaccaatatttctaaacaaaccaccaagctcaccctcactgcatatctccttctccgaaccacctttagccgaaccattgatatagtttctcaagcgatgacggatccgaattgacggcaagttatgtgtgagccgtgaggaatttgatgcattagtgaactacttgtcgcaacttataatcttgtgggttgcaaatagggttttaatgttaaacatctttctaatggttgtcttaatcggtaagaaaataaactgtaaaagtgctttacaaaaacgtgactctttttcttttcaccacaaacagaataattctaacataagacagagagacacacgtcacaaagtgaaaacaaagtatccccatttaaattaaaacagtttaacaagataaaatacaagtccgattttttcatctcccaaagattctcacagttaaaaatagaaaatagaaaaagtatatattctcacaatgctataaacgcttgaggagcatctgatttatcaataaagagaactaaaactttacaaatccaaaaacaataaaattatataaatccaactactttaaacgattttccaactagaaatttcgacttgatgattatagtgtcactgttttgcgtatctttatttaaatctaatagtctcatggttcccacatgttgaaggaacagaataactaattagaaaactagtacttatttatcgataaagaaaaatattattcttaaagacaaaaaacatgtaattaaaagtagtaacatggaatcgcttctcctaatagcttatgcttttctctatttattccttctctctcacgtattctcaaacaagaaacatccaaataattgctaatcgtgcatataattaagtaattaccattccaacttacacttaaacacacatttttcacggaagaggaggcagagtataaaatcaatgccgatcagtcggaaaattctaacgtgggccgctttggtggcaattatggccgtcttggtcgtcttagtgggtccatacatcattggaccggagagtatagagggctcgaaaaacgtcctaaccacagcgaggacaatcctccttcccgtggatggaccggagagcctggactggacccaagaggagaaggcccatacgttggcgtcactgacggtcgcatcctcaaatggagcggtgaagatcttggctggattgaattcgcctactcatctccccataggtttgttttatttatggatgaagtcatgcaccaataataagtagactgtttcaacgcaaatatttgtgtttgattatattactggttaaaattttatatttatatcttggttattatatatttatatctttaacaaacattatacacatttttttggtaaatttaataatgtttgaaaacacttaattatcaataacattggttatagacaacacaattatttaactatattttaattttgtgttgtaaatatatgaagaaaaaattgttcgagccataaggtggaacctgcgtgtggaaggcctttgggacttagcttcgagaagaaatcgggagatttgtatttttgcgacggttacttaggggtaatg

SEQ ID NO: 30096 - DNA, 3003 bp, Unknown; identical to SEQ ID NO: 16889
  misc_feature (1)..( 3003): 2750-1469P.txt file - cDNA_ID_3025927; gDNA_ID_2214563; Annot_ID_185922

SEQ ID NO: 30097 - DNA, 3003 bp, Unknown; identical to SEQ ID NO: 25687
  misc_feature (1)..( 3003): 2750-1469P.txt file - cDNA_ID_3025930; gDNA_ID_2214563; Annot_ID_185916

SEQ ID NO: 30098 - DNA, 3003 bp, Unknown
  misc_feature (1)..( 3003): 2750-1469P.txt file - cDNA_ID_3025955; gDNA_ID_2214564; Annot_ID_185962
agtcagcttttcggttctaatcaatggttctccacatggtcacatcaaccccactcgtggaatccgacaaggcgatccattatctccctatatattcatactttgtgctgaagttctctctcacatgatgaaccaagccgagatcaacaagcagcttaaagggataaaactatccacaagaggtccatctatctctcatcttctctttgctgatgattctctattttttactatggcaaatcataggtcatgccatgccattaaaacggttctacgtacttacgaggaagcttcgggtcaagcagtcaatttgcgaaaatcaactattacctttggcaaaaatgttagcaatgacataaagcgaagaatgagaaatctcctcggaatacacaatgagggaggtggcggaaaatacttggggctaccggaacagtttgataagaagaaatctgagatgtttcggtatattgttgagaaagttaaagaaaaaactcaaggttggagcaagaaatatctgtcacaagctggaaaagaggtactactcaaagcagtgctttagctatgccaatctactccatgaatgtgtacaagcgaacaaaagagatttgcaatgagattagtggagtactagcaaaattctggtgcggttcagacgctgaaaatcacggtatgcactggtttgcttgggatcgtcttgctttgccaaaacaggagggtggtcttggttttagggatcttgaaagttttaatttagcattacttggcaagcaaacgtggcgaatgcttcaatatccagagagtctaatggcaaaacttcttaaagggcgatatttccatgattcaaatatcctaaatgcagtccaagggaagaaggcctcttttatttggaaatccatcctacatggtagagatttagtcaggaaagggcttcgattctgtataggtgatggcacaatcgtcgacgcttggctggacccatggttaccaatgcatccccctagaccaagtgactccaccacctagaaacgttctcttgaaacaaagactatggaaattaagaactgctccgaaaatcaaacacttcttctggcggcttctatctacttctcttcctactggtgcaactttgaggtatcgacatattactaatgatgctaaacgtgtgagatgttgcagagaggacgaaacggtcaatcatctcttcttccgctgccattacgctcaagtcatatgaagaggctcgagaatcccaaatcccatctttctcgaccaaactgctccatgggacgataaaattcgcgccatctttaatatcaacacctcagcacgaacatctcatatgagacagttgcccttatggatcatgtggcgattatggaaaagtcgaaacacacttatgttccaacaacaaagtatacactggcggaaaagtctaagattagcgaagcaagatgcatgcgaatggcaagatgcagaagattatgttcaaaaaagctcaagcgggactcagattctaccctcaacggttaatattcaaaaaaattggacactcccacctagcggctggacaaaatgcaactatgatggtactttcaacagagacttgccaagtaaagctgcttggattatcagaaatgacagaggaacgttcttaggagcaggacaagcggtggggataacaacaacaaactctcttgagagcgagttacaagctctggtcatggcaatgcaaaattgttggagcaaaggccataagaaggtttattttgagggagataacaaagaggtagccgatacaatcaatgacaggaatccaaactttgcggtttttaattggctaagagaggttgtggcttggaaaacaagatttgaggattgtcgcttcacatgggttcgacgaaattccaacatggcagcagacacattagctaaacatgcactaccttcacatacttcttatcatttttctagttttactcctcatgtaattacagacatactccatcgagactttgtctctgcagttcaataataagattgatgttgatgaaaaaaaaagaaagtaaacttagtaaccgaaatatccgataaccgaaccgaatacccggaaacccaggattagctatagttaacaaaattaaatggataaaacaaaacgtacggttactacaaaatatccggcccataaaaggcccagtgatctctgaaaacatgcttcatgtcagatagataaaaaaaaaaaatagttattacggtcaaactttttttcctcttctgtgtttaaatttccaaatctcagtgtaccccacaaaacaaaattcgaaaaacctcgcaacgagcgcgagattcaaaaatcaaaatcaacaacacgcgaatcaaaagaaactgactcacacgcgcctctctcctcgaactccgtctcttttctctgctaaaacaaaaatcatctctcttctcgctctctgcttttgaatctctcttttttctctccaccacctgagattttcccatcactttcccggaaaaagcagcgattatcttcatggcttctcactcaccactatcccactgatgcttcagagtatgtttcgctactctctcttccccttaatttttcactttctctgcatttttctgtgttgttctttggaattagagtaatgcgcgatgaagaaaatggttgaatcgttactttagagtaattcgctgttgttttttggttattatcatcgtcttctatccaattttagagcgaattaagtagagattcgattttgtttagagtagagaaaatttcgaattcgctgttgttttttggttattatcatcttcttctttccaattatagagcgaattagggagagatttgaatttgcttcttcgattcaccagatccttgagctacatgtctcagactcaattctaattccttgttgcagttattggatttgaggaaggattatgaagacgaacatgcaagtaaaaggaagaggaggaaacatg

SEQ ID NO: 30099 - DNA, 3003 bp, Unknown; identical to SEQ ID NO: 25878
  misc_feature (1)..( 3003): 2750-1469P.txt file - cDNA_ID_3025995; gDNA_ID_2214564; Annot_ID_185949

SEQ ID NO: 30100 - DNA, 3000 bp, Unknown; identical to SEQ ID NO: 12672
  misc_feature (1)..( 3000): 2750-1469P.txt file - cDNA_ID_3026009; gDNA_ID_2214565; Annot_ID_185992

SEQ ID NO: 30101 - DNA, 3003 bp, Unknown
  misc_feature (1)..( 3003): 2750-1469P.txt file - cDNA_ID_3026013; gDNA_ID_2214565; Annot_ID_185991
tcacttctttccatccataaaaattgataagatccacaagggcagacatttggtgggcatcattaggtgtagtccgaagaaagaagggaaattggagggcagagagagttggatcagttgctgcaaatgagacaagaggaaagtggagcccttttgcaatatcggaaattgtatgagcaacagaggatgaaattggaccgatcatagccaccacttctttctcaagcaattcaaaagctgcaaaacaaaaaccactgaagcttaaaccaggcccttagtggtaaaaccaaagttttgtttccacttatgtacaggaaacacaggtcctagtaacagcctgtttagggtatgcggtctatattgttctatgcattattagcattcggaacccaaaatatgtaccaataaaaaacggattaaaacgtaaatcgatgtgccaatcatttccaactatcacaaaatgaaatattgttgctactgatgtgcattgaccgctttctataatatgtttgatatactgtatcagccatggatgagtgtcacaagtgtttgaaacacaaaagaactagaagaacagtcacggtacctccaaaggacccacgaaagacattgcaggcagaatcctccattaatagccgtagctccgtttctttgagaaagcttttatcattgttcacatcggaaacagctgcctctagagctacttttgcagctcttccgataaccgaatcaaaagcaaaaacagcaccgatgttcaccagttgaggtctttggcaatccattggaaccaccagaatgaccacaatcagtgccgtaatagcgacagatgggtcaatgcccagtcccatggagataatgcaatcaaagtaaggaccacttcagatagtttgtgttggaactagaaccatctcatttaaatctagcaactcttcattcagcattgaggatgagaagattagagaactaagcaaggtaaagtttccaactttgacctgtagagtcaatgcgattagaagacgaatcaagatctaagcgaagagcaatcacaagtcaaaccaaattgattattttagctgaaaactagcaacaatgtggatatgaagacttatatacacaaactcatccggacagaagaaaaatctgaaaaagagtttttacaaattcattgaaattaacaacagtgagacattctctttacctctttgagctaccttctggttctctctgcggaatatacgcaaacactttgtaggcataagttaaaaaagggaaattttacgacaacgcaacgaatttttaacaagagaagtcaagaactatcttttttaaaaaaccatgatttgacaggagattactaaaggaagagaaacaaaactagagagatcaaatcatgcccagaaattcatccatcattcttcttcttctgagaacaaaatagaagagagaaattgaaaaacgtgtgactgaagtgcttttttgattcgagctcacaaagtcctatctagtctatatactctatagtcacagcagccgtttgtttgtatttttgttttcagtggggcccatcattattgggccctacatgtaacggcccattttgttaagtttatttaagattagattacaatataaatattttaattgccatgtgttaatcattttatttcttctcaaaagtttattctcttaagttaatttgtcaatgaaatgttaatagtatttcattttatttttgcataaagagagacccgtagcaaggcaaaatttgagttggcgttttttattcataataaagatttttaggcggcaaaaaactattacataatgagattttatcacttattcatctaataatatttaattaaattacatatgtgtttttttctagctatgtcatttatttttacaatttatataaaattttgatatgtttccatgtatatatatattttaataaatgaaaactcaatccagaaaacataaattttgattttattttaaattatatgtttttatttataatttgttatctcttttatacattaaggtgtttttgcaataatacagtcttaatttttaaaaattacaattaagccctaaactttgtaaatgttccaaattaggaaggaaataaagaaaggagacaacttaaggttctcttattaaatgccattccctttctttcttacaagtcacaacctctctctctctctctctctctctctctctctctctgcgtctttctctttctctctgtctgaagttgagaacacgaaccactgaaaaacccgcgaaagactcgagcacgaaccaacaatggcggaacccaaaaccaagtatgatcgtcagctaaggtgcactctttctcctcccaactctctttctcttcttcaacttctctgtctctttcatcattcttcttaatttcgctcaaattgtgatgattggggataaattcataggatttggggagaattaggtcaatcagctcttgaaaccgcgagcatatgtttgctcaattgtggtccaactggctctgaggctctaaagaatcttgttattggtggaatcggaagtatcaccattgtcgacggatctaaagtagaaattggcgaccttggaaacaatttcatgggtataattctctctttttcatctttcttaagcaatgcgtttcttctatttgctgtttattgacatttattgatgattgttgttgatgtttcagtggatgcgaagagcgttggtcagtcaagagccaaaacggtctgtggctttcttcaggagcttaacgattctgttaaagcaaattttgttgaggagaatccagacactttgatatcgacagacccatctttcttctctcagttcactctagttatcgccactcaggtacattatgttgaggattagatagtttctagtctttgttttcagattttcacagagcgtttgccttattagtttgtcatgtgttgattgtagctagtagaagattcaatg

SEQ ID NO: 30102 - DNA, 3000 bp, Unknown
  misc_feature (1)..( 3000): 2750-1469P.txt file - cDNA_ID_3026029; gDNA_ID_2214565; Annot_ID_134943
cttcaattcttacgcgctgtatgcttacgattctgtttggttggtagctcgcgctctcgatgttttcttcagccaaggcaatacagtgactttctctaatgatccaagtctgaggaataccaacgatagcggcattaagctatcaaaacttcacattttcaatgaaggggagaggttcttgcaggtcattcttgagatgaattatacaggtctgactggacaaatcgagtttaattcagagaaaaaccggattaatccagcctacgacattctgaacataaaaagtacaggtccactgagagttggatactggtcgaatcatacaggtttctcagtcgcgcctccagagacattatactctaagccttcaaacacatctgcaaaagaccaacgtcttaatgagatcatatggccaggggaagtaataaagccacctcggggttgggttttccctgaaaatggaaagccgctgaaaatcggggtgcctaaccgtgtaagctacaaaaactatgcttctaaggacaagaacccgcttggtgttaaaggcttttgcatcgacatctttgaagctgcgattcaattgcttccatatcccgttccacgtacttatatactatatggggacgggaagaaaaatccttcatatgacaatctcataagtgaagttgctgcaaatgtgagtcctacttcttcttctattttactcaatcaattacacgaaacagtatacttatgttttgttctatttatgtctctagattttcgatgtagctgttggggatgttaccatcattacaaacagaaccaagtttgtagatttcacgcagccatttatagaatcagggcttgtggtggtagctccagtgaagggggccaagtctagtccttggtccttcttgaagccattcactatagagatgtgggctgtgaccggtgccctttttctctttgttggagccgtcatctggattcttgaacatcgatttaacgaagaattccgcggacctcctaggcgtcaaatcattacagtcttctggttagttccatacaattattgaatcgacacaaaactcatatgtattagtttaagctcaagtgctaaagctttgctttacccccttcctttctcgtcttcaatattgcaggtttagcttctcaacaatgttcttctctcacagtatgcacacaattacatttaagatcatacgaaaacatcaaagagaagaaactctcggttcttttcttttgttaccaaggtcgcaaggtgttttattcttcttcctttgttgatcttcaggggagaatacggtgagcacgttgggaaggtttgtgctactcgtatggttatttgtggttctaatcatcaactcaagctacacagccagtctcacttcaatcctcaccgttcaacagctaacatctcggatagaaggaatggacactttaatagcaagcaacgaacccattggagtccaagatggtacctttgcgtggaaatttctggtcaatgaacttaacatagctccatcaagaatcattccgcttaaagacgaagaagaatatctctctgctcttcaacgtggtcccagaggcggtggcgtggcagccattgtcgacgagcttccttacattaaagctctcttgtcaaacagcaactgcaagtttcgaacagttggacaggaattcactcggacaggctggggatttgtatgtgaaaaccaacttcaattttttaagatcagtctctgttaaaactttgcttaatggatctcgattcttgcaggcgttccagagagactctcctctagctgtggacatgtcgacagcgatcctgcaactggctgaagaaggaaaactcgagaaaatccgcaagaaatggcttacctacgaccacgaatgtacaatgcagatttcagatacagaaaactatcaaatatcggtacagagtttctggggactcttcctaatatgtggcgtcgtttggttcattgcactcacactcttctgctggaaagttttctggcaataccaacggttaagaccagaagagagtgatgaagtacaggcgaggagcgaggaggctggttcttctagagggaaaagtttgagagcagtgagtttcaaggatttgatcaaagttgttgataagagagaagcagagattaaggagatgcttaaggagaagagcagtaagaaactcaaagatggccaaagttcagctgagaattcgcagtcgaaagatcacgaaactccacagtgagatatataataacgagttacacaatttgtttaatgactgcagatataacattacacttagaaaggtacatagatttattacatagatagagataaaaatgcaaaacaatttccctaccatcttgcaagacgaacaagtgaactgagtcatggtttcaataccaagtagtctcaacattttaaaagatctaaaacgtaacactaagaaatgtaccttgctaaagaatttgcttaaggcaatgcaaggttgtaacttgcaagtgtgtttacgaatatgattcctccaaggcgtgagagataaggaattttgaaatgatcatgtctttagactccctgaaaaataaaaaataaaacatctgcaaattcaagagtcgaaagttattagaaccgtagagttcacatttttctagactatgtagaggatgtgaaacttattcaaatgtttagaacttaagattttgtaacagatcatgggctctcttaattagtgtagtccttcgggtgactattttttctggatactatatacatcctccgaggaagattatgggcctaaggcccggtagtgttcgaatttaccactgaatcaaaccggaaaaatggtagccgtttaaaccggttcgctttaatttagatttggccaattattaagtagccggctcttcgtttccgcggtcaacgacagattaaagcagagagaaaaacaaaatccattgaagaaggagaagaagaaaaaaaatg

SEQ ID NO: 30103 - DNA, 3000 bp, Unknown; identical to SEQ ID NO: 30102
  misc_feature (1)..( 3000): 2750-1469P.txt file - cDNA_ID_3026029; gDNA_ID_2214565; Annot_ID_185987

SEQ ID NO: 30104 - DNA, 3003 bp, Unknown; identical to SEQ ID NO: 25958
  misc_feature (1)..( 3003): 2750-1469P.txt file - cDNA_ID_3026036; gDNA_ID_2214565; Annot_ID_185983

SEQ ID NO: 30105 - DNA, 3003 bp, Unknown
  misc_feature (1)..( 3003): 2750-1469P.txt file - cDNA_ID_3026039; gDNA_ID_2214565; Annot_ID_185982
gagcatcaaattctgattttgatcataagttcataacttctgtacttgaggcttatagtcgaattcattgattttaagagcaaaaagaaaagtatttctggaaactatggttttgtgtattcgtctagtatttaaagttttgaaggtttaactatatattttgctttcaattattcaaatcccatttgaaaatgtgatagacgaaaaaaggtaagtggtaacatttttttttctttctaatcgacggattaaaataattgtgtctttttagtacccttttttccggttattgtacgaatgacttcactgaaggggaaaaaataatagttaaccataaagtaattactattctctacctagcggagatggtttatttcggtttagtcgaatggtttagtaccctatataaaccatttaaacttttaaagttgcaaagagaaacagaaacagagattgtgttgatcgtttttgaacactcgtcaagatttagatcaagattcactttttagtctttctctcgctcataggtatgtttctgcagattctttgttgtttctactaaatctctttcttagctcttttctcaaatctctgtctctccctctccgatcgatctcaagtaaacagtaactctgttcttatctctccctagctgctcattcaagacttgctattttcatctttttgtaatgcttcctgcgttttaccctaaaaacgaaactatagaagagacgagatagagattctttggaaagaagttaacatgaatgatgattgggattgggagggtttttatgatgagatagaggattttctcaagatattcggagaaccagaggtaaagtcttgttacattttcattgtataactagatcccacatttgtttaacgattcaccatattggttagacaccagcgttactaggagatgcagaaacgacacttccgttgaacatcaatcctcgtcccgagcctgtaccatctcaatttcaagtatctctctttcctttggtttttcgtttctgtcttcaacaagtttccatctttctaacacggtttatgatcatttctcttagtaccaaccaccgccaccacaactgccgttatcgtctagtttacacgctatacaagatcttgatcagtctaggcaatttggatacaacgagccaaatgtttctttatgtgaaacaagcaacagaactgctcagtttcaacgtggacactttcactatcaggtatctaatcgatacccttcgaaaactgctcaaagtgtctatcttttataagacaataagttgctaatatatatgtatcatcatttgctttaggaactaaacacaccatttgcaacagagagcttaaattctttattggcctccactgaagcgaaccagaacttatacacagtgccaccacataatttcggatatggtgagcccattggttctttatatgaaactagtaacagaacttatcagcttcaacgtggacactctcactatcaggtatcatcaaatatgatcttatccgtttcatctgctcaaaagtgtccatgttttataagactatgagttggtaatatatgttgttatcatattctgtaggaactatacacaccatcagttgaatttcagacgttattcccactgccacctcttaatattaatttcaatgagcctggtggtggtggttcttcaattgctgctgattctagtcaacaacaattcagctcaaatctacctatgtggcatgaaaatcagttgaacataggctcttttgactctggaccttcctcttctacagtggtaatgtcaaacatggacctatccacattcggtaaatcctctgaaatttgcaataaagcttacagatttgatatattaatcacacttgtcattaggtatcatcatcatcatcatcatcatcatcatcatcagaaaaccaacaagatcatcatgaacaagttgtaccaccaaatgaacttgatccattgaccatccagagaaatcaataccgagaggaagcaaaacagagatattttgagaagaagaggagtcgcaagtaagtgtttcgtttagctttctagttagggctgggatttcatcttcttattattgaggattttggtgaatctttgcagattcgtgaaggcacaccgatatgaaagtcgagcacaaacagctgcgaagaaaaaacgaagcagaggtagatttgtgaaaaacgatgacgaattcgacaatgaccccccagctatacagtgattgttctacttgtactttcgaaaccttggtgaaaaatttgtaaattatgggtgtcattgtcaagctttgttttttttttttttttttttttgtctctgatggtaccttcaatgtcacggaacatagaacttatttactacttctccacttaaaataactaaattggcgaaatgacccctcaatttcttcatttactttcaatgttacccgaaagtttaattttcttgtactttcgactttttcatttctccaaattcaccaaacactctctaattatcaactctccccacggccgttgccgccaacaaatccgccgcgaatccccaaatgtaatctccataacctctactatatcgacactgtgcagcttagagctgtcaaatggtccagcagcaaagccaggagaaactggaaacctcttagaccatcattaacgcaggcctcttaggtgggtttttagggttgttttgtgattaaaattaaattgcaaattgggctaaaatttaagaggcgctcttatataagagggccaaattatattaagaggcggtgacgtggcatgggtgagttgtctgaaaattgaagaaaaggaaagaaaaaaaaacagtcgtgggtttttgtttcttcagtctgtcgacgcttgctctctctctatttatcgaattccccgacggtgaacatcaccagacaaggaggaggagactaggaagatcgattttatcaatctcaattgaacaagatg

SEQ ID NO: 30106 - DNA, 3003 bp, Unknown
  misc_feature (1)..( 3003): 2750-1469P.txt file - cDNA_ID_3026045; gDNA_ID_2214565; Annot_ID_185979
cgttcgtgatgactccaagctgaagcatgacgtagacaggaacatagttggtcaacattttgtcttcatacgtcgtcgtattgaactctgtcgcctgtgttttcaagattaatgattcaaaaacacaaaaccagagagttaacagaaaaaaaagctcaaagattgttgttactactaacctttggttctgttgcagaagaagcagtggcttgatgcgttcttagagatccctccttgattgataatctccattggactcgttttttagtttctttatcttgtacaaaaattgaagatcctttgtggagatttcttccgttgatcagattagggttcatcattcctaatacgcttgtcatggtaccttgcacttgacggaactacaaaaatcatttactggaatcattatgatcatacacacacaaaaataattttttcagtgaaattaattaaatttgctaattttctggcgcgttcgtatgctatcaacaaaacgtggccataattttcttgcccaatttttttttttttttttttgtatttttgtttagtcacgtttttattccttgttttgtagtttcacggaaaatagaagaatgaattatcatataaccaataaatatctatgtgatactaggatagtggggtatgcaacattcgatcagtgtccatgaaggttctccagttactaatgaaaaatgtatgctcctgagacaactcatcgtgccttgataaataatcaattccatggacagtggtcgatataagatcctctgatttctaagaaagaccagacctctgattacatatcaccgacaacttctgcttctttccatttaagatatcttatgatttctaagaaagaccagacctctgataggactgaatctttcaaatacaaagtcatacggaattttcatgtgactagtggcggctacatgagacgacttctcatccggattatgaggctgaggtgaggagaagaaaaatacttcatcgttgtttttgcaggcaaacaagagctgtgggcgagccaaagatctggtcaagaacatcacggtaaaatagggatggccaagtatggaagcccatagctttgataacatctcgctataaattttttttttttttgaaaataatattaaattatatttaaagaaaaacatagcgtttgtacaactagtgcatcgaatagtagaaaattttagcagaaaattagaaacttttacacttagatccttgtttcaaaccaaacttgtaatccgttatcatagcgtttatcgcctagaagtcggattgtggaaaacggtttcggatttgtttgttaatccactcgatgatccaagaaactgtgtgtggagctttcccatgtcgtcgcctatttctccaccattaagtgaggtccttggtcgcatattgcataggcatgcaagacgatcctccaatgataaatcctagggctttgcggcttcggctctgctcttccacgatttcaacttatttttagaaaaagttgatctcaagtagagaaaccgaatgacgtgaagggctgagaggaagcccatgtaggacaaaatcagtctcgtttatgttcggtcgggctttttcaccaatctggttgaccactatcgagtcattggtaccgtaacaacaaagaagtaatacgtctgcacaatatgcattatctaatccgtcgaccaaaacaaaatggtgttggcattgacttttttttcttaacgtcatggtgtttgcattaacttatcttttttttcccttcacgtagaaattttcaaatggtacttcacttaagaattttagtttttttttttaaacatgtctttctttttagaaaaatcaactcggcctaaccccgacgcacaagaagtttattatcaaaactacgaacaactcgataaatctagacaataaaatattcatcatgaacctattaggaaaaaccgaattcaaactatttttcttttgtacctttcttactttatatgtgaaatattttagctttttatcaaattaacaaacgtaaacaaattaagtgaaaatgattataataaattaataatgttctactattgtcaaatacgaaatcttatgtaattgtcttccatttttggatgatttttcaactttacatgaacaaaatctagtactatattaagatttaagagatttgctttgataagacaaaagaattgttaaagtcaattaacttgcataagccgttgaccaaaacaaaaacatttgttttcttaaccaaaaaaaaaaaaaaaaaactctttcgatttgtttatccctctgtctcgctttcattgattattgtctttgctattaatctaatcatcacaacgtttctcttttcatctaaaatcgtttctctccattaagacttttattgattgttccttttctgggttttgccttccaagtcttccttaattcttcttacaacgtaaatactcatctcgtgaattgttcataggaggaaactcaatgcaatgtacactttgacgtttagggaaaaaattgaagacgttttttttttttgttaatgcgagtttttcgctaaaatacaaaagagggttttaattgaatctttctcagccgcttcaataaagccatcgacttttttttttgtgattcagattgaatcttttgatgggtttactttatttttattttctttggtatcaattgggtttaacatcatctcgatgcgattgttcatgttgagcagtgttgacgccttcttcagagtagcagcaagctattggtgaagaaagtttcctgttttggaaggtactcatttgtctttcttcgttgtaaagtctttcactttcgtggttggttattagacactagttttagttgaatttcgtaagagttaggttttaagctatgtcagttgttttgcgattggtttcagaacaaaactagagacagagaaagtttttgtctttggcatctatgtttgggggtgtcttgtctatg

SEQ ID NO: 30107 - DNA, 3000 bp, Unknown; identical to SEQ ID NO: 12660
  misc_feature (1)..( 3000): 2750-1469P.txt file - cDNA_ID_3026049; gDNA_ID_2214565; Annot_ID_134934

SEQ ID NO: 30108 - DNA, 3000 bp, Unknown; identical to SEQ ID NO: 12665
  misc_feature (1)..( 3000): 2750-1469P.txt file - cDNA_ID_3026049; gDNA_ID_2214565; Annot_ID_185978

SEQ ID NO: 30109 - DNA, 3003 bp, Unknown; identical to SEQ ID NO: 26310
  misc_feature (1)..( 3003): 2750-1469P.txt file - cDNA_ID_3026055; gDNA_ID_2214565; Annot_ID_185974

SEQ ID NO: 30110 - DNA, 3003 bp, Unknown; identical to SEQ ID NO: 25955
  misc_feature (1)..( 3003): 2750-1469P.txt file - cDNA_ID_3026059; gDNA_ID_2214565; Annot_ID_185973

SEQ ID NO: 30111 - DNA, 3000 bp, Unknown; identical to SEQ ID NO: 12655
  misc_feature (1)..( 3000): 2750-1469P.txt file - cDNA_ID_3026063; gDNA_ID_2214565; Annot_ID_185972

SEQ ID NO: 30112 - DNA, 3000 bp, Unknown; identical to SEQ ID NO: 12683
  misc_feature (1)..( 3000): 2750-1469P.txt file - cDNA_ID_3026078; gDNA_ID_2214566; Annot_ID_186004

SEQ ID NO: 30113 - DNA, 3003 bp, Unknown
  misc_feature (1)..( 3003): 2750-1469P.txt file - cDNA_ID_3026122; gDNA_ID_2214566; Annot_ID_186020
ctttaaagtattacccaaaggctattaaagtcgttttttccaatttgggctcctgatttattagtatgggagggcttagttttgggctttaaagtatgccccaatgcctaataatgtctagctagttcttcgttatactaaagaacgaattttggaaattcttgaattacgattgtacccttatattaatttcatcttttgtcttattcttatttatgcaaaagttatgcaaaagttttaagaaattagcagccaagcctaaagaatcattgagagtttataagggtgatttggtaattgagtagtttattagctaatttgatttcagtggcacgtggtaaattactggtggtttaaaactattgtacgtggacgattcttagccaacgaactagtacactctagtgcgaacaggtacatgattaaattcgtggacatccaatcatatctcgtccaagataagaccaaaacatatgaggtcattactcactaataaacatttaaacttttgttttgtcaacgaatagtgtgtttttcttttgtcattccaatttttttctgttttcttttcactattcacttttggtccataatattttatgggtatataagataatcgtttttgtcttcatacatggtaacatggatgtttatatatgtaatagtgttaaaaagaaaaagtggtcggttatacttaacttattatgatagagctttgaaaacaaacaacacgagatggagaaattagtcattcaacaaaagaaaaggacgaacgcagtgacttaacatgaaactgtgagcggcccaaaatcatttatgtaatggacccttaacttttcatgcacacgatttttctcatttatatgtttttctgctctctttttttcctctttatcattactttaatttattttatgttcttttttcgaagcaccataattgtatgctttcaccaaataatccaaatttagaatcattaatatgtcaaaaaagaattgcatatattcaataaaacgtaatgctaagtagtacaatgcatgtattatacaaaatgtaatgatatagatccaacgtatatatcaaagtggaccaaaatatatcttatgtattagacgagtttactatgcaaaatttatgattctattccgcatggagcgtgctaatactacttcgaacccctttgagaccaatatgtgattctatattctatctagtacaaattatgagaagtatatacgtacgatgagagtataaaacatttcaatatttgtatagagaggacaccacttggttgacttgacccacgataagatattgaagaaaccaaacttgtatagtacgaattcgaaatcgtaattgatgatgcgattcgacaagtccaggggctccctcccacgcgcaatgggcccagcaaccacgtgtggccactagagagaataaaccattagcccacgtgatcttgggcccaatcaatctctccctcacattaaacgacaaaacaaaagctcttctgggttaaattgataaatatcaaaactttaaaggtaatttgctaaaatcgccacacaaaaaaagtcgcagaaaatatatgaggaaacaaaaagcgaagacgacaaaaaaaaaaaaaactctgatttttttttgttatctctctctatctgagaggcacacattttgcttcgtcttcttcaatttattttattggtttctccacttatctccgatctcaattctccccattttcttcttcctcaagttcaaaattcttgagaatttagctctaccagaattcgtctccgataactagtggatgatgattcaccctaaatccttccttgtctcaaggtaattctgagaaatttctcaaattcaaaatcaaacggcatggtttccggagtcgggggtagtggcggtggccgtggcggtggccgtggcggagaagaagaaccgtcgtcaagtcacactcctaataaccgaagaggaggagaacaagctcaatcgtcgggaacgaaatctctcagaccaagaagcaacactgaatcaatgagcaaagcaattcaacagtacaccgtcgacgcaagactccacgccgttttcgaacaatccggcgaatcagggaaatcattcgactactcacaatcactcaaaacgacgacgtacggttcctctgtacctgagcaacagatcacagcttatctctctcgaatccagcgaggtggttacattcagcctttcggatgtatgatcgccgtcgatgaatccagtttccggatcatcggttacagtgaaaacgccagagaaatgttagggattatgcctcaatctgttcctactcttgagaaacctgagattctagctatgggaactgatgtgagatctttgttcacttcttcgagctcgattctactcgagcgtgctttcgttgctcgagagattaccttgttaaatccggtttggatccattccaagaatactggtaaaccgttttacgccattcttcataggattgatgttggtgttgttattgatttagagccagctagaactgaagatcctgcgctttctattgctggtgctgttcaatcgcagaaactcgcggttcgtgcgatttctcagttacaggctcttcctggtggagatattaagcttttgtgtgacactgtcgtggaaagtgtgagggacttgactggttatgatcgtgttatggtttataagtttcatgaagatgagcatggagaagttgtagctgagagtaaacgagatgatttagagccttatattggactgcattatcctgctactgatattcctcaagcgtcaaggttcttgtttaagcagaaccgtgtccgaatgatagtagattgcaatgccacacctgttcttgtggtccaggacgataggctaactcagtctatgtgcttggttggttctactcttagggctcctcatggttgtcactctcagtatatggctaacatgggatctattgcgtctttagcaatg

SEQ ID NO: 30114 - DNA, 3003 bp, Unknown; identical to SEQ ID NO: 16597
  misc_feature (1)..( 3003): 2750-1469P.txt file - cDNA_ID_3026129; gDNA_ID_2214566; Annot_ID_186014

SEQ ID NO: 30115 - DNA, 3000 bp, Unknown; identical to SEQ ID NO: 12709
  misc_feature (1)..( 3000): 2750-1469P.txt file - cDNA_ID_3026152; gDNA_ID_2214567; Annot_ID_186058

SEQ ID NO: 30116 - DNA, 3003 bp, Unknown; identical to SEQ ID NO: 25972
  misc_feature (1)..( 3003): 2750-1469P.txt file - cDNA_ID_3026160; gDNA_ID_2214567; Annot_ID_186052

SEQ ID NO: 30117 - DNA, 3000 bp, Unknown; identical to SEQ ID NO: 25971
  misc_feature (1)..( 3000): 2750-1469P.txt file - cDNA_ID_3026163; gDNA_ID_2214567; Annot_ID_186051

SEQ ID NO: 30118 - DNA, 3000 bp, Unknown; identical to SEQ ID NO: 12704
  misc_feature (1)..( 3000): 2750-1469P.txt file - cDNA_ID_3026172; gDNA_ID_2214567; Annot_ID_186047

SEQ ID NO: 30119 - DNA, 3003 bp, Unknown; identical to SEQ ID NO: 26316
  misc_feature (1)..( 3003): 2750-1469P.txt file - cDNA_ID_3026203; gDNA_ID_2214568; Annot_ID_186098

SEQ ID NO: 30120 - DNA, 3000 bp, Unknown; identical to SEQ ID NO: 12742
  misc_feature (1)..( 3000): 2750-1469P.txt file - cDNA_ID_3026209; gDNA_ID_2214568; Annot_ID_135015

SEQ ID NO: 30121 - DNA, 3000 bp, Unknown; identical to SEQ ID NO: 12723
  misc_feature (1)..( 3000): 2750-1469P.txt file - cDNA_ID_3026209; gDNA_ID_2214568; Annot_ID_186096

SEQ ID NO: 30122 - DNA, 3000 bp, Unknown; identical to SEQ ID NO: 12725
  misc_feature (1)..( 3000): 2750-1469P.txt file - cDNA_ID_3026213; gDNA_ID_2214568; Annot_ID_186094

SEQ ID NO: 30123 - DNA, 3003 bp, Unknown
  misc_feature (1)..( 3003): 2750-1469P.txt file - cDNA_ID_3026220; gDNA_ID_2214568; Annot_ID_186090
ggtgacgtttgggctattcctagctagcaaggtatcattggttagagctgtgtcgtacatggtggctcagtgtctcggagccacttgtggagttggtttggtgaaagtcttccagtcgacttattacaaccgctacggtggtggagccaacatgctctccgacggatacaatgttggcgttggggttggtgctgagattatcggcacttttgtcctcgtctacaccgtcttctccgctaccgaccctaagcgaaatgcccgtgactctcacattcctgtaagcaattttaactatcctacaagcctcaatcacatgaataacattaaaaagtatcaaaaacctagctaaagacttatagtagtacataaaattgatagttttctttcgtttcatttatttttaacaaaatgtagtactcgtggtaattacagaaataaataatggaagaaatattaggatagattttttgatttcgttgtcgacaatttttcgtacagaatcaaaatctagtgccagctatataacgcatttatttaatactgaaaacgatgtcgtctagccattttggccctaacgaaaataatacggaccaagtgtaacgtctatcttcttctatgagataaacgacgaaagggtgtccaattatttttcactcatttcttgttcgtttctttggtaccaaatgtctatttacacgttataacgacataccatatttgtgctccacgtctcttcatcacatgtctctgtatgtaaatggtccatattttgcatttccacaacgacccatgtgtatgtgtacatacattttccatgatatttgtccttgcaaatatatatgattcgttacaaaacaaatctttctgttatgcacatggtcattaattgattctttttcccattctagtaatcttggtacctatgattcattcaaatttaaatgtctatgtcattgattgttaatgacgtaagttgatttattttgtatgaaattattgaattgtaggtattagcaccattgccaattggattttccgtgttcatggttcatttagccacaattccaattactggcaccggaataaacccggctaggagttttggagctgccgtcatctacaacaatcaaaaggcttgggatgatcaggtttgtattttcaccatctgatattcgttcttgggttttaaattaacatattaatgagttttgttttaataactacagtggatcttctgggtcggtccatttgtgggtgcagccattgcagcattttaccatcagtttgtgttgagagctggtgcaatgaaggcctatgggtcagtcaggagccagcttcatgagctccatgcttaaatttgttatttcgaactagcgaagaggtgaagaattctttgggccaggaagggaggaaggaaaaaaaaaagggacccaaatcatataaaagaaaaaacgaatattatttaagatggtcggtgagtgacatttactgtgtcttatttgtggctttgtgggggaggtttgtgtgtaacaatttgtaacgtacaagcaatgtatgtgttatttgatgcatatgatatttatatatctacttattgatgattctatctttgatcaatcatcattataacttaaatttcatagaaaaaaacacaaactccaaaaccataaactactattgttcctaaattctcaggaatgtcaatgtcgatcacaatcttaaaatttcatgctaaagatcctttgggtcttttccatcaacggtgcatcctatcaatcactgaaaaataaagggcacaaacatttgtaatcgtctcaaacaaacaaataaaaaatgttgaaatgataacgccatggataaaatgttgaaataaaaataaatgattcacgacacatgtttagctatgtataggagaaaaaccaaatcctctcacttttctcttttatctggttcccctcagatttctttactatcttgttcctcttactttcctctatttctttggtattgccatctagtgagatcttaacatctcacaacttatatggcaccttcctctattttctatattttttcaaccgcataatgaacatgacaccaacaatcagaagtagaaacccaaccaatatccacaggtgtgaaacatagaattaccagatttagcatcagtctgacacatcttgtatggatactaagagagagggtagagtctagcatgattcttgagaataggtagataatcggcaataaatgcaacattgtttacactagtaaattgacatatttagcaataaaaatgtatatataaatgttaataaaaccaataaaagaaatctatttcacatttaatatcatgcgattgttgtaagatgtggtagcttagccgatcttccaaatatgcaagatctagctcatatttttgagcatgtgtagtttaggttcaaaataatatcttagagaaaataaagttggtaattagaatattattagaaatcaactcacacacatcgtgtgggtttattggtatcatatattattctacctattttattttattgaacaatgtgtctttaaaaatgaataagtacataattttttagacttatattttgaaattttgtctatattaatacttactatatatgaattgaacttgttaaatattgtattgacttttgtagtggtaagaagaaacaataaaaatccataaaaacaataacttggtttagcttttggttacgtatgtaagggggttactaaaagtaaaaacactgggtttgggctgggttcagtaactctcatacaaaatccataaaaactttgggctgggctcattcaaaatccatacttattttattactttcctaattaaaaaaaatacacatagcacaagaaaaaccaccgcccaagcttctctagaacctctccatcgttctcactatcactccccccccccccaaatataaaccctaattttcacaatcacagtaccaaaaaaaaatg

SEQ ID NO: 30124 - DNA, 3003 bp, Unknown
  misc_feature (1)..( 3003): 2750-1469P.txt file - cDNA_ID_3026224; gDNA_ID_2214568; Annot_ID_186089
acaaaaccattatccaaaaagacaatgtacattccgacccaaccacaagctcatcacgatccacaaatgtcgccacgtctctcgccgacatcatagaagtgtactaaccgtgtggtgtccagatgccatgtctcctgcttagaagtttccgcgacagaagattcacttcttcatctttttaaaaaaaaatgcagaatcattttcgatatcttacatgggtcactttttaatagttattgttctgttactttttttttccttacattaattaatactttatcgaatgtttgtttaagccgttttgggtaagctatttgttatgaacaataaagttgtcggaacaaagaatggagaaccttaaatgaagcctttgtatttcacgcaattgttttttacttttaagcagccctataccaattttttcacgtgttttaaacattcttgtttatagtaacaatttgagtctttttgcttcttcttttttaattacagcacgtattagcagcaaaatgatattattgacttatagtcatgtgactcatgtaaaaaataaaaattcaaaacaagaagatgttataaaaatatggatgaagatgaattgtatacatagaattaatattacaatgaatccgaatgtgtttagataagttgtaaattacaaaattgcgtagaaaaaaaaaaaatgttttgctatcagtatatccgtaatactttttatgaacggtcccatctctaggaaaaatgagtaatataattcatgaagcaattcattttcattttatttacagaaaaaaataatggtcgtcgctcgattattaagtgggacatttgtttttttttttggtattattaagtgatgcatcatctgttgtagtcttgtagaactctataatccgccaaatgcttcgcttcaaatatattcttgtatttatcttggtgtccaatcctactctgccatggacgggcctagctacgtaaattagatgggtctaccacggacaccacgtggacaagatttaatgttcatggttcatggaggtcgatcgtcttcccaaaaaaacagtcatttgatcctgtgttaataaaagtggatgatattcatgttaatatttattaaattatatggtttctcattctccattcttcatatcgtaattcttgctccacatatgaaacatttcaaatgttgggaataaaaggtttttttcagaaaatataataatcgtggtaaattcaatcccatcgcaagctctcctattggggttgggaaaatctttgaaaattttctttcaggctgtgtttagttccatggccaccttaatgaccagtatctttaaatacggcaagagttttaaatttgaaaagaaaaacaaaaacgtaaaatttcaagtattagacaacgtacattcttaaataggtgattgttgactccttgattaggagagctttcagatacattcgccccatttcactgtcatgtcatttgtatatactgttgctcgtcaaataatctgattctttgtttcaatttgtaatagcatttaaattacttttatttttctgcgttaaacttttcgactaaaggtcggtccaatttgcattttaaattactcttatattttctgcgttaaatgtatgagcgacgactctttcattttaagtagtctttttcattactttgcaacatctatcagtgtctgttattttgcattttttttggtcttttaagaactgaaatctaagaatctacgctaattacatgaatacaaccattctatcatttttctgtaattatggtgatatgaggaaaaaaataaataatggttgacagttatactaaacctaaacatattcgggtattaaagttacttggttagaaagaaaaattaaaaacccaaaatttatattttaaaatttctctttaaaggtttagctccggctatgaggatattgcgcacaacacaaagcctcgtatcaagtagtctacatgaaatgtttgcccattgtaattttgtaaactagcttgtttgttcgtgggtaaaataacttaataggaaaataccagcaaaaaaaggcgagaggaattagtgatttttccccccaacaaaattgttgcaaaataaccaaatcaaaatcaattgaaagcatattctttagacatcaatagagtcttcatagactaatcacaatcataaacacctgtagtgttcccttattttacgaactttttaataaataaaaaagaagaagataaattaattaacctcattgcaaaagaggaaaaacctaaagccacagctttccataaatagacccactcaccatctctgcacatcacccacatcttctaacagtctctcactttctctcttctctctctctctttcttttttgagtccgtgaaggctaagtctgaaagaatgacgaaggatgagttgacggaggaagagtcgctctccggcaaggactacttagacccaccgcctgtgaagacgttcgaggtgagagagctcaagaagtggtccttctacagagctgtcatcgctgagttcatagctactttgctctttctatacgtgactgttttgacagtcatcggctttaagagccagactgatatcaacgccggcggcggagcttgtgccagtgtcggcctcctaggcatctcttgggcctttggtggcatgatattcatcctcgtctactgcactgccggcatctctggtctctctctctctctctctctctctctctctctctctctctttccttaaccattttttgcattatctgatttgcatagcaaaatgcacatgcttcatcattcgaggctcctatacatgtcctcgtaacaaagaagcagaatttcaaaaataccaaatcaaccaaactatagtagttaaatgattgatgatacacaatgttggccagtatacatatgtggtaagaaaacttagctttctagaacattaaattccatccaaattaaaattccaaataatg

SEQ ID NO: 30125 - DNA, 3003 bp, Unknown
  misc_feature (1)..( 3003): 2750-1469P.txt file - cDNA_ID_3026232; gDNA_ID_2214568; Annot_ID_186085
tcgcgaatcgccgccggagcgatggagtaaaattgttacgattttgaaaaggagaagcgtggtggaagaatttcgaattaggattttgatagtgtgtaaacgacggtggtcaatccatgagctccggcgacggcgaacttcactggcaacgttgagagtttgtgtgattcgaaaacgtaaggatagcatagtttaattggatatagtgcccatttaatcaggcccaataaatttttatttggcccacttctttgttcattaagcgatgttgcatgagaagaaacatgcatgcgctatatatagcacaaaaagtggtccaaaatatttgatttcagtttacaagtaatttacatctaactattatagattgatcgagtttgtacgggatatcaagacctgataaaagtaaatttgaaaaatatttatgtatatataatcgggaaaaaacccgaaaaaaccgccatctatttaatttttggccgtttaatacccgtgtttttaaatttggaataataatacctcgtttagtttccgcgccctattaaaacattcatctaatttaaagtggtgaaattgtactcccgcgttaacggtgattaactttgctaacggaggctttaactggagttaaaatataaccacacgtggttaaatgaagtaaacaaaacacagtcgtgacctttagcctttttccccaaatcgaaaaacataaaccctaatttcgattggattgaaatcgagagattctatgtgtttggacgcttgattgactgcggtttggtcggaatttgggattgaggagtccgattagtcgcgtcgcgatgaggtatgtgttgatttagggttcatttaattctgggtttcggattaggatttcgcgttcttggtttttcctctcttttaatttcttctgttcgtttgcagtggattcgactgtctgaaactgaatataaagtacggaggagaggtctcctttgtcgatgagtcgttcacttaccttggaggattcgagaagagggacatgtcgatggatcccgatctgatgacgtggtcgatctttgctgatttccctagtgagaatggagtatctgctcccgtggagaacgtgtggtacaaacttgcaaatgaagacttagcatatgtaagagctatacccgaggatagagatagtgggattaggcaatcatcagattatttcgtcattactatatttcataattattctcttaagctaattatcgtatgtcatcaaggatacactgcccggagatatttcactttgttcaagatatttgcgttatatatttaatcgtgtcagtgtttttagaaattgtcaactccctatctcttgttagtttgccatttgtttactgtatcgagaaacgatggagtatgagtgttaggaggtcttgagaaacgttttctcattcatcttaactatatcaaatgtttaagaaccaagaaaaaaaacaatctttcattatacgggatcgaccttttctttgaaatgttgaaaaaggcaaaaaaaatttggtttgaaatctctataaattaatactcgataaattaataacttttataagttataaataattcatgtcttgactcgggactagtgtaaaaattgatacaaatcgataaattaataaaactataacttttttgaaaattctatgtaaatatatattcttatcaatattataaattaataattgtataaatttatgaatatatatttatatgtatgaatatagattatgtaaaatatgactttggtattatttttatttaatttatattaattctttgtagactttaattctaatatttttattacgtagaaaatttatttatttatttttaaacctaataatggttttcgacttgtaattggttttagaaagattattgattgtatagaaaaaactatttttttgatcaaatttttgtacaaaatttataatttatcgataaatcaaaactttattaaattaataattttttccgatcccaacattattaatttataaaggttttactgtatatactaaacgttcaaatctgttaaaaccatctaaggttttttttttgtgttttgattcaggtctccggaagtcgaagggtagaaaaatgcagagaagtgaagacatcaacgcacgatgtaggagtagctttttgttgcatctcaattatttcatcatcttttgttgtagctttagcaaatttccttttcagaaccagtacgttaaattgtgcactaagacgggagtgcgtttgaagaaccacattgtattttctcctcaatcacctgactctatgaattttcccaaagccaatttatttagaagtatgatttgaaaaacatatgtttttaaacagagctcttcacttcttcttgtgactcattttcttaaaacatttattgtgaacatgttgttgataatcaacattccacataacatatgttgcaaaaacataagtgatcgtagaccacaagatacgaggctctttttatatcgttagtgttgtccatattgccggctacataacttcgcatcctttcattaatttggaacattttggtagctctagctggtcccaagaccaaaccccattacatttaatcttttaaaaaaattgttccatccctttttcaaatactgtcgtagactatatgtttttttcaaaaaagattgccatataatattaatgtaaattttgaccgtaaatttttataatttgaatatatgtttcaaatttaatataactgtaaaacagaaaattttccaaaaggcaatttatttacaaatataacaaaaaagtagctaatatacgaactactttttccgtctgataaatgcgaaattagataacatcacttaaatgccaacacatttaatcaagagcgaaagaaaaacacagtaacttagtataagaaccaagtgtggctaaaggcaaagttggagagtaatcatgtatactatgaaaaagggaaaagacatg

SEQ ID NO: 30126 - DNA, 3000 bp, Unknown; identical to SEQ ID NO: 12730
  misc_feature (1)..( 3000): 2750-1469P.txt file - cDNA_ID_3026240; gDNA_ID_2214568; Annot_ID_186083

SEQ ID NO: 30127 - DNA, 3003 bp, Unknown
  misc_feature (1)..( 3003): 2750-1469P.txt file - cDNA_ID_3026244; gDNA_ID_2214568; Annot_ID_186082
gcacacactatattttttgtgttgacaattttactttttgaatgatcacactcgtgacaattaatgggcatgatattaaacaacacatcaaaaccgtgtacgcatcataagtcgttttcatttgttttataagagcaacccagggtccaacttatgttatcatggcacttataaccaaaaagtcttattaatattagcatttttgttagagccaacgaaaaaactagatttttttgtacggtgtgatttttattagatgagactgatttagagtatatgttttacgattgtttggtgtttaaatagtatatctagtcgacagagaagcgatatacaatcttccaagcaaaagctgattgtcgatgtagtggaaatcattgtgtgtcgtcatgagttaatgtgggctagctcatgattattgtcgtctcattttgccaatgatctttaataccatggtcaaacggcaatacctattttggttaactagtgttttacaaacgggtaccatccacaatatcgacttaagttgtatttagctactttggtcgcgataaagtagcaactttgttttccctatcacgtttttacttgcaagttgcaaacatttttattaatagttgatttcgaataatcactaaaataaacatcaaatgaaacaaaacacatctctataactttacaaggaaattaatatagtaaatatgtaaatatatttagttacttttaaatatatattaaaaattaattactaaaaatattgtgactaagatattaattttgaaaatatatatatggttactaagatattagtcaatcaatcttttcctaaaaaaaaaaatattcagaagataatcttttaacatgatcacctctacatattcaattttttttgaatttgtctttttacggacaaatgaagtggcagagagcatcaattgtactcaccattttttccactataaaaataaaaatattagaaaattaagagattttttcttagaaaaaagaaaataagatttaaataatgataaatatatatagacttcaaataggattgttggtgaaaattttgccttgctatttatacctttatagtttattagtaccgtgggagatttttgttcaaatatcatgggcgttatgataacatttatatgaattcatatgccataaattgtaattattatttttgtaaaagtaaaatgatgtcaattcaatgtccagtcgctaccaactcaatggaaattaatacatttgagtgtactaatgtgtttttcttgtgcgtgttaataaaaaatattcgatgtatgaatgattcttaactgatgtaggagttgtaggacactagctatatcttgaatcacatcagaaaagtttattaattctaagtaaatacgcataaggattgaccaattaattcacaacataaataacataaaatcagaaaaatcagttttaatatttagctctatcattaaaagtgacggattgcccattgctttccacaagataataactatcgtgacttagctaactcgttaaataagcaaaatttctctgacgctcaaaactataaaatctaatgatgtttgaatctttatcaaaaaaactagaatttgtagcgacttcgaatacataacaacaaatcaatacaacacactatacaaacaacaataaaaaaaaggatagaaagagaaactattacatgcaggtaatgtggttgcagccttcaccccgatcaactatactcatacagttttgacatttcatccatcctagactctttgttgcagcatcaaatagtccaatctctgaattcttataagccttggacttaataaactcatctcaagtctttatcttacatttttaggcataatttgaaactacattcaaggcatttggaaggttcagtctgagaataaccaaagttgcgctttgacatgagaagtgaacaagatgggttaggacattacattttgtccaaaacgtggatcttgtccattttttctttctggattataagagtcatttgatgatatcagcaatatcgtgaaaatattttaagagaataactaattctaaatcccaaaaactttgggttcgaaaacgtaggttaaagacgaatgtgttaaacattttgatcaaagttaaagagttaaaaatttatgtaacttgcaataatcaaagaaaaatagaaacttggatgaaggcataaatttagggttatgacttaaggtagaaaagagatgtagcagtgcacgtgtgctcccaaaacctcatcatcatagtgtagtgtcatgtgcataattaaataaaaaaactcactggcttgtaccattattaatcgcacaaggagtattacaaatcagttgttttcatcattctactctcatcatttcatttcctctcatcattagcttcttttttcttcccaaacttattctattgcatgatctagtcatttcttttgctaacaatttgttagtaaaattttttagatatttttgatccaaggagttttttttccaataatttttcattggtaagaacgccttcttacacctattctttttttcgtcaatttcttgcacctattttaaaaatgcaatttgatatcttttcaaataattaaataatattttctttgacaaactaaaatgatttatatatggcaaaaagcagaagcattaattaactttatagattcactttttctttttatattatggatttattagcaagacccaaaacaaaggtcaaaacagtcgcgaatctcaatacttcctcaatctcttcttcttcttcttcactctctctctctctctcgtcaccaccactaacacttccactgattcatcattctccactgagaaacatttctctcgttaattcaacacttcaagtctctcactctccgtttcttcgagtgttctttggttctcctttgcattttcttgcgtctttggactcattactgtttcttactcaatccgaagaatg

SEQ ID NO: 30128 - DNA, 3003 bp, Unknown; identical to SEQ ID NO: 26320
  misc_feature (1)..( 3003): 2750-1469P.txt file - cDNA_ID_3026248; gDNA_ID_2214568; Annot_ID_186081

SEQ ID NO: 30129 - DNA, 3003 bp, Unknown; identical to SEQ ID NO: 26321
  misc_feature (1)..( 3003): 2750-1469P.txt file - cDNA_ID_3026252; gDNA_ID_2214568; Annot_ID_186080

SEQ ID NO: 30130 - DNA, 3003 bp, Unknown
  misc_feature (1)..( 3003): 2750-1469P.txt file - cDNA_ID_3026267; gDNA_ID_2214568; Annot_ID_134996
ttgttattagagtatcttaattttctatgatttatttacgtagataattcattgaaaaattaaatgaatttatgtttaaattctcatctaattattatacaatagattgaaaaagtcacccttagtcaaattgttcatatagttttcttaaattgtctaattaattaccaaattaatccttgtctgaaaacttttacaaaagctaatacagaacaaatacaaaaaaacgtgtaatcatatcatataaacaccagtcgcagcgtttcgtagaaaaattcgatttctctaaagccctaaaactaaaacgactatccccaattccaagttctagggtttccatcttccccaatctgtacgccattttcgatttccttttttgttgtttactttagcttcatcgaccatgtttaggtttcaaattgagtgtttgttctgtttctgtagagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgagtatgcattcccaatttttcttctttcaatcgaatttgttggaaaatattttgctctttggtgaaaaaaattgatcatttgttggaactttgggtttgtgagagatagttttcttaaactagctatggattgagtttagctcagagagttttttgaagtttatagagcaaagattatgtttttttttttgtcacaatgttaatcaaccattgtttggtatgggtttaccttaacctagttcctttcctatagaccattttgcagattatttcacatgcttctactgtgttatatcttaactctgtcaaataaattgttagatttttttcttcatttaaccatcttagggtataaaagccgtatcttgatcatgtttcaaagattcttttatctttaggatctgtttgtttttgttcctttttgttcatttaaggcaaaagatatgtttttcatcatgaaggaattgcttgtgttgaatgcgttttaggtctctgattgatgagttttatgtttcttataacatcagatgcccccgttctttgttaggaagaaataagttatcatgtatgaaactatgatttatctattggttcaagataagcttgtctgatgttgcgcttaagtctcttttgctggtcttatgttgattcgttgactgtaatggccaattgactggtatctgtttctgctaatcagggccagtgataagtgtcaaaaagagaaaaggaaaactgtgaatggtgatgatttgttgtgggcaatggcaacattaggatttgaggattacctggaacctctaaagatatacctagcgaggtacagggaggtatgttgctttgactccctaatcatgtgttctgaaatccttaatatcctagtcaagagattagtagctgtgagtaacatcgaagcttgccatgatagcagttttacaatcccttcaatacgtcttgtgtagaatttttgaagcaagaaagataaatctagaccaacagtcaggatgcatattagtaaattttgaaagacatttattactctctcttttgtgcttttgttgttaacatacataataaaatcaaaatgtttcttattaagttgagactaattcggttcttttcattccctgggattggttgctgacacaccacctgctgatgcagttggaggtaaataaaccacatacttatttctactttatattccattccagtgttgcccattggcttcttacgttttgttgtgaaattatgatagggtgataataagggatcaggaaagagtggagatggatcaaatagagatgctggtggcggtgtttctggtgaagaaatgccggtatgattttgacaagtatagatgataccaatgctatacagcctatattgtacttagctctgacttcatcattttgattcaatcacagagctggtaaaagaagttgcaagtagtgattaagaacaatcgccaaatgatcaagtaattcttctctctatcacacggcctcatgtacacaaatgaagagcatagtctatatgcatgtaggttcatatccaatcttcacttcgttacaactgatgatagtaggacatgccttgtaaacttgctgatcatgttatattttgctgtgtgaatgaactatggctagtttcaaaattgtttgtctaacgtgaaattctctaaaacggtgcaggggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaatacaaaatccttaaattaaatttgtacagtacctttgttttgggtatagacaattacattttaagtcagttgatctgtatcaaatactacacttacaaaatcacaaagtaaaggcagcaattaattttgctttgaattgaaaagctttgagagagtaatcaaatgcttaaatcacgaaaacttacaaatttcaaaattttgtctctccataaattctcttaataaaggctgttgtttttccaatttgaaaattctatttttcaaaatcaagaacaggctatggaatttcaagaagctggttcatcatcaagtagaatcatcttcctctgtttcctctcctatctaaaatctctttagtcttcagaaactgattatactttgtgcagcagcaagagtaaagattgactttgtgcagccgatg

SEQ ID NO: 30131 - DNA, 3003 bp, Unknown; identical to SEQ ID NO: 25979
  misc_feature (1)..( 3003): 2750-1469P.txt file - cDNA_ID_3026267; gDNA_ID_2214568; Annot_ID_186073

SEQ ID NO: 30132 - DNA, 3000 bp, Unknown
  misc_feature (1)..( 3000): 2750-1469P.txt file - cDNA_ID_3026271; gDNA_ID_2214568; Annot_ID_134993
taaagaacaaattcttttacttatgtaaaaaatcctaaactttaaagaacaaaaattaaaatacaaagataagtaattaacattttattgggcttctaactggatttggttctatttatttgggcctacgtttgaaaacctcggtcttaaagaatttgtgtccagctccagcacaaggagaggcttatagaccatatgtcttttggtgtctgtttcaatgggcttacatgttttgttttcaggcggcctcgtcttcttgacacacacaagtttgtaacattgggcagtgtgaaacatacacaaaactaaacactaattaattctcaaccacaaatatttaagtgtgatggtgacttggtctcatataatatgtgattttgtaattttgttcgaaacccgcatatagagttgttaccaattaatacctaaatctttattccggatacgtgcttttaccaatcttaaacagaccaaaagaaaaactatgactaagttgaactgtatatacgtgttttaaactgtatatacatatcaaattgaatattaactatatgacaagattatcaaacgggaacaaaaaaaaaactatatgactaagttgtgatgttgtttgtcaaattttatgtacgtcaacaattcaacataattgacattatcgttgtttgtgtgtgtgacaacaattgattatagtatttttatacatgaattttatgaaggacagtttggtcatttttgtcggctaagtgccaaatttggcagaagcgtttttttgcatgcaaacagaattcagtcgacgctagaaatatttttcaccttcgtttgtttttcaaatttcgacattatcttagccttagaaaccttatcttgttctcgataaggtttgaacatcgtgatataaatatgtacatttcaaagctttataaaacaaaatcagaagtgtcaaagcttttaccaaacaaattaataatgtcaacgaaggggctattaaaagctggtttcgtcaaagtttgacttttgaatctgcaacctcaccgacgacaccgacaccaagacgtaacgtacgtatccgattctataaatgggactcaaatctctaaaggtgagcatacaaatacatcagaagactacataaatatatacaagagtgaagaaaaatgtcgaccgaatgtcctagtaagtttttgtatttgtattgtatagttcataattaaagttttatatgtttgtaaatagttagctaatgttcaattagatatggattcaaggcatttaaaattgtaattcaatagctataacatatatgattacattttctaaagtctgttagaaggttaattatgttacatatggtcaatccatggtgatgtttctagttcttttgttttcatttactcaaatatgagcttcttgatctccaaaatcccaaacgtaaatgattgaccgatctaacgtaacgtgatcgcagggaagaactcgtggccggagcttacgggaacaaatggtgactatgcggccgtggtgatagagagagagaaccccaccgtcaatgctgccgtgattttggatgggagtccggtgaccgcagacttcaggtgcgaccgggtcagagtttttgttgatggaaaccgtatcgtcgtcaaaacccccaaatccggctagacttgtataatttctatattcataatgaaaaagctatagacgagtcgtggttggttagtaatcaatcatgtaaaataataatcgtttgccttcataatttctgtgttactgatgcctaaagttatgaatgaaaatagtatcctatatttcaatttgtaatgtttcaatttttttttgtcagccaaattttttgatttaaagttcaaaagaacagattgtgataacgatttctaagagaaaaacacgtgtggcaagtggcaacgtgtagacaacaaatggttgaggggagaaggagcaccccgacctagtcctccgccttgaagctcttccaagcaagaatcaggaaaaccaaaaattagcaaataatggataatggaccatttcaaataaataaaataataagtgaagtacaaattaataaattaaagcaggcctgttttgctgccaaaataaataaattaaagcacttatgatatatacaaattttagaaaaagtcatatgattaacaaaattttacaagagtattttaagctaatagaccgtttagtgactagtgtgatcatcttgtagaggtctattacacgtgttagtgactagtgtgatcatcatacacatgaatttttctacaaaatacacatggatttttctacaaaatacacatggatttttctacacatacacatcccagaagctctcctaaatccaagctttccacaacccaagggtcccatgcatagtctaggtttatcgaggcccaagcttagcttatgcatacatgctccttgtagccaatatgctctagaatcctgactccacaaacatgagattcatgtagctcaagttctccatagtccaggctttggtaaacatggctacatatcattctttagattttctagattctagcttccgagagaccgtactctgaacgttaactcacgagtcatgtgcattaaatgaaatacatacacgacgttttgtatacatcacattcaatctaccaaaagtattattttacaccaaccaaatggatgtaaaataatacaaaatggaactattcaacataagtataccaattcaatgtccatttcataagtataccaattcagccacatataatagttagcagaaactacataccattcaaagttatagctagtttatatatttgtaataaggacttttcaccagttggactttgaagccaccaaaaaaagtaggtgaaagtgagttggtggggggattcaaaagttccacatgacaaatagataatcagtataaataagattagttcttcttatattgtcttattcaatgcacacaaacatttacccaaaatg

SEQ ID NO: 30133 - DNA, 3000 bp, Unknown; identical to SEQ ID NO: 30132
  misc_feature (1)..( 3000): 2750-1469P.txt file - cDNA_ID_3026271; gDNA_ID_2214568; Annot_ID_186071

SEQ ID NO: 30134 - DNA, 3003 bp, Unknown
  misc_feature (1)..( 3003): 2750-1469P.txt file - cDNA_ID_3026283; gDNA_ID_2214569; Annot_ID_186121
aacaatcatacgaatatatgtcaatatcacttactatatttaaacttaataattattagaagcccttttctatatatacatgcgtgtatgttgtattgttatatataaataaaaagtacacttatttacttaaaacaacgaaaatattttatatttttgcttctgcaagaagcatgcagtcgaacatatggacctgcgttctttggagttgttggattgttggaatcatatgataatttcagcagacgcctatacattaatacttttcattgtgattttttgtattatatatatggactaactatctgacactgtaacactacgtgtaataactataatttttttagtttataaacaaatggggtctaataacttgaaatgtactcttcaatgtgtgaatccagccaaatttggtcattataaactattttttgttatattatctagtgtttcatttattggcatcccaactagaaaaatgatatatatgaacaaacaaaatataaacaatattttacttgttacgttttggccttacactttttaaaattgaaatgactaaacccatttgcattgcatcagcattagtggtttatttattgttaagtatcaaagccatctctgctcatagattccgcgcatgcgtttgtacctccactaaccatctcaatatttatttcctttggtatttgatctctattataccaacttatttttttacatatataaaagagatattaccaaatatgttgaatctaaaaatattaaccactaaacttagatataccttaacttcgtgaatatacatatacttgtataagtattattaataaaacataaaacaaaatgactatacatgaacgaacacatcttttatcgtatatcatttcatatgttttccaataatagatgttttggaaaatttaaatttttatacaaatacaaaaaaaatatgcaaattttatataacactttcaatgttattctattagttagagatttagagttgaaatacttaatttaaataactaacaactaataattaactataaaacaaagtgtattgcattgcaatttgtaaaaatgttcttcgtatttatataatgtctaaaacatacaactttataaaacgagtgagtattgcagatatcttactgcaataatgccgacaaaaaatataaaagtaaaaatcttactgcattaggtatgctttcgaaagttaaaagttttcaagtggcaaacatttgtccgcctagacaggaataaaacaaaaaaaatattcataaaaccaaaactgttgcttttactaaagaagactttatgctacatttttaacaaaaaaaaacaaaaaaactttatgctaaattttatattttaaatgtgacaattaacaggtaacaacacgctggaaaaccagcagagatattaaatccggttaaggcttaatatttactgcttacatttccagtgacaatatagagaatctaacattaaattatatgaacatgagattaataaactcactatagtaaaataagcaggagacatcacgtgaagcgtcggattgtttgtcataatgtcttcatcgtacggcaacgcgatgaattgaaacagaagacatcacgtgaaccagtgctacatggttaactcaatcattaacggcgtatattttcttgtattgattcttctccggatcgttaactatgctcccgatttaacaccgtcagttcagtatttatacggcgcaataaattacgataatgtagcctcttgagagaatgttttgcgggttggactttggagaagaaaacaatcatataacctatctatataaaatcgagtagaacgagaaataaaattattgtaaagcgagagtgcattaggattatgtggtctaattatgaaagaaaaaagattatgccaataatgatgatatcgaataaacaccagcacgatggttttctaataatccacaactaaacaaacgtaaggcctttatttatctatttttatgttaatcttgaactatcgaagcacgacttgagctatctatgagttattacaaaaatatgatgtcgtcagtttgtcaccgagggcttattaattagataaattacaaaccaatttttgtccttcatataatttcatttaacggatcatgaaaattaagaatcaatacgatacaaaatgcataattgtgtatttgacgtgataaaagaacaacgaaccaatgcacatgtaaccatgtgataacgtatcccccgaaaacaaaaaaaaatagccaagacactacagcgaagtcgtcttttgtgatgtcgattctatatcgtcgcccccacttacaacgacgtcgtataggtttaatcatcaatcatggtttcatttataaacaatccaacaaaaaaaactttgtatacgttctaattgataaaacaaaattaaaaaagagagggatggatcctaacactgagttacagagacattagagacaaatttgcttgtgacttaactaggtcaatataaaacaaaatcaaagaaagttccaaaaaacgacactgactcgtatgtcccccattcttacttgtcacccatctaatctaaccatctcctaggcagcttcacgagccgtagtctaatctaaaatcttatcattagacatttctatatatattttaatttctttacctttttacaccactgtagaaaaccacgaattttactccataagttgatatcattttcatttacgtctccgtcactctttctccctatccactaaacacagatcccaaaaaagaaataaacgagtaaaaaatgtaaagaaacgtccctttgtttctacgcgattttctgtaaattttccttcgttttctcgcagtttctttctcaccaaacaaacccttatatcactctatctctttctttctctcacattcaaagcttcttcttcttaactctacccctaacgtcctctcatcttctctggcagaacagaaaacgatg

SEQ ID NO: 30135 - DNA, 3000 bp, Unknown; identical to SEQ ID NO: 12765
  misc_feature (1)..( 3000): 2750-1469P.txt file - cDNA_ID_3026310; gDNA_ID_2214570; Annot_ID_135049

SEQ ID NO: 30136 - DNA, 3000 bp, Unknown; identical to SEQ ID NO: 12765
  misc_feature (1)..( 3000): 2750-1469P.txt file - cDNA_ID_3026358; gDNA_ID_2214570; Annot_ID_186143

SEQ ID NO: 30137 - DNA, 3000 bp, Unknown; identical to SEQ ID NO: 26325
  misc_feature (1)..( 3000): 2750-1469P.txt file - cDNA_ID_3026364; gDNA_ID_2214570; Annot_ID_186141

SEQ ID NO: 30138 - DNA, 3003 bp, Unknown; identical to SEQ ID NO: 25983
  misc_feature (1)..( 3003): 2750-1469P.txt file - cDNA_ID_3026384; gDNA_ID_2214570; Annot_ID_186133

SEQ ID NO: 30139 - DNA, 3000 bp, Unknown; identical to SEQ ID NO: 12757
  misc_feature (1)..( 3000): 2750-1469P.txt file - cDNA_ID_3026388; gDNA_ID_2214570; Annot_ID_186132

SEQ ID NO: 30140 - DNA, 3000 bp, Unknown; identical to SEQ ID NO: 12771
  misc_feature (1)..( 3000): 2750-1469P.txt file - cDNA_ID_3026394; gDNA_ID_2214570; Annot_ID_186127

SEQ ID NO: 30141 - DNA, 3003 bp, Unknown
  misc_feature (1)..( 3003): 2750-1469P.txt file - cDNA_ID_3026433; gDNA_ID_2214571; Annot_ID_186192
gcaggtaaatctttaacatctttagtatagttatgatttttaagcctatgttaatgaatgtgagtgttttcaggtagctcgtctacaaaactggttgagagttcagatgggtggagaaccgcttcggtgacgggttggttcagcagcggtatggttcatcgggtagtctcgtcggctacagtgaaggaaggaagagtttatttaaaccatattgttggatttgggtctaaaaagaaacacgtacttgtagaagctgtgttttagagtcttcttagttataaatcgcttcttaaattgtgctaatgatctcggtatgattctattgagatctgatgtaaaactttttttatcatgttttatgttgatttttcattatgatcttacgtgttgaaatttaacatatatatattgtgtacatagattagttgtagatggtatgtcgacgttatcgaaaattgaaaatttgttcaatttttaaaacaagttggtgctgcaacgcccgacacacacacacaaaaaaaaaactcattaatcttactatagttttttgtatatgaaatcaaatcttcaaattaatgattgtgtccggcacgttattcttaaaatcaatagttgcacttaacaatcaaattatatcgctagttcatacttccgcatgttttttgtttagttaaatatggaatacacacttgtttttcttataacaaatatcgtggaacttttggagcggatttgggatgacgtcttagattatatagaaaatagaagtagattttgactgaatatcatcaatgaaaggaacaaagaaaaatatttaggttgatttgatagctaattaaactagatgtagactgatttatataacaatattacaaaacaatgatcaacaataaataaatgtctttctaaaaaagtttatgaataccaactaaactggtggaacaaaccattattgtgatgttgtaaatttgtaattgactttttcgataaattaatcgaaattgactagaccggtgaaagctaaaccggttccatctaattaaaatgagaaaaaaaagtagtggtagtaacttcgtctcgaaccatgcgcgggattaaagagagcgaattatacgaccactatggcaagacgcatttaattgaataaataatactagatttgcgcaaaatagttgttatacattttgaacaaaatatataatataaaaaccaaataatatttagatccgtgatgtacaggttgaatctatagaatttttttagaggaagtaaaaaagaatcaaaatctaaagttaaaattaataccttaaattttttgaaaccttagagagagtcttcttcccgtaaaaatatatattttactttatactgaaaaagtataatattttctatgattttttggcaaaaaaacaaagaaattgtatcacggaatctgcaaaacaaacatattgtttaaaaaatatttctaaaatagttatttaattgatcgtaattaatatgtcccctcatgtcttatccgttgatttatttttagtgacaatccacaaaaatcggccataatctctacttgatagttttttctttctattttgatattgaaaggttagtcctatgtttgactaatattgaggaatcttctttgttgatgtattttgtgcaaattttgaggaaccaaagagaatttcaattccaattttgggtggattcgagctattttattgatttatttttggttatatctcgaaggatgttctgacaatcaatagataatttgaaggccaacactgtttttgcataaatataggattcttcatctcaaaaattaaaaagatacataaataatcggaactcaccatataattgatctgttttggttctcgtcctagttcttcttgtacttctctttccaatttcttctctcctttcttctttcccatttcttctcttctttcttctttcccatgactatgattagattttttttggccctttttaccagcaagatgttatcttgtccatggaatttttaaaactagttcaattttgattaattattttaaattgaccccattataaagtagaaattaatccttgtaaaatttagtttaagagcaaacaattagatattatataactttttaggccaatttaaatcaaaacaaataaatataaaataaaaacatgtctattgaaatgatttcaacctcataattttgtcctcttgttagtctatcatttttttatcatccttttttttttcattcaccatttttcattgaaaattaagttaaaaataaagttataggttaaaaaattaatatacattttaattttaaatacaatgttttgatgattttatctaactgattatataaaaaaaatattcagcgtcttcaaaaaaaaaaagaaaaaaaaattattcagttagaatattgattcaaagaaatttttcaatgggtataaaaaatagcaacgcaaattactttggttgaaaaaaactaaatttaaaaatataattcgagttataaattgagctataaactcaaataaaagttttaatacgaaattaaacaatagaatcttctgcaattcgaaattccttttggtacgtccatgtcttctttccgccatggaaataatgccatctgttaatcatcaatgttcattgcacctcttcatctctagggttcccatttctaattctctcttaaacccttctcgccgttttcgcccataagtttctcaattcccaaattcgcaatcgtaatggcgattctcctcaagctttcgtcttgctgatcctttaaaggtacgatttttctattcaatttagtatcagccaatgattagttattgataattggttctgaatcgcttggattgtgttttcactctgcaattaggttgttgtttggtttttgatcacaaagtctcatactttttggttaagattcaatcaaaagagtcaaaggttacttctttgttactgggttttgagtaatg

SEQ ID NO: 30142 - DNA, 3003 bp, Unknown
  misc_feature (1)..( 3003): 2750-1469P.txt file - cDNA_ID_3026439; gDNA_ID_2214571; Annot_ID_186189
tgtaataaaaaaagaagaagaagaaattgttataattttaatacaaacatatataatatataaagtagagttttcaaagttgttaactcatatgattgatgagatatcgacatgtattaaatctaattttgttaatatataaaaaatcttctaaccctatcgggaaaataaaatatatacataaatcacaaaaattatttatataatcaaaaaatttaattatattttatataataaaataattcatattattagcgaatttgttttttttaaaggaccgttcaaatatgtttttttgtgtattttgtcgaaatttttgttatttttctttttattttgttaaaataactctaaaatatagatttcaaacaacacataaaatagtgagatgcatagataaaggttataatgggaaaactcaatagtatcaaagataaatgagaattaattatagtcatgtttgtgtaaaaaatttaggacaagttactaatatttaaagtttaagcctagttatttagtaaacaacaaaaataacttacgttatctaacgatatttttggagaatagatagattgaaataagagttagaacactaaatattgaaaacgtgtgtgggttactatttaaaatttaaatatcataaagaattaaaacacgaagatgaaatatgtagaaatattttttcagctcttatccattaaaatgaaatatatagaattaaaattcagtatattttcatgaaatatatagttaaattattgcaaaatagaatggataaaattaaattttggttttaaaatatttagataaaatgaaaaagtgtacattgctattagaattcaattattatttgaaaaattatatatgttttttatattcgcctatttaaacggggtttatctaatatatatatatatatatatatatatatatatatatatatatatatatatgatcttataaagaaataattaaaagatagagaggaatggacgagaaagcaacatgacagttctctcttattaactttcactcctcttcttcttattaatactgagatccaccagaaaagggttattgctattgattgatgaagatgatccattgctttacgagtacgattataacttctaagcttttttatatggtttcccatagatattcttagctttaactgaccaaggtagttatatgttgtagtcggaatagccattaatatctcaggtgcatcgcagcactgtaaacgccttgcaagcctggacaggtggacagtcatggtctagaagaagatcatgttcatagcttttttggagactttggcttttatagaaatcaaggaataagaaagtattttaaagtatagaggctttaggtattttaagtcatgctagaagtgaacaattggcatgggaggctgctcaattgaatcttgtaggagagataaaggaaagagaagtacttccaatgttttctccaataattttgtgccagacgagttgtttttaggaagatgcaaaagtagtacttttaaggcaaaatgtcacaggaggaggagtctctcaccgattcacttggaaatggaagccttattatatgagccatgaataataatatcctatcaagacggataaattatcagctttttgaaatacattgtgtagaacttgtcttaatagtggaattccttgagaattaaaccattttctctaatcttttcgatgaatttgcttcgagttaagttttttatttattttcaaagctaattatttctcgttcttgtaacttcaagttgattgtttagccaagacctcataaacctttactttcagaagtttcttatgtacacactctttctcctaattggattaccaatcaaaaagtgaatttttaactagtacaagattgaaaaaagaaacatttatataatatccgtttagattgaaagaatttttcttttgttaatctttatctcttttttatatttcgatataagccgtttctcggaaaattaaaaattctaagccgtttatatggccataagtaatgaggcagctctaagcccgaaatagccggtggccacacatattcacttgggacttggcccttttaaaacacctaatttcatgccttttcccgctaaacttgccactttctcctaaccaactcatttcttcatataaaaccaacaacatcacacaaaaagagccctcatttattcacctttcttttcccttaaatataatctttataaaaaaaattaaaaattaaaaaaaggaagtaaattgaaaaaacaaaattggtcccctgtcttcttttgttcactggacccttttcttggcttcgctaaatcatactatctctatcttctcaccgacactttcttcttctttgatcatatcatatttatcttcactacaaaaaaaacaagtaaaataaagccaatcttcttaaatatctccagaagatctatcagcatttacgtattcaggtcctccaatgtaagtttcttttttactttcttattctatttgtgtcaatctggtttcattagtcgtggcagctgggcaggtacaaatgctgatggcacatggcatcaaaactatcaatttatttatgtcctaaagacaaaatttaatgataaaatacaaaggatttaggtgatactatgttgtctcttaatgctcatcgtgtatctcttaaaaatccaaaatcttcttattttccttatatttaattaaatgtgtcttgaattttcaagtgtgtctctctctcaatactctggagtttttgtttgtttgtatctgatagttgttacaacatcaattttctgattattctatctttcaacttccctataaaataattatttagagaacaacataaagtttgtattttaaaaatatttaatagccattgattacttttgtaattgcgttttctattagttcttctcacaaagaaaaaggaagaaaaaaaagaagttgtgagagcaaaaaaaaaatg

SEQ ID NO: 30143 - DNA, 3000 bp, Unknown; identical to SEQ ID NO: 12786
  misc_feature (1)..( 3000): 2750-1469P.txt file - cDNA_ID_3026454; gDNA_ID_2214571; Annot_ID_186180

SEQ ID NO: 30144 - DNA, 446 bp, Unknown
  misc_feature (1)..( 446): 2750-1469P.txt file - cDNA_ID_3026476; gDNA_ID_2214572; Annot_ID_186232
ttatgcgaaaatgttaaacttgccaatatattttgaccaatttagtgacaaacttggcatgaaactatctagaaatagtttcctatcttatgtgtgaccaaagctgttttcattcatagaaagacagtcatcttatttaaagaaattcctttttttctggtagattcttagttgacttctttctgtggtttataacttataagaagctgaagacatatactatttatagtggagaaacaactcaaaaagggtctaaaactacatatgtctatagatgtccaaagtgtgttttttaaaaacagcataacctataaacagcatatacatctgtgtgtcatttgtttacaaattgtttctttgttatcaaaaggaacacaacatttattttgttatcgtcttccccattttgacaagaactcacttaagattttgaagtcatggaaatg

SEQ ID NO: 30145 - DNA, 3003 bp, Unknown; identical to SEQ ID NO: 26337
  misc_feature (1)..( 3003): 2750-1469P.txt file - cDNA_ID_3026488; gDNA_ID_2214572; Annot_ID_186229

SEQ ID NO: 30146 - DNA, 3003 bp, Unknown; identical to SEQ ID NO: 26338
  misc_feature (1)..( 3003): 2750-1469P.txt file - cDNA_ID_3026494; gDNA_ID_2214572; Annot_ID_186226

SEQ ID NO: 30147 - DNA, 3003 bp, Unknown
  misc_feature (1)..( 3003): 2750-1469P.txt file - cDNA_ID_3026498; gDNA_ID_2214572; Annot_ID_186223
cgaaacgagattgtgttaagaaacataacgaatccatggttcatcgatttagatttctagggttctgaacggagattgtaccttctaaacgacgagataagcgaacgattctagcgatacagccgtcacagtgaaaatcaatcttaagaacgacgtgaaccggcgacgtcgtattgttctgtttctttttcttctcctcctccacatctccgtggtaacattcacacacttgcggattctccattttcgtctctaacttcttctgcatacaggtttaaaaaaaaaacctcaaaaaaaaaaaactcaaaaagcaaggagacaaacacattagcagagacagagagaaccttgatggaggatagagaatagagactggagtatctgtctcggtttcttcaaaggaaaagtggagaagacgacgaaaatgggtttcagagacggctgcgtaacagaagggagtgtagggaggtggttcacagtgtacgtacaactttgttatagtcctttccttactcttgctttttctatttttgttttcattaagatcatttatatattcaatatttttttaaaaaatgaaataagttctattaaacaggttattaaaaaaaaaaaattgttagtaatttgagattcctatttttgttttggttaataatgtgtgaatttggtttacactaaaaaaatgtcgtgcaagaaaatactaataaaaatgagaaatgttgagaaaataaatctttttaatcattactagacagtagacatttttctttcaattccattaaaaatggaaaaattggtcatcatttattcaatgttatttagtcacatagttatactaaaaacaaatttttattgcgtttgcattaagtttccaaccaataatgaataatcacgtcaaagttagaaccaaagcaaaaaaaactaaaaagctcaagaagaaaaggatagagacgacaaaactccattgaagaacttattagagaagaagaacaacaacaaggaagataacgaaagtcactaaaatctttcaagacccatgaactctcaaatcactcttttcttcttcttcttctcaatcctctccctctcccaaatctcaaattcatcatcactactaaaaccacacccatgtccaattttacccctcccatcctcccaacagctccaatggcaactcggatccatggccatgttcctccattttggacccaacactttcaccgactccgaatggggcaccggaaaagctaacccatccattttcaacccgacccatctcaacgcaagtcaatgggtccaaatcgctaaagactcaggcttttcccgcgttatcctcacagctaagcaccatgatggattctgtctctggcctagcgaatacactgattactccgtcaaatctagccaatggagaaacggagccggcgatgtagtggctgaactagcttctgcggcaaaggaagctggaattggacttggtctttacctttctccatgggatcgacatgaacagtgttatggcaagacattggagtataacgagttctatctgagtcaaatgaccgagttactaacaaagtaagctcctttttctcatatcagtcaaatgggtttgtgattccagttccaagtttttaaaaaggttgaatctttattaggtatggagagattaaggaagtttggttagatggagctaaaggagacggagagaaagatatggaatatttctttgatacttggtttagtttgatccatcagcttcagcctaaagctgttatattctctgacgctggtcctgatgtcaggtggattggtgatgaagctggtctagctggctctacttgctggtcactctttaacagaaccaatgcaaagattggtgacactgagccttcgtgagtcactctctaatgttgaaactttctatagatgttagggatgatagagatcatagcttgaagttgtttgtttgatcttgtaggtattctcaagaaggtgatggctatgggcaagattgggtaccagcggaatgtgatgtatcgattcgacccggttggttttggcatgcgtcggagtcgcctaaaccggctgttcagcttttggatatatactataactcagttggaagaaactgtctcttcttgcttaatgtacctcctaattcttcaggattgatatctgagcaagacattaaggttcttgaagagttcagcgaaatgaagaactccattttctcgaacaatctcgcccgtaaagcattcgttaactcgagcagtattcgtggcgatcaaagttcacagtttggtcctaagaatgttttggaagaaggattagacaagtactgggcgccagaagagaatcaaaacgaatgggtgttatacttagagtttaaagatttggttagcttcaatgtgttggagattcgagaaccaatccatatgggtcaaaggatcgcatctttccatctcgagacacggaagactggaagcggtgagtgggagagagttgtgagcggcacgacggttggtaacaaaaggcttttacggtttctgaatgttgttgagtcgcggtctctaaagcttgtggtggacaaagcgaggaccgacccacttatatcgtacctcggactctacatggataagttttcgggttctagtagaaacacaacaaagataacaatcacaaggacactaaaggaagagcagcaactacatgatttgtaagaaataactctcaaggattcatcacataagtgttaggtattcttgagaatatctatgtgcatcaagtcatatatgtgtcactatcaattcttgtatgttaaggctctaacttttactctattgctttaaaagaaatatgactttttttcttcaatgacataaatttgaggatttgggtcttcttttgtaactcggcccaaatgttttaaagaatttcttatggattggagaaaacttttgtggaaaaacagagaaagccctaaagttaagagacatg

SEQ ID NO: 30148 - DNA, 3003 bp, Unknown
  misc_feature (1)..( 3003): 2750-1469P.txt file - cDNA_ID_3026501; gDNA_ID_2214572; Annot_ID_186222
atgtcgttaggcgtaaacatcaagccgaggtgcattagcactaaagtaaacaagtcgaaggaccatatatgttctttaaatataggaactcaattcttatttggagaaagactttgcttcgtatgaacttaaaggccgggactcatggaaacatatttttttataagttgtaaccattaagttcttcatggaaacatgaaagcttaaaattctatttccaaattcactatgtcgaaaagtggatcctctccacaaaaacgtactctgatatctctcaaaatagaaaatactagtgtatttttttactactctcatgtgacacagaccatcacaatatatccttcagactttacttcttcttcttttttcttttctgtttcctattagtttatttacctcctagtatatatatttgtaataaactccaaatgctttgtcacctcgaaactcacataacgctgcaatagctctgatcttcctcactgaaaaacccagtcattgggccttccatgaacctgtaaggcccaatcccatgagtgcatccatttccaggttgacaaggagacccgactttggtgtttacctctgcattgtccttgtctttcttcttcttcttcttctcaggcacgacctggacggttttcttcagcttgcgtttcaaattatctgtcacagacttgatgtccattgttcccatgactgttaccgtttccttctctttgtccattttgacttgatacactcctattgacaaaatcacatactcaataccattagacacagattaaaatggccgcaaacaagttctgtatgagtcaaaccaaatacacaaagtaatagtcaggaaaaattcttacccttggtcgtagagacagccttttgaattctcttgatgcaaccatcacaagagcaattcactttcaacaccactgtggtcacagcaacctaagaagaagaacagagaatataatgtcatagcaagtaatttcgaaagactaaagtacttattaacccatatgatcacctagaagataacggctatagtacattatctacaaaggaatggtacgagttaagaagattgttacttgaggatcaagtaagcctgagaaaatctaccttttgatactacttacttccttactagttatcacattctagtcatggtttaagtgtttgtgagaaacaaatgtcctaatcagagaacgtatgcaatgaatgtagagcttaccacagtctgagtcttatcattagcctttttctcattgttctctttggtgtctttctttggtttaggagatatcagctccactttcttcttgctcttcttctgaagtttctcagcaatcttcactggatccatgataaacccaatcagagtcagcttgttcgaatcaggatctgctctcactgtttcaactcctgatacagtacaacaatcagaacaagtcaatgagccattgagcatcgatagcaatttcttgtataccaacaaaaatcatgaatcaaagactcaaaaattgactaatttctttacaatcgctgtgttttcaatagcagaaacagagaatatttatgatcctgaaactagatctaagaagaagatcgataaacgtaaataaacgaggaagagaacaaaacttcgtcagggtttagggtttaacaaaaactctcaatcgctttcacgatgctcgaaaccattatcggagaagaaacgaaacaaagcaaacgattaacacggatgattcgactgagatttcagcaacgaatccatgaaaatccacaaaacagagaaatcgaacccgagataaatgcgaaacgagattgtgttaagaaacataacgaatccatggttcatcgatttagatttctagggttctgaacggagattgtaccttctaaacgacgagataagcgaacgattctagcgatacagccgtcacagtgaaaatcaatcttaagaacgacgtgaaccggcgacgtcgtattgttctgtttctttttcttctcctcctccacatctccgtggtaacattcacacacttgcggattctccattttcgtctctaacttcttctgcatacaggtttaaaaaaaaaacctcaaaaaaaaaaaactcaaaaagcaaggagacaaacacattagcagagacagagagaaccttgatggaggatagagaatagagactggagtatctgtctcggtttcttcaaaggaaaagtggagaagacgacgaaaatgggtttcagagacggctgcgtaacagaagggagtgtagggaggtggttcacagtgtacgtacaactttgttatagtcctttccttactcttgctttttctatttttgttttcattaagatcatttatatattcaatatttttttaaaaaatgaaataagttctattaaacaggttattaaaaaaaaaaaattgttagtaatttgagattcctatttttgttttggttaataatgtgtgaatttggtttacactaaaaaaatgtcgtgcaagaaaatactaataaaaatgagaaatgttgagaaaataaatctttttaatcattactagacagtagacatttttctttcaattccattaaaaatggaaaaattggtcatcatttattcaatgttatttagtcacatagttatactaaaaacaaatttttattgcgtttgcattaagtttccaaccaataatgaataatcacgtcaaagttagaaccaaagcaaaaaaaactaaaaagctcaagaagaaaaggatagagacgacaaaactccattgaagaacttattagagaagaagaacaacaacaaggaagataacgaaagtcactaaaatctttcaagacccatgaactctcaaatcactcttttcttcttcttcttctcaatcctctccctctcccaaatctcaaattcatcatcactactaaaaccacacccatgtccaattttacccctcccatcctcccaacagctccaatggcaactcggatccatg

SEQ ID NO: 30149 - DNA, 3003 bp, Unknown; identical to SEQ ID NO: 25153
  misc_feature (1)..( 3003): 2750-1469P.txt file - cDNA_ID_3026507; gDNA_ID_2214572; Annot_ID_186217

SEQ ID NO: 30150 - DNA, 3000 bp, Unknown; identical to SEQ ID NO: 12797
  misc_feature (1)..( 3000): 2750-1469P.txt file - cDNA_ID_3026521; gDNA_ID_2214572; Annot_ID_186211

SEQ ID NO: 30151 - DNA, 3000 bp, Unknown; identical to SEQ ID NO: 12824
  misc_feature (1)..( 3000): 2750-1469P.txt file - cDNA_ID_3026560; gDNA_ID_2214573; Annot_ID_186263

SEQ ID NO: 30152 - DNA, 3000 bp, Unknown; identical to SEQ ID NO: 12816
  misc_feature (1)..( 3000): 2750-1469P.txt file - cDNA_ID_3026564; gDNA_ID_2214573; Annot_ID_186262

SEQ ID NO: 30153 - DNA, 3003 bp, Unknown; identical to SEQ ID NO: 25990
  misc_feature (1)..( 3003): 2750-1469P.txt file - cDNA_ID_3026595; gDNA_ID_2214573; Annot_ID_186252

SEQ ID NO: 30154 - DNA, 3003 bp, Unknown; identical to SEQ ID NO: 26341
  misc_feature (1)..( 3003): 2750-1469P.txt file - cDNA_ID_3026599; gDNA_ID_2214573; Annot_ID_186249

SEQ ID NO: 30155 - DNA, 3003 bp, Unknown
  misc_feature (1)..( 3003): 2750-1469P.txt file - cDNA_ID_3026615; gDNA_ID_2214573; Annot_ID_135106
gattgtaaatcagggaaaattggtttctgatgagatcattgtagacttattgtccaaaagacttgaggctggtgaagctagaggtgaatcagggtttatccttgatggctttcctcgtaccatgagacaagctgtaagtattattcgttttaagcaatttttgataatcaatctccattatcatttctaacagtggattgtcttttggttcaggaaatactgggagatgtaactgacatcgatttggtggtgaatttgaagcttcctgaggaagttttggttgacaaatgccttggaaggagaacatgtagtcaatgtggcaagggttttaatgtagctcacatcaacttaaagggtgagaatggaagacctggaattagtatggatccacttctccctccacatcaatgtatgtcaaagcttgtcactcgagctgatgatactgaagaggtggtgaaagcaaggcttcgtatatacaatgaaacggtaagcccctctattgtccttttccattgctagtttatgaacgatcaggtgttaattagtgcctttttgtatttttctatatgcagagccagcctcttgaagaatactaccgtaccaagggaaagcttatggagtttgacttacctggaggcatcccagagtcatggccaaggctattggaagctttaaggcttgacgattacgaggagaaacagtctgtcgcagcataagttcactatcaaatcccggtatttaaaattctttgcatgtggaatacatatgcgtaatcaattttgtgttggaaataaaagtaaaaagaaaaccttagattgtttttcacctcaatagaaataatcatacacacttgcgcaaactattatttttccaccagccggggattttggctccatgagagaaatatgatgtatcatgattgtttgagattgctagtgacattacaggaatgtatcaatacttctacaccacttgttatgcattgagtttaatcgttatgctcttgtgatatgttttttttggaaaatgtgatgaatgatgatattgcggctggccgagctggctggttaaagaactcaaccagacagtaaagtaaaacagccgcatagattaaacgggaacttataaccagctcttgactgtcctagcattggcggtgcgggatagaatcgttccttacatcatggaattgatgctctcattatcggtcattgtgtattacttgctctgttatttgttgtgatcaaaacctagcttctgttttacgtttgccgtctctgaatttttttttggtttttaactctccctacgtgagtatggatggtaaatacagattcaatttgaaatgctgaacgggacttggctcatagcaatctaaatcacagtgacaaacgtgtacttcgattgcctttgtgatggtcaatcaaagctgtaatgttgttggtttttgacgctaaccggaactaaactcctttcactgagaggtctcgatgagagaaatcattgtcatgaacgaaataatttaaaacatgatttaagattacagaaaatgcctaacgcaaaattattgacgaatcacaaggcaaggaagaagtagagaggagagttgataagaaaagagaaatcttcatagaaactaaaactgtgtacaagtgtttatatacattgattaagcttcaacaatcttcttaattaaccacattgattagcttcaacaatcttcttaactaacctaacatattagttagacaattaataatgtcaactccaatatttgttgaaactccaatattgttataaattgcaagctaacaaagtaacaattgataggtttaataaatattttcgtcaaatgatcattgggtagtggtatttaataatattttattaactcatgtagtgaaaagtattggacaagatgactgaattttcttcgtctcttatctaacagaggtgtaaccgaaataaaccgaattcaatttggttgggttgagttaaaataaaataagttggtacagttcagttcacgtgtttacttcgaacagaacaggctcgtgcgcgtgtcaacaaccaataagttcttttggtcgctgtagtcttcaactaaaaccaaacgacaccgttccttgtggccgcgttttccaactaactttcaacttcaactaacgttcaacgagtgtccatctcctctatctctctttttccttttcattggcttcttcatcactatagagactaaaactgaccttgatccatccaacgttccctatactgacacgtgtatccatcacagtgtcggctaaagctcaaggaactcataccaagaaatacatcatcatctctcaataatcacaaaccggatccggatcaatttggatccatcagattttcttcgttccctaactcctaaaaaggagagattcttcaaatccttatcacaacttcagtttttgcattcaccgtcgtgagtgttctacttttggtaatgattcactagtcaagtttctttctttatgctataacttgcaactagatcttgtactaatggaattgatgtttctccaatcatcttctttgattttgctccatctttcttttcctaatttggaaaaatgagtctttacctatagaatctgataaatatgtctcttacataattgattaaggtcaagtaatggaggtgaatgatggtgaaagagtggtaatagcaaaaccagttgcctcaagaccttcttcaagttctggcttcaggacattcactgagcttcttactgattcagttaccgtatctccgcaaacgacttgccacgagattgtagacgctgctataagaccaaagactttgagattcaatcagccagtagcagcttcggtctcatgtccacgggtatcgagttgtctatttaattcttcgcattgttatcttctttccgcatcctctagtcttgactcaactatttctgataatgataggctgaagtaaaaggtattggaaatggaatg

SEQ ID NO: 30156 - DNA, 3003 bp, Unknown
  misc_feature (1)..( 3003): 2750-1469P.txt file - cDNA_ID_3026615; gDNA_ID_2214573; Annot_ID_186242
tctctcaaaaggtgcgacctttttttttctttcccattttctgttactgtgattctgatggagattctcttctttgttcgattttggatccatatagtctgaaattgaatgtttagctaatcggactttcattattggatctgaaaatttccgtctatctctcgatagatctagtgagctaagtccatttgaaagtgtttctaactacatttgatcagtatcataacagatctattcatatatattaaagtcaatggctttgttttgtttgttatctgtatgcataattgttaaacaatctcttgttacttgatgcagctatcggagattgtaaatcagggaaaattggtttctgatgagatcattgtagacttattgtccaaaagacttgaggctggtgaagctagaggtgaatcagggtttatccttgatggctttcctcgtaccatgagacaagctgtaagtattattcgttttaagcaatttttgataatcaatctccattatcatttctaacagtggattgtcttttggttcaggaaatactgggagatgtaactgacatcgatttggtggtgaatttgaagcttcctgaggaagttttggttgacaaatgccttggaaggagaacatgtagtcaatgtggcaagggttttaatgtagctcacatcaacttaaagggtgagaatggaagacctggaattagtatggatccacttctccctccacatcaatgtatgtcaaagcttgtcactcgagctgatgatactgaagaggtggtgaaagcaaggcttcgtatatacaatgaaacggtaagcccctctattgtccttttccattgctagtttatgaacgatcaggtgttaattagtgcctttttgtatttttctatatgcagagccagcctcttgaagaatactaccgtaccaagggaaagcttatggagtttgacttacctggaggcatcccagagtcatggccaaggctattggaagctttaaggcttgacgattacgaggagaaacagtctgtcgcagcataagttcactatcaaatcccggtatttaaaattctttgcatgtggaatacatatgcgtaatcaattttgtgttggaaataaaagtaaaaagaaaaccttagattgtttttcacctcaatagaaataatcatacacacttgcgcaaactattatttttccaccagccggggattttggctccatgagagaaatatgatgtatcatgattgtttgagattgctagtgacattacaggaatgtatcaatacttctacaccacttgttatgcattgagtttaatcgttatgctcttgtgatatgttttttttggaaaatgtgatgaatgatgatattgcggctggccgagctggctggttaaagaactcaaccagacagtaaagtaaaacagccgcatagattaaacgggaacttataaccagctcttgactgtcctagcattggcggtgcgggatagaatcgttccttacatcatggaattgatgctctcattatcggtcattgtgtattacttgctctgttatttgttgtgatcaaaacctagcttctgttttacgtttgccgtctctgaatttttttttggtttttaactctccctacgtgagtatggatggtaaatacagattcaatttgaaatgctgaacgggacttggctcatagcaatctaaatcacagtgacaaacgtgtacttcgattgcctttgtgatggtcaatcaaagctgtaatgttgttggtttttgacgctaaccggaactaaactcctttcactgagaggtctcgatgagagaaatcattgtcatgaacgaaataatttaaaacatgatttaagattacagaaaatgcctaacgcaaaattattgacgaatcacaaggcaaggaagaagtagagaggagagttgataagaaaagagaaatcttcatagaaactaaaactgtgtacaagtgtttatatacattgattaagcttcaacaatcttcttaattaaccacattgattagcttcaacaatcttcttaactaacctaacatattagttagacaattaataatgtcaactccaatatttgttgaaactccaatattgttataaattgcaagctaacaaagtaacaattgataggtttaataaatattttcgtcaaatgatcattgggtagtggtatttaataatattttattaactcatgtagtgaaaagtattggacaagatgactgaattttcttcgtctcttatctaacagaggtgtaaccgaaataaaccgaattcaatttggttgggttgagttaaaataaaataagttggtacagttcagttcacgtgtttacttcgaacagaacaggctcgtgcgcgtgtcaacaaccaataagttcttttggtcgctgtagtcttcaactaaaaccaaacgacaccgttccttgtggccgcgttttccaactaactttcaacttcaactaacgttcaacgagtgtccatctcctctatctctctttttccttttcattggcttcttcatcactatagagactaaaactgaccttgatccatccaacgttccctatactgacacgtgtatccatcacagtgtcggctaaagctcaaggaactcataccaagaaatacatcatcatctctcaataatcacaaaccggatccggatcaatttggatccatcagattttcttcgttccctaactcctaaaaaggagagattcttcaaatccttatcacaacttcagtttttgcattcaccgtcgtgagtgttctacttttggtaatgattcactagtcaagtttctttctttatgctataacttgcaactagatcttgtactaatggaattgatgtttctccaatcatcttctttgattttgctccatctttcttttcctaatttggaaaaatgagtctttacctatagaatctgataaatatgtctcttacataattgattaaggtcaagtaatg

SEQ ID NO: 30157 - DNA, 3000 bp, Unknown
  misc_feature (1)..( 3000): 2750-1469P.txt file - cDNA_ID_3026619; gDNA_ID_2214573; Annot_ID_186239
gatctatcgagagatagacggaaattttcagatccaataatgaaagtccgattagctaaacattcaatttcagactatatggatccaaaatcgaacaaagaagagaatctccatcagaatcacagtaacagaaaatgggaaagaaaaaaaaaggtcgcaccttttgagagagaggtccagaagatgcaagctcttcacggacgagatcgccggtggcgatgtgaggaacgccgagaagggttgatagtctactagcgtaagttccttttccaacaccaggacatcccaaaaacacccactgaacatttctatctttcggagcaaccctgctagctccgccgccgtgaagaaacggcgaaggcgacgacgcgtggctagcttcggctgaagtagagtagaaacggttaccaaagccaaagagggaggaggatctagccacacgcactaatctcgccattgcagaaagagaaatgtagagagatagaagcggcttgagctttgagcttaccctaaacaagaacgtgcacgaacatatgctctttagattcttttcccattttgccctaaagttaactgacgtggcatgtgactttttctctgagatcatggttacatcatctgacacgtgtaataacccaactccacgagattaaccaacggtatgagaaaatcgatttcgattttaaattgggattattattattttcagctttctctggaagcaacaatggcgattgctctctcgtcgtcgtcgacgatcacgtccattactctgcagccgaagctgaagacgattcatggattagggacagtacttcctggttattcggtcaaatctcactttcgtagtgtctctctccggcgtagcgccgtggtcgtgtcggccattaccggagcttcttccggtgagcttaagtgtcttctctttctatattatattgaatacggagattctagattacttactagattatattgattctccacaggagctggaatagggaaaggtacagctgattcgctagatacagtgaaagtcttggatttgagaggaaatgagattccgatttctgatttatggaaagataggaaggccgttgttgcatttgctcgtcattttgggtaattttctcattatatttgatgattctggtttatgactatgtgtaactatctaagattgcttgttatgttttcagatgtgtgctctgtcggaaacgagcagcttatcttgcagaaaagaaggtaacagaatgatctttggtttaaaaagattggccatttatacacaattgaagtcattgagtgatacctttgagatttttgtttaggatgtgatggatgcatctggtgttgctcttgttctgatcggaccgggaagcatcgatcaggtaaacaacattttgaatacgcaatttttgtaagcgtaagcagttttaagctgctgcttctcacgttatgaccatctatgtatgcaggctaatacttttgtggaacagactaagtttaaaggaggtatgttttctcttgattactaaaaaagcctggtgagtagttccttttatgagatgatctaattatctgtaatcaactttctctcaatacagaggtctatgcggatccaaaccacgcatcatacgaggcgcttgagttcgtttcaggggtttctgttacatttacacccaaagtagagtgacttctacttagcatattataattaggtaaccaaaatgttctgcttttgtggtctcagactctcagtagcttctgtggcattattataggctgctatgaagatactagagtcttacatggaaggataccgccaagactggaaactctcgtttatgaaagatacagttgaaagaggcggctggtaagtttaagagtatatgaatcattcattccttctggttagagatcgatgagattactttccgtttttcttaacaactattgtcacggaccttgtgcaggcaacaaggcggaatcttagttgctggccctgggaaagataacatctcttatatacgcaaggtaatctctttcgtctaatcttgattgtgaaactagcctcatatttgggaacctagtataccgatatatcttttcaaacacattgttgttttcaacaatttgtttgcggatttcaggacaaagaagccggtgatgacccgcctgttgaagagatccttaaagcgtgttgtgcttgaagagttgaaagaatcgcaatcgaaaaatagatatttaaaaaacagtaacgacactgctatgcccggatactcaactaaatccataaaacaccattaccacaatcacaacgaccacatttgatatataggtagggaaagaaaaaaagacaagtcgtagaccgaaagtaatgatcattgtttcttgatttttgatgatcattatgacttatgagtcgagatcagcgaaggataagtgtggcccttgctagaagatatatatttttatttccaaataaagatgtacatcaaattcacataatccagttatcgaaacaattttgtctctattgatatgataacatagttgatcaaaggtaagactatagattactatcttgaagtcccacaaaatatgtcagcttaggcatctcctatcaccatccaacatttgtttaaggttacatttcaaattactttatacatgtttgttattcctcataagaactttaaacattaataaaaacaaataaattatagataacagtgtggaaattacatgttggtcaacactagatacgattctaggcccatctgttatgcacgaaaccgggctggatagtaacacttaacaggccgggttcaagttcagaaaatacccgacccggaacaagatttggatccaggactccatttcttccctaaactaaaaccctactcatcactaaaaactcttgcttcctttgtccttccatgtcgaattgaaaattttcagaaaaactcagagacaaaggttccatttcctgtaatg

SEQ ID NO: 30158 - DNA, 3000 bp, Unknown
  misc_feature (1)..( 3000): 2750-1469P.txt file - cDNA_ID_3026664; gDNA_ID_2214574; Annot_ID_186289
attagtgaactccaaaatccggcgaagcaaaaatcgcactttttccggcgaagaggaattgagaaacctccggcgcgagatagcaacttcgttatggctgagaaggagaagcgggtactcagagtttccccgaggagaaaactgtcttcgacaaaggcaacggtggaactggataagtttctcttattttccgtctggagattaaaaatttgaattgaaaatctctgtttacgccaaaaatcagcttttgagtattaatgtggataaatcttgtgtacgtacacgaattcgtattgtttacatccttacttaattgtatatcactccaaattgcagacagtacaagtgttgctccgacggaagatcttatttatgccaagaaaccacatatgggaagaatgagcttcaggtattatactaattagcagtgatcactagcagatagtgcaatgtttcgttttgcagcacaccttcttgtctcagtgaaattccattttatggtcaatactttcatggccgcagattgtcaaattaaaagtaaagtagtgggatttcacaagtcttactctgaaaccaagcccattaatgaattcggaaaccaagaataaataaatatgtatacagtatataaactatttctgatgcggctataaccaaaagtaatcatcaatcaaagctctcgagttccaaggagacttcaccaatataaagagtctcctcatcaaaggactctgaacttgacgaaatcttgtgttaatttcctacactagaagctgaaagatttatggattttgataatggcgaagcaacatttcttcaagcctcttcttcccggattccactgtcatttggtactctctctctctctcactctttcccttcttttatctctgtctatgcccctctgagaagctcatttagaataaactgccaaactggtctggttttgtatttacatgttgcttgagacaattcatgcagccttcttcttgaagaatatagaaggaagagacgagtagaagacggcggagctgagataggacgtgtcgaagataacttgggaagtgaagatagatggacagagactcactgacggttgtaaagagtttgctctctcacatgatgatagactttagtggtatgaatgataatgtaaatactcgattaaagcctatctttataaacttccatataggcatgaccacggttacggttattacggttacggttattacggttacggtttattaaccaccggttacgtttataaatttttgttaatcttaaccttaaccgttatatatacggttaaaacggttacggttaaatacggttacggttaaatacggttatggttaaatacggtatttgataattatgatatagttaatatatgagacaaaatattatattttttaatctttataataaaataaataaataaatagtgatatatcaaataatatttattttacgtaattatgtgtttcaaatatttatagtgaatcaactatctatttttcttaaataaaccaatgaataaacaaattaatggtcataattataataattgagttaattacattttccaaacaaaaacaatactaaagagaagatgttgtgaacattaagaaacagttttaagagtataataataatatgaactacttatgatttgatttatggtaaaaagagtagtggagtaacttcgatcgtagtagtgggcatattaaacgatttaagttactattttagtgaaataattatttatttagaattatacacagttacaactatatttttaaggttttaaccatacggttaaccgacggttttgatacggtttcggttaattaatggttacggttagtatattttcttaaccgtaacgggtctattttcacggttaacggttacggttattaaccgttttatacaattacggttgggttacggttaataaacggtctggttacggtccgaaatacggttacggttagattttggtcatgcctacttccatacattaattaaaaactctcaaggttcaggaattacaaggattgaacaatcaaacaaatgaagaacaagactagattctcagcatctcttcgaatctaatctctccatacgatagtctcataacgactaatcctccacttgattcaacatgcttttccccaaagcattctctccttatttataagcagcaatcccaaggcacaaccttaacccttcgtacgggtgatccctgtcacctcatcaacctcctcacttgtcatatcctcacacgtgtgtgctactttgtccttctttctcctgaaaaacaccctgtgtaacttatcacatgatcttcgaatcggtgacattgttgttttcagacaagagagagatctgtccttccacgttacactgttggggcctagttggtgtgagattcaatatatgtcttgtttacacgactagagcaacctcggttagttgtgctgtctttcgaactctgtccttgatattttaaaaatctgctgagataatagaatctgaatcttaaagtagagataatcagtttaactattaccagtttgatttgttctcttcgtttgaagggaagattcaatggaagaagaatccaagaagagaaacagagtcttcgtcactagatccttcttgttgtgtggctaatgtcatggcttcgagtctacagcttgtccgccaaagagccagaataacaagctaatgaagagtctctttccccagaactagaaagcagtgaagataccaaccttggtgagttttgtttcgtctctcattctaatacgtgacattcaagaatcagtttcactattaccacttgtatttattcctgtcattttctgggatgattcaaaggaggaagaaaaggaagaagaatccctttagttttgtggctaatattttgcctacgagtctacgttatgacaaactggcgaggtgaatggcataaaaaatgcaaagaagatg

SEQ ID NO: 30159 - DNA, 3000 bp, Unknown; identical to SEQ ID NO: 12852
  misc_feature (1)..( 3000): 2750-1469P.txt file - cDNA_ID_3026705; gDNA_ID_2214575; Annot_ID_135172

SEQ ID NO: 30160 - DNA, 3000 bp, Unknown; identical to SEQ ID NO: 12843
  misc_feature (1)..( 3000): 2750-1469P.txt file - cDNA_ID_3026705; gDNA_ID_2214575; Annot_ID_186331

SEQ ID NO: 30161 - DNA, 3003 bp, Unknown; identical to SEQ ID NO: 26001
  misc_feature (1)..( 3003): 2750-1469P.txt file - cDNA_ID_3026709; gDNA_ID_2214575; Annot_ID_186330

SEQ ID NO: 30162 - DNA, 3003 bp, Unknown; identical to SEQ ID NO: 25995
  misc_feature (1)..( 3003): 2750-1469P.txt file - cDNA_ID_3026712; gDNA_ID_2214575; Annot_ID_186329

SEQ ID NO: 30163 - DNA, 3003 bp, Unknown; identical to SEQ ID NO: 26000
  misc_feature (1)..( 3003): 2750-1469P.txt file - cDNA_ID_3026728; gDNA_ID_2214575; Annot_ID_186316

SEQ ID NO: 30164 - DNA, 3003 bp, Unknown
  misc_feature (1)..( 3003): 2750-1469P.txt file - cDNA_ID_3026766; gDNA_ID_2214576; Annot_ID_186353
actcaaagacagatgatgcagaaacactcttgatctcattcacattatcataatcagaatactcttgaagacccaaactaatcgatctagctatccctgaagtagaacaatcagtaatctcactcacaacatcaacatctttgcaatcatctaatccactagcaactacaacatttgaaaacaacaaaagcaaagaaaaaaagatgcaaactttagattcaaatagagacaaaaggcgttattaaaaagagtattaagaaatgattaaggggctccaccataaaccctagggtcatcaatttgattagacccagatctcattgtaggagttgattcttcttcttcattcttctttctatcaacacctagaagaagcatactccttaacttccccggagaaaatccgccgccgctactagtaacctattcatcggaggaaacagagtttatcaaatcaaaaacagagatgatgatgaagtgatttgcaaaaggaaagtttgtactttgaagtaagaaatcagaaaattgacaaatctggcttttgatatccctaattttacgcaaaacccagtttcggtaaacgtgaaaccgaagcattttctcacctgggtctttccgattcgttcgtaatccatcgaaagagaatctcaaaaatcttcacttttttctcgagaaccaaaaatcctgaaaaagagtgatgcaaaatgtgtaagaaaatataatagtagtagtagattgttggtgttatcagaactcagaagcattatttgaaaggaagagtacagtgaatgataagagagcttggaagcttgtgaaagtacagagattgatacacactgtgtctttctttctttctttctcaaagcttctctcttttcttttcttttttttggttttttttttttttggtcttaagctgacatcaaaataagggacattcacagtgatggagcctttaagttaagcaactgttgtaccatctgccaaaaaaagaagaagttaagggacattcaataatcttgatctatagttcataaatcttacataattcttcacatccaaattcgttgttgattataacgcaggacttgctatttgaatcgaaattttacccaaataatactatagttatattatttggtcagttctctatatagactagagtttgttgtaattcttgaccccccaaaaaagtattaattcaaaatattaaaatcttaacttttgacccccaaaaaaacacatcttattttagttaattacttaatttaattctgttttgcttttgcacttcttaatttgtacttaaattattttacaacaaattaattttttttgttgatacctaaagtgataaaaattcgatatcaaaaatgcaattttttttgagaaacttactagattttaggttatatatatttttcactaaacattatttcttgattagaactatagaagtatattacaatttggcaacaaaaaaatatatattagtgtatttagttatatatgttatatatgtatatatattcttttaattttttaaaatgtctaattcataaattaactcatgttcgttaaaactcgttcatataatttgtactctaaattatacttgattatataactcatctattaaatgaatttcattcatactgataaaaaaccaagctgagttgactcatctcatgagctaacatatcatttcgacacctctaattaggactatagaagtattttacaattaggcacacaaaaaaaagtatattatcattacgaagaaaaaaaagtggtggcctggcctccataggatgctcatgctgtctttgaaggcccataagtaaggccatgcctatttgacggtcaaagacaaaaatggttccatttgaccaagaagatgatcatatagtattatgacagctattgtactccccaatccaacacagcaacacacgaatgcctagtcggtgattcatcatgaagattaattcctacataattagtattatcttctaacaattctcatttttcaaagattcaagcctgcagctccaaagtgagaatcacggattgtacttaaatcgagtgcgaatatagctgatgtttagaatttttggaaaatttctacgtttcgtagatataattttttgggattactagcaaaacccaaacctccaaaaattcttaatctcgaattaattatattttttttatcgtcgatttattatttattacaaattatataaactgttatatagtcgattatactacgaacaattccttccaaccgttattagatctacgacagccgccaccaccttttcttttttcatgcttttgatggacattttttcaacaattttttttgcgtagaatcctaacaagcagttataattgtacatcgttggaaatctcttacatacttacttccattaatctgcaaatcagctaataaatttctatcgtcgaagctttttgtaggtatacgtttttttatttctctcactttaaaaataaaaaccaaaaaaattttttatgcaaaaacaaaatgatctcatatgaggactcttgtatgttgggcctggccctgaagatatctattgtaagaaagatcaattaaaaaagtaaaaattaccataactgtcattctctaatcataatagcttactttgcttcacttgattaggcataatatttgaattctctttgtgtggatcaagccagctttggtttgctctttatccacatgtgccacgtggagcagcgtgtcagtcaactttcaacaactacttgactctcccgacgataattaccggctatctccggttctcgtttccgacgtcggccgtttctttttcatttttgtcgttttttttccaaatttttttatttcgggaaaataacaaaaaaagaaagaaataaaaagaggtgattcaaatccagagagttctcattatgtatattcaaaatctgaatcgagaaggaatctgactcgtgtagatg

SEQ ID NO: 30165 - DNA, 3000 bp, Unknown; identical to SEQ ID NO: 12860
  misc_feature (1)..( 3000): 2750-1469P.txt file - cDNA_ID_3026770; gDNA_ID_2214576; Annot_ID_186352

SEQ ID NO: 30166 - DNA, 3003 bp, Unknown
  misc_feature (1)..( 3003): 2750-1469P.txt file - cDNA_ID_3026794; gDNA_ID_2214577; Annot_ID_186381
ttcgcggtcagatcgatattgttcacttcaagcttttggacctgcagttcggctgctttcatccggttcatgactttattggctttctccacggccttggcattttcatcttcacttcgcttgaaactctcaatttcaacatccttgtcaaagagttggtcctcgtgactgcagaaaacggagttgaactctaggattaactgcataataaaaagttgttattcaactaggtcatccatggacataacaaatatggattcagttcgggccttaccttgccaagttttctggcaaagcgaagatagttttccttgttgacttctttcatctcgtcaaaaggagctatggcagaaccaggcggaacgagagtcctcattgtatccgcaaaagtcattggaggagctaaatcattttgaagtcagatcgaaagacaatattcaaaagttgaaataattgatgagttcgttacctggaagagggacgttgcgacgttccgattcgcaggtttcagattcccgagaagacagaaccaccaggttctgaggggcttccttcacaatccccttcaacttcgctcccttttcctcatggcgagggcgggaagagcgaggtggggaggggttagtctcttcgggttgcttccttttcttatcagcagcccgcttctcggagtcttttccagcggggtccttaatagtctttccagagcccgaagtgggggtttcaggttttttcccagctgacaccgaagccttgttggtcgtctggcgggacctcgacccagagtcagattgttggtatttcgatttctctagagaacgaagtttgctgtcctcaagggtccccgccatcacagttttgtcggatttaatccgcgccttttcctgctcggctctctctctctctcaagtttcttttctgcgcggtacgaagggagagacatgtcggctttgtcgattattcgtggacagaaaggaggcgaagatacggcaaggtcagttcgggatctgattctccgacctgaagctcgaattctatctatggtcaaggactcccaacctagatcttggcaacagaaattcgagaagtgagcagcgaaagtatgtgaaacgggaggcatgctgactttaaatgaaaacaaaaacataaaagaagatggtcagttcaggtgccacgaagtgtttgcattcagaaattacaactaaattaagttgtgttttcctaaagcgaattcactatctaccggtgcgagctgcccattcagatacaaataagccagtcttgtttccataagtaagatcattcactggaaagaagaagtatgattttctccattgttcatctttatctgggaagtcatcgaaaactcggaaacctttccgaggtgacaagaaaaatgttccctttgttcgccctttcttaactgcgtatagctgaaggagatcgttcagtgatagagaaaatctgtcttcttcagctagagtaatgaggcataagacagttcgaataacattcgggcacaactagggaagtgcgattccaacgcatagcgaaaataaaatttcgaacgcacacggatgccctgggggaggattctcaggacagaccgtcggttcgggagaaataagtggaatctggtgaggaatttggtgggctcctctcagcagcaagagtctgctcgaagtcgagagcgaagtcttgtatttttcgaacttaccatctattagaaacacttcgcgaactactttcctcggaggcatgacaaacaccgcgaagtaatttgcaagaaaaaagtcatatctgagggccgtttttcgtttattttctgaaaagctctcttaagcagctgaagaacacttgaagatcttcttcaagaacccaggagcagagaaaggtccgcgctgtatttaatcgatcggcgaaccggtgagacggtgaatctaagaatttgacgacggaatttgaccggaaagaggtgtagaacggcggtgacgttgagttttcttcgaatttctaaacttaaaatctaagaaatcgataaagaatctactccaaatactaccggcctaaacctactgcgattctaggtctaagattccggctatctattgattcaggtgaaattcggaacaaagactgaacgaaaacgaattatggaaaggaggagtcggggttgttacctgaggcgaggaatgagtctggtagcttataagaggtcagtcagaaggtgaagggttcgtcggtttatatagaggattgaatgggcgggaaatccaaaaccctaggattacgaagcgtcacactctttcaaaggaaatcctcgaaaatcacgcgattcagtttccttttttacctcgggagattcttgttatcccgaaatggcgttctgagatctccgagaatggcgccacgagttgaacttaagtccccgaagtgttcacttcgaggacttggggggcaaattgtggatgttggatttcgtatccggcccaatacgcggtctgagcccagcggagggcccatcgagagaagtgggcctgtttaaagaagcccatcggttcaaaagtcagattatgctttaattcgagtaacggaaggatctcgaattaaagacgctcattaattgctcgagctggagagttcgtaacgtttgaagtaaacgaagcgagattcccggcgtagaatcagcgtagtgattaattcatttgattcgaaatatttgtataaatgtagtccgattgcaattgtagagagacgaatgaattgacactgaaactatacagaaataaacaaacacttttccgattgatctttgttcgtttaacaagtcttaagatcttcgaaacacgaccacgaaattctgattgtggattccgacatccacaaatattttatatgtaattaatatgtgaggtgtaaggtaagccaaattaacgtcaatatgtctttagaagaacagaacaccgatgcatgttatgaaaatacatgcaaaatacaaagatg

SEQ ID NO: 30167 - DNA, 3003 bp, Unknown; identical to SEQ ID NO: 26010
  misc_feature (1)..( 3003): 2750-1469P.txt file - cDNA_ID_3026821; gDNA_ID_2214577; Annot_ID_186372

SEQ ID NO: 30168 - DNA, 2610 bp, Unknown; identical to SEQ ID NO: 12891
  misc_feature (1)..( 2610): 2750-1469P.txt file - cDNA_ID_3026864; gDNA_ID_2214578; Annot_ID_186404

SEQ ID NO: 30169 - DNA, 3003 bp, Unknown
  misc_feature (1)..( 3003): 2750-1469P.txt file - cDNA_ID_3026877; gDNA_ID_2214578; Annot_ID_186397
acatgagtgaaactggagcatcagaggataaggcgcgttcgcatgttcgacagatgatcaatgacttgtgggatgaaatgaattatgagaaaatggcacatagctcttcgatactccatcatgattttatggaaacagtgataaatttggcacgcatgtctcaatgcatgtatcaatatggcgatggccatggctctcccgaaaaagccaaaatcgttgatcgtgtcatgtccttactcttcaatccgattcctttagattgaacttcatattgattacattaaatatcatatggttttttgaattctaggacatagggttccatgaaactatatatatttggtgtaattttataacaaaataatatatattatatgtttatgaaacatcaacattacaactttaacaagagctggtatatatgcatgaacaaataatttcaggtaataacttttaatagatcttacgagattggggacccaaagccatagttccactatatatgttgttatacatgtgtcgaccacagataaacatgttaatcacttgaccatcgtaaatcggttggccttgtaaacctctaaaataattaaaacatgttaaccactttacacttcaaagaaaaaaaactggaatgacacctaaacaatttttgtttcaaataatatgtaagatggttataacctatgatatctttttgtctttttctatttttggtgacgcatgacttcacggatcattggcgtcttcttcgacaacatgtgatatctttcactatcgttcatcatgtccacatgaagtacgtcattagtagattctttttatctagagacaaattaattgtaaccaattataataatacaattaagaaacgttttttgcggacaacgtaagaagcttgtacaatattatatatagagacaattacatctagggtaagtggtgtaatacttttgttcaatggccactttactgcagataggttcagctctaatttacaataatgcacttgcgaagactcttccaggtcctcaacctttcacatgcaccataatggccaaaatgacacctggtgagtctcccgttgttcctcgtcgttccacaaactatcagccttctctttgggaccaccgcccatctcctttttatagaaaataaatatgtggtatatatatgtaagtaattaatacctgtataatattaatctataatgaggtcatatatatattgagtactatattgttgatagctatatatgttcaatacacagcgttcaaaaagatgaaagtgtgtgagatcagagagagagagatttgttgaaggaaagggtgagaaagatgctataagaagaagaattatctcgaccaattggagctaattgacgatctacgtacataaacttggggttcccaaaaataagacaatactaataatacgatgtggccattggttttaacttttaatagaaaagtatctttattcgaatgcacatctcaaagcttggaacgtttcatatttttcattcgacttgtgggagccatatattgctggccacatgacagcatgatacgacatgtgataacactaagatcacacaaacatttgagacttaacctttacacagataaacacatgcataaccaaatcattggcctaaggtggggtcaaaactcaaaaggtttcacaagccatcgatcgtagtatctgagaaatcttccccattaaattttttgaactgagggatctgcaacgtaaaaaaaaaccagcttaaaattatgttcttattttataactctaaattatattgtgtctaaacgttgttaggagtgggtttctttaatgttttcacatgtaatacgtctaaagtcatttggatgcaaacatgaaagttgaagatcaaataatatggagaaatatcctagcatggtacgtattcaatgagaagatgccaaccgttggatcaaattaaaagttggaaaattatagggaaacaagtgaggtttaatttagctctggtttgagttctgtcagaccaatgaactaaatgctaatgctatagtgttattgaagaagttgatgcgaaattgagatttgttttgcaaaagctcgagttcaattgttgaatgagcatataaataactcctgagaaggcagcatcgatcagtccacctattggattgatcgtttcacctattggctttaacattccaactattggatatatcatccagcaagagcatcatcaatcgatcccttgtagaattgattgatcatttttcctaagggtcgattaattgatatgattgttgtgtttataagtattcgtaaatttcaattcagatttatcaacaacatgaaatgagatgacaagaaaagtaaaataataatcaacgattttactcctttaattcacctattatacaaaaagtgatttttagataacatgcttttattttatgtgactttctaatttatcaaatgaaagtaacaagtggtgtcacttgtgtcacataattttcacgaaatgtatggttttcctctctaccatatttatttacgtgaagtcgtgaacatctaatttgtcaaaatagattaaaattttcgtcatatgaactgattacatgttattaattagtacgtactctaaacattagtacatctcttcagaaaaaataccatattttatgtttttaagtacattaaataaaatagaatataccgtcacatttcatttaaagggtaaagtaaaaattagtgtcagacattattaacaatatggcaaatagaccaaaaacgtgccaaaaaaacaggtaagtgggtcattgtcaatttgtcatggcaataagtaacgaatgaaagatctcagccgttaatagccagttagcgaatccgacggctatggatccgtacattcctaaagctcatgaggcctaatcgcatgctctgtttcttcaccggaaaaattgcaacttaaagaaaaaaagaaaagggatttaaaaaatg

SEQ ID NO: 30170 - DNA, 3003 bp, Unknown; identical to SEQ ID NO: 26019
  misc_feature (1)..( 3003): 2750-1469P.txt file - cDNA_ID_3026881; gDNA_ID_2214578; Annot_ID_186393

SEQ ID NO: 30171 - DNA, 3000 bp, Unknown; identical to SEQ ID NO: 12884
  misc_feature (1)..( 3000): 2750-1469P.txt file - cDNA_ID_3026885; gDNA_ID_2214578; Annot_ID_186392

SEQ ID NO: 30172 - DNA, 3000 bp, Unknown; identical to SEQ ID NO: 12880
  misc_feature (1)..( 3000): 2750-1469P.txt file - cDNA_ID_3026889; gDNA_ID_2214578; Annot_ID_186389

SEQ ID NO: 30173 - DNA, 3000 bp, Unknown; identical to SEQ ID NO: 12874
  misc_feature (1)..( 3000): 2750-1469P.txt file - cDNA_ID_3026897; gDNA_ID_2214578; Annot_ID_186386

SEQ ID NO: 30174 - DNA, 3003 bp, Unknown; identical to SEQ ID NO: 26357
  misc_feature (1)..( 3003): 2750-1469P.txt file - cDNA_ID_3026922; gDNA_ID_2214579; Annot_ID_186415

SEQ ID NO: 30175 - DNA, 1440 bp, Unknown; identical to SEQ ID NO: 12912
  misc_feature (1)..( 1440): 2750-1469P.txt file - cDNA_ID_3026995; gDNA_ID_2214580; Annot_ID_186471

SEQ ID NO: 30176 - DNA, 3003 bp, Unknown; identical to SEQ ID NO: 26358
  misc_feature (1)..( 3003): 2750-1469P.txt file - cDNA_ID_3026999; gDNA_ID_2214580; Annot_ID_186469

SEQ ID NO: 30177 - DNA, 3000 bp, Unknown; identical to SEQ ID NO: 12911
  misc_feature (1)..( 3000): 2750-1469P.txt file - cDNA_ID_3027008; gDNA_ID_2214580; Annot_ID_186463

SEQ ID NO: 30178 - DNA, 3003 bp, Unknown
  misc_feature (1)..( 3003): 2750-1469P.txt file - cDNA_ID_3027012; gDNA_ID_2214580; Annot_ID_186461
aactagtttgaaacttacagaaaacatttttttttgtaaatttcttagatatttcaaataactctctcgagacataaatcataaagacgataactagttaagatcattgtgaatagtttataatggatttaacaaaaaaaagaatagtttataatggagtcttgagagagttatttgaattattttgggaatttacaaaattgttggataaaaaaagtagttacaagaaaaaggaaaatatttacaagtgtgtttctaattttttcctactagaaagacaactagataagatcatttcaatagtcttctattcactaattatggacaagtaaaaattaaaagatttgttacaccatctctatcttacatttctctatttatagattcacatacccaatgtaaaaacaaatctcttgcctatataactctagacataattcattatattacaacaaacaaagattcaataatcaaaagaaaaatttagaatgacaagtaaatatttctccgtactagtgttcatcatcttggcttccaatgaagttgttgccaagagacactcttcaacacctaaattaagaaaaactgatttcccagaagatttcattttcggagctgcaacctctgcgtaccaagttgaaggagctgctcaggaagatggtagaggacctagtatatgggatacgttttctgaaaaatacccagaaaagataaaagatggtagcaacggatctattgcagatgactcttaccatctttacaaggaggatgtgggtttattgcatcaaattgggttcaatgcctatagattctccatctcgtggtcgcgtattttgcctcgtgggaatcttaaaggaggaatcaaccaagctggtattgactattacaacaacttgatcaatgagcttttgtctaaaggaattaagcctttcgcaaccattttccattgggacacaccacaagaccttgaagatgcttacggaggattccgtggggcagaaattgttaatgattttcgcgactatgccgatatttgtttcaagagctttggagatcgagtgaaacattggattacattgaacgagccattaacagtggtgcaacaaggatatgttgcaggtgttatggctccaggaaggtgttcaaaatttacaaaccctaactgcaccgccgggaatggagccaccgagccttatatcgttggtcacaaccttatcctagctcacggagaagcaatcaaagtctatagaaaaaagtataaggcttctcaaaaaggtcaagtcggtatagctttgaatgcaggttggaacttaccttatacagaatcagctgaggataggttagccgcggcacgagccatggctttcacattcgactatttcatggagccgctcgtgaccggtaaatacccggttgacatggttaacaacgtaaaaggcggtcgcttgcctacatttacttcaaaacaatctaacatgcttaagggatcatatgatttcattggcatcaattattactcgtcttcttatgcaaaagatgttccttgctcaagcgaaaacgttacaatgttctctgatccttgtgctagcgtcacaggcgaaagagatggagttcccattggtccaaaagctgcatcagattgacttttgatatatccaaagggaattcgtgatcttatcctctatgcaaaatacaagttcaaagaccctgtcatgtacataacagaaaatgggagagatgaagctagcactggtaaaatcttacttaaagatggcgatagaatcgattactacgctcgacatctcaagatggttcaagacgctatcttgattggagcaaacgttaagggcttttttgcatggtcgttgctagataactttgaatgggcatcggggtacacggtcaggtttggacttgtttacgtggatttcaacgatagacgtaagagatatcttaagaaatcggctcactggttcagacatttattgaatggaaaaaaggagaattgatgagatatgcaacattccaatatattaactaactagattaatacatgcacaatggtttgtttggaaaacaactattgttaatatacaaataaggtttgattttactgtattatatcaaacttaaatctcaaaaatagtggtttcaatgtaaaacttgtgcacactaaattaaatggaatagtatgcatttaaataaaaaaatcaagaattttcattcttatttcggccttctaaaattaattaattagttaaattagtttgtgattttattttgttgtggttgtcactagtggtaaattattaataatttaaaaatctaatattttcaataaaaattaatgatctatttttaatattaaataaaaatagttaaaattatagaaatttagttcatattgatatctctctaattcatttggaaaaatatttttagcacagacaacagtttatgcctgcatcattacaacaattttttttactattttctcataattttttaatactatttgagttataattgaaaagctaattacggttaaggagcagctatagataacgaattaatagattagagaggttaattatagagtcgtcacatctctctcacatgcctctctaagttccctttagggttttcttcttcactatagagactcatgctcttctcttcccaatcgccgcctctgatctctcttcctcgcttctcagattaggtattagacattcactctttcttacattgttataacattgatgaagtagaagcttagattcatatcattgccattggtcacgattaatcatctctttcactaaatcatcaattgtttcaatgagaaccaataacagctgaatcaatgtcgatacatttgttgttacgaaatcttttgaatcttcactgaatccgctttgtcatttttcttttgcagcctttgttttgttagattgatttgttatgtccaacaatctattgcctcagccttgtatgcaaatg

SEQ ID NO: 30179 - DNA, 3003 bp, Unknown
  misc_feature (1)..( 3003): 2750-1469P.txt file - cDNA_ID_3027016; gDNA_ID_2214580; Annot_ID_186460
ttgcttttttttttcctttttgtttttgaagtgagagattttttttcttattaaaaaagggatatatttacagtttatatgagaagtaaacatagtattttgaaaaatagcaagaaaggaaatctgaaattttagactaatagcaaaaagattttgagttaagttgacaaaattgaattttagtaacttgggaccttttttacatcttttttatataaaaaaagtcgacacatgagatattacttataaaattaaaaatacattattttcatgaatatttaatagagtttatgaatttctcacatatgttaattattaagtgctgaaaaatgtttaattgtttttctgtataaatgttaagtactgaaaaatgcttggaatgtttttctatatttatatctctgctatttatatgtgtgatttagtgttatttagggcattaaatataagatattaaaatattaaatttttctataatttaaaaataagtaaataaacatgttgtagaccgtaattgccagattatttgtgctgtttcctaaatacttttacattctttgatggtcaccaaattaactataagaaaaattaggactcagtctcattaatttttcggaagagaaaaagaatcagtctcatggtagttgttaggaaatatttgaatattgtttcgccattagaaactttttatgtggatttttttcctgaaaacgatggttactattaattaaacggaccgacaagaaccttgttgacgtggtaacaagtgatgacacatgctaattggccatcattgtcaaataatttgttcgcaaggcgtgatacgtgtacgttgttattcagacgtagcaaacagattcacgacttttgttcaatttgtctttgtatggagtatggacctaacatctccaacggaccaatgctattgggtcaagtccatcttttctaggttaagttcattctttgggctttagttaagtatagagaaagaacatattggaagaaaaatttagatgtggtttgtattgcatgcgcatatgaaatgtaataatttgaggatacatatatagtaagaaaaaatgagtgacccaagtaagaatgggttagtagttatatatatgttggaggtgaaaggaataaaataaaatttgttctaggtggattcttaagaaaaagaaggaaacgaaaacagaggaataacaatggcagggagaataagctgctgtctaaatcttcctcccctagattcaaattctgcacaatcattagcttcactgctcaagacaacgtcaaagatctcttggtatctcttctattcatgaaaagttattatttacctgataatttttcatatcaatgatctttgttcttttattgtttagtaggagaacagaaaatgagacagagccacggaaaaacaagtgttcttttgtcttgggggtggcggcaactgtcgtaatcggcgggattcagatcaatgatgttgcatcagtggaagctgcggttgtgaaatcgccggtagaagagatggctgcgggtgtggtgccgccgcggaggtggagtgacaagaggacgtgtccgccttggcttgagaactcgctagagaccatcgtaccggagaatcttcctcgtccgtctgctcatcgacgtttggagttagccggattagctaagggtgatgcaccgccggtcggtgtggtgatgacacgtgtcaacaggggtggttgtttctccgtgtaaattggaagttcattacgtgtaagggagattgttaggcaggtgtaaaaaaagtcaattagaaacaaataatacacacaaaaactattgtagatatattaaattttaagtatttgtttgtgtagttactgatgacaaaacattgaaccaaactggtctttaattcatgcaaaattttctttgaggatgccatttttgatttttggtttaaatcgaaccgtataaaaataattaactcattaaattcattgagatctttatgtgcacgattagttttggtccgtcctttttttctttgttttgtaatcttgtatcctaccaaattttgggagttttcagctttgtgtgttaaagtagtactctattggatgtgaaatgaaagaaaagtagtacatgcgtgtagtacaaaagaaaaacactccaagtacttcctactgaaatgagttggcctattatcgatccaaagtgaagcccaactctatgtcactccaacgattagtttgatttcggcctcgtatttcaaagtttaactacaactctacaaatttcacttccatgtcggaccttcaataatttaatttcttgatgctcatgttctttgcttttacaagaatggtgagagaataaagggagattagccttagcgagagagaaaagactcgtagcatgaagagaagaagaagaaaaaattggttttgcaataagagacctacgttaacaagaaaatggacacagcttgatcatcttatgcaaatccacactcacgattttctaaaactagtttgaaacttacagaaaacatttttttttgtaaatttcttagatatttcaaataactctctcgagacataaatcataaagacgataactagttaagatcattgtgaatagtttataatggatttaacaaaaaaaagaatagtttataatggagtcttgagagagttatttgaattattttgggaatttacaaaattgttggataaaaaaagtagttacaagaaaaaggaaaatatttacaagtgtgtttctaattttttcctactagaaagacaactagataagatcatttcaatagtcttctattcactaattatggacaagtaaaaattaaaagatttgttacaccatctctatcttacatttctctatttatagattcacatacccaatgtaaaaacaaatctcttgcctatataactctagacataattcattatattacaacaaacaaagattcaataatcaaaagaaaaatttagaatg

SEQ ID NO: 30180 - DNA, 3003 bp, Unknown
  misc_feature (1)..( 3003): 2750-1469P.txt file - cDNA_ID_3027019; gDNA_ID_2214580; Annot_ID_186459
cacattaagttgtccatttagatagccatcgaatacatgtccacccgatgcttcaatgcgtctcctttccttactgctcatgggtttgtggtctcttgacatttcaatggcttttccctgacgggataagactgctctgcaatctccagcgtttgctaccaccaacgacctgttaccacaaaactatatgttaacacggtaccaaacggtttcataccagaatactaatagagtatgaaatgagcaagtatatacgtgactcaaagaccatatgagacaataactacattatagcagcagcacatatgggcagagaatacatctacaggcgaattagttgtacatgattgtgttaaaggtcaagattatgcacactacgcagttgaggataagcatctattcccaaacacgtttttctttaacataaccaagatgtaagagtttaggttagacaaaactaaaagataataagagttgaatcaacaaaccttccaaaaagaatagctgccaaagcagtagttcctgaagcaaggctcccatccaatgaacacgcctctaagaaggcagtgtctgtttgaagaaatgctgaagataacaccttattgatttcactaggaaactcttgatcttcaacaatgtacctcggtatatggtgacatgcaaactcagcggcatgcttcccaccatgtccatcaaatacctaataacaaacaaaattcaataagagatccccatattttcactacattcacagttgtttgcttatgctacaaatctacaaaaaatcaggaaaactgaagaaagaacataccccatagaaggcacttggaccagcctcagaattcagaaggccaaagctatccatgaaattatcaacgcatagataagcatcttccatgcttgacctggagccaatatcagaccaagctccagaacgcgtagcaggaacaaactcagacttgttcttctctatagtaaactcattctcaacagatatatctgacaccattgtcttcacctaccaaaatgaaaatcaatcagaaaacctcaaacatctcataatgacacattaaaaacagaaactttctaccttaattatacacattaggaaaccaataatgatcaaatccaaaagcagagcaataattacaaaacctcaacttaaattgatcattcaatacacaaaataaacctaactgatccacaaatcaagttgaagagaaacgaatcttacgagagatgagtgtcgaaccagtgacctcttattacacggcgccaacgatcgctcgccgtcgaaggtttgcctgtaaacggcagcagcggcggaggaagaagagaaggagagtggattcggcggtttaccgccgtaactcgaactcccattctctggatcagaaattcctctagtttcttccatattgaaacatcatcgtataaaaattcaataagcaattatggaaacagctgacgagtcaactcacgagtgagcgagtcgattaaaaacgatttaacgaagaatgtagctttagatgagagattcgtaaacaatggattcagaatcgaaaacaaaattgaagagattgttgaaaggttacacgaatttcagggtttaagagaaaattagggttttgtggaagaaattggaacacgcagaaagagagagataataaaactgttcgccggcggaggcgagaaatatgagtccgacggttatttaaaaggcaaaaagaaaaaggaaaaaggaaaaaggaagcttaacataaacacgaaacgtcggcgtattatttactttttctctttgcttttttttttcctttttgtttttgaagtgagagattttttttcttattaaaaaagggatatatttacagtttatatgagaagtaaacatagtattttgaaaaatagcaagaaaggaaatctgaaattttagactaatagcaaaaagattttgagttaagttgacaaaattgaattttagtaacttgggaccttttttacatcttttttatataaaaaaagtcgacacatgagatattacttataaaattaaaaatacattattttcatgaatatttaatagagtttatgaatttctcacatatgttaattattaagtgctgaaaaatgtttaattgtttttctgtataaatgttaagtactgaaaaatgcttggaatgtttttctatatttatatctctgctatttatatgtgtgatttagtgttatttagggcattaaatataagatattaaaatattaaatttttctataatttaaaaataagtaaataaacatgttgtagaccgtaattgccagattatttgtgctgtttcctaaatacttttacattctttgatggtcaccaaattaactataagaaaaattaggactcagtctcattaatttttcggaagagaaaaagaatcagtctcatggtagttgttaggaaatatttgaatattgtttcgccattagaaactttttatgtggatttttttcctgaaaacgatggttactattaattaaacggaccgacaagaaccttgttgacgtggtaacaagtgatgacacatgctaattggccatcattgtcaaataatttgttcgcaaggcgtgatacgtgtacgttgttattcagacgtagcaaacagattcacgacttttgttcaatttgtctttgtatggagtatggacctaacatctccaacggaccaatgctattgggtcaagtccatcttttctaggttaagttcattctttgggctttagttaagtatagagaaagaacatattggaagaaaaatttagatgtggtttgtattgcatgcgcatatgaaatgtaataatttgaggatacatatatagtaagaaaaaatgagtgacccaagtaagaatgggttagtagttatatatatgttggaggtgaaaggaataaaataaaatttgttctaggtggattcttaagaaaaagaaggaaacgaaaacagaggaataacaatg

SEQ ID NO: 30181 - DNA, 3003 bp, Unknown
  misc_feature (1)..( 3003): 2750-1469P.txt file - cDNA_ID_3027021; gDNA_ID_2214580; Annot_ID_186456
ttgttgcaattggagaaccaaaacatatttgataatgtttttgtgtatgtgtttctttacaggtagttagtgaagcacagagaggacatgtttttggtgaagttggggtactatgttacagaccgcagctgtttactgttcgtaccaagcgattgagtcagttgcttcgtctgaaccgtacagtactcttaaatcttgttcaggcaaatgtaggagatggagcaataatcatgaataatcttcttcaggtttgtaataactctgaatagtacagtttgtttcaacctgttgacacacaggaccagttccataacagatatgttgtggttcatgcagcatttaaaagactcagaagatccagtgatgaaaggcgttttggctgatacagaacacatgttggctcaagggaaaatggatttacctctcagcttgtgctttgctgcagccagaggagatgatttattgctgcatcagttactaagacgaggctcaagccctaatgaaatggataaggacgggcgaactgcgctggtaagcccggatttcctttgtatataccatcatcctccttttaatgcctaaaccaaatttgctcactctctatgtttcttctttgaatatctcagcatatagcagcatcaaagggaagccattattgcgtcgttttacttctcgaacatggagcagatcctaacattagaggtaagtagtaaaaaataatgtttcactaggtcaattagcttaggatgataggatcatgtagtactaaattatcggtggctcgtacattgtttacagattccgaaggcaatgtacccttgtgggaagcaatcataggaagacatagagaaattgctaaactccttgcagagaatggagcaaagctaagcttagactcagtgagctatttctctggcttagccgtggagaaaaactgcttagacgcactcaaagacatcatcaaatatggcggcgacgtcacactccctgatggaaacggaaccacagctttacacagagcagtgtcagaaggacacttggagattgtgaagttcttactagaccaaggtgctgacttggactggccggattcttacggatggactcctcgtggtcttgccgatcatcaagggaatgaagaaatcaaaaccttgtttcataatcacaggcctgtggagaaaaaaccgaaacctatccctggaatacctcagagtcctgtgacagggaagccattaatgaagtatagcagtgagcctacaatgcattcaggagaactcgtcttagacgggggtcaggttgttgtttctcagaaacggaaactcaataacttcagaaactcgctcttcggaatcatttcagctgcaaatagcggtaaaaccacctcacctctccatctgctctctagatactcgttgctttcttgtcacgtaaccataattttcagaacttttcacatcacaatagtcattcttatatacaattcacaacgttcattacattgttctgttccttacaaatttacaaatttggttttcatttctggtttttttccagctgatgatggaggagaagttccaagaagtccagcggttcctggaggaggaggtagtatgatttatccggagagagtgacgataagttcgccggaaaacggtgaaactggtggaaaagttgttttgttaccaaattctatggaagagctattgaaaattggtgaaaataagatgggattcgtcccaactaaagtacttacgagagaaggagctgaaattgacgacatcactcttatcagagatggcgattttctccttctatcaagggatccttgattcacacgcaactctctttcgattttgagtaatgaaaactatttgtcttaacgcaaactcgcaaaccaccacagtcaagctttatggtggtgatatgatgctaatattaggggaaaccgtaagccccaatcaactccgggattgaaatatcttttaggttttttttttttgcttttgtgtatatattcactgcttactatttttcacatgtatatatatatatatcctgttgactattttctgttaaaagaactctctaacaacctcatgatattaacatcgaaatctacaagaagtatggaaacaatcttgtttttttcagaaagcatacaaggataaaggtcctttcttaaacgtctagacaatcttcttctctaagtctctaagaagaagcaagtgttaaaatttataacttttgtgcgaggtcgagatttgagagtaactcctcactcatcttttccaatcaagcttaaatcctctctaggtgacttatcctatttctgagatgaattatcatctcatctttcatttttgtttagatccatgatggtaaagtgatattgatgggacttgggagccaaagcattaccgaaaatgagcacaatgattgagatagagttagagacaacacacactataatattattattatttcatgcttcaaatgcaagaaggtaatatttgaatcagactctagagagcttaatctgctcccatctctctgaccaatacgaaacatccgcaatctgctcaatcaacctaaagaggtgaagttgtattttatgtctagttgaattaaaacccttgtcaaattagacaatggtttaaggttgatgagaatttgatgttggaaaaaaaaagtgatataaaagataaaagcggttcaaaacggttttgcgattgatgttaaaagagtgcgaccggttgtgggagaaccggtcaactcctagtcctagaggctagagagtgttgtgttgtgtgatttgtggtgcagataatatcttaaccggcttcaaattttaaaatctagctcggttagcattttaaaactgttttctggtttgattccgtgtctatctctcggctccgttgtatcggaaggtagatattaaaactgaaagaccactgccgtcgagagcaactcaaaagatcatcagaaccgattcgaacgatg

SEQ ID NO: 30182 - DNA, 3003 bp, Unknown; identical to SEQ ID NO: 26031
  misc_feature (1)..( 3003): 2750-1469P.txt file - cDNA_ID_3027045; gDNA_ID_2214581; Annot_ID_186507

SEQ ID NO: 30183 - DNA, 3000 bp, Unknown; identical to SEQ ID NO: 26359
  misc_feature (1)..( 3000): 2750-1469P.txt file - cDNA_ID_3027059; gDNA_ID_2214581; Annot_ID_186497

SEQ ID NO: 30184 - DNA, 3003 bp, Unknown
  misc_feature (1)..( 3003): 2750-1469P.txt file - cDNA_ID_3027113; gDNA_ID_2214582; Annot_ID_186520
ataatagtttttgctgaccaccacttaattatttttgttttctgttaggttgccaaaacatttgatgttagcttgatgggagcttcatcgaggtcgtgtaaatatgttttgaacacacttatgcaggtaacttcgtgtgaattagtgatgctgctcttcttcattagctggctagcccacttagatttgtttgtgaagttcactactcataagtatgtatttttgcagacattccaaaataaaaagcttgcccatgcagtcaaagaagggactcttgaaagccttataacagagctcttgctttggcttctggatgaaagagttccacgcatggaagatgggagtcaacttcttaaagctctgaatgttttgatgcttaagatcctggtcagatattcgttccatgctaaaggttttcatcatatgtggctatgaagttctctgacttcattatttttatttcttgttttatttaattcaggataatgcagatcggacatcttcgtttgtggtgcttattagcttgctacgtcctctagatccatctagatggccttcacctgctacggctgaagtttatgctgtccggaatcagaaattctctgatttggtagttaaatgccttattaaacttacaaaggtattttaggacaatcattgttcacataactcaagtagttgttacgtacagccctactgtctattatgcaacacttgcctttcctacttgctacaatcacagtgtcaaattgtttagtattgtatatctgataattgcttgtccttgttaagctcctccaaagcaccatatatgaagttgatcttgatagacttcttcagagtatccatgtatatctgcaagatctgggaatggaagagatacgtaggaggtacatctctttaaatgcactcttagaaattttgcaaatctatgtctgtttattatgtggagatttttcgtacttggcaatactaatgcattctcggttggtattttttccaatgaaaagagctggggcagatgataaacctctgaggatggtgaaaactgttctacatgaacttgttaagctccgcggagccgcaattaagggccacttgtctcttgtccctattgacatgaggccacaacccatcattctcgcttacatcgatctaaaccttgaggtgagacctccttagtcgtctaacttcatgtccagaaattttgacaaatttgctgaagctgagggtttggtcaaagagcgcatccaaactatttgctgttttactatgttttgagaaatttagacgccattggtagtaactatttaaatacctgcagactttagctgcagcaagaatgttaactgcaacaggtcctgtgggccaaacccattggacagattcaacagccaacaatccttcacctcctgcaaattctgccgatgttcagttgaagcaagagcttggggctatttttaagaaaataggtgacaaacaaacttccacaattggtctttacgacctctaccacatcacaaagtcatatccaaaggtaatagatatgactatgtatttcaagtctcaatgtttcctgttcttcatgaacaaacgagccaaattgtatgtacttacaacctcatcttaatgcttgtaggttgatatattttcccaacttcaaaatgctagtgaagcgtttcgtacttacatcagagatggtctggcacaggtctgtaactagtctcctagctttttactatgatttcgataaaactcaagttttttgtcttgaagttttgcaatcggttctgtaggttgagaagaatgcagctgcgggaagaacaccttcaagcctaccgttgtcaactcctcccccttcgtccttagctcttccatctcctgatattccttccttgtcctctttagatgtgaagcctttgatgaaccctagatctgatttatacacagacgacatccgagccagtaacatgaatcctggaggtagtttcctagatccttatccttctttgtccttccttgcggtgtttatatatatctgttaaaaacaaacatctttggcagtgatgacagggacgctagatgcaatcagagaaaggatgaagaacatgcaactggcttcatcagagccagtaagcaaaccgctgatgccaacaaacgataacttatcaatgaaccaacagagcgttcccccgagccaaatgggacaagagacagtccacacacacccagtggttctcccaatggatgagaaagcattgtccggtcttcaagcccgaatggagaggctcaaaggtggatcactggaacatatgtagaactagagaccccaagctttggagtctgaagttacataagcaaattcgccatttttgttacttctctccaattaatgtagtagtaaaatacttttcttttaatatacaaacatataagagagagcaatattttatggtgaagcggctagatttcaatggagttagtgtgtatagtggtgggagagtctgggagctgatggtgagtgtgccagattctttttaatatgagacaaaatattattctttctatgcttgtttacatctttttttcaaccactagtagaaacctgaatattctctcgactctgtttagatatgattctgatgtagttggcatatcttgtgtaatccctccactctcaaatttctaacaattcttaatttttgggttgaaacggaagtaatattttgttcttccatctaaccaaaggtcgtatatttgcaaaccaattgaagtagaaattaacttaaaccgggaactggtttaagagatattaatatatgaccgaagacattgggtttaaaaagtcagaataataaaaagttggcgtagtctaaacgccgacccagaggccctctcatacctttaccagtgcctatatatatatatatatataaacagactaattactattccccatcgcacagacccccctaagaatccgagagagaagaagagataatg

SEQ ID NO: 30185 - DNA, 3000 bp, Unknown; identical to SEQ ID NO: 26033
  misc_feature (1)..( 3000): 2750-1469P.txt file - cDNA_ID_3027151; gDNA_ID_2214582; Annot_ID_186526

SEQ ID NO: 30186 - DNA, 3003 bp, Unknown
  misc_feature (1)..( 3003): 2750-1469P.txt file - cDNA_ID_3027161; gDNA_ID_2214582; Annot_ID_186523
atccagttgactccaaatagactagaaagagaaagaaagagagagagagagagagagagaaccagagattatcgaacacgaagcagaagacgattcgtggaagagacttggagagaatatttctcaatgtctcctctcccaatcttccatcgtcttcctcacgccacgttctcttcctttctcctctcactggttcgttccctccattgacgaatgttgcattttgcttgttacctacgactgcttttgattctctttctccatttgggtttcttccgattactttaatacttcttcaatttggacttgtcgtcaacattttcttgctaaagtatggattttttgttgttgggttactgttcagtttgactttgatttcagagaacccattctttgttgttcttgcgtgctacattgcttttagatctgattcactaaatccgttaaaataccaaatctttatcgtgtttgtctttttgtcctctaagagcattaaaacttggtgtttttcttgtcctctagttctgggttctctaatcgttttctcttttacttgtcattgtagtctcaagctggaagttctaaaacatcagtggcattcctcaatgccttcaaatcagaagatatcattgctcgaattggactatggtggcagcttataagggctgttgtagttgtacctgtcttcaagttcctggtgcttctatgtttggtcatgtctgtcatgttcttcgttgaggttatgtacatgggaatcgttgttttgtatgtcaagctgttcaagagaaagccagagaaattttacaaatgggaagccatggaggatgatgttgagtgtggcagtgcaagctaccctatggttcttgtgcagatacctatgtacaatgaaaaagaggtagttactgaaccagcaactatttttccagtgattggtttgtagttgaacttatttggtgggatgttaatgtttgtggtaggtttgtgagcaatctattgcagctgcttgcaaaatctcatggccatcgaatcgtataataattcaagtgcttgatgattccacggatccagccagtaaggtccttgtttaacctctatagacacttgtccctttctcgtctaaatccctctgttttagactcatgattgtgttgtgttaaagtgagttccttaacatttgattatgtggcaatgatggaaggaaacaggagttggtgaaaaaggagtgtgacagatggtctaaagaaggtgtcaacataacgtttgagataagggacaacaggaacggatacaaagctggtgcgttgagagaaggaatgaggcatagctatgtgaagcagtgtgattatgttgctatctttgatgctgatttccagcctgatcctgacttcctccaccgcactgttccattcttaattcacaatcccaagttagcacttgtacaaggccggtgggagtttggtaacattccttagttacctttcttttctttttccatcataagtttatagattgtacatgctttgagatttttctttgcaaacaatctcagtgaacgcgggtcaatgcatgatgacgagattacaggagatgtctctaagttaccactttacaatagagcagcaagttggatcttcaacatttgccttctttgggttcaacggtatagcattctcaattttcttttcttttctctccataaagctttttcttattctctgaaactattgcaggaactgctggcgtctggagaatctcagcattgaatgagtccgggggatggaatgaccagacaacagtagaagacatggatttagctgtacgagctacactgagaggctggaagtttctatatatcgatgatctcaaggtatgtatagaagattcctctcttttcttggaatcttggattttgcatttgaatcattaatgcgttatctgtaggtaaaaagtgagttaccttgttccttcaaagctctgcgtagccagcagcatcgatggacttgcggccctgccaatcttttaaggaaaatggctggacaaataataagaagcgagaatgtatctctatggaagaagtggtatatgttgtacagcttcttcttcatgcgcaagatcgtggctcacatcctcacattctgcttctactgtgttatcttgccagcaactgtattgttcccagaagtcacagttccgaaatgggctgcattttatctcccttctttgatcactctcttaatcgcaattggtagactaagatcaatccaccttttggctttctgggttctatttgagaatgcaatgtccctgctaagagcaaaggctctggtcatgggcttgttcgaaacaggaagagtacaagaatgggttgtgacggagaagttaggtgatactctcaagacgaagctgattccacaagttcctaacgtcagattcagagagaggtaagttagacatttcgtattaggcctcctttacttaaccgagtttgagcttaaaccattgtgttgcaatcagggtgcatttgctggagctattggttggagcgtacctgttattctgcggaatctacgacatcgtctatgggaagaacacactctatgtgtaccttctgtttcagtcagtggccttcttcgttgttggttttggatttgtaggaaaatatgttcctgcttcctcttacttagcataggatagatcatagagtctcaatatgtttcagaaggttttttgtttgatgtcatattgagaacaatgcctatatactactctccatttgtattaacacttgagtatctgtaaccaacgaagctcagatgtgatcgatattatttttttaacagtataaaaccacttaacacttatttagtttgttgacctcgtggcttcatattgactacagaatgaaataggtaaactataaagtctacactatttatggctgaaatttatttgaatacatatccaccacttgtcttgttcttgaaacacacggtcgtggccatg

SEQ ID NO: 30187 - DNA, 3003 bp, Unknown; identical to SEQ ID NO: 26360
  misc_feature (1)..( 3003): 2750-1469P.txt file - cDNA_ID_3027169; gDNA_ID_2214582; Annot_ID_186519

SEQ ID NO: 30188 - DNA, 3000 bp, Unknown
  misc_feature (1)..( 3000): 2750-1469P.txt file - cDNA_ID_3027177; gDNA_ID_2214582; Annot_ID_186517
ataccagtatcagcaatctagcaagtaactctatggctagatggtgaacctatacatcagagtgcaagggttaaccgtatgtgtctagataaccctagcagtgttgcaaaaacatagaatgaatgacataccagaaaaacatcgacggcctctaattctacccaaagcaagaaagcagcctgcgccttgtccacagtattcttccgacccgtaaggcatttgagcgcaatagcatcgcaaacttcctttgcataccttcaaaagcagaaacaaactaattattcacatgcaaacgaacactccactctgcccatttctaaagcaataaaaataaacaacaccataccttccagcatctgaatcggctgctcgcaaaaacgcaatcaatgcatcaagcgctttctcttgcaccggcgcattagaatctgccaccgtcttcctaaacaagtgacctgcgaataaaaaataataatcagaaattcaatcaaaagtaaagcaaaatggaaccctagaccaatcacattcccactcaacaatccaaattcaaaacagatccacaccgatataaaccaccctaatcagatctgagcttcaaaaacaaaaaccctaacataataataataaaaaaacgaggtagagaaactcaccaaaatcgcgaagacgagggtccttaggatcagtaatcgaatcaaaaacagaagctaaatcgacgttagcttcgttcctaactttccaattcttatgcccaagccgatcctcccaaggaagttttttcgcctccttcaataacttctcatcctccgtcgacattactccacgaaattatctctccgacggtatcgatcttatcgatctataccaagttttttttttcttcgtacggtctcttggaaactttctctctcttttcaaaaaaatttcttcgtgttgttagtgccggcaagagagagagagagaaggacaaaaaagaagagtagggtggagcgtaatgagagagagagagtgggggaattttggtttctacgtttaaatcggtggtgtaatttttttgttaaaaacccttcacgcgcgttttgattggaaatgtttacacgcgcgattatttcaaatcttaaaacgagcgtttttcttttgctttctccacgtggagagatcggcattttcaaactattttaggaaatgattaacagtactgaattttcctattgttggttctgtaaatattttcaaaatatatttacattaacaatctattaatttctaagaaaataaagtaatattttgaaatgaataactcatttttagttataaaaatatttattttaaaaaatcaacaaaatcatgagttattattacttacttattggattatcttttcttctataaaatacaaataaatagtcattttctataaaactagacacgtaaaccaaaatggatttattagtttgattatggaagttcaaaaacattgtgtattttatgatttaaaaactagttaaaatttattattttaatatcctaaatatttatgctaggatctgatttcgctttggattttaatatatttgaaatatctaattcaaattcagaatacaaatactcaaatttcaaacaaactttgattgataattagtacaagaatatttaagccacaccacaccttacaccttttccatctccatcctcatgtcttaggtgatgtaactctctatctccagatatcttttcttgtctactgctaacacatgaaacaacaactcaaatttaagccatatttttacaatggtaccaaatttataagaatcatagatgaaattaccaaaacaagaagttacgtggaaagattgaatccaatattaatattttgatttctattataaaagcaaatgaaataatgattatcagtccattgtttgttccatttttaagtacacttgtttgtttgatttaggtgaataagatccgctaaagctgaaaatacaagaattgtccctaaagatagtaaagtacagtacgcttccaaataaataacaatgggctttagtaggcccacgcaataacgatgttttaactgacccaacaagcccttgtccagttctggcattatacaatgcgtcggtcgacacgtgtaataagtcatgatcggcacgtgtggtctccacttctcctctctcattggtcgtaaactcgtaactagccgattccttctccaaagtatctcacatttccactgcacactctactttctctctcttcactctctcataaatcacaacaacaacaaaaaaaaaaaagttgttagttaagacattgctttacagctcaattgcgtcttcttcctctgtcttattcttcatcttcatcttcctcctcgcggatccattttgaggttcgtgtaaattcccattctctttcgccatttttttgggggaagtgagattttggtctgagttatcggcgaatcgatttcgtttttttagattattgaatggttttgttgactcttcagttcttcttgtgctgtgattgcaatgatgtcctccgaatttcgtgatttaagttcgattttagctatccgagctcctctttaaataatgagttggggttttattctgaaggttcgatttctgattttgcaaatttgggaggtggatttgatccgattagataatctcactgttctgggtgctgtaattgttaatgagaccatgcaaatgttgtgcatcgatgttgtggaacgcttgatttgtaattgaggatttggttgtctgattattggaagatcgaggcttgatagagtttcaaatgagggtcagctgttattgttgtacggtctaatgacattattttatttaacttcaggagtctctttttgtttcttgaagatagactgggcgtcacggagcagctgagtatatgctacgagtgttgcattccggaggctgttctttcagatgattggcagtagctatattatgcttgaacggtgccataatg

SEQ ID NO: 30189 - DNA, 3000 bp, Unknown; identical to SEQ ID NO: 12945
  misc_feature (1)..( 3000): 2750-1469P.txt file - cDNA_ID_3027186; gDNA_ID_2214582; Annot_ID_186514

SEQ ID NO: 30190 - DNA, 3003 bp, Unknown
  misc_feature (1)..( 3003): 2750-1469P.txt file - cDNA_ID_3027190; gDNA_ID_2214583; Annot_ID_135300
attccaaatgaagttccataatattcttcggggtgtagaatagaggtgttttcttacaatttaggacgtctatactagtagctatgattgaaaccaagacaaatccaacaattgtggtccaaaacaatattgtacattgcttaaggaaagcgttgaagataataaatcagaattaaccaaaaagaaagaaaaataataaatcattgttatggtcgtcttatggatcctagttatatacgaattgagttttcattcatagttgagaacgaattcgtttgctcgcgtgtgagtttagatcgtggttgtttttgtttgatcgtctactagtgttaattaagatcattatttcttaaacccttgaatggttcttctaaaacctatgcaatgaccgtgaaaacgttgatgatattagttttaaccaaagaaatgttatgctaataatgatattgtgatgttaaattaataaagaaaaggttatgcttagcatgatcccaagcgataattcgtgtgtcctatcattaggtttggaaaaactctaccaatcatagacgattagaccagtatagttgattatagttttcagaattcagatttcagaccaaagatagagttgtggacgtaggtttcttgatttttgttttgtttctgtttatgtttttttgtcgttatacatggataaaaaaaattccaaccaatcgttaccttgagatgtgtagttggacttttattgcctcatcaatacacttatacaaaaggttcaattttctgtctaattatggacatgtttatttcaaatgtatggtaatcttccaacacttataataccataatgaaaaatacttctgtttatatatatattgaactgagattcaattagtgccacccatgtgacctgatggactctccgtagacaaatgtgggggcaattttgttggatcaaccaaacccaacatttattttatatctgatttgaagattacattagtaaataaacaatggttagagtcaagtttatacaaatatatgggacccaactaataagaaaaaaaaattattgacgtcagatatatactaataaagtatataacaaaggaccctcagtgcatgtaattaatatatattttccaataaatatcaaactatagattttctaatgtatttaatgttattatttctaactagtaattaattgataatttgacaaataaatttttgtttcacattattcttatataaaactgtaaatgatttgtagcaaaaatacaaaactgtgtatataatatactttataaatagtttctatgtattggatccaagtaggatttcgaagactttgaagggcacatctttttcaaagtttacttatacatatttaatgtaagataaagtcattgtttatatgtttttttctagaacacttaaatttccacaatatgataatttaaattaattgaattttgttttactttggttggtttgtggataaaatccaaatattacagtcactatctttcgacgtgtctcacttgcaacctaatccttttctggaatgtagctttttttttgtttgtcaattttatttctttctctcttaatccataaaaattttaggcatttttgtattactgtcaaagaactgattagctatgtcttctatatatctaaaataaaccataagaatcatagttcatactcattatggtattcttaattttctgaaactatcgataaaatgttaaaacgttatatacaaaaaaggactatcaacgtagcaataaaatgaatttagacttatatgaaagctaatggtgacgaagaagttgacggtgatgccggtcatttgggtcggtggtggttccgtcacggagactttgacggtgcattattgacgtcaacatgaagtagctctcacaaaacacaaaaaggaccgtttagtttgctagttattaaaaatataatgggcttcaagcccataataacatgtctttttacaaaacagaagccacgtattatataaacccattttttaatatataaataattgggctgtacttgggcttggacggtttcactcttttatttttatttttttaaagttttttctatattagtaatgatatatttacagtggaagcctttttggcggaaagttctattaatacttatacacaaagaaattgaggttcaagtcccaaatactgtgatttattagcagataatggagataagtgtgcaagagatctcgaacgatgtacaattataactgtttgccaggatttgaagatctttcaaggtgtccatcaaaagcatgaagacggagaagaaagtgtcgtctttcgtggatctaataaagatcgaaacaaattacccataatagaatcggctatataacggttctcataaatcataatttgcaataaataataaatctaaaacggtaaaagaaaaatatatttacatgaaaataacatgtcattttaaatatttccagaattaaaatataattccaactgtcaacggtccatatacgttatctatagactatatagtacataaattattttaaaaagacaaataatttgtttcgagaaataatgttgctgtctcgtcaaaattggaaaaaaaatacattttaaaatacagagaaacgaattattgagaggagaaatttagagaccattcaggttttgattgaagaaaaaaaagattcccattttatcatctttttagtttttagtgtcaactctccaacaaaagcaaaaaccttaaagaattttgttctttttttaaagcaaaagaaccaaacatggtttcacatgaatcccaatttcattgcaaagcataactaaaaataaagaagaagactttttggagatcgaatctgttcatgttgatgggttttggctgagctttctagagatagagctagagagtactgggtctgtgtaaagttgataactttttttggtttagagagagaaaggacagagctttacagagatg

SEQ ID NO: 30191 - DNA, 3003 bp, Unknown; identical to SEQ ID NO: 30190
  misc_feature (1)..( 3003): 2750-1469P.txt file - cDNA_ID_3027190; gDNA_ID_2214583; Annot_ID_186559

SEQ ID NO: 30192 - DNA, 3003 bp, Unknown
  misc_feature (1)..( 3003): 2750-1469P.txt file - cDNA_ID_3027225; gDNA_ID_2214583; Annot_ID_186565
agtttctgtattttttaaagcttattttgtattgatcataaggtccttggagcagtgatggtttatgcaaagatgggagatgcagcgattgtgtacactggagattacaatatgacgacagatagacatctaggagctgctaaaattgacagactccagttggatcttctcatttcagagtatggaaaacaaatacaaacttgttcgctggtatttttcaacaaacttagaaagaacaagtttacctgatataggtttaactatgccgttttaggtccacatatgcaactaccattcgcggctcaaaatatccccgggagagagagtttcttcaagctgtatgtctacttgtaactattaacacatggtttctaaatttgttcttaaatggtttttgattataattacccgcatcacctttggcttgtttctgatcaatataccccttcaggaaatgcttaagctttcgtttggtaattgtctgatatctcagaaaactcttccaggttcataaatgtgttgctggcggagggaaggcgctgattccttcatttgctcttggaagggctcaggtctgtcttcttacagagctttgaagtcagttacttaaacttgtctttgcttctcttatgtctcattgacaattgcgtttcctttttcaggaactctgcatgctgcttgatgattactgggaacgcatgaatataaaggttccaatttacttctcatcaggtctgttaaatcaccaccaatcctcatatgaaatcaattctgcagattagtcagctcaacaaagtcgtgactctatttcatgaatagtgatctctatcttctgaaaattgctgtccctgaagataaatttgtacttttgcaggtttgaccatccaagcaaatatgtattacaaaatgctcatcagctggacaagccagaacgttaaagaaaagcacaatacgcataacccatttgattttaagaatggtatgtgtactaccatttgcaaataactttagaacgttgaagatgaaatttatatcatatggaaccgaaactctgatgtgcttgaaaaataagaaccaaactagtggttctaatacatcctttgcgtccattttttgttcttatccactaccttagctgtacaactctgcttgctttctaactactaccttcacattctgcagttaaagatttcgatcgatctcttatacatgctcctgggccatgtgttctctttgccacacctggtatgctttgtgctggcttttcacttgaagtgttcaagcactgggctccttctcccttgaatcttgttgcattacccgggtactatacctattgtgtttcccctttattagcaattcagttttttcctagcatagcatctaacacgaaattgtatctcttttcatccatttatggatccgttttttacagatactctgtggctgggaccgttgggcacaaactgatggctggtaaacccacgacggttgatctctacaatggcaccaaggtcgatgtccgttgcaaggtttgtttactctttcttctggttctcacaaaatttatgtaaccttaacacgaaaacagcaatgcgtccaattcacacgttgaacctaaactaaaatgtcttgttgattctgttgttatcaggtacatcaagtggctttcagtcctcacacagatgcaaaaggaataatggatctcacaaagttcctttccccaaagaacgttgtactcgtgcacggcgaaaaacccagcatgatgattcttaaggaaaagataacctcagagcttgacatcccctgtttcgtccctgccaatggcgaaacagtttcattcgcttcaaccacttatataaaagcaaacgcttctgatatgttcctaaaaagctgctccaacccgaatttcaaattctcaaactctactcagctccgtgttacagaccatagaaccgcagacggggttttggtaatagagaagagcaaaaaggcaaagatagttcaccaagatgaaatctctgaggtgttacatgagaaaaaccatgtggtctctttagctcattgttgtccagtgaaagttaaaggagaatcagaagatgatgatgttgatctaatcaaacaattgtctgcaaagatcttgaagacagtgtctggtgctcagatccatgaatctgaaaactgtttgcaggttgcatctttcaagggctctttgtgtctaaaagacaagtgtatgcatcgaagcagtagtagtagtagtgaagctgtgttcttgtgttgcaactggtctatcgcagatttagagcttggctgggaaatcatcaatgctatcaaactaaatcactgattcttgtaacactgagaagtgttttcagtttttgtcgtttttctgtcggcatatgtaaaagttttgatcctagtaaattaaattaacccagtagtaactaaacttaccaactttagcgccaatttctatctaacaaagtaacacccgtattaaaaaccggaaccaattacccgaaactgaatctgaatccgaaaatttacttgtgtcctaaattcttctaccctaaaaaccaaatctgaagtcgaacccaaaaatacatgaatattttaatcaaaaatttaaattttattcgaaatccgaaaaatttgcatatttacccgcaaaatcaagtatggttctaaaaaaggcctaaaatctatacacgaaccgatattttagatttaccctatagaatcctaaacttctctacccgaaaaaccgtattcgatcgaattttacccgaatccgacccgtttatccgaatggccactcctaaccggatcctttaaggttaaagacgtacgacttattgtgataatgataattaacttataagactgtgtctaatcttcaattaatgttaattaactaaaaccattttttaaaactgtccgccatggcttagcgttttctagagcagagagaaagaagaatctcaattctcttcgttactaatg

SEQ ID NO: 30193 - DNA, 3000 bp, Unknown; identical to SEQ ID NO: 12950
  misc_feature (1)..( 3000): 2750-1469P.txt file - cDNA_ID_3027233; gDNA_ID_2214583; Annot_ID_186563

SEQ ID NO: 30194 - DNA, 3000 bp, Unknown; identical to SEQ ID NO: 12949
  misc_feature (1)..( 3000): 2750-1469P.txt file - cDNA_ID_3027237; gDNA_ID_2214583; Annot_ID_186560

SEQ ID NO: 30195 - DNA, 3000 bp, Unknown
  misc_feature (1)..( 3000): 2750-1469P.txt file - cDNA_ID_3027247; gDNA_ID_2214583; Annot_ID_186555
gtttatggattctactgtcgcctccattccaaaatacatttcggctatcacaaaaagattttgtacgtagtgagaaatatacaattaattataatattcatatgctaccttcaaattaaagttgaaaaagaagagatgaacccattgtatagattggggatactttaaatctttgaaagaaaaaaatataaattgtgttttgaataataacataagcattaataataagaaaatgtgaattaggttcttatgaggtaagatcgtattaccaggggaaatacggctaggaacagtatatgaaatgtcatctttcatcgccatattaaggttctggttcatcatttccgccgattgcaaccttataccttcaacagaagtttcaaaatgcattgaaaacaccaaaaatatggtacaaatggtgaaaacagttgaacaattcatagtgctagttttaaggtcaaagattaaaattgttgagttgtattgatgaaaaaattagtatagatcaaattgggttactactatgttatataatggattaaaaatactttcttctaattggagttaaattttgatttatctatttttggacaataattttaggtattaaattttttattttattttatttatttgccaaagattgcaagtagtagaattaattgatttgattaagtaaatatgacagctagatacactctttgcatgtaattaaaaattaaaaaattgaaattttaatttattacaagattttgatatcaaccacttttagagaaagagagtaaccaggcaatattaggaaaatataaaattaatcaagaaaaatagacatgaaaaacaaactactccaatctttttgtttagccaataaagagattaattaagctaatatcttactaaaaaagagtttatatattattaattttataacttagaaaatttctaatctattatgcaaaaagttatttctaattaataagattgattctactaattttgataatagatatttgattcaaatataatgaaaaataaaaatgacctctagcaatttttaaatttttggtaacaaaatactaacaattttcttttctggcatagtttaaattaactttagatagtttgaaataatcttaaggatcaaaagataatagttacaatctatgaaaaaattgttcttgcaatgtaacaaagatcacctaaatcaaaaatgccctcgagttgtccatagatgtgtgtaaaattaacttaacaaaactaatcagtgcatgattatattttttttagtcggccaatttatccattagataatgaaagtgtgtacagaaatacatttaacagacccaagagactataactccaattggtaacattacataatagcataataatataaattgccaaataaaaatttgtaaaatgaaaaattgtagaataaaattatttttaaaatatgttgattgcataaattttgtagaataatactgcttttgttgagcctctcttgctaatgtatttgccattacatttggttctctacgactatatatattatagtaacggttcttggccaaagctaagatattatttaggcagtcctgaatttcccaatttcccggtgtaggatgatgacatgatgtgcgcatataccaactacttttaacaaaaataaaattacactaggtgaatactcacactacgtataggttgttattttaaaaattatttaaaaataattatgtttaactattttgattgctaatttatgttttttccgtatatgttattatgtagttaataaagttatatttattttatgtaattatatttgtagagttagattcacttttgattcacatatcaattatattttttatgtataaatctttttatctctatacccaaaattctaatctttttttaactatcatgaattacttacatcaacaatatatgatacaatggtatgcaattatgttacttatttagtttgaaagttgtctaatttgattctaagcaaacaatttattgtttcatgtattctctcttaatctaatatcccaatcacatcatgataaactcatggctaagtattagattgacataaaataaataacatatgtataactaactactcatttgcattaaaagttttcacgtgaaagaaaaaaaagaaagcaaaaattaaacagtcttttaagttaatacttttaggtttctctctttacatttgcatttagctatattggagagaatgtcgtatattaaattttttggtatatctaacgtctcaaaagaccattactttaaaaaacatgcatgttattattaatgttactaatttatcataaagtacaaaaagaccatgataatatcatgtagaccaaaaaatgtaataataagaaaaattaagttaaaattactaaattaaaaaaggttaagtaccaggtaagttgcaatacccaaaagtttctaaccattatcaaatactgactattaaaaaaaatagcaaaataagaaaagtaaaatgaaaatagtatttgatatattaacataattttttatatttttttcttttaagtgaagatattttgttaaaaataagattaatgaatgattcaatgcaatgttaaacttttaaattttatcaccaagttttattatttttctaataatattaatttaggataacatgtgacactcattagtgtgatgatgtgtcactcatatgaagaaagttagccaactttcatatatatgattaccaaataaataattttgacatatagtatatcgattaccaaaccatataactgataaacagatgataaaaatacaatataatcaaagtgtttcataatcatatagtaacgcaccaatcattaaaaaaaaaaaaaagttaaacaccaagcataaaaaaaagtcgcgacgttctcattctttctcgaatcataccacagagagagagagaacaaaaagaagcaatcgtcgaaagtcatg

SEQ ID NO: 30196 - DNA, 3000 bp, Unknown; identical to SEQ ID NO: 12972
  misc_feature (1)..( 3000): 2750-1469P.txt file - cDNA_ID_3027260; gDNA_ID_2214584; Annot_ID_135327

SEQ ID NO: 30197 - DNA, 3000 bp, Unknown; identical to SEQ ID NO: 12968
  misc_feature (1)..( 3000): 2750-1469P.txt file - cDNA_ID_3027260; gDNA_ID_2214584; Annot_ID_186604

SEQ ID NO: 30198 - DNA, 3000 bp, Unknown; identical to SEQ ID NO: 12970
  misc_feature (1)..( 3000): 2750-1469P.txt file - cDNA_ID_3027268; gDNA_ID_2214584; Annot_ID_186599

SEQ ID NO: 30199 - DNA, 3000 bp, Unknown; identical to SEQ ID NO: 12966
  misc_feature (1)..( 3000): 2750-1469P.txt file - cDNA_ID_3027284; gDNA_ID_2214584; Annot_ID_186588

SEQ ID NO: 30200 - DNA, 3000 bp, Unknown; identical to SEQ ID NO: 12975
  misc_feature (1)..( 3000): 2750-1469P.txt file - cDNA_ID_3027292; gDNA_ID_2214585; Annot_ID_186627

SEQ ID NO: 30201 - DNA, 3003 bp, Unknown
  misc_feature (1)..( 3003): 2750-1469P.txt file - cDNA_ID_3027355; gDNA_ID_2214586; Annot_ID_186650
cttgtgcctgaagcggtgaaacactaggtccctaaaaagggggatcacaagtaggacgagagaggtctcttgcggcccaataattggattttacagtatatttactagatttagtataataccagctgtcggcatcactcttgtaagtacgactcggcctaatccctaaaatgaaagtgatatcagaagaatcaaccaaggcttgaaggcgtgaattaggtcattaacataaaggtgtgaattccttatgttaagaatactttttgctggccttgcagggacagaaggaatccaaggatcttgccatacacgggttcgccttctagagcctattgttcgtcgtagacccgagagaagaagtggtttagctgccataatacttctccatccaaaagaggggcagttagtctttcctatatgtataggatcactatacctaaagtatcttcccttcaacacccgactaaggagacgattttgaaacctaattagacgccataattgctttgctaataaggcaagattaaattcttccgatgttctgaactctaggccaccatcagaaaagagtgtgcaaagcttatcccaagctatccaatgaatattgttgctttcttcccttgtcttccaccaaaaaattgcaattgcactactaagttttgagcgaatacctttgggaagaagaaagcatgacataacatatgtcggaagggcttgtgccacggaattaataagaacctctttgcctcctttagacaagaattttgatgtccacccatttattcttttttgaaatctatcccccacaaaggaaaaaacttggtttttcgaaccatgaatttgttccgggagtcctaaataggatcccatacccccattcttaaatattcgaaaagatagtttaatggtattccgaatagagctattcacctcatggacaataaaaaattaaagacttgttagtattcagttgttgtcctgaagcctcaccatatgttcggagaatatcgataatctcttttccttgtactgggcctgctttacagaataaaagactatcatcggcaaaaaggagatgagaagtggagggactagctcgtgagatctgaattccttggattaggccatgccactcagcatctttcaactttgctacaagagcttccatacacagcatacacaataacggggaaataggatcgccttggtgaatccctctcgaaggtttaataaaacctttagggatccatttaacagaattttgtaagataccgacgatatacagaagattatccaatctacccatttctgagcgaagcccatcttcaacattaaagcttgtaggaatgaccattccacgcggtcataggctttactcatatcagttttaatggccatgtacttcttcctacaagctgtattcgtgcaaaaagcatgaaaattctcttgagcgacaaggatgttgtcagtgatcaaacgctcagccacaaaggcggattgagtctctgatataaggtccgaaagaagacgttttagtcgggagcttaagaccttcgaaattactttgtaacttagattacaaagactgataggtcaaaattctgacatttttctaggtctttctatttttgggatcaagcaaatattggtctcattcagccgtttatcaaaaaagccggtggaatggaagttttgaacaagtctgataaggccaggccctgtcaggtcccaatattgctgataatagaaggttgtcatctcgtctggaccgggagctttatcaaggtttagtgaaaaagaggacgtttaacttcttctataaagttcgctttgtgagtgttttgttcatgtctttggtcactaacacgggaacttaccagagaactgagtaaaaaactcgaggatttgacgtagaaaaaagagtcttgaagtaatcctctgctaagtgttcgatccgcaactcattatccacccataggccatcttggttaagtaagcctagaattttatttctagcccttctttgtttcgtagaagcatgaaaatattttgtgtttttgtccccaagtaggagccatatctccctacttttaagcttccaaaaaacctcctcgtctatgtaagcctggcagagctttcattttagggcaagtaagtcttcagtagaaaaattctcatcttcgtatggtagatcaagctgagaatgtagttcaagaatgagcttctcggaatttgttcaattggatttttccaaatagaaatagtttgtctacaattcctaatcttttggaatattggaaagccctctccacgagaggagaaagcccatccttctttaacaaaatctttgaatcctggtttatctatccaatgtttatcaaagataaagtgtttataaggacgctgagatttattctaaatggatgctagaaggggtctataatcggaacccctcaattgtaggtactctggtgtacgtttacaagaaaacaggtaaaagacgactacaatcagcgacaaccaacgtagtcgtatatttaaacgacattttggcgacggatttacgactacagtgcgacaactcgaatatttgtagttacatagttgtttacttacgactaacatagatagtcggaacatagtcgacaagtaacgactatttgacgattatattatttaagggagaaggttgtcgttacgtagtcgctatttgacgactatcataccgtctatctaatttagtcgctaattggacgactaatggacgactactttacttagtcatcctgtagtcgtagaaacgtcgcataggagtcatataaagtaggtgaaaacgtgtttcgcattggtaagtaggtacacctaattatttagtggtagtcgtaaattagtcacaaaaattggcctatataataaactttcacgaaactcttctttcaccaacaaatcaaaacaacaacaacatcaaagaaaaaaaaaatttagttagtttattgtataatg

SEQ ID NO: 30202 - DNA, 3000 bp, Unknown; identical to SEQ ID NO: 12989
  misc_feature (1)..( 3000): 2750-1469P.txt file - cDNA_ID_3027442; gDNA_ID_2214587; Annot_ID_186670

SEQ ID NO: 30203 - DNA, 3003 bp, Unknown
  misc_feature (1)..( 3003): 2750-1469P.txt file - cDNA_ID_3027463; gDNA_ID_2214587; Annot_ID_186664
agttctatcagcatttttggtcgaaaataaaaggctccattattcaagaggtaaacaacgtttttagagaaaacaagctatacgagaatcgtaaccacactaatctctgtctcatccccaaagtggaagccttgtcaccaatgggtgatttcagaccaatagctttgtgtaatgtaagctataagataatctctaagattctgggtaatcaactaaagaaacatcttagaggagtgataatagataatcaagcggcttttgttctggggcgaatgataaccgataacatcattatggctcatgaagtttattatgctctgaaagcaagaaagggtcgagcgtcctcaaacatggcaataaagaccgatattactaaagcctatgatcggttggattgggattttttggaggaaactatgaggcgaatgggatttgatgacaaatggatatcttggatcatgacctgcgtgacattagtgagacactcggttttgattaatggagcctcacaagggcactataaaccggaacgaggtatacgttaaggagacatactctcaccatacctttcattctgtgtgcaaaagtcttatcgcatctgaagaaacaagcagaagctacgaagcaactacaagggataaaaatctgcaacagaagtccttctttatctcaccttttatttgtagatgattcgttattcttcactcttgcaaattatcgatctggcatggcaatacagaatatcctaagtaatatgaggaggtttcaagacaggctgttaatttaagaaaatcagctataacctttggtcgacttgtgaagtcaaatacaaagagacaaatccgtcatttactaggaatcaacaatgaaggaggtggatgtaaatatttggggcttcctgaacagtttgatgaaaagaaatcagaactttttcaatacatcgtggaaaaggtgaaggaaaagactcaggaatggagcaaaatgtttttatcccatggaggaaaggaagttcttctcaacgcagttgctcttgcgattcccgtctactcaatgaatgtttttaagttaacaaaggagatttgtgaaaagataaatggcatataagcgaagttttactggagctcaggcaatgacaaaaaaggtatgcattggttctcctggaatcgtctaagcttgccgaagagagaaggaggtttgggattcaaggatctaaagaattttaacttggccttgttaggaaaacaagcatggaggatcttagaacagcctcattgcctgatgtcaagaatgctaaaaggaagatacttcccagacactaatatcatggatgctaatcaaggtcagaaggattcttttatttggaaatcaattttgcagggcatggacctactaaagaagggatttcgctattgtgttggtaatgggactctagttaatgcgtggttggatccatgctgcccattcacccgccgagaccgccacaaaaaaactagggatgccctagatcagcatatggttagtgagctcttaaactcaacacgcacatattgggatttcatcaaactcgctacttagataatacttgatgatgtggagaatgtcaaaaatattaaagtttgtgcattatacaaagactgacattatacaaagactggcatttagactatgaaatctgcatatgttatacaaacatatgttttgaaggagataatcatgagttggaatcaattatcaacagaagaagtccacacttttgagtttcaattttggatatgagagattcgagcttagaaacaaatatttctaggaagcaaatttttatgaataggaagaaaacacaacaaaccagcggatattctcgtaaagcagcaatgacctcaaggaacaaaatttatctttcataatcatattctttatgtaattcataatgctatgtgtttgtatcatacgttatttcaatattaataagaagctacaattcaaaaaaaaattaaaaccaaaatctacaccaaactttttttttttttttttttttttgtcgtcctacaccaaactttttaaaaccgaaaatacgaacttaaaaaaccaattatagtatactttttttttgttccgttttaatttttgttttatttcgataaatatctctggcgtagattagcgagagaggtttagctgtcgttttacattctctcaaagctctctcttttatagctttccaataacaaatcccaaatctgattctttcagctaaaaatcttacatcaatcaatcgaattgtcaaaaaaagatatcacaacccttcttctgaattctcatttcttaagcttatacacttgaaatctccaaaaaggtaccatttttatgactttgttatctccgttttgtgttcgttgtttgcgattctcaattgggttaaaagggtttagtcgttaaacatttccatcttcgtttttggacttgatgtgaatttaaagttgggaccttttatgttttgatccaaagaaaagaatctgcttaattgttgttttagtgtcagatttgtttcttctttgatgcaggggaaaaagaaaatgagttaggtgaagtttcagaaccatagagacgacgatttgatcgttgcgtaaaccaaatgatataaagcaaaagatgcaatcgagaatcgtcggattagctccggcgttttctctcttccctaacctaaacacacctcacaaaaccttcactttccatcaaatcttagttctcatcatcacattcacagcctacgcttcctttcacgcttctcgtaaaccaccaagtatcgtcaaaagcgtccttggtccaccttctcttaattcatcttcaattgataatggctgggctccgtttaacggaacccaaggaaccaagagacttggtgagcttgatttggcttttctttcttcttatgctttgggtatgtattttgctggacatttaggagataggattgatttgagatactttcttgtgtttggaatg

SEQ ID NO: 30204 - DNA, 3003 bp, Unknown
  misc_feature (1)..( 3003): 2750-1469P.txt file - cDNA_ID_3027516; gDNA_ID_2214588; Annot_ID_186699
ggttgggccatagcccatagctaaatctctttcctaggttctttgctcttttcagctaccaattctcttctcgcttgttaggcctggccaaataaaccaaactgaatatatcaaacccaaaccaaagtaaaataatcgaactgaaaaatttaaaataactgaatgaatactaaattctataattgaaagaactaaagtcgaatcggtactataccgaaatatttggataaccgaaaatatccgaaatatattagttatttctatattaaataattaaaaatatgtgaaatatatatataatagtaaaaataatcgaaaataaccgaaaaatatctgaaatatctaaaaataactgaaatgtacgaaaattttgaaagcaaaataaccgaatggatacgaaattttaaaaccgaaagaacaggatccgaaccgaaacctaaccaaaatttcaaaataatcgaatggatactaaactttataaccaaaatatctgataaccgaatggatacaaaccgaaaccgaatagataaaaatctgaaccgaattgataatcgaatggatacgaattgataaccgaatggatataaaccggaactatcatttggtatgttttttgtttttgttctctcaattgttaaatcacactacctagcattaaatatatacttttgagacacgtttgatcatttttgactagttagtcacacattgatataattggtttcttaattcatcatagaaagtaatctgtacgtatatgattggttcattcgcaatccattttatttggttatcggatgggtcatcaatggagattaacaaggttttgaaatttaattaactagacttggaaattgaattatttatttcccccggataagacacaaatttgacaaatatggataaagcacgttttgataatgtgtattcgagctgtttaatttgaaccacgatgtacatatgattcatcagtcaatacataatatttatactactaatacacaaattgtgtgcaatatcgtattaataacaataaaaatggaatatatatatacttaggttattgaccaatattgacgacaaaaatttcaaatgaatgtatatatattcgtcattagtggacgaggaaggcaacttcgcaggaaatgatattgcgagcttacatacaaaaaatataaaggccacatggttttcacgtagctatcacacttaaacgtgattacgtgacgtaccttgtttaactaacgtaaccttcatggtcttgcttttttttgttcataattattatcttcatggtcttaccacgttctttgaacgtttcttaactcttgacttctaatcagtagacaaattattacacattagacacatcatatatagacaataggcacattattattgtatgtagtgatcaaaagttcatggtaaatcttttgaattagtcaataactgtagcctaaacattaaaaacaaagattcaaagctacatatttccgactgacttttaacattgtacggatcggaccgtcaagttgatttaaactatgattagtgatgatttatggaaaccctctctaacgtacatgtggagatattgtgtcagctgttatgtcattgtttatagctttccaagttgcaaaggagaccatcattttggacttttttctttctttcttgtaacatctgttaagtatcactagctagacacttgctattaggtccacaacctcgttagtggacggaccagaccataattaagaaattagacacgagtgaccgtagtataaaagattaaaagtgagtttagaaatgtacctgactagtacaatttccagatttcatcgtgacataaaaggtgcatctaaattataaatgatggataataattgtcttaagcatgcaccgttaattttccgtgatcaacgtaaaaaagtagcaatcgagtaataatatagtaatgcaaaagacaaaatgattatcgcaaataattaaccaacccattaagcttataatgcatgcgtattatatcaatcaaatcaaagcattaatatggtccacaagagtagaagacttgtaccgcgcatccgcatgatgttgttaagttgaaaattgcttacaaaagtcctgtttttttcaacctagaatccatttcccacaaaagttagcacttttatcactgttattttccttttaaatactagcgaccctcgatataatctaaagaacgttaggtatttgtaaaatacaattttggagtttatggcatatttttctttcttacctccgctttattattttgtcttgttcatattttagcgagtctaagattttgaatggatgcagcggacaaaacggtttaatttgtctgctattcagtctacttcatttttgggcggacaataaatcgatgcggatcaaatttatttatatgtaaaaacggtccgtagatggtccgttgcggttttcttctattattttttatccagaccactgcgtactataattaatgaatggtaaataaaaaaaggtttgatccattgacgattttgtccgccttaaccatcataaccatccaaaccctaattctaaaatttcaacgtggcagaaaagaaggtaattgaataacaaggtgatatactcttgaaataaacatgaatctacaagctatacttaatagttgcatgtgatgcgcacgagtaccatcttgttgaaatagtggtagtacaatttaagagaaatccaaatactaattaaaaaagccatcatgattaaaataattaggcttgaaatcgtacgtagtcaaaaggtttgtccattaattaagaaattaataaaaatggaccatcatttccacgtatctacaaatctctcttacccccatatgcacatgtctgcgaaccccatcatttaaagccccaacgtagcaacctcaccgccttcaatcatcaaacatccaaactctatcctttcgttttcttgtcagacaaaaactaatactagatg

SEQ ID NO: 30205 - DNA, 2408 bp, Unknown; identical to SEQ ID NO: 13001
  misc_feature (1)..( 2408): 2750-1469P.txt file - cDNA_ID_3027530; gDNA_ID_2214588; Annot_ID_186703

SEQ ID NO: 30206 - DNA, 3000 bp, Unknown
  misc_feature (1)..( 3000): 2750-1469P.txt file - cDNA_ID_3027532; gDNA_ID_2214588; Annot_ID_186700
aggaatatggtagcacaacagaggaagtatgtacgtgtaagttattttagaactggttggcgaatcaagcaaggcaagtggattcacctaaaagttgttctagtcagtgttgtttgaataccatattttgcttgtcgcctacacgtttgtaagatggaaaacgctctttgtaaatacatagccaccagtcatagaacccaaggacccattttctctgctgttaccttaatgaaaaaggtgagattcatatatatggaaaaatctcttctgtaaaatggtacttagtgtcctgaaactgaatatgcataaagcaaccggttgggttgggtcttcactgacatgattgttgtaggttccatcagagttagaaactcacaaagataatgtcacagcctccattcaaactagttcgtgaaggagtgttgagttgtagccaaacagaagaaaaaattgatattgggacaaatgatcgatcattagtgacattagatacaaaacttgacagcccttctttttggaagttgtagccacaattacttaaccctaatgcttttttttttttttgtcaaacacttaaccctaatgctaagcggctatataaatagaagatctttattctgatattatctctacaacttttttatcttgaaaaaaaaaatgaaaggaataacaaaaaaacttttggtctcccgctctctcaaacgtctgacggccaagaaaaaccggaggaagattcatcgagagacgaacaagcgtctcaaaccggaggaagatccatcgatggtgaagaggcgtcaagactctgattcagattcgctggagaaggaggtttcagttgttgtaaccaagacgagtgatgatgagatggtgtcaacagataccaaaaagaattattttcaaagaatatggagtgatgatgatgagattgttttgctgcaaggcatggttgattttgagaatgataaagggaagagtccttatgatgatatgactggttttattgatacggtgaagaacttcattagctttcaagcgaatcaacatcaattcacaaccaaaatccgtcgcttgaaggacaagttcctcaagaaatggaacaatggtgtagatgagaactctcttgtaaatgctcacgaccggaaatgttttcaactttccaaagtaatttgggaacctacaactaaggtggaggaggtaggagattggtttgtaaattcttatcttgtaggatcaattgcgaggttaggggtgagtgaagacgtaatgaaacagagttggagcatggttccgatagagacgaagaaggaggtcgaagagaagttcaagctgttgaaagatgaagaatctgaaaacctacggctaaagacaagttttttgcaaaaggtcaactctatgatcattgaagcaacaaattagacaagtatcgaattagaggtttaatgcatctttttcatttccatcccatatgagtctgttttttctatttggtttgttattggtttttgatacttggattgtgttgttaaaaacactatggaagaacggcagattaaattttaatgcatccaattgtggtcaaggtttatggtctaaattttggtcagaatactcttgttagatacctctcactttgcttagggtcaacaagcatcaatgtttctgagatcacagattttgtaatcaaacagaagcaacagattttgtctatcttgcaagcaaacagaagatcacatgcatattttgtcttcaacatgaacaatttcccggaaacgtgtagaagcaacaagactcttctgctccttcctcaatgacgatgtttctctctggaaatcactggttttctcaagaccagacaatagaacatcgtatgtcccaagcgaaggcattatctctcgctctctcatctctcctaatatcttcattgctttctctggactccctgctgagatataaacatccatcagcgcagtgtaagcagatagacccttttgatcatccggaagtaagtctaaagcctctgcagctaagctaggtcttctcccaaacccgagcatgtggatcagcattgctccatggtacacaccaagcgagtgttgggatttcaccatctccttgaccacatcaatcactttagagagctcgtttgatctcagaaagttaccagctaacgcaagatacgctgacttctcaagatgaattcccatttccaagctccaatcaagagccaacgaagccaagtaaataaccaagatactgtgccaactattagtagtcattaagagacaaaatcagtactagatactgtgccaactattgtcaaacccaaaagtgtttggacggtttcctattatatctctatgcttttactaagacaacctagcaaatattctgaaagtgtaactgcacgactgatagttgcatcaatagtgtgacaagaagccataaatgtttgatcagaggtgtaccatacgggtacctgcatagttggagtaaacaattgaaagatgaatttagccaagcaggaataacaaacagtttaaaattttgtaatcgatccagggagtgtatttactcaaagaacagatcaaggactcttctaatagctcctgagctagctagttcttttcctattgcttcacttcgagttttcagtaagacatgaatgaactccacaatctaagacaagccatcagcaacacaaacgaaatcagaaatatattacacaacagaaaacacacacaagacacaagagtatatgttttgagttagaactccgtacttgttacatgtttgagtgttatgttttatgttgaatttaactaaaatgcagacgttagtatggaatgggcttcacaaataaaagcccaatagtatgtttttttggtagggagcccaatagtatgttggttcacccaaatatcatttctttctctgagagctgtttattatattcacacaaagaagaccaacaagaaacagagttgaatcagttctacaatg

SEQ ID NO: 30207 - DNA, 3000 bp, Unknown; identical to SEQ ID NO: 12999
  misc_feature (1)..( 3000): 2750-1469P.txt file - cDNA_ID_3027536; gDNA_ID_2214588; Annot_ID_186697

SEQ ID NO: 30208 - DNA, 3003 bp, Unknown
  misc_feature (1)..( 3003): 2750-1469P.txt file - cDNA_ID_3027548; gDNA_ID_2214588; Annot_ID_186691
ttgaaggttagaaacaacaaaggccatttctgagcattagtttttaaatttgaagttacctggtatgatataagagcataaaagatgataataatatatatcatcatcttagtatatagtatctacaccatgctttcggttctagtagagaaatgaacgcacaaaccttatcagcaaaaggttcacggatgtatggaaggtctctttcaagatactcaaacatcaaacgaccttgagagcctaaaggttcgccatcatcactggaagagtcttcctgatgttgatccctcaatgagatacagtctactctagcagaaacccgctcggaatcactatcgctgctaacatcgctacttgaatcccgaaaatcactgtcgctactatcaccaggacgcctgccataggaaccgtacatgacataatgaaaaacagcttgttatactataatgctgctatgatgagttcacaaagaattaagaaccttgatttaagagatgaatccaaggcatgagaatgagcatagatttgaatggctgacaaagaagggacatagtattggataacacgatccttgttgttattcaaaacaagaggcacaccggtgccgtaagcactccactctgcaaatgagtcccatatatcaccaagcacaaaataaggcacaagtttattataatcatcatctgctcttctttctcgtagcaatgtctacacagagattatcaccatcaccatcagagaacaacacagacttagattaaaaaaaaaaaaacataaaatagagattgtaataaaccttggataaaaactgagccggtacggatggtgtgaccgactctaaaaaccgatctagattactggaagataaatcggacggctcgagttgttgtttatgcggagaaggagctgatgatggaacgttagagacgtcgctctgagctctacggagctgatcgatgcgctgattggccctgcgagtttttgcggaagtgtagaaaggatcgtcgccgtgtctgcctctcgtcaactgaaatccagcacccaacatctccgagtagtcgtagttgagtttttacctatatatctatatatctatctaagcttaatttagttgatttagcgtgaatatgtgtttgtctccgatgagacggcgaagaagcttggtcgaatcggagattccaaagaaaggggtaaaaatggatcgaatgaaggagaattgatagaacaaaaaccttctgatgatatctaagctccgattaaacaggcaaaagattagtggaagaggaaaatctgaagaagagattcgctgaaatggagagagatttggtaatttcaaaaaaaggggtcaatgaagagagaaagacgattggttagtaattggagggggagagacaaaaaccattgaataacacatgaatccctcataagttagtgtttttacattttggtccttttcattttgatgattgattacagttttacccgaaacttctttgtaattcagttatacgcttacttataaacaagttaatcatacggtaatgcaaggtattttagactgctcagatgcataatgtagatggtgcataggaatgatttggggttatgaatgtaacattttaaaatctgatgagaaatatgtgactatgggaaatataaaggggttaaacattggcaaaagccaaaggccatatgtatattaggaggctctttaatttaatggttgatactcgatgcttgcttgctagatgctgacaagattataaagaaataaaaaagaaaggctgtaaaacatttggtctttctttttttgttcatagataagcttcacaatgttcaagagtaatcaaaaactatactaccattgaagattcgactaatgcatgtacaccaactacattcatcattcattgacaatgacataaacgtatcagaacatatatattcatgtatttagtaacacttatatgagattataaggagttttttgataagtgaaatgaatgaattttcacatattattgagcacctgactctgcattctgcaataggcggctagtttttatcagccacataagtagtcttttattatttgaagatatgcacatgaccaacacattatagtgttctttttgcctggcttcgataggtccacaaataatgggtttgatagaaaacaattcttgcataatgtgggggattcgcctagctagacatgaagcatttttttggagtatataaatggggattttagcaatactatgattagtatttggattatgtaatctgtgatacttaaacacattgcctgcatataaatccatatattatttaaaatatatcatttttgatttttgacagaaatcatagagattacggaaacagataaaagcacactccagaaaattagagacaaatattactattcaaaaagattcagatcgctactaagtgagggtcgccaaatcgcgagtcgaaacaccgattttgagtccgcgaaattcggaaatttgcgtggttgccacaataccgaagtactggaatcctcatcgtgaatggaatctctatatgtaatgtttcagtgtagtaaaattcaggtcttagcatttgctttctagatttgtatgtctaaaataagtgttaagcttgaatgtttgataacagtatcgaccataaatctcccatctaagccgataatgtgttttgatcatcattgtgaattttaaatcagtgaaccataagatagcccaattgggcccaaataatgttgtctgaataaagcccattatcaacagtaacggagttcaaagagtgggtaagagatgtgcgacgtcgttcaggagcttctatatcacaaatcttccttcattttctcagtggaagaggagggaagctttcttctgtagatcttcgcttcctctctctatctatctctgttgagaagaagaatcgaaactttgaaatctgtgagaggaggggttcatagttcgattggatttgatg

SEQ ID NO: 30209 - DNA, 3000 bp, Unknown; identical to SEQ ID NO: 26368
  misc_feature (1)..( 3000): 2750-1469P.txt file - cDNA_ID_3027552; gDNA_ID_2214588; Annot_ID_186690

SEQ ID NO: 30210 - DNA, 3003 bp, Unknown; identical to SEQ ID NO: 26052
  misc_feature (1)..( 3003): 2750-1469P.txt file - cDNA_ID_3027558; gDNA_ID_2214588; Annot_ID_186687

SEQ ID NO: 30211 - DNA, 3003 bp, Unknown
  misc_feature (1)..( 3003): 2750-1469P.txt file - cDNA_ID_3027564; gDNA_ID_2214588; Annot_ID_186683
aatgcttgcatgagcgccgtctggagctttgacgcgagtcttacccacgaccctttctttgactctccaacagaggtcgaatccaatgcaaaccactagcttcttcatgtctgtggcaatttctttggttgaaaccattaatgtcatcttatgttattcaatttgtaaatattatgatttatgaaggtgttaggcagagggtgaatattaagaacaccttcaatggggatttctaaacaaataataaaaaaattatatgatttaaatcttacatgaatctcttaaatttgatgaaacctaagccaattgtttcttaactaaaagataattagtcttggtttcaccaaatttaagagacccataattaaaaatattatttatctatatttacattttaattttgtttaagaagggtttttaggtaattcttattgcatatgaaagtagaataggaagatagagaataaaaaaaaactcttatctaaaatttatataagagtctaatgagacacatgtctcttttatattggtttatttttttttctaaaaattaaaatttaattatttagtaaattatattaaaataataatatataggtatttagaagaaaaaattaagagtcctccattgaggatgcatccctaatggtagtttctaaacaaaactcttaatatataataaaaaatgtatattatttaaatattagatgggtttcttaaatttgaaaaaacttaattcaattgttttttagttaaaaaacaattgggctaagtttctttaaatttaaaaaatccttcattaaaaattattatttatctatacttatactttaatttattttaaaaaacctatgttaagaaactcccattagaaatattagaaatggtcttaactcttaagcttagaaaactccattgaaaatgttctaaggacttaatttaaaagccatgaaaggtataattccttttgtaactaataaatatagttaaataataccagtagtagtagtacgtgaagagccgtcggatgcaatctgaatcgcaaaataaggaggaatctacggacaggatcacagtggaaagatgatacagagtagagagatttcttcttcttctttggcagattccagcgaggaaccaattagtaggcctgctgtcaaataatgtgacccacaacttctttgattccttaattacaacttttgattagtaacgcttataatgtctcaccttttactaatcaaagtaattacgaatcagctttccataatcatatcatcgtccaattttattcattactttgctttaggaaactctattcatcttattcctttctaaattgttgattaaagtgatttgaaaaggtaataatctcgtgcatttgttgctaatgtgccaaaatatatttgttttggggttattcaccattttcatgtgaccttgttgtatgttataacttataaccgttgggttttttttataactctttttggtaatattatatatttatatatattaatatacagtagtagtagaaaactaaattatcatcagtttgttgcttttctttaacaaaataaccaattaactaattaaattatattaacattgtttgactgtttgtagtgggtatactagtttactaaataaaatatttttgtcaccagccgtactacaatagcctaatgatacgttaaatttaatcatatttgcgatcattatattgtgagtttttacattctaactaataacaaaaaaatactacctttgtattaaaaggtaggatgttttagctaaaatgcatacacttgaaaaaaataaattgtttttgaaaagaagtattaaataatttaattcaaaaaaattcagccaatgatataaaggctgcataatacaaatggtcataaaatatcaaaatatttaaaatttgcataaaaattggtaaaaagtatatattattttaaaatttttctaaaacatcttataatttgatataagggaagtagtgtttatggaaaatcccgacatatatgtaaccacatttatggaatctccgtctctcaatttccagttagctcacatacacaaattgtatttactcgttgacaaacggtttatatagttgataatgcattagatgtatccataagaaagtcgacaaaataacattgaggcgatcattatagtgtgagtttttatttcctaactaataacaaaaattttaagatagtgataaatcttactctctttgtattaaaatatttttttaaaaaataattatttaatatttaattcaagaaaatttgtcaatgatataaaagattgcataataaaaatgatcataaaatatcaaatgtatttaaaaatttgtaaaacatgatatatattttaaaaaaaaatcctaaaacatcgtatattttgatataaaggaagtaatgtctatgaaaaatcccgacacgtatgtaacaacatttttgagaactcggtctctcgattcgcagttaactcgcatacacaatttatacttactgcttgacggatggtttatatagttgatcatacatacatccatttgaaagagcatgttggtcttaattgcatcaaacattcttatcaacacaaaatgatatacatggcatcagataaaccatcacgaacaaatacaattttgaaaggtaatacacacaaattcactaacactattaaggtaatacacacaaacattcttatcaatttcatgattttctattaaaatgtcattataaaaaaaaaaaaactgaaagaaattggactgaaagagaaataaatttaaccataattgtttggtaaaaatagtaaaatatgccaaaaatgagatttaagaggaaaataaaaagaagaaaaaaaaaacagctgtagtctacatttacatacaagtcgtggactaacagctatactactactaagtactaactctttctctctctaaatatcaaattcaatttaatttttcttctgcaaatg

SEQ ID NO: 30212 - DNA, 3000 bp, Unknown
  misc_feature (1)..( 3000): 2750-1469P.txt file - cDNA_ID_3027568; gDNA_ID_2214588; Annot_ID_186680
ttattcttctatcaaaccgtcaagttgggaaacaaaacaaaactcgcaagtttaacaacgcgtcttctacctcctcctcatcggactatttatctatagtcttcgttagatcaattcctctgttttactcctaagtttcgagatccacatttctctttaacctcatctcatctcttagtcgagatcttcactttctgatgacaatagggtcgtttttctcttctctcttattctggcgcaattctcaggtaacctcaatcgactattctctgttctactcccttttttctttatcattttaaaaatcctaacattgaaaataaagtagttaaatagagtcaacgaaaacattgttaatgaaacagtggtgtgcttagcataacgaatcagacagacaaaaagtgtctggatccgtagagcaaagtgttgtcgtgtctttgacaaagttctttgtttgcctaaaccaatttgttcatccgatagaatgaattgcattccgttgttactatcatccaaaccggagatgtcaagccctaaccctcaagtagtatttcttagagagccattctttgtttgtttagatccaattagaagaaggtttagttgactgtgatgattgtttgtgtttttggtggcaggaccaggaggcgcagagagggaggatgcaggagatagatcttagtgttcacactataaagtcccatggaggaagagtcgcttctaaacacaagcacgattggatcatactcgtcatcttgattgccatcgagataggcttgaacctcatctctcctttctaccgctacgtgggaaaagacatgatgactgacctcaagtaccctttcaaggacaacaccgtacctatctggtctgtccctgtgtacgctgtgcttcttcccatcatagtgttcgtctgcttctacctgaagaggacatgtgtgtacgatctgcaccacagcatcctcgggctgctcttcgccgtcttgataactggtgtcatcactgactccatcaaggtagccaccggacgccctcgtcctaacttctactggcgctgcttccccgacggcaaagagctgtatgatgcgttgggaggtgtggtatgccacggcaaggcagctgaggtcaaggaaggccacaagagcttcccgagcggacacacttcctggtcctttgcggggcttacattcctttccctttacctctctggcaaaatcaaggccttcaacaatgaaggacatgtggcgaaactctgcctcgtgatcttccctctgcttgccgcttgtcttgtggggatatctcgtgtggatgactactggcaccactggcaagatgtcttcgcaggagctctcattggcacccttgtagccgccttctgctaccgtcagttctaccccaacccttaccacgaagaaggatggggtccctacgcctatttcaaggcagctcaagaacgaggagtccctgtgacctcctcccaaaacggagatgccttgagggctatgtctctgcagatggattcaacatctctcgaaaacatggaatctggcacttccaccgctcccagatgatcctcctctcttattatttgattcattatttggtttttcattttgatttggccgtcgtcgtgagattgtgaatggtgtagctacatactgtatgtgtattcaaaactctacttgtaccattacatttttgtaaatccactcttcatgaaattgacgtttttctggtgtccgagaggcttgggtcgctcgaataatctcgtccaatagactaatacggctctagtgaacacggtatttacatgtttgtgatctaaactgaaatcagttatttcttaattcgtaatcattcttgggttaacattttctcttataatctgatggttgaagatggcaaagccattgttagcatagccatagctggttcaatcatccacaacactaaattactcgagctctccacatgcgtaatctctctttctctctatttctcccttcgtttctctcattcttcttcttcttttaatttctgggtagctattattttagtgtagaacaaagtttgacacttgtgcttacgcacatgcgctgccaactatgctgcaggtattaaatcagttctgaaaatattgaagcacaactggaaaccgtttcttttgtgcactcaagatattaaaatggttctctgtttctgaaaatattggaacagaactgaaaactgtgtttttgtcatgctagcgtattgttatattgtgttttattgagcaaatgatgatactagcaattcaaatttcatctcttctctttgttattatgaatttcatgcttgtattggaagacattattttgcaaaaatttgatttttgtttactcaaggacccattgtttcttaaccattggagtagaaatttgttaaagactcttattagtttcttaacttacaaaaagcaaaattttaataaaaaaaaaaaagttaaggatcatggttaaggacctaaccaatggggatggtcttagcttctgatctcactggtctttgttcgattgaatcaatccaagtttcgtaagtggtgatggtaggtaatcggagcagcagcgcatgtaaccatcggcagttgtcgaaagcttgtatagtcacatacctccctcatcgtctcttctcagtgtcgccaggtaaatcttctcaatcgtttcttttgtatattactcatagagtcgtgcgctgtctctccctgagaaggttcaatcgatttcttccgattgatgattgatgtatcataatcagaacaaaggttatatttctgaattggatgtgtctctgaaattatagcggatgttgtatgtatgggaacacaagagaccaatgatgatgctaatgtttgattgtcatcattgattaagtgaactaatcaagcagaaccatgatttgttttactttgttggtgctagtggtttggggctatctctgtttctaattcgtatatatgttatg

SEQ ID NO: 30213 - DNA, 3000 bp, Unknown; identical to SEQ ID NO: 12994
  misc_feature (1)..( 3000): 2750-1469P.txt file - cDNA_ID_3027572; gDNA_ID_2214588; Annot_ID_186678

SEQ ID NO: 30214 - DNA, 3003 bp, Unknown; identical to SEQ ID NO: 26060
  misc_feature (1)..( 3003): 2750-1469P.txt file - cDNA_ID_3027597; gDNA_ID_2214589; Annot_ID_186738

SEQ ID NO: 30215 - DNA, 3003 bp, Unknown; identical to SEQ ID NO: 26059
  misc_feature (1)..( 3003): 2750-1469P.txt file - cDNA_ID_3027601; gDNA_ID_2214589; Annot_ID_186737

SEQ ID NO: 30216 - DNA, 3000 bp, Unknown; identical to SEQ ID NO: 13019
  misc_feature (1)..( 3000): 2750-1469P.txt file - cDNA_ID_3027620; gDNA_ID_2214589; Annot_ID_186723

SEQ ID NO: 30217 - DNA, 3000 bp, Unknown; identical to SEQ ID NO: 13007
  misc_feature (1)..( 3000): 2750-1469P.txt file - cDNA_ID_3027627; gDNA_ID_2214589; Annot_ID_186717

SEQ ID NO: 30218 - DNA, 3003 bp, Unknown; identical to SEQ ID NO: 26064
  misc_feature (1)..( 3003): 2750-1469P.txt file - cDNA_ID_3027641; gDNA_ID_2214590; Annot_ID_186762

SEQ ID NO: 30219 - DNA, 3003 bp, Unknown
  misc_feature (1)..( 3003): 2750-1469P.txt file - cDNA_ID_3027645; gDNA_ID_2214590; Annot_ID_186761
tcttcaaccttcagagaacaaagatgcaatggaaactcttgtcattacgagattatctacgcggacaaaacctattccaagggaatcttggcaaccgagacggtcacgataccttccacttcaggagagccctttgtgatggctgaaacaaaaattggttgtggcctcgacaacacaaacctccagtactcagggtttgcatcgagttcttccggcattgttggtctaaatatgggacctttgtcgcttatatctcagatggacttaccctacccaggtcttatctcttactgcttttctggtcaaggaactagtaagatcaattttggaacaaatgccattgtggcaggagatggaacggtagcagccgatatgtttatcaagaaagataatcctttctattatctaaacctagacgcggtcagcgttgaggacaacctgattgcgacattggggacaccgtttcatgccgaagacgggaacatttttatagactcaggaaccactctcacgtactttccaatgagctactgcaacctagtgagggaggcagtggaacaggttgtgacagcagttaaagtacctgacatgggcagtgacaacttgctttgctactactcggacaccatagatatctttcccgtgatcacaatgcatttttctggcggtgcggatcttgtcttggataagtataatatgtatctcgaaacgattaccggaggaatcttttgtttggctattgggtgtaatgatccgtcaatgcctgctgtctttgggaacagagcgcagaacaattttttggtgggttatgatccttcttcaaatgtgatttctttcagtcccactaattgttctgctttgtggagttgaagaaacaaaccaagagattctcttttctacattttcatggttttaacttcagttttgtttcgatttatttgtactgtcactaaaagcatatgacatagacatgtttaaatgaaaaaatatgcgaatgagttacacaattaatcgaaattcaaatcacaatctgctataatctcaagttttttctggagtttgcaacttgttctatcaaagtcttttataagttcattttttctcaatgcttcttatagataaacatgaccaaagaaagaaatcactaatattgcaaagcacataattttacctagaaatactaagttatgttttggtttagcctctcacagcttgaacggtagcaatcatgtgagccatcacgagagcgtaacgaacagctgtgtgttgtggagtgtagatgtctccaagtccaaactccccaaagttgagatctatgttcacaaacttacccggcaacgaccttttagccagagcttcattccatatctccaagaactcctccatcaccttttgtgccttttccattgatgatataggaagatactccacctgcaagtaacaacacacaaactcaaaattgagattacaagaaacaagacaatcaccaaaagggaacagctccatataccctttaggtgattagattagcattgagactatagggatttaagaaaacaaggattttttcatcatcattgtgattacacgaaacaagactaaagaaacttgtagatgcatagtcaacaatcaacaatgttcaattttcatcatctgtcttaacatcataaacagcatcaaggatcatcactaaaagatattacaagaaactcttttaacaagaaaaatctgtagaaaaacaagattttcatctttaaaattaatcaccactgttcagtgttcatcatatctgtcttaaacaagaaaaagctggaaactttgtttacctccatgacaatgcctctaacattctcagaatgagtaggaacaactttaccaactctcaacctaaaatcaccaagctgatactgaaacccatcaaagtaaagagccactttagatttataagactgaagcttctccataatcaactgaatcgaagaatcagcttccaagacaatcctctgcgtcctgataatgaaatagtacttattcggctgatccgcaagtgaaatccctagaaaatcacgaggaaactccaattgattcgcttggtcttttaacatgggtttgtaatagttgagtgttgctttccatcttccttctttcacaccattgatgctctctacacattgtgttgcttcgtttaggatttggctgcttactgttgatccttggtttggttgccaatgtaaaaccctagaaaaaaacaaaacccaaatacaagaatcggaagagtaatcagaacagaaacgaaaaaaatcgagattttggaaaacgaaattggatcaaagcttaccacttgacgggcattgttgttgagggagaatgacaaaacaaacactgttcgaaactgacacaacaaaaaataaaaaaaacatatgtatatgttatatcaacaaacccaatcgaaattgaggtatgggccgaaggcccaaaacagcttaataaatgtggcccaacacagcttaattaaatactccatgtctcttgattctattaactgttcttaacctggacttcacgtagacgaggaagaagaaccttgaatccgacatttgtttcttcattttaaggtagggttaagtctattttcggttctgggttttcttctctttcaattctcaaacaataactcgcaattttattttcacggatcttttttatttcaaaatcgaattgaaaaaaatggttcttcacaatctagcatatatgaaatttgggaataaagttacgatttttatatataatatggttttaatttcgttgattctatgttttgctactatgattgttaaagtgtcactctcattttcaacttctcggtgattagtgtgtttgtgttcttcaaagattgtaaatttgaatagcttggttttgttttctctaatagactgagatatgttatgatgtgtagctaaacctcttcactggtgaaagcaatttgatgttatggttccaatg

SEQ ID NO: 30220 - DNA, 479 bp, Unknown; identical to SEQ ID NO: 13022
  misc_feature (1)..( 479): 2750-1469P.txt file - cDNA_ID_3027674; gDNA_ID_2214590; Annot_ID_186751

SEQ ID NO: 30221 - DNA, 3000 bp, Unknown; identical to SEQ ID NO: 13034
  misc_feature (1)..( 3000): 2750-1469P.txt file - cDNA_ID_3027702; gDNA_ID_2214591; Annot_ID_186784

SEQ ID NO: 30222 - DNA, 3000 bp, Unknown; identical to SEQ ID NO: 13041
  misc_feature (1)..( 3000): 2750-1469P.txt file - cDNA_ID_3027777; gDNA_ID_2214592; Annot_ID_186801

SEQ ID NO: 30223 - DNA, 3000 bp, Unknown; identical to SEQ ID NO: 13042
  misc_feature (1)..( 3000): 2750-1469P.txt file - cDNA_ID_3027781; gDNA_ID_2214592; Annot_ID_186800

SEQ ID NO: 30224 - DNA, 3003 bp, Unknown
  misc_feature (1)..( 3003): 2750-1469P.txt file - cDNA_ID_3027788; gDNA_ID_2214592; Annot_ID_186797
tacgaaaaatagagagacaaaatctcaagggtaattttgtctattttctcagcaaaaacaagataaagtgcctaaactttgaaaagtgtctaaaacggaaaaacatttcttaaaagtgcctcatagtgtcacattcccttttaattaactattaattttaagattttacgacattaattttataattttgtaatttttaaaattaatgtcatataatctaaaaattaatagttaattgagatggtaaggataaaattgtaattttatttttgttgtgagatcgtgagtatgaaaataataacatttaattgtttgcgtataaaattgcacagttttattacttcatgtctttttcttctaagcaaaaacaattgggtattaaatgtccaaataaaaattaattgaggttttttttggtttttttcgttcttctttagttgatgttttataaaaatgcacacctattaagaaataatataattatataattaattttgcattgaaaattaaaaatatcatgtatttaaaaacaaaaataaaagcttaaaacatcatttataagagaacggaaggagtattaagtgtaatcttttgcattttgttttaaaataagtgtcattttgtcatttcaatgtatatgtttgataataagattttcagttttattcatattatattaatgtataaaccaatagaaaatatataatatattaataaaaagtaacatagataattgaatttttttaaatatatgtgtaacaatcttaaaacacatttctaatgaaacaacatttgcagataaattgttttttatcaaccacatgttgttcaaatcgagtaagataaaagtaaagttacatcaatcttcattatcttggttgactttaaaatattttccaaaaaagatataaacttgtctggcgtatttttacttttggattattttatttctctcagttgtttcatatatggacggagtatataggatttcgcacgtcggtttgtaacttttcacaatgataattattcgcatttagttatcatcatactccatgaaaatgccttgttactccatttacgtatttaaattttattgttccttgtcttgtccaactcctaaataatttctgtcaagaagaatttttttatatatttttgtcataaaaaagagaagagttgtctaatattatatagtaacaagtttagagttttcgtgttcgttgaggacttttcgtttccacattgtcaaatactataataagttagaattgttcttttttatttcttcttctttttattgattttcttgacaaatgggtggatgacaataaggagtgttgagtttttctatttggtagtcgtaagccaataaaaactatataacagtctatatcacttgaattctgactgattaaattcttttaaaacgaattattctctttggaaatatttctccaaaacttattttaatattataccttgactatttgattattcttcccttttattattgacttttctcctgagaagaacaaaaccttgtctgattcggtttgtcaaggtgtaatatatatttttttttttttatcaattctcatatatataatgatgttgagatgtattagtcaagaattttctatactttttaagcaaaatcatgaaggtttctatgaggcttctgagtcatttcttgagcatgttcatatgtgacgtccctgtagccctcatagattaagaccacaaaacttggtctacacaagttttaacaaaagaaatagcatcaaaaactttgtctggtaaacttagatactttgaattctgtcataactatggtctatggtataagttatgagtggtgaataaggttcctcataacttggttaaagaacatttcttaattaggacttgtcgaaaaagttgtaatacttcatacttgtagtaatatacgtactagtgatgacatgctataaaagtcatattggtttaagaatgataacataaccatttgtatcattagttgtctaattttacaagagccatttgtcacataaatatataaggttacgtgtggaatcaaaaactaggtagctaacaagtctttaatacctatatgtatcgttaattcaactgctgtgtgtaggtttgattctgatcatgcgctcgtgtgcatgaaagtaccacacatgcatggaagtcaacgtacaagttgataatatccactaggtccgatctaaaaattatgtcacttcaactctgtggcacggcattgaagtcatcagccaccatgcatcatctattacgaaaccgatttctttggaatctgaatctgaatgttagtcctagtcccactaaaggttgcttcgtcgtaaaagttaaagttttttttttcaagttttttctttctttctattctataatttccaaaagatcagattacatcaaattcagaaatagaaggatagtttaagttcatttcaatgaaagttgttgtagcgtcactatttttttaaaatatccgtttttaacaaatttagctaaatgacatttactataatgtttgttttgtctattatacataattaagaatcttttaaatggaacgcaaggagtattaaatattgggtttctgaccaaaagaaaggatggcattgattactagagatttcaaattctttcaaatgatatctaagtacgtacaaataatatctaagtacgtacaaataataatgtatttttaaaaataatatgctcatatattggtccaacatttaatggacaataagaagacatggtgtgaatatatctgactcactagccgtgcatggattggctgcttcagaaatttctgcactctatccacttgaaggtgacatatatatacacattttaatagtggttattggtacttacttggagtataaatatacgcacatatcagatcagattgtatcattattgtctacatatctttttgaagccgtcataacttgcaagtaaagaatg

SEQ ID NO: 30225 - DNA, 3000 bp, Unknown; identical to SEQ ID NO: 13046
  misc_feature (1)..( 3000): 2750-1469P.txt file - cDNA_ID_3027817; gDNA_ID_2214593; Annot_ID_186818

SEQ ID NO: 30226 - DNA, 3000 bp, Unknown
  misc_feature (1)..( 3000): 2750-1469P.txt file - cDNA_ID_3027844; gDNA_ID_2214594; Annot_ID_186835
atagagagcatgcaatttaaaattacaataaaatagtgatgagaaagtatatcactactgaagtgaatcgatctggttgccgactatatctcgaagtttcactttcacggccaaggaaggttgctttttttctttgacacagtcaatatttgtaaagattatctagaaggttgtaccactaaaatcgaaataatgaataattaggtgggataacaaaattttggattaaactaagtaaaaacaaaaatgttgtgacttatatagttttaaatgataagttgtaaatgttatgggaagagcaatcttttcctaggtaacatattaatgctctttacattacgttaatttttatataatggatgttagaatttagaatttatacgttcacataaccgttaatgtgttttgaaatagaataactatgttatatgaaaaatcaggcaaaaattaaatggaacaaaatatggaacgaacacttttttgatgtgaatgatttaaaagaaatatgacacatcgatatcaaaaacctaaattctttttaaatgatcaacatttggcaattctctacacgaaaaaagttatgaggtttctaggcaattctaaaatattagtctctaagatatatcgctaggagttgtttcttacgtatcgatcacactattaatatataagatccacatacatccctcaatcaattcactatatagaacttcaatctggatattcaattcatgtaaaatttgcccaaatgatgctaaagaattgtgatttttgcgatatgggttgcactgtctatttaacagaaggtaaacggtgcacacacctacacaaaaaacaaaaaaaaaaacaaaaacacacacacacacacaaacacaaacacaaaggtaaacctggtaaaacattcagacaattaaggatgagaaactgttgatttactcgttagctctgtagagattacatagtttatagctctgtaaacaaaatttcctagtctctcttaaactaataaaaggaaacctaattaattcaaaaaaactaaataatgttaacttcttcctccttctacgagacttggcttcacatgtgcaaatcatgttaattatgcacatgatagttacatgatatcttcttctaaccttaaacttaaatatatatactttcaatctttcatataccaagattcgtggctcctctcactcgaataagctctgcctctgcgattatgtgtttcgcttattgaatcacagcatttggtgagaatgcaacaacattattggtgaccgcgcgcgacacttcgtgtctcactacttgttcagacacaaaacaaattactttttcttcaagaaacatagtgcatttaacgaaacggcaaagatagatcacacatttcttcaagatactttttaacctaataatgaaacataaacgtttcattgttcttttcttttgctgagaagttttgggttattttcttttgctgagaagttttgggttatacacatgggcggaggtatattgtccacatggagtcaattaacctgtttgaatttttagatttttttttatttacttgtagttttagaagcaaactttataaaaatagtttaaaatgtgtttattgcccccataaaatttgtttaaaaatagatctctcatcctttgtaagagttgtaacgccaccgtttctacaagtactatatcctcttttagggcccgttggcctattttttttcgataatcggttttctatgtctgagaggctttaaagacttgtttaccgatcctataaatcactatatgatatttcttcatgatttgtgctcactcgcatggttccaacaatcaattttgggaaggtcatatatcatgaaattactccagcccaaacacgctcactgtggagttctctcatataattgaccaatataagtgcaattttattacataaatggccacatcaattattttaaacctttctgcatacactactatattctttaaactgaagtagtacaagagtaatggctagatcccctactgcatatgcctatacattctcttatgccagagacaagaacatttaatatgatttcttcacaaatgccgctcaaaccagcattttctagaatttatgtaagaagttttatcaaatgagtaattgacacttggtaacttattgtttcttcatttctaagaagggtttaaattgcgcacagtagccgttgacccacttttaatttcagattttgacactgtgggctgggcctttcattaagccaaaaactgaccaaaatgcccctgacgaaactgaacccggtttgtacgtacggaccgcgtcgttggaatccaaaagaaccgggttcgtacgtacactgttcatcgacgagaaatgcattaaatgatttctgggtttcggcgaatttgacacttgagattggaattaaaaaaatttaaaattggttgggctcagaagtttttaatgctaaaaagttttgacaagactaaaagtcatgattacctattataatagagattatattgtaagatatttagataatttagattagaattctgggaaaaaaacaaaaatcgaaaaattgtgttacggtgaagaaacgaaaatcgaaattgtgttacggtgaagaatctgaagttttcagttgctgttttacaaagtttgaaggattgaaggggagacaatctgtgttctgggtaagaaattcgtgttaatcctattaattacacttgagaacgtgatgtgaaagtaatgatacgtttttaaaaaattttgggttcataaattgttttgttggagattctttttgtatttgtagatataaatgaaagttctatgttctgttttgttaaatttataagtacataaattgttttgttagagattctttttgtcttcgttgacataaatgaaagccttcaaaaagatctgatttttttgtatttaatgttggtctgacctgaggaatttatgttgcaggtatg

SEQ ID NO: 30227 - DNA, 3000 bp, Unknown; identical to SEQ ID NO: 13050
  misc_feature (1)..( 3000): 2750-1469P.txt file - cDNA_ID_3027879; gDNA_ID_2214594; Annot_ID_186855

SEQ ID NO: 30228 - DNA, 3003 bp, Unknown; identical to SEQ ID NO: 26069
  misc_feature (1)..( 3003): 2750-1469P.txt file - cDNA_ID_3027905; gDNA_ID_2214594; Annot_ID_186847

SEQ ID NO: 30229 - DNA, 1289 bp, Unknown; identical to SEQ ID NO: 13063
  misc_feature (1)..( 1289): 2750-1469P.txt file - cDNA_ID_3027952; gDNA_ID_2214595; Annot_ID_186905

SEQ ID NO: 30230 - DNA, 3003 bp, Unknown
  misc_feature (1)..( 3003): 2750-1469P.txt file - cDNA_ID_3027964; gDNA_ID_2214595; Annot_ID_186898
tcatgctatttatttgatttgtaattcgtaatttgaaccatgtcctgtaattatttggcaggcttttgagccccctatagacttgagtaaacacatgcgcgagccaataacaggagcactgtctatggaggtcagatcaagacttggaaatttatccttttcattttgaaatctttaatttatatgtataaatgcaggagctccaaagggaggaacatcatcatgatcattccctcaagaatgcagagataagactcaataacaagacatgtgaatttgatggaggccacttaaatcatgaccatggcagtgtaatcatgccaactcatatacttttatacctcatatagtgtaattctaattctaatgttgctctcttttctttcttaggtaccattttcatctcatgattggttggattcttcgttacaggcgcatgttcctctggttgatgtaaataaggtatgctttttcacttttactatggttgattatattagttttttttcatcctagcaactcataattgttgtagagctattttagtgtgaacaaagataaaaagaatatatcctcaattctcaaaatgtacatgaaacatgttagaggtgagaggtgacacgcacaccagtacaattgtatatatatatatatatatatatgttggatgttgtgtgtattgctcaccaatctattacttagaaatgtgcatgcatggtttttgttgtattctaacacaggttcgttgggtaataaggaatatagttcgagactggggagcagaggtaatcatatttttgtttgtcatgatggcaaggatgagatcctttctctaatatcatgatcacaactttagtggtatatacaatcttttgacttacagggtcagagagaacgagatgaatgctacaagcctatccttgaagagcttgattccttgtttcctgatcgtcacaaggagaggtacactttctgacttttgagtttctgacctcccatcaatgcattctgagtatttttgttttaccattcaatatctaaatttggtggctttgctgtctaatccataaactctgcttacaaagttaacgtatatgatttgcagcactcgtccagcctgtttagtccctggtgctggacttgggcggctggcccttgaaatttcttgtctaggcatgcagtggagaagcaaactttttttttttgttttttttttgtagctttgatgatagcgaggaattaatataacaactcttgtacattggaacaggtttcagaagccaaggcaatgaagtttcatactacatgatgttatgctcaagttttattcttaattagtaagagtttcttacttttctcttatacatttttaacatcagccagcaacaaacttataagtgtgtttctaagttgcttttggagagtctctaaatttgattgagttaatttcttgattctgttccagttttgagttttgctctactttttttcttttttctttttcataagtacacaattgcctggtgagtggacaatatacccctggatacacactaactgcaattcactctcggatgatgatcaactacgccctatttctattcctgatattcatcctgcaaggtatgccttatcagagagagtactttgcctatggtttggaaatttttgatagctttaaggataaagggactaagcaacttgtattggggatttcatggagctactacaatcatttatttcaatttactaaaaagtttaatgtaaacactctctgagagcagtgcaggagtaacagaaagtttctcaatgtgtcgtggtgattttgttgaagtattcaatgaatcaagtcaagcaggtaagaaatggtgactacttgcttttgtttaagccaatatgtgtatgttttataccaaatacaccactcatcactgagtttcaggaatgtgggatgcagttgtgacttgctttttcattgacacggctcataacatcatcgagtacatcgaaaccatatccaagattttaaaggatggaggagtacgtaatttcctatacgtaccctcctttccaacgtctttgatatttcatcactcgcctatctaaattaatgaatttatccatcaggttttgataaatctaggacctctgttgtatcactttgcagacgagcagggccttgaaaatgtaagcattggaattgtcacacaatctctcgctagataaataaatttgatataacaataatatatcttacttgtttctccttaggaaatgtcgattgagctaagtttggaggatgtaaagagagttgcttcacattatgggtttgagatggaggtaaatctacacaatataatgacaatgacatttgcctgtcagaaataaaacatctcatgatgcatgttcttcctcacttatatgagtggttgtcctaacaatatttgcagaaagaaaaaacaatagaaacaacgtactctacaaacccccggtctatgatgaaggtcagatttttttccatgtctttggatttgtggttgacttttggatccagagatgggtttaatttgtgcatgatgttgtgtgtgtctgttgcagaaccgatactatcctgtcttctggacaatgaggaagaagtgtgctataacaacaacttaaccaaatattcctcaaaactatatatgttttattctgttgcatttgtttttaaggaattaacgggtccaatctaaaacacatactatttcttttgttgttgcaaaataatgaaactgtgtttttcggttgatgtttgaaaaccaagtaaccaacactcaaagctaaacaaaacctttggcctgtgggcacaaagctaaaattttattattttctcggcactactacgcaaataggctaactaaggcccattaaataatatgaggcccaacttgaaaaagactcgtttcttgttactaataacctttccgatgaaatcaactccaaaaccgaagagccaccaccatg

SEQ ID NO: 30231 - DNA, 3003 bp, Unknown
  misc_feature (1)..( 3003): 2750-1469P.txt file - cDNA_ID_3027968; gDNA_ID_2214595; Annot_ID_186897
ggaatagcgccagctgtcaagaagaatattgacggtaactaaacaaaaacaatcttaattagtgcttaattacttatatttttcttaagacatttgggtgaatgatattattatctgggcagattttctagtggagaaatttggattctcagaaagtaaagcttcaagcttaagagttgaactcttcaagacttatggaagtactctcgctggtcttagggtaatttcacttctccattttctaaagaattactagttcattatatatcattgctttctaatttatttatttctttcttataaattgtaggcgttaggtcatgatgttcatcctgatgaatatcacaggtaataatcaatcatcttcaacaactatataaatattttgatctcaggaaagcgatttttgttcttaagcttttttttcttgcaaaatctgttttgtagtttcgtgcacggaaggttaccgtatgggtcgatcgaaccaaacaacaagctacgtaaccttctcaacaaaatcaaacagagaaaaattgtaagtttaatcttttatttattgtggcatgaatttttcttgggtccatacagccaacactaataaatgatcatttgttttttcttgggtccagatatttacgaattcggacaagaatcatgcggtgaaggtcctcaagaaacttggtttagaagattgtttcgaagagatgatttgttttgagacaatgaacccaaatttattcgggtcaacaacccgacccgatgaatacccggttgttctcaagccttcgttgaccgcaatggatatttgcattcgtgtagccaacgttgatcctcgccgaacagtaatattcttatttatttaattatttcttatgataaaactattgtatcatcattacaataagcaaactgtttttgtaaataggtatttttggatgataatatccacaatattaccgcgggtaaatctgtcgggcttcgcacaatcctggtaaatttttgttacatttcacatttattaattccctattttgcgacatttgtatgtgttagtttcaagttttaaaaatttggttacaaaaaggtgggaagagcagaaaagacgaaagatgcggattatgcggtggagacggttactgagatagctacggcggtgccagagatttgggctacggcgacggcgacaggcggatttgacgttggtggtgagaggatcagacggagcaagagtgagctggagggtatggcttcaatagcagccgtcggtgcgtgacgtgatcgagtgggcggatcgtggccgttggataattttaacgtctagtggttgggattgtacaggtggcgttaaaatgttgataatgcatatgtgaatataaataatagtggtggtggacaatattcatcccatgtggacaccaaatgtgaatacgcaatcagataatattatgtatgatgattatgatttcaatatgtgtacatttttattcaactgatttttttaaagtttgattgggattttataattagtctgttcgtttcgtcgccgcgggtacctgcggctgcggtagacgcaactagttgtgtttgtttggttgccgcaactacttgcggcaaaacgcagcgtcaaacgcagttttctgcggttaaaaattttagacgccatttaaatttagcgtcaaagatgaaagagttgcgttatatatcctaaatgacaaaaatatccttattatttttgaaaattcacaaacaaaccaagcgattctcttcttcaacaaacaaaccctaaatcccaattctcttcttcgtttcttctgtcaagatcaccaaacatgcggcagcgtcggtggcaacgatggcggcatcgaaacgaacacaaaacctgcggttgcgacagcggctgcggcaacgttggcggcgacgaaacgaacaacaacctgcggcagtgttaccgttgccgctgccgcaaccgcagccgctgccgcctgcggccactaaacgaacagactaaatatagttttttattagagatatgctgtttataattttatctccaaccaccatgatacatattacagttaaatctctataaattaataaattctttcactcccgaattgggaccattataaaaaataatataaatcgataaattaataagataataactttttgaaaagtcctatgtaaatatatggtctcatcaatatcataaattaataattttataaatatatcaattatatatacattatatgtaagaaattgttttgaaatataattctaatatttttttgcttaaaacttgtatttattcttatttaaaatttagttatagtattttactttatcaaaaacttttgatgttgttttctaaacatgatattattatttacttgtaattgatttttgaaagatattttctataatgaaaaaaatcttatagaaatttttgaaaagttactaaattaagaaaatctctgtataaattaataaatattaatttatcgataaattaaaacatctataaattaataaaattttgcagtctcaacattattaatttataaaggttttactgtatttgataaacgaatcccttgcgatttatatcttgctgtatttctaaatcctaccgaagttttttttctactgtaggaagtaattcacagttttatatctatggtatttataaattctgaatgtctggcattacaacatttaaaacgttcctaacttactccattttcattgtaggagaaataatataacatttatatctatgttagtaatataacattttcaaattgctattgttatattttcaaatttggacctcatgttccttagtaggccaaactttaccccattttcatagtaggagaaataataaaacgtacctttcagaaataatcttacgtcaaaatatatccttaaataacagaaaagtctttttagtcttcgtgtatacgaggaaccataatgatttcatcgtcagagatgatg

SEQ ID NO: 30232 - DNA, 3003 bp, Unknown; identical to SEQ ID NO: 26379
  misc_feature (1)..( 3003): 2750-1469P.txt file - cDNA_ID_3027976; gDNA_ID_2214595; Annot_ID_186895

SEQ ID NO: 30233 - DNA, 3000 bp, Unknown; identical to SEQ ID NO: 13067
  misc_feature (1)..( 3000): 2750-1469P.txt file - cDNA_ID_3027979; gDNA_ID_2214595; Annot_ID_186894

SEQ ID NO: 30234 - DNA, 3000 bp, Unknown; identical to SEQ ID NO: 13076
  misc_feature (1)..( 3000): 2750-1469P.txt file - cDNA_ID_3027983; gDNA_ID_2214595; Annot_ID_186893

SEQ ID NO: 30235 - DNA, 3003 bp, Unknown
  misc_feature (1)..( 3003): 2750-1469P.txt file - cDNA_ID_3027987; gDNA_ID_2214595; Annot_ID_186891
ttcccactggtctacacacgattcctgggaactctgtgtccatcgctacgaatgggaaatcgtctacgacttctcgaatcagagccatctctgattcgagattgtcgttccatacttcacggatttgaatcgaatcgtcttttagaaacagtgacatggtgatgataacgatgatgatgaattcgagtaaataagttaaggagcatctggatctagagcaagatccgatctggtttcatcagatctgcaatagatttaacacaaaacaaatgaatcacttacaaaaaccaaaaccttctgattttacataaatcaatgaaaacagagaaactcgacagatacatagacaaatactaagagagacagctggattcgaaccttgtaatgaagcgaagtaagaaagatgtttctcgagaagacggcgagttgttcaggctagggtttcagaggatgtggtggtttattagagaggaggttataaatcaccgacagattattttttatttttttctctctctcggactgtgcccaaagttgctcctttttttagggtttttgttttttatttacaaacgctgtttttttatcttctcccttgttttatacgcaacgttgatttctttttcttttttttttattattgaggcattttcgattaacctaaaaatcgaaatttttgtctaaccaaagcatgcttaggacagtatatacaattcgcaactgctcttagaacctctggtagtagaactaaatcattttcagacaaaaccaaaaagaattcgtaactcatgtatagaacttacacttcatcttttattccaacaggcattagcccaaacatataaaccccaatattcttttacaattgaaatgcatcaagccgtcaacagatatacacccaatgacccaaactgaacaaaaacaaaaaaagttaaaacagaacagaagcaaatgagggagggagggagagagagagagagagagagagatacacatggtggatgattttcagcttattcccagttgcagactccaaagtttgttttatctactattaaggcaaatgatgatcctgctgaattatttttagaagatgtgaaggggcgagagatattacgtgaaactattgcacaccgcgatcaggcagtcgacttgaagttgccagattcaaatggttagaggattgaaaatttccatcctctaagagaatcaatacttatctctgaggaggatcaactgtcctgacatttgcacctgtcataccttcaattttatctttggtgatctccacaaagtgaccaattacttcgtgaaactgcttaagacccgataacggtagaatgatggaagacctgtcagaacctgccacctatattgagaaatgctttaatgttaaaaccatggtaaatacaagctctcaagagataagccagcaaaagattgttcttccaagattacctcagatatccttaagaaatggcccctgttattgttcccaagatcaaagaagaaccgtttctggtcagctctgattactttagaaacaccagtcattccggtttcttcctggcctggcgagtcaattgttcgatccacattatgttctgaagaagatggctgctgactaccatgtccaggtataaaaccagctccaacatcatcaaccaagtgttcctgtccatcagaaggtttctgtttccaaaacgaagatacaatgagaccagagaacttagttaaaggcttttcaatcaaaggagacgataataccacctgatttggcatcacaaaaagtcctgatgcttcatgtatctcagccaatatattcctgaaagctgcccatccttcatcaggagagcttccagctggaacaataatggtacttcgatttctactaaccgatgcttctgacacctaacaccacaccaaaacccatcagaacattcctacaacttctgatacctcaggataattagtcacataaccaaaatgaaaagaacattcctaaccataagtctagtactccctaaatcttcaattcacatataccaaagaaaaaaaacttcagattcattaagtaaaacagaaaaatttctaccttcaagaagcgtcctcttctgttctcaccgatatcgaagtaaaacacctgaataaagcaacaacagcagaaattaaagagagtggaaaagtcaacgatcgccagaagagagtgatgataaagttgaaaccttggaatcaagctgcaattctttgctaaaaagctcgtgttcctcagaattgacatagtagttgaagagatcaaggaaccaagagatgccggaggaaggaacaatgatggttgacctcgtcgccgacgtcttctccgatatctttagataccttccacgaggattctccttaagatcaaaatagaatagcttatgctccacttgcaacgtcttgctcaccaattccacatcgctccctcctcctcctcctcctcctccggttaccgctcttccgccttcagctcctcctcctccgcctgaattagcttccatttcaatcttcaattgatcgatcggagtagaaaattcggtgaaagaaatctcttcactgaagagttgaaattgacgtctgatctggtaaaggaagtgcgattggaagaatgaggaattggtggaggtgagagattacggagcaataagggtttaataccggaccggatgttttaaaccggatacattgtttggtcggggtccgaacatttctgattggtcggatattcagattaagcaacagattaatttttcttggagtaactgcaattacgtataataattcttttttttaaagttggttttagtttcactgatagtcaaaccgatcggttcaaccttatggtttgattaaagatgtgttataaggagccgatgccacgtacttttactaatctcttttttgtcgaccatttttgtttctgagttgttcttcttgattagctttgtccgcttggaaccaaacatg

SEQ ID NO: 30236 - DNA, 3000 bp, Unknown; identical to SEQ ID NO: 26075
  misc_feature (1)..( 3000): 2750-1469P.txt file - cDNA_ID_3027990; gDNA_ID_2214595; Annot_ID_186890

SEQ ID NO: 30237 - DNA, 3000 bp, Unknown; identical to SEQ ID NO: 13070
  misc_feature (1)..( 3000): 2750-1469P.txt file - cDNA_ID_3028000; gDNA_ID_2214595; Annot_ID_186882

SEQ ID NO: 30238 - DNA, 3003 bp, Unknown
  misc_feature (1)..( 3003): 2750-1469P.txt file - cDNA_ID_3028012; gDNA_ID_2214595; Annot_ID_186877
aaaatataatcaaaagtgagagaaggaggaagaaaagagatgacctttggtaaacggagagagtctttgttcaaaataaacgactacgttgagaaaatggagacggcactctcaagtagagagagagagagagactagagagagtttggctaaaagcctaaacaaaaaaaaaaaaaacatgaaactctttcgtcttttctgatgatatctgtcggtctcgccggttaccggttataggcaatcaaaccgacctcaattggtaaatttactggtccgagtgaaattcagattgcatctggatcggatatgtcattagaataataatttattaactgtgcttacatcattgtttaatgtaataaactattaaattttacaatctgcgaattatgtaacaaccaaactccaaacatttgtactaaattttttatttctctgtatattgatattatgttaaaactttatagataaccaaatttatgattgattgattaaaacgatggtttcctatctaagcaagttagtgataatgtaatctaaagttaattttaggctgtgtgactggctttgatcaattttgtacgtaactttgttttattggataaagatataaactcaaaagtcaaaacacaccaaaatctaaactacaaatatatcattataaaggaattttttttggaagaacttatggaggaatggttttttgcatatctgtctagcttcacattagtctaaattcatctatgatattactaccactttgtaattttcttaacactctatagtctatacgttcattgtatcagtcccctcggcccactttaactatgttgattcaatctcttctcttatggtagattgtctattcatagtggttaaagaaagaaaaaatcattagcatatatctttaaccagtacagtacagtactagagatatatataaacaacaaaatattctcgtatgtgtatttgcagatatttttcgtcaagatcagattcttttccacatattcctattgttcttcattatcgtatgcatacgttgatataccaaaaaagctttgtgcacatgtttactataaatgcgacattctcacgctaattttcaatatcaacaattctccccacgtattcatatcgcttaactagttagtaggaaataaaatgaagagctctactacctctatgcagttaattccaacacttttcttcttaaccattcttcttgcttcaccaggtatgcaaatctagtttctcacaaactcacaatattaaaaagttactaaaacatataatatacgcttatattttaatatttaatgcatggggttttacgcatctacttgaataatttaatatttgatgatattgaagaataagtcaattattgattgtttatatgattataattatattattattcaattatttattgaataatgataatgtattatattatagatatagagatggttgaaggacaacaaatgtgtgaagcaaagagcttggactggaagggtatgtgtctgaaatggaggaattgtcgccaagtatgcattagcgaaggtttcactgacggtcgttgcaaaggattcacccgcaaatgcatttgtagcaaaccttgttttgtccttcctaattaagttcttgtttctcattattttgatattaaaattttaaaataataacacaattcattattgattgattaaaaagattatggttttttaatttatatgtaagctgatataaaaaaaaaactcagttttaagcaatgattttctctaagtttgttctaaaatatcatttttcaatacatgaaatactaaaaaagaaagtttggattcatttcctacacaaatttatggttttataaatgtacaaagaatattgaactaatatttcatgttccgattatatataagttcccattttcaatcgatgagattaataaagaaactttctggagtatatatttaacattttcgattttatattatgaagctaaagtatgtacagtatgttggtgaaaaaacatggatcgttaaataaaaaaacatattaaggaggagaacgaccgagcatcttctaaagaagattaaagcataagaacattggaataaggaaggtgaagtattgtcgtggacattcctgagtgggaagactcaccattacatacataattaattagtaacaaagacattggcgcctgtcttgttcccgttgcttttccccatctttatctccaattctctctctctctgtctctcttgttctactactttggggaagatgatagcttcttcttcttctccctccatcacttgttcttgattctacttgtggtcctccgcttctcttttcaggtgattggtcattgatctctggtttttttattttgcaaacttatgggttttgcttttcgtttttttctctgtcttactaatccgaatctgattcaaagtttacaactttaactaggggtttttctcactgaactcttatgagtgagacatagattcgtcttctaggtctgtttccggagggaattaattaataatagtatcaattttcgattatttttctttggttgattctctatcgaagattgtcgatgcttccaaagttgaagcctttgttacttctgaactcaggattgtcttgtgcctcgctgtagattatcgaagatagttgtggttctgggtaattagcttttggtgataaaggtttgtgctttacacatcttctgctactttttgggtatggcctaactaaaaaaagtaacttttagtatctctttccgatgatatcgattttataggagtgaatctctcatcttgcttcggagtgaaacaaatcatgtttttgttttgtcggaatgcttatctgattgcagtgcatatagttgtcaaagtttgttcttgatggtgatgtagaagctcttttatttgacatatttggttctttgtttagtttatttttagtaggatctagaagatcatg

SEQ ID NO: 30239 - DNA, 475 bp, Unknown; identical to SEQ ID NO: 13068
  misc_feature (1)..( 475): 2750-1469P.txt file - cDNA_ID_3028020; gDNA_ID_2214595; Annot_ID_186874

SEQ ID NO: 30240 - DNA, 3000 bp, Unknown; identical to SEQ ID NO: 13088
  misc_feature (1)..( 3000): 2750-1469P.txt file - cDNA_ID_3028027; gDNA_ID_2214596; Annot_ID_186925

SEQ ID NO: 30241 - DNA, 3003 bp, Unknown; identical to SEQ ID NO: 26082
  misc_feature (1)..( 3003): 2750-1469P.txt file - cDNA_ID_3028035; gDNA_ID_2214596; Annot_ID_186922

SEQ ID NO: 30242 - DNA, 3003 bp, Unknown
  misc_feature (1)..( 3003): 2750-1469P.txt file - cDNA_ID_3028040; gDNA_ID_2214597; Annot_ID_186944
cttaaccttcaattattccagaaaaagtagtcaaagaaacataggtcgaataattaaatgaaaagatattttgaaaattcttataacaaatataatgctggaaacaaagttgatagagttatttaaggataagttttaagggctgcaagctcttcatccatatttttctggttattatcgatgagttaaatttttatttgtgggagtattgaaaacgtatattcgaagggaaaaaatgattttgtgagctaaatttgttgccgtctacagcatcccagcgtactgtgtgagccgacatgtagaatttacaatttaaaactgttattttaataagtagttctcttacgttcaatatatttttaaatataaaaataaaataaatcatctaagagccaatttcacgaaagaaaaacaacaaaaagtttatcttaaaagagaattaatttcattctctattttagatgagtgttagagtatatatgtatatagcgtcatacatctagactaagttaaatattggtgttatttggtagggcttaagatatagtgtttaacatttagatgaagttaattatataggtttgggtttataaagtaggaactagggtttagtgttataaattcagatgaatttgaataactaatttgggtttataaggtagggttagggtttaaggaataactgatggaagcacatacaataatgtaaacttatatctttagttcatatctaactaaaaatatttgaacaatttgaaacctcattcgattatatttaaaattatttatgacttaaagttcattgtaattgtgtttatttggtatagtgtttaacatttagataaagttaaatataggttcggatttataaggtattaggtaggatttagtattattcatgtagacgaattgaaataactaatctgggtttataaggtacaggttagggtttaaggtttagaagtctcatgaatattaaaaaggggtgctaagtaatttgcaaggattaggcacttatggggcttggagttattcctcttctcctccgttgggaataagtttttttagtgaaagttgtccagaaaacgagagggaagaactcaactatttctcaatttgaagaagcttccggtggatcctttttttgttcttgagacctttgaagttaatcagtaggggtcctaggcgctagaatgtctagattgaaaaagtagcatatataagcttttttatttcaagagagtaaagtttaccctgttttagtgtaccaaaagataagagactgtgtttttgtgtgtaagaaatctcaagagacaagctaaagtagtcgaaactttgtgtaaaaccaattaagagagttacaagttctttataagattttttgatgaatttataagctcattgttgctgaattttttaaatttttttagttacttattattttgaagttagattttgatattgtcaaaagtatttatgggtccggcgcataggcagacacaaagaagattaaaggaggtcagctggtctttttagaattctacatttgcattgtaaccctttaaaattcatgatattatttatatatatttttttatttttactcttttaaaattacaaattcatatgtaaaccttctaagttttattgtatttttcttctactttgtggtttgacactatttctaacatgttttttactttttttgtttgattcacccataaacattgaaccatattttatctattttttaaatgaagttttttgagttttaaattttttggttacttattatttcgaagttatattttgatactttataaattatttatgggtccgccgcataggcagacccaaaaaagattaaagcaggtcaactggtctctctagaattttatattcgcattgtaacccattaaaatttatgatattatttatatttctattgtttttacctttaaaatcactaattcttatgtaaacatttaaagatttatcgtgtttttcttctactttgtgttttgatactatttctttgttttcaacttttttgtttgattcacccataaatattgaaccaaattttggtgtttttaaaagaaatgaagatttttttagttttttaattacttattattcaagttataatttgatcctataaaaagtattttggatccttgacttgaaatgtaaaattaacgggtacaatgtgatagttaatatcctaaacattatatgacacatgcctttgatacgggtaaatagatataaatataggtgttgttatatccatataatatatattttttaatttcgtaaatgtctctaacttatcactctaaattatgattgattcaagaagatactcattttaaatttttttggtcgaatttcaaaaattttggtatgcttgatctttaaaatttaaatttaattttaaaaaaacaaattttggtcgcgcaaggcgcgggtggctcacttagtctcatattattccttcacgaatctggacttattacattttcgtttataaaaggaacgttaatacccggttcattccagtttacagactcaatcatagttattctaaaccatactctaataaaaaccaaattagtcaaactgacccaaatcagaaacaaaacgaaccataaataaatcgaaatgcacatcactagcaacttttctataaaagtgaaagtgggtggacagacacttgggtagaaaacccaagagatgagtggcttccacgtcatcctttacagtgatcctcgcacgcatgtataacacttatatcagtcaaagtcattattttaatcaatggaccatttccaacttaactttaactttaatgatgccagctttgtgtcacaccacttactaataaacgtagaaatatatccaaaaatgaactaaaacactactctggaaatattaaatatagaaaaccaaagaattggaacagttcatcgggaagggttttgggaccctagagaatccatg

SEQ ID NO: 30243 - DNA, 3000 bp, Unknown; identical to SEQ ID NO: 13094
  misc_feature (1)..( 3000): 2750-1469P.txt file - cDNA_ID_3028047; gDNA_ID_2214597; Annot_ID_186941

SEQ ID NO: 30244 - DNA, 3003 bp, Unknown
  misc_feature (1)..( 3003): 2750-1469P.txt file - cDNA_ID_3028084; gDNA_ID_2214598; Annot_ID_186954
ccagcgaaagaaaggaatccattattaatctgctaattatgtatgtattttcataattatttctctgcaggtaattttagcctctctggaagatggagtcagagaagggagggcattgctgcatgattggctagtaattctaacagcacaatacaacgatgcctttaaccttgtccaatacaaaaacggaaataagtcaatgagttctcagattgatatcacgttttcacaatgtcctcaacttgagcctttgcctcgtttagtctttgccttactccgtaatccccttctccggtttcatgaagaaggtgttcatcctgattacagaatctacttgcaatgccttttcaggtaaccatcccaatgaactactaataaccaacctagagtcagcgtgaacaatattgtatatttagtgtattttttcgatcgtggatttatttggaaaaaataccttggtatctcatgtaaacagaccacaagcaaggctttagtctctaaatttcgtgtttgtgttcttctgttttgttttccttaaaactgcagtgtgttggacccgagctctcttcattgcggcatttacccagcactaatgtcatattcaacaccggatacactggcatatccgcgtcattcgttgagccgtgcagcattgataacaagtggtagtccgatatttttcctagatgcatataccactttgatagtcttctactcatcaacagcagacccgtcaatacctttccctccacctcaagactgtaagttttctcaccaaatgaaatccagttcaaccacctttagatctttgagactatgttgattcgaaaacttatatcttacaggtttattgaggcagaccataaataaagtgaagcaagaaaggagcatcacaccaaaactagtgtttatccgaggaggacgagacgatgctactgtctttgagaactatcttatagaagaacaagatgtggacggtaatggttttgctagcgccatgggtttcgtgtctttcctcgatgatatttcgcagcgtgtcactgaatacatgaagtgaaagccaaatgaccctctagtttattatacatccaaactcaaaattttcaactgtgtcagagttttactcttcttgttgtaacatttgctttagactagcatcccaacttttttgctctcttaatcaaaatgaataattaagctaaaattttgttgcaaaacttcattttctaaactttgacttacatatttggtaacactagagccaaagagcaaaaagatatgttagtctattacatgctcatggccacaaccactgcttcaagcttacaagctaatctccaacataaacctgaaaacatgttcttagcaaaaatataaccttgagttcattcatcttcttcatcactctctacctcttcaccacttccacttacgctcccgtcctcgttctcattatcttcaccaaccccgctcccattttcttccatgctatggtcctcattcccgctctcttcgctctcattcccattctcttccatgctgttttcctcatcctccttctcgttctcctcatcattcccattctcttccgtattttcatcgtcgttctcctcatcattcccattctcttctgtattttcatcgtcattctcatcttcctcatcgtttccattctcatcctcctcatcgtttccattctcttcttccgtgttgtcattctcagtctcctcgtcattcctcttagtttcctcatctattttgcttttccttgcacccttttgcgtagatggttcttcctgtttcctcttcttcgtctctttgggcttcgaagcagttccacttgaagatttcaaagcagctccaccagcaggatacgaagcagctgcagcacccgcctttttccccgcattcttcttcttaaaatctgaaaaccagtcatgtggattacactaggattgacatcataagctcaaagtgcacacacctaggccagtgtccataacaagacaaatcacaacctaagccatttctactaacactccatgaaagtaacaacagatagtgacaataggatcttcatccgaacaaaacacttaccttcaagagaagatttaagcggctccaaaaattctgaaaaatccatttcttctaatgccttaaacacatcatcagccttcatagtttgtcttcttgcatctttacaaaaatcatttgccctatatcattcacccccaaattaaactaaatccatcaattcgatcgatcacaattcacaaacactaacattcatcaattgaatcacattaacataaacccaaacttggaacattccaaatcattcactatcatagtgcagaaattcgaaaaaaagttagggtttgtgaagtgtacatacgtggcggagaggtagtggatgaagatcctcgcactctctgagaatgcgagcaaagcttccttgtgaatactgacgtcataatccggcgaacactccgacagcttcttcttcaccacccggcgcacaatagctagcggcagctcgtccaccaccactttctccgactccattcttctctcctctctctcagtcgccgtctttcccgcctttatgttaataatacaacaaaacacatcggcccagtaagctgatcagcctattaaaatatttaaaagcccatattcaagtttataagcactaaagagttatgaccacgccgctcaatattacccgttggattgattgacaaaatcctagccgtcaaatcgtactagcaaatcggcccattattcaaattgataagcactaaagagttatgagcacgttgtcaatctcaccgttggataacctttattaaatcttcaccgtccaatcgtaatactaataaattcgatcaaaacacgaataagaatcggagtcgtcttcaacctctggaatttgagacatcttcgaataaccagattctccgaattcgagccatttctaagaatttcatactctgattaatg

SEQ ID NO: 30245 - DNA, 3000 bp, Unknown
  misc_feature (1)..( 3000): 2750-1469P.txt file - cDNA_ID_3028087; gDNA_ID_2214598; Annot_ID_186951
ccaagaatcagaactaacatgtcttggggaagagttgaatcatcagtgcttgaatacaaaaacagtgaaccgccactttcaatgctaaggaacttcagggatgctaaatctgtgtactcatttgtaactgcaaataaatctacacatacacctgattggacagcaatggtggcctataaaagagccgttagatctaagctcaaagaatatatccattccggagacagaaaatcttgaaataagacttactaggtctttgtagaatggtgtttgttcaggaagtagagcacgatcagcatctacccttttacttgcatattgttcaccatatctacttgtatccaattgtccacgtccataatcaggaggaccagataggaaagcaaacaccctagctgcacttatatcaagtcaataaaacaataccaactggccactacgactatgttgaaacatatagagtatgggcatgctaaataatttcacatacctaatgcaaatgtattcccaaattcagatcctagatagttgaatagagcttccatagctgtaccaaagcccctaccacccatcaacacactatccatcccttgacctgctccagctgatctctcccaagaagtaattggtctgagtgtctcaagtgcagcagcaatacgatccttgcaagtttctacctgcaggaagtacagaaagagaacttagtctgtcaacaggtattccaagccatgtgatccgacaatcaatttgaatgaccaaggaagtaggaaacaggaaacaagatgttaaaaaatgaccataccggagccaaaaattgtaacaagggcatgacatcctcaagttctagcgataagctgctctccccatcagggggaatgaatacattctttacaactggtataggtccttgaacatcatacagtcctattttgtgactgaacgtaacaagaccaaaaagagcccctggacttagagctgcatatacgaaaaaacgagagaattgttttcctcaggacacagtcacacagaagaaaaagtaaatccttgctttaaatttggtatgaaacgaccttccagagcggctagcaatgcactttttgtaagctccaaaaattcctcagaagctgcagataacaaaaataatcatgagcaaaaagtgcaacatttgaacaaaattcgaaacaaatttactgctaccacaccctatctccaaagtcatgacaaaatcacaacataagcaagccaaaaatcgataagaacaacaaaaaagcatacaaacccaagctagaatcataatccatagcaaaatgacacacacattgctttcaaaattcacaatccaaagttcactaacacacaattcaagtacaatctacactgatcacaatgagcttcgaacacaatatagaagaaataagccttacaagagatatcaatcgccgcaacatacacaggtcgtgcttgcgtcatctcttcctccgatccatccactagaaaaacaaacaattaatcagaaattagaaccaattccaacaaaaaaaacaaaagaatcagtatagagatgacgtaagacatacgaggcatctcaagatcaatgaaggaggaagtcatttcaggtatagagtgaggattagagtaacgagcaatagcatcagaaggaagtccattgagagttccacaaagcgagcaattccaagcccattgatcaagctcacaataggtattgaagtaagcgtagcagttttcgcaacgaggaagaagatgaccgttagatccgcacgctggtccgattccgttctcgtctttggccgcgaatggtgttactgtcagtccccaaggaagtcctgacgcctcttgagcgtctgaatcgatcggaaaacgcgacaccgttgctctcactgccattgtttcagatcagatccttccaaatgtgaaaattttgattctggttttaaggttttcggagatttggtgaaattggatgagcacggtggaaattaggcgcacgttagcttttccagtaaaattcgtctccagcgcacgttagcttttgtgaacgtcttttttttttggaagtttttttttccaacatcaaagaggccaatgatttaaaggtggaagtagtgatggtactacatatgtataaacatggagtgatgcaacaactcaagtataagaccatcatcgcgaagattaaagacctgaggaaattcactatattttgttcttctagagagctcgaacttaaaagatatattatactctatgtttactcgggggataacgtcaatatggtgtcaatgtagacatcaaagagtttgaagatcaagtacaagactcctcaattaagtatcttgttggatcactgaatattgttataccttctagttttctaggtaagagattgtttagtcgaatacagattttattgatgaagaaaagaaagtgattatgtattgtgggagatgcgaggatttcacggagaacatgatgtacattattggaaggcatggttgcagaaaattcgattattgtacaaaccaattgaaatattgtccctggtttctcttcagttattatgtctctggtttctcttcagttattatgttctaagtgattatgttccaagtttagttattttaaatccaccaatgtaacttttacccaccaacacttattttgtatcaacttgtttatgtcttgtgcatatagtagataagtgtagaagaatctaaaataagaccatacaaggattaggatccctcattcataaaacatctaaaatgttccaactcaatttggggttttacgtctgcgtttgcgtttgcgtttgcgtttgtgaacgcctttattcgattttggaaaagaaaaaatgttctgttctattttgttctctctgctagtcacagtcaaatgagtcagctaccttatattcgattttgagcgtccttaaattccttcactgtgagaaaaaacacagagaaagagagagaaacaatg

SEQ ID NO: 30246 - DNA, 380 bp, Unknown; identical to SEQ ID NO: 13116
  misc_feature (1)..( 380): 2750-1469P.txt file - cDNA_ID_3028109; gDNA_ID_2214599; Annot_ID_186997

SEQ ID NO: 30247 - DNA, 3000 bp, Unknown; identical to SEQ ID NO: 26101
  misc_feature (1)..( 3000): 2750-1469P.txt file - cDNA_ID_3028148; gDNA_ID_2214599; Annot_ID_186994

SEQ ID NO: 30248 - DNA, 3000 bp, Unknown; identical to SEQ ID NO: 13120
  misc_feature (1)..( 3000): 2750-1469P.txt file - cDNA_ID_3028155; gDNA_ID_2214599; Annot_ID_186987

SEQ ID NO: 30249 - DNA, 3000 bp, Unknown; identical to SEQ ID NO: 26386
  misc_feature (1)..( 3000): 2750-1469P.txt file - cDNA_ID_3028159; gDNA_ID_2214599; Annot_ID_186986

SEQ ID NO: 30250 - DNA, 3000 bp, Unknown; identical to SEQ ID NO: 13108
  misc_feature (1)..( 3000): 2750-1469P.txt file - cDNA_ID_3028162; gDNA_ID_2214599; Annot_ID_186985

SEQ ID NO: 30251 - DNA, 3003 bp, Unknown
  misc_feature (1)..( 3003): 2750-1469P.txt file - cDNA_ID_3028180; gDNA_ID_2214599; Annot_ID_186979
gctgctgtgtccaatggagacccaatctcctggcagttcagctgctgtctgttcccctcccagtggagcaaacgatccaaaatgtctgtacctgaatggctggaaccgatgtcgaccctctcctctgaacctcaatggtccctctggcttcttctcacatttctccattttgttgaagcactttgcaaggtacttcccttgttgtgatgcaacctgtataagaatcaaaacatcaaaatctgtgtggtggattgatttcatcttgttttgatctataacaagcttacctgtgcagttgctggaaggttcttcatctgtgaatcaacctcagagagagcttgcttaaacttttcgatattcacttgtgtgtcctcaccatttgcactcttgagcaagtttgcaatgttcttcagcttattcttcttcaagtagagctccacctgagggtacctctggcaaatgtctttaaccacactattgaaatctttcttcttcaaagttcctgtgtttcccttgtctgctttgttgaaaatcgcagctatatcttcctgtttgttcaacaacatcaagacaaaacagaaggttaaagattcattcatcaactgagatgtgacacaaaggaacaatgtcaagagagatgataccatgactctgcgttggttgatcgttgcagtgtcacctaaagcatagacaccgtcacatccctctactctaagccattcgtcggtagccaagacacgtctctgtccctgtaaccatactcaatctagttaggtgggacactagcaaatgatttggttagtcaaatgatttcttcatgtgatcaagtgtaatctaacctgaccaatctgctgcataaagtctttgatgacaggacgtgaaccaattcctgttgaccacacaaccataccataaggttcggagacaatcttgccagtttctctttcctttgtggatatctcatcagcagtcactcccacaaccattgaacctgtcttcagatcaataccatctcgctggaacttttcctcagcaaaagcagtgattctcttgtcaaacctgaagtagaattgaaccaacattggaaaagcagtagatttagccaaagttaatgaagcttgatgggtggaacttacatgttgagaatgtggtcgcctgcttcaagaagagtgatttttgtgaactcttggacctttgggtaaatcttagccacatcctggactaggaaatcatgaagctctgcagagaactcgactccagttggtcctccaccaaccacaacgaaatgcagaatctttttcctctcttcttcagttagattcggaagagaggctctctcgaaacagtcgatgactgaatgacgaatgtttagagcatcctctgcttctttgaggaaataggcatgttcctcaactccaggggtgttgaatgtgttaggcttagcaccaacagctaagatgagaatgtcataatccatgtcaaactctgttgtgcccttaagacttgacccttccttggaccggcagtggattttcttgttcgatgcatcaatcttgacacactctgcttctttgtactcaaatcctttcttgcgcataagaccacgaatgggttcaacaatgctacgggcttcgacagtaccattggtgacacttggcaagagaggagtgaagaggaaaaagttacgaggagagacaacttgaacatcatagttagggttgttcaagtaactcaagaagctgtagccgctccatccactgccaagaacgaccaccttcttcttccttattgggttgccatctgagtcaagagtagcgtctgcgtgtaatatacgtttcaatggattcgagtctgaatacaccagtacaccaccaccaccactggacaacaatacataaaaagacacaaaccaaaataattgttagacccacgttacttaaaaaaaacatagatctgagtcgaaaaaggtatgaagcttatagagatggtatgcattatatcatgcatcacagctagggaagaggccaaaagaggacaagcgaaaaattcggacacgtgcataggagtggtcaaaaacatcacaagactaaaaatactaagaaaacagtcaaagcatctataaagagaattggaaacaaaagagttatatagattctacagctaaaagaagaataagaagaagaagaagaagaagaagaagtgtagaatggtgaaggagatctaaaggagaataaggagagacctgaaagtgctgagaagaagaatcttggaagtagaagggtaagccttgaataagctagaagctctctggtaaaagctatggaaactcatgttgatgatttctcaaacctcagatccaaaagaaaacaaagctgagagctttggaagagaggctgcgaatgtgaaagaatatgcaatatggaaactatcaaagctactttagggtacgtgagagagaggtcggcgacacacaaaacaaaatttaaagaaaaaagaaaaaaagaaaagacagtgaggtatttaggaaattggagtaacgcccaagtaaatttaggtatattcttttttttttttttttaaagtaaataaacagcagatttgtttagggtttgactttctctcaaaactcgagactttaagcgacattatgttccgcgttccctggagattttttattattatatatatttggaattcgaacaactgttggattcgattttgattttcatttctgattttatttggaatactgtatatgataaagctaataagaagaatggaataaatacctcattcacttctatacatgcatgttacaattcataaaattcataactaaactttttatgttatatatgcatgaagactatgagattgtgcctttacaaactcttatcgattacaaaaacgatattgaggtaagtgcttttgaagatattaatagtttttaacaagaaaactattagtttgatgtctttaattaaggttcaatttatgaaaatg

SEQ ID NO: 30252 - DNA, 3000 bp, Unknown; identical to SEQ ID NO: 13106
  misc_feature (1)..( 3000): 2750-1469P.txt file - cDNA_ID_3028184; gDNA_ID_2214599; Annot_ID_135520

SEQ ID NO: 30253 - DNA, 3000 bp, Unknown; identical to SEQ ID NO: 13112
  misc_feature (1)..( 3000): 2750-1469P.txt file - cDNA_ID_3028184; gDNA_ID_2214599; Annot_ID_186977

SEQ ID NO: 30254 - DNA, 3000 bp, Unknown; identical to SEQ ID NO: 13114
  misc_feature (1)..( 3000): 2750-1469P.txt file - cDNA_ID_3028196; gDNA_ID_2214599; Annot_ID_186971

SEQ ID NO: 30255 - DNA, 3003 bp, Unknown; identical to SEQ ID NO: 26092
  misc_feature (1)..( 3003): 2750-1469P.txt file - cDNA_ID_3028206; gDNA_ID_2214599; Annot_ID_186964

SEQ ID NO: 30256 - DNA, 3003 bp, Unknown; identical to SEQ ID NO: 26387
  misc_feature (1)..( 3003): 2750-1469P.txt file - cDNA_ID_3028243; gDNA_ID_2214600; Annot_ID_187045

SEQ ID NO: 30257 - DNA, 3000 bp, Unknown; identical to SEQ ID NO: 13138
  misc_feature (1)..( 3000): 2750-1469P.txt file - cDNA_ID_3028259; gDNA_ID_2214600; Annot_ID_187041

SEQ ID NO: 30258 - DNA, 3003 bp, Unknown; identical to SEQ ID NO: 26388
  misc_feature (1)..( 3003): 2750-1469P.txt file - cDNA_ID_3028267; gDNA_ID_2214600; Annot_ID_187036

SEQ ID NO: 30259 - DNA, 3003 bp, Unknown; identical to SEQ ID NO: 26391
  misc_feature (1)..( 3003): 2750-1469P.txt file - cDNA_ID_3028275; gDNA_ID_2214600; Annot_ID_187029

SEQ ID NO: 30260 - DNA, 3003 bp, Unknown
  misc_feature (1)..( 3003): 2750-1469P.txt file - cDNA_ID_3028290; gDNA_ID_2214600; Annot_ID_187022
tgttctgttttcttttgattttcttcttcatcctgtaaaacctagaattttgtttcttcaaccaaaaatgaacagagaagtctctgagagaattcatattttgttcttccccttcatggctcaaggccacatgattccaattttggacatggccaagcttttctcgaggagaggagccaagtcaacccttctcacaaccccaatcaacgctaagatcttcgagaaacctattgaagcattcaaaaatcaaaaccctgatctcgaaatcggaatcaagatcttcaatttcccttgtgtagagcttggattgcctgaaggatgcgagaacgctgactttatcaactcataccaaaaatctgactcaggtgacttgttcttgaagtttcttttctctaccaagtatatgaaacaacagttggagagtttcattgaaacaaccaaaccaagtgctcttgttgccgatatgttcttcccttgggcgacagaatctgctgagaagctcggtgtaccaagacttgtgttccacggtacatctttcttttctttgtgttgttcgtataacatgaggattcataagccacacaagaaagtcgctacgagttctactccttttgtaatccctggtctcccaggagacatagttattacagaagaccaagccaatgttgccaaagaagaaacgccaatgggaaagtttatgaaagaggttagggaatcagagaccaatagctttggtgtattggttaatagcttctacgagctggaatcagcttatgctgatttttatcgtagttttgtggcgaaaagagcttggcatatcggtccgctttcgctatctaacagagagttaggagagaaagccagaagagggaaaaaggctaacattgatgagcaagaatgcctaaaatggctggactctaagacacctggttcagtagtttacttgtcctttgggagcggaactaatttcaccaacgaccagctgttagagatcgcttttggtcttgaaggttctggacaaagtttcatctgggtggttaggaaaaatgaaaaccaaggtaaattgtttctccccagccattattaaccaacatagtaatgttaatatttgtgtatatattcgtattgccaaatatgctctgataccatggcaagtaatagattggctcatgtattttatttgtgatcatgtagaattttcttaacagttatgacttggtgttggtatggttgggacaggtgacaatgaagagtggttgcctgaagggtttaaagagaggacaacagggaaagggctaataatacctggatgggcgccgcaagtgctgatacttgaccataaagcaattggaggatttgtgactcattgcggatggaactcggctatagagggcattgccgcggggctgcctatggtaacatggccaatgggggcagaacagttctacaatgagaagctattgacaaaagtgttgagaataggagtgaacgttggagctaccgagttggtgaaaaaaggaaagttgattagtagagcacaagtggagaaggcagtaagggaagtgattggtggtgagaaggcagaggaaaggcggctatgggctaagaagctgggcgagatggctaaagccgctgtggaagaaggagggtcctcttataatgatgtgaacaagtttatggaagagctgaatggtagaaagtagaggaagagaatatgtttaatgttctgagatagattattgactttgtgttcctctttggagttgttctttatgtcatcttagcttttgctactgtttagtaagagaaagtccattgtgtgtttctatataataaagaatagacctgaagataggcattttcaagtttctgctttaagataccaaatcttcgttgtgcatactttttacttcttgtgatcttactatgtgatttatatggcatggattatataggtcggattttctttgaattttaagtatataaatttgaagtaacaaagtatgtgtagtaatgatgcgatgaaaaattggtaatgaatctagggcctaaactagtatagtttcaggtttattccaccaaactcttagcgtatgtcacttggatccaccaaacttgatccaagcgttttacaaaattgtataccgagctaaaaataaaacattctttgttgtttccacaaaccttattttctaacatagcctacatgtctttctccttaagcactcattcttttggcctctcgactctttgaaaatctctcacattaagacttaatgttacccaaacctaattaaactactcgagaaccccatgttcgtgtccatgagaattctcactcaagtcttccctttagccacttacaaaactacttgtagaactatggctatgaatgatgacataactcgcacccaaaaccgcatcgtaacagtgttgtaatagtatcaaaatctttacatatacatatatatctatgtatttttgttactatttaaaccgcaccgcacttctcccacaccacaaaacgcagtcactattcggacaatatgttttaaaaacgctattttgccattccccataggctcatggctttaaatgcaaagccttcgaaatttatggctcatagcttgcacaatactcatcgctaagtgagaagtcaaagtttgcttctacgagaaacagaacacatgtgctgactcgattcccggtttgtagccaaccaaagatgacgaaccagaatacggcaacacaaaagtaaaatatgacgtatgcaaacacgtaagtgatcttcgttaattaattttttatctgatcttcctccactgtcttcttttaagtgcacacgtgcgtgtatatatctcgatatggccgaaactggaagaaacaattcagacaaagtcccaagctaagaaaagagactctctttgttttgtctggcagaatattttccattcttgttctgttttcttttcatttttcttcttaatcctaaaaccaaacatg

SEQ ID NO: 30261 - DNA, 3000 bp, Unknown
  misc_feature (1)..( 3000): 2750-1469P.txt file - cDNA_ID_3028372; gDNA_ID_2214602; Annot_ID_135579
ttagctaatgtcatcaacttattgactccaaggcaaatcatgatcgtatttgttttagttgtgagatgccaaacgagttgggtactttcccatgtgtctccattgactcttttcacaatcatttccattattataagagcttttgataattggtttctatttaaccatcgacgaataatttggtcagtctcgtctagtgtccaattgatagacatatcttagcatttatgattacaacgagatagatcttgacctctatattaaaattcatcattcatgtatattacgactaaattgatcttaagaagttcacatacatagttatgtttggcttttgaacaacagctgagatgctattgaattcctagggatagctttcaactgctccataatcgtctatttatcttctaagttagatctaagagagattgtcttcgtcttattagttaccaaatctagattacctgcaatagtgcggatgatcacctaacaaagaaaaaaaaaaaaaaaaaaactaatttgatgggctagacttttaagtaaaaggccttaggagagttgggccaatctttgactaagccccaagagtcataagacatccaaaaaagttcctaatgcatttgttaattgggaaaaatgtcattaaaatcccgaactttgttaaaacgttgatttaaatcccgaactttatttgaaacgaaaaaaatatcaaacttttgttgacttttctaataaatcttaaacttgtgttgaccgcgccattttagtcttgccgttatctgggttaacagacttaattgacagggttaattagacgttaacagagacataatttgcaaacgacacagtttcgtttttagtaaacgacgtcgttttatcaaaacgacttgctatgttttcccccaattcgatcagaaatcgaagaaatcacaagccctaaaaaaacaaaatttctcagttctcttcttctacgacagaattgaaatcgatttcgaaaattggatcttcctacgcaatgagttcaagttcagcgtcatcgggtgttgtccaaaaccgtggttttccggtgaagtgttggtgtggagatgatgtgacaatcttcacatcgaagagtgttgataatccgggcagacctttttttcgttgtgaaacgaaaagagatccaaagacgtggacaaacaaaaaagatgtaagtttgagtttgagtttgagtttgagtttgagtttgagtttgagtttgtgtttatgttatgtaacttagcagctaatcatatcggatttggtttgattgtgtaacagagtcatttgtttaaatgggttgaggatgctgtatacgaagaggttgaagatgttttaccaaaatttgtgatcattgcaaatgagcttaacaaagccaaatccgaggcaaatgagctaattgtgatgatacatgaactaaaagaagaagcaatgttgagtaaacaagaaatctgcaagtggaaagtgtgtttgaaaatatgtttttttggctttgtttgatcagcattttcattctttacatgatgcttggtaaggcaaaaaaaaatgaatttgttgttgcttaatagtgtaggtctatctatcttgttgtcttcggcaagcttgtaatgacaatgtagtatttgtgacttttatgactttgtaatgttggctttgttgctgtcttaataaaacttgtgagtgtttggtctttatttttcttgggtgaatgtgagtgtttggtcttgatataaggtgtgagtgtttggtcggtgtgagtgtttggtcttgatatgagaatcggagtaaagagatggaataatttcactcaaacaaaaacttgtcttaaaactatgagtgattaaaagtagttaaccaacatgtcttaaaacttgccgaaccaaaaatcaaacaacaaaagagacaacaaaagagacatctcaagttatgaaacaatccaaataccaacaaccaaagaccaatcgatgttctcatgtcaagtttgaacactcaaaccatgatctccatccttctactccttttcgattttttccttctattgtcaccatctaacctgttaccattctgtttcgatttttttcttctcctattgtcaacgacagaatgagacggcctagtagaaggctcgtgaacagcaggagcctcgacagaagcacgtcatagctcagcaacagacggaggctcgatagcaacagacggaggctctatggaagcagacggaggctcgatagaagcagacggaggctcgacaacaacatgaggcggctcaacaacaggaggaggcgggtcgacatcagcaggcagcttctttctcatcattacagtttcgaatttctcttcctcgatcgacaaaagagaattgagaatttttgttttttagggctcgtgatttttcaaatcgaattggggaagttcagtctttttgataaaacgacgtcgtttactaaaaccgaaactgtgtcgtttgcaaattatgtctctgttaacgtctaattaaccctgtcaattaagtctgttaacccagataacgacaagactaaaatggcgcggtcaacacaagtttaagatttattagaaaagtcaacaaaagttcgatgtttttttcgtttcaaataaagtacgggatttaaatcaacgttttagcaaagttcaggattttaatgacatttttccctttgttaattcaatcatcatgtgatatgtgaagataatctgctgtatgtagtaaataaattttgaagtcatctgattgtaataatgtaataatatatagaagtaaatgttacttattgggcttctctattttactaagatgcaaatgaattaatattttataatttatttattttgtcctaagtatacatgtcttttttgtcttttgtctgaatctttctcgtcggaaacacagatctcagttccttacagaagaatctccgactcgtttctttgccggcattctcagatttccggatactagccatg

SEQ ID NO: 30262 - DNA, 3000 bp, Unknown; identical to SEQ ID NO: 30261
  misc_feature (1)..( 3000): 2750-1469P.txt file - cDNA_ID_3028372; gDNA_ID_2214602; Annot_ID_187091

SEQ ID NO: 30263 - DNA, 3003 bp, Unknown; identical to SEQ ID NO: 25023
  misc_feature (1)..( 3003): 2750-1469P.txt file - cDNA_ID_3028400; gDNA_ID_2214602; Annot_ID_187096

SEQ ID NO: 30264 - DNA, 3000 bp, Unknown; identical to SEQ ID NO: 13155
  misc_feature (1)..( 3000): 2750-1469P.txt file - cDNA_ID_3028404; gDNA_ID_2214602; Annot_ID_187095

SEQ ID NO: 30265 - DNA, 3000 bp, Unknown; identical to SEQ ID NO: 13156
  misc_feature (1)..( 3000): 2750-1469P.txt file - cDNA_ID_3028408; gDNA_ID_2214602; Annot_ID_187093

SEQ ID NO: 30266 - DNA, 3003 bp, Unknown; identical to SEQ ID NO: 26401
  misc_feature (1)..( 3003): 2750-1469P.txt file - cDNA_ID_3028423; gDNA_ID_2214602; Annot_ID_187084

SEQ ID NO: 30267 - DNA, 3003 bp, Unknown; identical to SEQ ID NO: 26402
  misc_feature (1)..( 3003): 2750-1469P.txt file - cDNA_ID_3028473; gDNA_ID_2214603; Annot_ID_187139

SEQ ID NO: 30268 - DNA, 3000 bp, Unknown; identical to SEQ ID NO: 13183
  misc_feature (1)..( 3000): 2750-1469P.txt file - cDNA_ID_3028480; gDNA_ID_2214603; Annot_ID_187135

SEQ ID NO: 30269 - DNA, 3000 bp, Unknown; identical to SEQ ID NO: 13179
  misc_feature (1)..( 3000): 2750-1469P.txt file - cDNA_ID_3028491; gDNA_ID_2214603; Annot_ID_187130

SEQ ID NO: 30270 - DNA, 3003 bp, Unknown
  misc_feature (1)..( 3003): 2750-1469P.txt file - cDNA_ID_3028499; gDNA_ID_2214603; Annot_ID_135603
gataaaaggaaactttaatatgaaaagaagattatcatatttgagccaaaagtaattaaaaataataattttgttgctcgaacgacgtcgctttgctgggagcgcaaataatctccggcttctgatcaaagccgctaactcaggcagaggctttaacatgccttcactccagttcaccgccgttgtcttctctctcaccgacggcttaagttttatctgtcggagtagtttcaatgcggagtgggaagaagagagctcgctcagaacctggatccacaaagcaaccccgaagcaaatactccgacaacccaccggattttgcctcgttagcgtctctttacccatctttcaagccctttgttttcttctccggtagtcgagctcgcatcgactggaccgattacaacgcaacccgagagctcactcgtgtcctccttctacatgaccatggcgtcaactggtatgatttcaattgtacaaaggaactagcttttttgctctcaagaacagttagttatttaccaaagtcttatatatataggtggattcctgatggacagctttgcccaactgttcctaatagatcgaattacattcattggatcaatgatcttttgtcctctgggatcattcaaagtttgggtggtgatggaagtaaagtaaagggctttgacattggtactggggctaattgcatttatcctctccttggtgcatctctttttggttggagttttgttggctcaggtttttcttcttcttttattatacttcatctgcattatactagcttctttagtagttggctctatgttctcaatttggtgacaatgttgttttgtatgcagattttactgttgtagctctagaatgggcagagaagaatgttcaaagtaatccccatttttcagaccttatcgagatcagagactctaaagttcctccacagtgttcctctgtccctgaggttgaaaatacagagagggagaaaaccatacaggaggaagctgaaatttccgccacggttaagtctgattatcatgacaacaagagttttattgaaccagctgtactactcggtgttgtcaaggaaaacgaaacattcgacttctgtatgtccaatcctccattttttgagacctttgaagaagcggggctaaatcctaaaacttcatgcggtggaactcctgaagagatggtttgcaatggtggggagcaagcttttgtgtcacgtattatcaaagatagcgctgtactgaggcaaagattcaggtaaattgtacccaaataaacctttggatcttccacattctggttttccatccatcaggacttatcgttttgtgaacatgtttaatattaggtggtacacttcaatgcttggaaagaaggctaacctcaaactcttgatatctaagctttgggaagtgggagtgaccattgtgaagaccactgaatttgtccaaggtcaaacatcccgttggggcctcgcttggtcgtttatgccaatagctaggaagattatagcacctcctgtagtcaaaaagagcgttctttcttttatgcttgaggtattctatctataactttcgtcatcctttacttatatttgttctgtaactatataaaagtctcgggctttacaaaagccttacattctccatggtggatttgtgtgtttatagtgcattaaacggcagtacagtgccgtagatgtgctgcaatcagttgaagaattcttcaagagctgtggcgcctcgtgcaagttaaactcttctacattttctgttgacgtaagtgcactacctgtattgttttgtcttgccatccaatcttgtttctacagtatctcaagctcaatggagtttctttctattgttgtgcagattgttgcatctaatgaccagtgcaacacaatctcaaagaatgacattgcagatgtagatagtgtaagaagccatggatatgaaaaacagtcactggatggctccagtttgcaagtccctgaatataacctatctttccgcatcttggtatgtttggatttcatttgagaaatccctaacaattgccttcaccttttcgaattgtttatgatgaagaaacttcttttacaggtgttccaacagatgccaggaacgttgcttataaaaggatcattgcagcagaaagatagtcccctctcaggttagtcattttgctcggtttccctaagttgctggaaaaaatttcacttctttattcatgaatctgcaaaagctttggttctattcatttgatctcaccaaaatcgcgaagtaccaaaactttcgctgttagttaccaacgtgaagacaactgaattgtcggtttaattttgcatatgcaggattgttctccagggtcttcggttcgttggaagaaagtttgaagtccaaattttgccggtaacgagtcccagggtactgttctgacttgaagactggcatctgtcaaaaactaaatgaaaatgatgaatcttcaaatcttagacacatgacatgttcttacacacaaaaacaagccgtcttttgaattgattcctacataaactgagacaattactctcaacagaagcaagcaaacttttttcagctaatcttgttgtggatgaaaagtgttgcatagcagaccactcgtgtttctcaactgcatatataactagaatcaagacttgaaaagacttaccttacggggaaagatacacagagccaagttggattacccaaaagtagtaaaggagagagagagagagagggttcttcacttcacgtgactaagcaagttacttttgcctttctctccagtttctctttttgatcaaccatcgtttgtgatgaaaaatgtaagacctctaccacctatatatatcttgcattgcatgtgggtgtagttattttgaattgtcattttctcttttcgcagtgaccacctatatataactttggtgatccctcaaccctttgattcatttggaaagatatg

SEQ ID NO: 30271 - DNA, 3003 bp, Unknown; identical to SEQ ID NO: 25026
  misc_feature (1)..( 3003): 2750-1469P.txt file - cDNA_ID_3028499; gDNA_ID_2214603; Annot_ID_187127

SEQ ID NO: 30272 - DNA, 3003 bp, Unknown; identical to SEQ ID NO: 26105
  misc_feature (1)..( 3003): 2750-1469P.txt file - cDNA_ID_3028503; gDNA_ID_2214603; Annot_ID_187124

SEQ ID NO: 30273 - DNA, 3000 bp, Unknown; identical to SEQ ID NO: 13187
  misc_feature (1)..( 3000): 2750-1469P.txt file - cDNA_ID_3028507; gDNA_ID_2214603; Annot_ID_187122

SEQ ID NO: 30274 - DNA, 3003 bp, Unknown; identical to SEQ ID NO: 26405
  misc_feature (1)..( 3003): 2750-1469P.txt file - cDNA_ID_3028511; gDNA_ID_2214603; Annot_ID_187121

SEQ ID NO: 30275 - DNA, 1743 bp, Unknown; identical to SEQ ID NO: 13198
  misc_feature (1)..( 1743): 2750-1469P.txt file - cDNA_ID_3028536; gDNA_ID_2214604; Annot_ID_187183

SEQ ID NO: 30276 - DNA, 3003 bp, Unknown; identical to SEQ ID NO: 25028
  misc_feature (1)..( 3003): 2750-1469P.txt file - cDNA_ID_3028544; gDNA_ID_2214604; Annot_ID_187175

SEQ ID NO: 30277 - DNA, 3000 bp, Unknown; identical to SEQ ID NO: 13195
  misc_feature (1)..( 3000): 2750-1469P.txt file - cDNA_ID_3028552; gDNA_ID_2214604; Annot_ID_187169

SEQ ID NO: 30278 - DNA, 3000 bp, Unknown
  misc_feature (1)..( 3000): 2750-1469P.txt file - cDNA_ID_3028554; gDNA_ID_2214604; Annot_ID_187168
aaatttacgacgatagattaggctgacggcccgaccacccgttatgggtcaataataaaggcccattaacggtataacttagcaagataacaaacgaagaagaaaagtcgttgacaaaaagaaaaaaaaaacacgattttgagacaatttgccgattcctcgatcatttcatctgctgaataacaacagtgattggctcttctgattagcaagcttcttcttttcgaaatcgcatcactttggctgatcggtggattctacgaaccatgttcaatttctggtaacatcaacttcatgaatctgatttttgtgattatgcgattttgttaccctcttttacctcagctcgattatgctgttatctaattttgattatgatcgttttggagaatttcaatttctatgtgtttgggattaaagaactctgctttttgttagttacttactgttttatgcataccattgatggctcttatagttagttgctgctaacatagttaaggtgaacaaaaattttagttgtaatcattaaaagaacctgatctatgctcatgaagttgtgctgggtcttaagattttgcaatgttagtatattgggtattggaacagtttcaggtaagtatttttaagattgttgtgttaaaaatccaggggatcaaaagaacagcaacaaggacaatctcgtccttctccagaagcttctgcaacaccgtggtattcgccgtctcttgtcacctctcctagctcatcccggcctcaaacctcagggcagattccatcacatgtttcaccaggtgaagccgccggcattattgccattttaaaagacaaaaggttagtcttcaatttccttataccttcttgtttgcctcttttgtacatgatgtataacagttttcttgtgtcacacagtcacacatttcttgtcatctttaatatgaatttatggtcttttaggcttggaatagtttagattaacgctagaccaaacactagatttactggttctgtggttttgatagtttggttgctgatagtctcttgtgattttgcgttgtgttactaatttgcagagatatataaagggaattgatttctgtacttgtcggtatgttatcttgtatgcttactcttattactcatttatgatgttcttcaaatgttttgctcttagtgtggatgagcttaggaagcttctctctgacaaggatgcgtatcaacagtttctgcactcgcttgaccaggtcactattcaaaacaatgtaagtgggaaacatgatgtaaaaatcatctattgtcttaagaaatgtagcttcttcattatttacgtttttgagatgattcagttttgtgctttttctttatatgttcattagatcagagaagagcttcgcaaagaaacgttacatctagctagtgagttcttgtatgactttttttgacgatgacaattatattcatattgcgagatctaaaacattcatgctaatataacaggagaaaacttggagaaggaaccacagatagtggagctcagaaaccaagtgaataatatcattcaatctctgagtgagttaattaagtatatgaaacttctctccatttgtataatctttttaaaaacagtgcagaataatccgtacatccgagcttgcgactgctcaagagaagctcaatgagcttgagaatcaaagagaagagatcctcaaattctactctccaggttctcttcttcatagacttcaaggtaagtaaaaccattagctgcttcactcaatatccttcatgtgtaacaacaaaatgatacatgtcggtttctaatacacaatcccgggtttgtttatcgcagatgctatgaaccaggtggatgaagaatcagaggagctgcaacagaagtttatggagaaggatattgacacagctgcatttgtgcagaaatacaaaaagctaagaagcaagtatcatcgacgggctttgattcatctcgctgctaaaacttcatctattggctgaaaacaaacttacacgttttgttttttttgcttccgaccttaattcgatgtgtaagtaaacaaaactggttaaaagtcgagatctatatacgagatcaatatatatcattgtattacataatcatgttatgctctatgaatctgaatcttctatagttctttctgattttgaatcttttgttattggttcgtcctggtttgggtgtggaaatgcacaattatgttcagatgacgtggaatgtgtccaatttttgtctttgtttaggaaactcacaccacaatttaccaaagcctcattcattctttgacgtgtccttatggatcatgaagactagcacgactcacctacaagtcaattttaaataatataagtaaaccatatcttaacttactcattcatataattttgtagttaattcgaaggtggtcttacgagtggtgactaataatattaagcctcactgaccctaaaaactgctcagaaaatttgtctaaagatttgcgtataagaaactttgagttctcacaataaataatagcggaaatatacaatttggttgatcccttgtttaagaaaatttcccggtttgcatgctcaattttatcatttcataatcttctgcatctataattgaggaaatttagtaaaacagagaaagcagatagaggaatcaatataccaatcgttaatttaaaatagtaaacaactagatttgaacataaaatcgaaactaaaccgaaccaaaccaaactaaaccgaaatcaataattttggaatatataaatttcattagtccccactatctccgctaaaacatttgagaacgtctctctctctctctctctctctgacagttctttctgtctctctctctgctcgatgcgaagaatcgagcatttgtgtcgctctctggaacgtgtgtcttcatcgggaatataaccataatctccacgagctgcttgaatgcgtacccttcgttccctaatg

SEQ ID NO: 30279 - DNA, 614 bp, Unknown; identical to SEQ ID NO: 13209
  misc_feature (1)..( 614): 2750-1469P.txt file - cDNA_ID_3028580; gDNA_ID_2214605; Annot_ID_187211

SEQ ID NO: 30280 - DNA, 3003 bp, Unknown
  misc_feature (1)..( 3003): 2750-1469P.txt file - cDNA_ID_3028587; gDNA_ID_2214605; Annot_ID_187208
ctagaaactccattgaagtattacattactttattgcatggttcttatatatcatatgaatgatttgagatttattgtaagtaaaaaaataattaacaatgataaatgcatctacaccgattaggcgctggagctgatggaactgattttatgcacataccagccgcttgcttaaacctccttacacacatctttttgcactcaccggtaacacaaaggtttacatctatagtcttataacactgttgtttatatccttggtccacgtctcccaccgctcctattaaaacaatgattcaaacttattatcttaatttcaatatttaaaaagtaaaaaaatatatactattttatccatttttcgagaagatatatatctcgaagagtttcatgtctattaacaaaaaataatctgtaacataaattatgtattttcttattcactaattcttcttgaaaaagtgtcataggatggtaacaataatcctcaataatatgataagaccatatcctctatatattagcagggaatttgaaaataaaatatttagggatcagtgtgctagggtatgcattcggcctaagaggagacacaactttacattatggaattatatactgtattgaacaaaaaaagatttgacacatattaataattaaaacataggtgaattgatatttagaagaatgatgctaagtggtgcacaaaaaaagaagaagagaaaaggtaactaaaacttttactagtcaaccagattttaactaaattgatttttctaaaacgaatatatgtaatatattaaaattttataaagataaatacaaacctaacacaaaaatggtgaacataatcagaatagcaaacgagagttgaatatgtttgcccatcatagatgatatacatgatttgtttttttttttctaaattgaaaaagtaagaacaaattgtagttatatacatgttagatgtctaggtactattcaaacatatctaatttaagctatctcccacctaagattccgaatgaaaaggatctatagtttgacccaagttctcgaccatttgtttattttatatgtaaaacgctttagactcggttatttttttcttctttacaatctacatttgacattgctaatttaaccaaaccatcgtcttcaaaaccacatcgctaaaaataaatgacctataattctattcaagtttaacaaaaaaaaaaaaaacaattctgttcaagtatcttttttggttaaagttctatttaagtatttattaacaaatttctgcagttgttttgatttaaatgaacatagtaaatctacaaaaatcacgtgagttcacttataattgttttgggctgaaatggaattcggatcccacatgagtaatgagtaacttgaaaattcgatcttaggtgacttttaacagaaaggatagcaaatcctgtgaagtgtgtgaacagtgaaagccaaagaaagagtcacgttataatacatgtgaaaccaattaaaaccaattacgtaccaaccgtcaaatatatcttttgacacatgaaacaattaatcaagaatacaagaggtaattaataaatcaaaaaacaacgtaaaacaaatcattattacggttttgtttagagaaaaatatatgaaattgaatggctaatgcaaccggaagccattaggtgattatttcacatgataattttttaggtgattatttcataaaaacgcagcactaaaaaccaatattcttaacataacataccaaatgaagttaatcataaaaataacgtaagatacaagactcaatctcacaacataaatggaaggcgtgaagggaagagatgcatgcttgacccctcttgtgccattatagattagagatcgatcgatgttgtgttccaaggcaggtgtgttattattacactcactcacataactctgtttgtaatatattaaagaaaatatatattgttgctgatccttcaagggaagaagaacttgaatttaattatagattgccaaagtgtaatgattgttcctacttcctacttgtgattctactacttcctaataatgccttaattaaaaaagtataggatgctaacaactaaaggtatgtgattaagtatcttatggaaccagatctagctactcaaattttctaattcgtaattaggcaaagtataaactcacactacaaaaaaatctaagtctagcatcaattttttaaaaaagttagtgttgcttttaaagtgacactagaattatatagtcattttgaaaagcgatgctaaattcagtgaagctaaaaatatttagtatcattttttaaatgacgttataattcatggttaacatcgttattttttggatcttgaaactaagcacaaaatataaacgaattttatttctgtttgattttgcataaaacattttagtaaaacaatcaattaatattatagatgctcaaatacttcaatatatttttgttattaaaatcatttattggatttagcttaattcggttagtttgattctgttagactaaatttatttagatttatacttggtatataaatttttacacggtttaatttgattggagttcgaattgatgaattttggtttgattcggattgattttttttggtccatccctagtttttatggtcaaaaacaagatcggtttagcaaaatctgaagactatttgggttttcattgaaccaaaagatttcaggaccatggaaacagagaaaaagtaaaaattatgttgggaaaaggtagagaaatcatgagaaatcatattgttcccttatgtaaatgtcttatctttttcacccaccagattattattatcaatcccaagcaacaaccactttatttcacatcaccttataaataccaactttcttcatagtctcaacaaatacactacactactcaacttataacctttctacactttcaagaaaccaaacagaagctgagttagagaaatg

SEQ ID NO: 30281 - DNA, 3000 bp, Unknown; identical to SEQ ID NO: 13212
  misc_feature (1)..( 3000): 2750-1469P.txt file - cDNA_ID_3028591; gDNA_ID_2214605; Annot_ID_187205

SEQ ID NO: 30282 - DNA, 3000 bp, Unknown
  misc_feature (1)..( 3000): 2750-1469P.txt file - cDNA_ID_3028595; gDNA_ID_2214605; Annot_ID_187202
tgttccagcagaatcaagctctttgtcttacacgacagctatgacacatatctcaatgagtctttggaacttcgaatttctcctttagctaacaaattcagtcaaaatatttcagcacacgagccatatgttttatacaatatagtttttgcaattcagtcaacatatcataataatgcattcaacatctgaaatttcttcaatcatacaacaaagccgaccagatagtttcattgtacaacaaaatgaataaggtcgtcgtctacaaaacaattcccagtttccaagtattgggtttgaagaaagttggttccaaacccaaaacaagaaagaagaagaaaaatcagtcactatacaccgaaaaacacaccatgaaaacacatcttgctgagcagtatcgtgtcaacgggatgcaagagaccagaaattgaagagaaacgaaggcaaagcagcgaaccagcttatgaaagctaatgccgttgatgtttcaaactgaacacagtggttttgtgcgcagctattcagatcgttgtctattagaaccgttatgcctgccgatgcacaagctgctgcaaaagtcagcgtcgatgtcacctgaaataatgttgaaaaatgcttatttgtacacatctcttttctcatacgattttattaaattgagaggctaaatggtaaatctcttaccccatcaccaattgcaaacaagctcacaagtcgacggttctgtagagagcgtttgaccataatggcatagacgtcaaccatggctagtgcaagactccacaagctctgcagaccagtagctgcaactaggtagctgatgaatcaaatacagtaaaccatcttagcagattctaacagtcaccaaacatggtttaatcacataaaagcataaaggtttaacccaatatactacccatcccgtacaatcggttcaactatcacattatgtccacagcttaacactgctactacaaagattcattcatctggactctagaaaatttgcaacaggagacctacatacaaagtacaccagtgcctgtcactaaggcaaacttacctaagtaaccactaccagacaccatgatgcaaagcatgattaataaccaaattaaacaacagtgaccaaatgaaaaacatgatatgatagccattttatcaacattaacttctcgaagaaagctcatctagttaaaatgatctttatgaccatgatatatcccggattagcagctacatcatattactgggcaccagtaataaaatcccctatacacagctgttaactagcttctaataagccttaaagatactaatagactagcaagcctcataacttatcatattaagccacaaacccgatgcttattttgtattgcactttcggaaatggaaacaacaaaaagcagattccagttcatagtgtatagcatattggaagaaagatagggtgctatcacatccgattctgataaatacagattctcacagaagtttatagtaaagcatatattcgatttctaatagaccaaagtcttaccagaaggcggtaacggaaggaaaatcactagtagaagccatgacacaaagagcagcagcagcaaacaagaactgaaaaaaacgcaatgcaagaccaagcaatgttccaggcattccttccatatcatccatcctcacccgaggcggattctctacttccgtcgcagctgcaggaggatcttccactggatgtaccgatgcatggctcacattcatttcttcttcttctttcctccaccaaactcaaccaattcaacacatctctctctcccttcctcttcaccaatagctgaattacaaatctaacaatctactactactcaaatctcccctacctgtattcaccaaattaaaccacaatttatacaatctaatgataactcagtacaaagttcaaggaggactaaatcaaacatagaatcaaatctccgcgatagctaaactaaatccaaggttacgaaattgaactagatttggctccggagaagtaaagagaaaacgagatccaatcaattgagcacgtagatcgagtaagggattggtgtttacctgagagaattaagaagagaggaagaaattgaaagcagccatggagcttgggtagaggaaattaagaaaatcctaagctatatttgagggaagaagaagaagaagatcgtggaaatggtttttaaggtttatgcgaagaagaagaagaggtgtgggtgttttgatcaaaaggaagaatatagcttgacgaaaagagattaaccattaaaccaaatttagaggtcaattaaacttcttaaggggaaatataaccaccaatctatattttcttttgttcacattttttttggtttcctaaattatactttaaaatatatctttttttaagaaacaataccacatatattttttattttttccctttttacattaatatgggtactaattttatttcaaatattatcagtttatcactaactatgatttatattgtagcaatttagcatgcttttttttgttaaactccaaaatgtgatataatttgtgatgaaaaaatttctgtaccaaccaaacgacaatattgcattttatttttttgtcaaatcagtcatatctgctatagattttttaattataatcaaatttaaattaataatataagatgtctatttaagtataatcaaatttaaattaatactgtgtaacaaattttcaaggttaatatagtactttttatgttttatttactaatttcttattatggttctaaactggccaatatttcgcggctttacattctttttggcaaatttctggttggtaaaaaaaaaatttgtaagtttttagttcgcataactcgggtgtcggccttctaggatcatatattaaaagtatgaattcttcaagcatttaaggcttctaagtaaggtatgttcttcgatcagcgacgattaagacaagtagaccatg

SEQ ID NO: 30283 - DNA, 3003 bp, Unknown
  misc_feature (1)..( 3003): 2750-1469P.txt file - cDNA_ID_3028610; gDNA_ID_2214605; Annot_ID_187194
attactctagtatagttactttaatacttcaatgttgtatatgatcaatgtaccacgctaaatctattaaatatgtgatttatacaaaaatttacatgtgaactattttttaaaaaactttatctacccagagattagttttgaactcctccacaggtggtgaggatttatcttcaattaacaggaaaaaaaaagtttatcatcattcactctaataaatttatttctccagttttccatcttcattttttgaaagtaatatatattaaaacttgtaaattttaattttataaaatatttatattttacagtttataattgttattaagtaacgctataccacgaatccatgagacaattgttaaaatttttaagttttaacccctattaaaacagcatattaaacatatttcaaaattttataaatattgattcaaatacatctaccatataacccaattccaaaataaaacccgttctgtaatttctttacccgtcccgtggtttttttaaaaatagtaatttttaaaatttaagaattattttttatatataaaagttttgcaaattgtatcattctctaatacatttatattttatagtttaattttatatataataacattatacataccacataacatttttggttttatataaccttttctaaattaggatgatttgatatgtttaatattagtggtcttaaaatataataaattaaagatttaatccgtattgaaattgtggattaattatattttacttttttattaatgttgattcaaaaacccgtccctccaaatccgtcttgccaaaaagccatttattttattaatattaattttattaatgacatgactctgaattataatctaaacattttatctaataacaaatgagtgcaccatatttatttaataggagactgtaccatatgacccgaatgcacttttatccaaatccaccaaaaaagtcttgcaaaaatactatagagataagaaacgatagtcggttttgataggtataagattagcaactatataagttagcttaaattagttaaagaatacaaattgaaaagatatattacactttattcgaatatagtatcaaaacttatataacacagagatttgataattttttaattattgaatacattttttgtgctaatttttatgtgattaagatttaattgatttcgtatataaaatattaaattgttttacgaacttatttgtttataatttggtaacagatagatatttgaatattcagatctttgatgacccgtctttagatccaataaaccctataatctagttattaacctgcagtataccgcaggtaggcttatactttagttaaactaaaaacttttattgtaaagatgatttaaatatatatgatattattttatttgattttaaatgtatagtaaactgtgagttgtatatgttttgttgatattatctatattgtttagtgtttaagattatacacttgtagtttggttgttaatttaagagtttcacctgtagtatatcatcttgtattaatatcgatctaaatccgtccattttacgattttccagcttgtattaaaaattgaatcacatctaatatgttattaattactgtagtatataagattataaattttcaatataatatgtgtgaaattgaatagaactatttcaaattatgattcgttactcagtagaaagttttcttaaatctatttttctcccgttataatattttttcatgtattgaacagtttatattcgtttttaaaaatttaaattatggcatatgcgaaaaaaactctaattatttgtttataatgatgatattatttttcggcaaaaatagaatcatataaagatgagaagtgaactataataattaataaaaaattaatatgataatttagatattaaatctaatttgttgattttaattggttacttttttggaaattaataatgtatttcgtttttctaattaaattaaattaattaaaatttagatatcaaatcttatatgttaattttgattggttattatttttggaaattaataatatatttcgttttttaattaaatttaattaattaaattagtatttgactttttaatctttaaagagataaattaatttactctttaaaattttatttctaatggtatacccatgtaattacttacaaaaattaaggttacattttaaaatgtacttcccaaataatatagtaggattttattaatttttatttgtctttaaacaataaagcttaaagcaaaagtgaaaccaattacaaatttacaacagttgcgatgtgtctagaaaagcgaaaaccgattttaaccctataaggccagaccaggccaaggcctatcatatcaaaaagggcaaaaacgagtgaatttggacaaaatcgaaaccaccaatcagaaaatatatgtggttaaaactttgaacacatcaataaacacgaaaagggtaataacgtcatttccataaattcgtaatcattcgtcctcaaatctttattgtcacttttacaaaaaatactcccaatttcagagaaacctgttgaaaaaaaattcagggaaaattggaaaaagtgatgatgatgacgagagatcaattcaaatcttaagtcctccaaattttaaaaatttcgatctccactaccttcgtcatcttcctctacttctgattctcttttctgggtttgtcgtttaatgggttgattttgtatcgtcaaaacggagaaaacaagaagacttcttttggttttcttattgcgaagaagatatttctagggtttcgagattttctgggttttctgggtttttgtgtgttctttgattggatttgattattgggcaatttccttggaattcaagaaacttctaaggttcttaaagtgtaaagctttgtgattttctcttattcatacattctaggactttggttttggagttgtaatg

SEQ ID NO: 30284 - DNA, 3003 bp, Unknown
  misc_feature (1)..( 3003): 2750-1469P.txt file - cDNA_ID_3028614; gDNA_ID_2214605; Annot_ID_187193
gaacgaatgaaaatgcaaaggttattattactactattttggggatagtgtttgggacttttattggtatcacattaccttcactttcgtttaaggtatgagttttgtttttcataggtccttttatgtgtccctttcatttttgcacctgttgaattttgtttcgtattcctgcagattaacttaccctcgcgccttatatcatctcttgatgtagccatatctggtgacaaatcccctgaagatttcggttcaagaaagtttcctgaggtatataataaacttcttgttcggttccctttcgttagcttttcgattatgttctagaatagtgcctcatttcagatgaaatgtatcgtttctgtatgtttgattgcagatatatgttccaactaacccgcgtggtgcagaactactacctccaggaatcgttgtggcgaaaactgatttttacttgcgtagattatggggagaacctaatgaagtattgacttctcattctatatttactttctcaatatatatggttttatctctgaaggccattagaatagttaatgtcaaaacaataacctttgcaggatttgaagaagaagccaaaatatcttgtgacatttacagttggatttgagcagaggaaccatattaatggagttgttaagaaggttctgcaatatcagcatgtgttttagcaagtattgttttatatattctttgtggatacactcagattttttgttttcttgtcatatcttcagttttctgaagatttccaaattttgctcttccattatgatggccggacaactgaatgggaccaatttgagtggtcgaagagcgcgattcatattagtacaagaaagcaaacaaaatggttagtcatctggtcatttaccggttattaagtatgtttgtcgagtatgtttttatcgaaattctctactggttttggcaggtggtacgcgaagaggtttttgcatcctgatgttgtgtcagcttatgagtacatatttatatgggatgaagatcttggagtggagcatttcaatgcggataagtaagttattacttgtctgaagtagcagaacaatcttatattttacattttgtgatggaattctattaaaacttcaggtacattgagttagttaagaagcatggtttagagatttctcaaccaggcttagagcctaacaatggactcacatgggaaatgacaaagaggagaggtgaccgggaagtccataagtaagatctccttctctaaccattcttctttgcctttctttcaaatttggttctgaattaagaaatgtgttgttacttactgttgaacagagatacaaaagagaaaccaggatggtgtaaagacccacatttacctccatgtgccgcgtaagtctctctttgaaacgttctctttagagcaactcaagagtgtttagtcattgtcagtactgagttttctgaaaaaaattccctctcacaggtttgttgaaataatggcgcctgtattttctcgagaagcatggcgatgtgtgtggcatatgattcaggttcgtcgatctgtagatacatagtcctagtcttagtccatcaaaataatgcttgttgttttgatcagtttgtttatgtttctgatgcagaatgatctggttcatggatggggtctcgactttgcgcttagaagatgcgttgaagtaagttgtttttgccccccccttgcttaccttaataacacaatattctcttgactgatgatgaaaatttgtgtgttttgcttttgcagcctgctcatgagaagattggtgttgtggattcgcaatggataatacataaagtgataccttcacttggaagtcaaggaaagtcagagaatgggaaagctccatggcaaggagtgagagatagatgcaaaatggaatggacaatgtttcagaaccgattggctgatgctgataaagagtatcttgggaagatggtgaaagattagatttgtttttcttttttctttctatataattaatatattaaaaaaacttttacttttgtatatcaaatattttacactaaattaggttttcataggacatgtgtgaagccctttttattgatattgtgtaagatttatacattttgattgagctttattatgttgtttgttactttctccatttcaaattcttagatgtttttaaaaagaaattgctttcactaaacaagagagaagtgaaacatgtaaaaaaaaaaaactttagaaaacaaaggtgtaatagaagtggttgttattacataatctttttgacttctgaaaagacaataagaaaacaagacttataaccagtttcatgatttatctatttcacccaatttcataaattggctattttatatttgctctcaataggtaacgtaaatggtagagaaattaaggagaagagaagggtattggtatggactttggagtgagtgtgaagctttacaccaaatccaaataatttcaattttcattttagtttctattttacaatattttgcccaatagaaaaagtatgagaaattcagtttcaccttcctttttgcttttagttcaagtcaattgtttgtccatagaaaaccatacaatgtctccctccattggctgtttcatttcagagtcttttttatggttaagaatttgctatcatatcattagtagaagtctcttatgaggaaaaacaaatattaagcaacatcattatagtttttctcatgtatcttgtgcgtaattatgtaaatgtcataattattaaaacatgaaattaggaagaacagaagtttggtgttagacaccaaccatttttatacaaacaaataataaaaatctcattatatcacctttgcatttcatcactcatcacattcacaatccttctctttttctcacatcaatatatatctctctttctctctcttcatttgatagatttgaagatttgagaggagagagaggaagaaaaaatg

SEQ ID NO: 30285 - DNA, 3003 bp, Unknown
  misc_feature (1)..( 3003): 2750-1469P.txt file - cDNA_ID_3028618; gDNA_ID_2214605; Annot_ID_187192
caattgagacaaaacaggccaatttattggccggtgatattttcatgtttcccttatcttatttttttgttaggagtataatttaattattttgtctgtcttttgaaatgtgtagttaatttctaatgaaaaataaaaataaaaagccaccaatcatgttgctccaaaatatgattacctttctacgaaaggggtcaaggtgataaatgtaaggaaaacacctcgagagactaaatcatcattacctctatcctttctcacaacataatgggctaaaatatgattgcataagataaaaatggatttgtatattacatgttgaatccaaaacagtagcattaagagccattttgttagattcacacatctttggaggaagaaaaccataaaacaagtggtgtgagtgtgtaagagatttgtctttttgttttggaatatatagaagacacaagtggtgagagtgagtggtaataaaaaaataacaaacaatattgtgtaaattgtggataaagataacaggagagacagtgggagaagtgaaggcagtagcagacatgcaccaaaggaaagctgaaatggctaagcactctgatgcttttatcgctttacctggttggttccttttcattttcttatccaccattttaatcattagattttatacaaaatgtgattagtaaaatgggaatttataatgttgaatgttattatgtaggtgggtatgggacacttgaagagcttcttgaagttatcacttgggcacagctaggcatccatgataaaccagtaatcattttgcttccatttctatttatatatattacattatacattcctaataacttgaagtaatcttagactaaactaggtaattaacaaggaaaaataactattgccatcaaatagtgaaagaaaatctcctaaagagaatacattattttttaggtaacacgttattttagttctattttatggacatctttttttcacatacgtcctaaccaaagtaaactctaaaactctaattttcttttagtaaattagacgttcacattagaaataatctataacgaacgattaatcgatcgtgacgaaaatcgtaaatgattgataaattcgtcaaatgaaaatttaagtcattactagtttcttaaatgccatgttattagttttttttttaccaataataattcttaatgttatgaatgtgaaggtgggactgttgaatgtggaaggatactacaattcattgttatcattcatagacaaagcagtggaagaaggtttcatttcaccaactgctcgtcatatcattgtatctgctccttctgctaaagaacttgtcaagaaacttgaggttgctttttcacttttttctttacttgtttgactattttctgtatagtttttttttttaacttctgtggatttgaaaaaaataggattatgtaccaaggcatgagaaggtagcctcaaagaaaagctgggagatggagcaaatagggctaagtcccacttgtgaaatctcaagatgaaaaaggactaattaatttccttaattaggacaacccaattgaatgatctctccaaattgggaccctctttattgattgtaaaacttagtccaagcaaaccggggaaaaaacagattgactttcttctttttgtgtagttgattctgttgtttaatgtattttttttagatttttattcgggaaaaaaaaagaaaagacagaaaatatgttggtttttttagtttggattttgtaatatgtcccccaacaaacaactcaattttatagtttttctttctttctttctttctttctttgttgaattcttgttctctagagttcctttttgttgtgattatagtaaattgagttttgatcaattcagattgaagttacaagtctcttgaacccattttataccactaaaaccaaagtataacgtaatacaccattaaacaagactagtaaccccttttgtaaaaagttgatttactaattctataaagctgtaaaatagtgaattaaacctttttgtaagaaaaatgatttactaattctataaagcaggaagcatagaaaaaaaattgttaatcaattcgtattatactaatgtaaaattaaaattgctcatattaaaaggtatttttgtccctcaaaatttacagtaaaaaagccaagtaacaatttttcaaaaaaatataattctaagcccaatcatggagttgctgcatgtacatcagaacatggagtcatggaccatctatgggctcagtcccaaacttagcccatatgtttcctttacagtaatcttattcttcttattcaacacatatttcttaatgattctatttcctttgttgtcacaaatgaaagtagttaagtttgactgattacgagatttagaaacaagaaaaaccagttttaattttcaaatcttgttggctccaaaagaatgtaataaatgagttgtgtaataaaaaaaagacaggaacaaatgtatgtaatgtcctaataatagagcttatcttttgattaattaatcaaaaaagtttgggccttttaagaatttaaaaaacctccaaaaattcgacgcaaataggcctctccaccaaatctctctctctttctctctgtcacactctttatcactctctgctctcacagatcggagaatctcctctgagagctctaatctctcagctttcttcaccggcgtctccggatctaataatcctgtaaggcctgtaagtaatctcatttttattttcaagatttatttgcgatttcatctcttttatgctgaatttgattttcgatgtagccttgttttagctatcagtattacaattagttatcactgtgatatatatcttctctgaagtattatgtttgcgttttgaagctactgcagaaaaaagattgaatttttacaatttggggtgactcaattttgttgactagagtgtttggagatatttctaactaaatg

SEQ ID NO: 30286 - DNA, 3003 bp, Unknown; identical to SEQ ID NO: 25043
  misc_feature (1)..( 3003): 2750-1469P.txt file - cDNA_ID_3028639; gDNA_ID_2214606; Annot_ID_187248

SEQ ID NO: 30287 - DNA, 3003 bp, Unknown; identical to SEQ ID NO: 25042
  misc_feature (1)..( 3003): 2750-1469P.txt file - cDNA_ID_3028650; gDNA_ID_2214606; Annot_ID_187245

SEQ ID NO: 30288 - DNA, 3000 bp, Unknown; identical to SEQ ID NO: 13235
  misc_feature (1)..( 3000): 2750-1469P.txt file - cDNA_ID_3028660; gDNA_ID_2214606; Annot_ID_187240

SEQ ID NO: 30289 - DNA, 3000 bp, Unknown; identical to SEQ ID NO: 13225
  misc_feature (1)..( 3000): 2750-1469P.txt file - cDNA_ID_3028664; gDNA_ID_2214606; Annot_ID_187239

SEQ ID NO: 30290 - DNA, 3003 bp, Unknown
  misc_feature (1)..( 3003): 2750-1469P.txt file - cDNA_ID_3028674; gDNA_ID_2214606; Annot_ID_187231
tggtcattgcaatatatctgatgtttatagtttcttgtatctttagcagatctttagcagtagttaattattacgtttagaactcttcacatgaaacaataccaaaatcttttgatataattaaaaaattagtgatgaagtcaagtcactataatcatatttcactaaattgtcttaattatatttttttaaacatatgtttataaaagttttatcgtatctacaactcttcatgatatttttggatacagttttaagaaaaaacaaacaacataatgatatcatagttcactaaattgtctaaattatgtatatatttgtttttggtcaaatgtctcaattatattttgtatatttttttttttgctcaaatgcctgatgatataaagcaaataaatattctcagcattgaacatataaattccgataaatatcacaaaaataaaaataatcaaatatcttatatcggataagaaaatacaaaatcagtcagtacaagaaaaaaaattaggtccaaaaagtttttatagaacacaaaaaaaattattataggtttgatccgatccgatttgacccgactcaaccttacccgaaatacaatatcttgaagcatgttttaaatgattaaaataaaaaagaataataaaaactaaagagagtaaaactcaaaacaaaagtttttttattgctttctatttctcttctcttttctttgtaacttataaacgaatgaatgaataaaatgaactatatataatagagtttacttagttagaaaataaattaattagcgaaaaaataataaataaatatcatccatattttagtgaagaagtaataaataaacatcatacatatttgaaataattactagaatagaacacaattgtatgtttattcctataatagaacacatcttttttttttattcgtatgttttcagtacttgtgtaattacacttaatacccttgattagttttaattaaatattattattaaattcgtttctaattaaaaaataaataaaaaaacagtgattatccatgtcatcagttcatgtcatttaccctaatccacgtcatccgaaaccaaaaattcccttaaaactttcagtttctcattttttcagcacatcttactgttcatccgcgcaaaaaaaaaaaaaaaaaaaaaaaaaaaaaaaaactgtcgctctcttctctcgttcagtcgacggaaccctaatttcatcgccgttctctacttatctcgtctctttcggccgaaactctttcggtggtgtcgaatttcaagtcatcaaaaatcgaaacccaaatcaaagagatctatggaattttatgtgatttgttacaggttttagttgaatcaagaataactactcttttactttgattttatatgtctatcgtttagttttcctctcaatcgatctatttagaaatatttctacttctatcaatgttttgattcatatggtttcgtcttcctcctatgtatccctcaaacagattattacgtttcttaatttgattgttgttatttggccaataaatttcatattgtcttccccagaaaaatgttgctttccgatctgtattataaatcagccgtaaagtgatgtaactcagccgtaacgtgatgtaactcagccgtaacatataatttacacaaccattcgtctttcctaaatgataactcagccgtgacatgtaatttaccgaacctttcgtcttccctgaagcatataactcagccgtaacatataatttacactcatctttcgtttgcccttgaacatataactcagccgtgacatgtaaatttatagatgtcttcccttaaacatataactcagtcgtaatgtaattttaccgaacctttcgtcttccctggaacatataactcagccgcgacatgtaaattgactgaacgtttcgttcttccttaagcatataactcaactgtaatgtaattttatcgaacctttcgtctttcttggaacgtataactcagtcgtgacatgtaaattgactaaacctttcgtcttcccttaagcatataactcagccgtgacatgtaaatttgtcgtgaaacaataagagatacaacattttgtctaactttatcatcgagcaccaacttcacaaatttgtcgtgcgttgttttcgcatctatctgcacaagtttacaccctctttcattagtgttaaatatgtatttttgtttctatacccaattcctggaaacaacaattaccaaaactagatcaaccatatcgggagaaagatgaaagaaattgaagaaaaatgaggaaaacgatgaggaattagaagttccggtgatgtgaaaaactcaagtgaagaagacgagttgaaaaaattttaccctatttttttatcctttgatgatgcacatggaatgatgacatggaatattacagccgacgtcgttttgaattgatgaggtggcaactaagccaccaaacgaacatttgataactcagccatcaagcaaatctatacgtcagtcgcaacatgaatactattacagtaattaaaaaaggaaaaaaaataaagttaagtcagccgtgtaatgtcgtaactcaactaactcaaccgtaacgttcaacaactcggccataactgcatgatattatagtaattaatcttttaaaaataagtcagccataacatggctgagttatatcgtaatccagctattggcggctgatttatatcactcgaccataactcagctgtcacatctttccataactaagccaatcaaaactataactcggccgcgtcgaggaaataagtcagcctttttctcataactcagccatattgttggctgggttatcgtataacttcttataactcggccgaacatccttaactcaaccataccgttgtctgagttatactataactcaggcaacatttttcaactcagccgtaacgtctggctgagttatacttatacttcgccgttttgttatg

SEQ ID NO: 30291 - DNA, 3000 bp, Unknown; identical to SEQ ID NO: 13230
  misc_feature (1)..( 3000): 2750-1469P.txt file - cDNA_ID_3028680; gDNA_ID_2214606; Annot_ID_187228

SEQ ID NO: 30292 - DNA, 3003 bp, Unknown
  misc_feature (1)..( 3003): 2750-1469P.txt file - cDNA_ID_3028716; gDNA_ID_2214607; Annot_ID_187267
aacatacttccgaataacataactctcggatccaccagccctagttgcacgtagtctccaactacagttttcatcaatacaatgaagaacatacctcgtgagatctgatttcactgtatgaaactcaaagttgtgcttcactgcaaacatccgcaacgtgaataccatttcatctttgtctttgaaattttttccaataaacaaagaatcagcatcacttagaccagttgaaaacgcataactagaatactgttgatcaagaatactagatgtttcagatacacacgcctcaataatcctagaggttaacctcgactgccaaaataaaaagcttacctcaaacatcaatctatcttaaataatgattttacaaggatttttaaaaggggtttaaaaacgataatgattttacaagattttttaaaaggattattacctgagtagtagatgcagaatgagaagcaaaaggatttgaagtcgtctcagcctgtaataaactcaatcactgacttaataatgattttacaaggatttttaaaaggggtttaaaaacgttaataatgattttacaaggatttttaaaaggggtttaaaaacgttaataatgattttacaaggatttttaaaacgattagtacctgagcattagggacagaatgagaaacaaaaggatttgaagtagtctcagcctataataagcacaatcactgacttaataatgattttacaaggatttttaaaattataacacaagaaggttattgaaaaacctgctcaactgtcacagaaatttgctctatagtcaaacataactgaagcaatcctccactctgtgagaatttgtgcataaaagttgcaagctgtctatcgttcctagtataaagaggatgagattgtatggttgtagacgtggagactaacttgtaactaagcttcaaagaattggttgaactatctatttgaaaatcctctacaagaatatcaaccaacgcgtgataggtaatgtgctcatcaatgagcactaaagaagctcccaattcaatgtctaattcaaattcccaagtcatattgtttgtcaacttccacaagccacaaacagaatacaattctagcattataacctgataagataaataacaacaaaatcaacacctacaaaaacactgtcactacagagagaagcaaggtttacaaatcgttttaaagagtaagtaagtagcatagaataatttacaagggattttaaaagctttgaaaagtggttaacatggtttacaaatcgttttaaagagtaagtaagtagcatagaataatttacaagggattttaaaagctttgaaaagtggttaacatggtttacaaattgttttaaagcgtaagtaagtagcatagaataatttacaagggattttaaaagctttgaaaagtggttaacatggtttataaatcgttttaaagcgtaagtaagtagcataaaataatttacaagggattttaaaagctttgaaaagtggttaatatggtttacaaatcgttttaaagcgtaagtgacatagatctatcacgaaagcatatgcaaaagaggtaaacactaaatcagaaccaaaatctattacgaaatagtataacgaattcacataagcaaatctatcacgaaacagtataacgaattcaaaaggattttagaacagtataacgaatgtacaaggattttagaaacaaattcaatcatcaaatctcaaacaaaattcaaattcgaagctgaagcaaatgtcaaactgtcgattgaatcaggattcaaataacgaattcacataatcaacaacaaaaatcgaataaaccaattcgaaaacgaagatttaagctaacattataaaatcaaacctgggaaacgcaagagattcgacgacgacacacagctctacttacgacggcgaagatgggttttcacggcgagtaaactcactatttccgacggcatgggattcaacggcattcacaatttccgatggaggaagaagagagagagtgaagaaatgaattaggtctgtgggtagctcattaaaggtaatttggggagaaaagtattagaaagggtagaaatgaaagtgggaaaaaaaagggtagagttgcaaaagggcattgagaaaagggcattagagtgaattattctaattcttttgacatacaattgttagtaattatttaactggcctattctactttataaataggtttttgtgcaaaacaattctcaaaatcttctatttttgtaattttatttttcacgtccaaaaaatacagaattatcataggaagttaaaaataatacgcaatatagttttttcgctattgtcaaattctcaaaattttgctaaataatatatcaaatcgaagacttcgagatgataaggtcaactatatcattagattttttaaaaacaaatgtaagtaatcgtaaaaacgtttacaatatatatatataaaatttaaaaatgaggtttattgtctactattttaaatttcatgagattattttgtattttttcgacgtatatggtaaaattgtaaaaatagacgactttgataattgttttgtataaaacccttataattagttgacgtaatatacagctaaaaacttttagtacagtctacaattatagtgaatgaatcactcttcttcgacttaaaaaaagatagtataacaaactcaaatttcctaaaagaatagtaagttagttacacacacattgtagtttgttttaatgacaaaataaaagaaagaccggtcgtagtttcttctaccaacatataaaataaaaataccaagtcgcatttgtacaaaacttagataatgggacactgccgaagaaaaggtctttgattgaccaatcaccatcttgattatttttctcacaaatccatttattttctctataaatacatccatctaaatcaaaacagatcattgtcccaaaatacaagcaaaatacaaagatg

SEQ ID NO: 30293 - DNA, 3000 bp, Unknown; identical to SEQ ID NO: 25048
  misc_feature (1)..( 3000): 2750-1469P.txt file - cDNA_ID_3028750; gDNA_ID_2214608; Annot_ID_187286

SEQ ID NO: 30294 - DNA, 3003 bp, Unknown
  misc_feature (1)..( 3003): 2750-1469P.txt file - cDNA_ID_3028754; gDNA_ID_2214608; Annot_ID_187284
ccttcctttctcttgtaccagaaaaaattgcgtctagttgatctatccagcaacaatttatctggaaatattcctacgtggctgctgacgaataatccagaacttgaagtcctacagctgcagaataattcatttaccatctttccaattcctacaatggtgcataatttgcagatctttgatttttcagcaaataatatcgggaagttccctgataagatggaccatgcactaccgaatctggtacgtttaaatggctcgaataatgggttccaaggttattttccaacgtctattggtgaaatgaagaatatttcattcttggacctgtcttataataacttctctgggaagttacctagaagctttgtcacaggttgtgtttcaataatgttcctgaagctctctcacaacaaatttagcggccgttttcttccaagagaaacaaacttcccttcacttgacgtgttgagaatggataacaacttgtttacggggaacatcggaggtggtttgagtaactccactatgttgcggattctagacatgtccaacaatgggctctctggtgctattccaagatggttatttgagtttccttatttggattacgtattgatatccaacaatttcttagaaggtacgatacctccttctttgttgggaatgccttttctttcgtttctagacctttctggaaaccaattttctggagccttaccgtcacatgttgatagcgagctcgggatatatatgttcctacacaacaacaacttcacagggccaattccagacacattgttgaaaagtgtccagatacttgatctgcggaacaataaactctctgggagtatcccgcagtttgacgatacacagagcataaacattcttttgttgaagggaaacaatttaacagggtctattccacgggagctttgtgatttgagcaacgtcagacttctagatctttcagacaacaagctcaatggtgtcataccttcatgcctctctaatttgtcatttggacgcttacaagaggacgcaatggctctcaatattccgccctctttcttgcaaacaagccttgagatggaattatacaaatcaacttttttggtagataagattgaagtggaccgctctacttatcaagaaactgaaatcaaatttgccgcaaagcaaaggtatgattcttatagtggaagatctgagttcagcgaaggaattcttcgtcttatgtatgggatggatttgtcaaacaatgaattaagtggtgttatcccgacagagcttggagatctcttgaaactacgaaccttgaatctatctcacaattccttgttgggatctataccatccagcttctccaaactgatagatgttgagagccttgatctttctcataacatgttgcagggaagcattcctcagctactcagcagccttacctctcttgctgtgttcgacgtgtcttccaacaatttatcaggaatcattccccaaggaaggcagtttaacacctttgaagaggagagctacttaggaaatcctctgctttgtggaccaccgaccagtagaagttgtgagactaataagagtccagaggaagcagataatggacaagaagaagaagacgataaagctgctattgatatgatggttttctattttagtactgcttcaatttatgtgaccgcattgataggcgttcttgtacttatgtgctttgattgtccttggcgtcgagcatggctccgcattgtggatgctttcatcgcctcagctaaacatgtgttgccttagatctgttgagcttagttcttggatatttcagtgaaattttgtttatgtatggtttgagtgtttttgtagtgtaatttacgatgccttttcacttatgaatagttgtgtctctttatctcaattttttgttaaaatatttaaggttttttttgtctttttattgaatcttttttttattgaaatatttacggattttttaaaaggttttgtcctcttattacatgtcttttgcacttttgaacggttgtgtctttttaatgcaattttttgttgatatatttataaattctttcgaatgtatctttctatcgtatctttttgttgaaatgtttacgattattttttacaatcgtatattttcagtttacgtttgtgtctttatagttgtatctaatcatttaaagttatgtctcttcattatattttattgcatttactcgtcacaatttctcgtatgagtagttgtctatctaaatgtttgtgacttttgaactttatatatttgtcactttctaagtgaatcccaaatttttgttcttttacacaaatttgttttattataaatccaaactaattaatctgtaaagtagctccaagttctttactctctaaactatttttaaacatacattatttcaatattaaagaaattcctctaatttttgatctaaaaaaaataaaaaattggcatcttcgttagaatttttatacttttttaaagttgattaaaaattcttcatttctatgatcattccaaaatttgatttagaatatataatttttaatgaactttaaattttagattgcaatgtattttgatttattgttaaaaaaaactttttaaaaaaaaattatcttagtttatgacttttcgtttcatatttgtttattacaaacttttttgaaataattttctccgcgatgtcgccggggtctgcgtcctagttattagtacaatggaatcaaactaatgtaaaactgtgaacttgacggaaaaaaaaaaaaaatactgtgaacagcaaagggaaaaaaaaaaaagaaaaaaaatgtcagaacaaatccttctcctccattgagacagtgtacttctgcttcaatggacatttgatatcatcaaatcctgcgtcaggtgagaaagacgcttcgccgttgtcagagttccttttctttattctctgtagaaactagaggcaaaaaatg

SEQ ID NO: 30295 - DNA, 3000 bp, Unknown; identical to SEQ ID NO: 13250
  misc_feature (1)..( 3000): 2750-1469P.txt file - cDNA_ID_3028762; gDNA_ID_2214608; Annot_ID_187282

SEQ ID NO: 30296 - DNA, 3003 bp, Unknown; identical to SEQ ID NO: 21037
  misc_feature (1)..( 3003): 2750-1469P.txt file - cDNA_ID_3028771; gDNA_ID_2214608; Annot_ID_187277

SEQ ID NO: 30297 - DNA, 3000 bp, Unknown; identical to SEQ ID NO: 13266
  misc_feature (1)..( 3000): 2750-1469P.txt file - cDNA_ID_3028855; gDNA_ID_2214609; Annot_ID_187307

SEQ ID NO: 30298 - DNA, 3003 bp, Unknown
  misc_feature (1)..( 3003): 2750-1469P.txt file - cDNA_ID_3028872; gDNA_ID_2214609; Annot_ID_187300
ccgtatctaatatccaagaggatgttaaagacttacccgagagtttttctgtgctcgtgcttgcaccaccattgagtaagaccttcaaacgacgccactccacatcactaaagccactcacaccatcacggtctgcatcagtgataacataattcgcttgttctgtttgtggttgttgagaaacatgaacagcattgacgttgatatgacgccctcgaccaacagaagcagctccgggtgtgacgcctttgcctcttccattaacaacacggctacgtggtctctcaccccaccattcaggatacccgacgactgcaaagcagttgttggaggcatgaccggagcgattacaatgtttacaaaccacagctctctcgaaagcatcaattcgatcggagatgggacgtgacttggtttgaaccgcatgagccacaacttgagaggaatcttcatagtgatgcaccgtagttttgagatcttcctcttgacgaacaacattgtaaacctcctccagagactggataggcacacgggaaaccagagaagatcgaacagttcgaaaactgtagtcaagaccagacagaaactcatgaactttgtcactttcacggtcctgttcttggagaaatccaagatcgcagtcacactttccacatttgcagacacgcacgggacgataatgagccatgttgtcccaaatctggttcagttttcagtagtacgcctcaatggcgagaccacgttgcttgcaacacgccaactccgccttcagttgctgaatacgcggaccattcgtcacagaaaatctcttcttcaagttgtcccacaaatctttggcaacatcacgatgggaaatactcgaacggagagatgaatcgatggacatcttgatccaggacacaagtaaggcctgaatcgtccaccaatcgtcaagatctgcagacccttctgctggcctagcaatcgagccatcaagaaaaccaaatttcttgcgagagcagagagctgttttcatgccgcaagaccattcatcgtagttggatcccttgaataagggatgagagatcacggcacctggattgtcggctgcggtaaggtcgtaaggtgagatggtgcgtcgtgtctccatcgggttaggggtcgtggtcgtttcggtcgcatcagagtttgctggggtggccatcgtttcaaagcaaacatgtttaagacaatagaaaaaaaaattgtcagggctctgataccatgaacaaatagagatcgatgtatgagaaaaagtttcttgtccttattcacagtagcctttacattgttatataggtaagagacgatatctactttcctaaagagatacaaatcagaatcaattcacaataaatgtgattgatattggagcgtatcacattgatacgttaagatacgctattacgctattacaaagtcctaaaaaaaatggattaccgagttacggtcgcatggaaattttaaactaagggtatcagctggtttagaaagtactttatatttggtaagggtttcttatacaagcatttgagttgtgtgccctgaaaatatttgcctctacgtatttctcggtttggccacttggagaaagataatcaaatgctcgtattgactgaatggaagtactagtgtggctgttactagtgtggtttgttgaaaaacaagtctttctttcacgggaaatcgttcagttactttacaagttatcattgcttttattaatggtttatggaaactacaatatcctgtttaggttggttggtatctttcgaaagttaacaatgagacatcactagagagagcttttaaccttcgtcggagtctttctccactatatactgaagtggaagtactagtctgggcagtgccggtcctgacctaaagctgaacaagtaaaggttttaggcgccaaaatatatataacattttgagggcatcaaaacaataagatattttgtagtatagtggctgttccttgtttttttgtttatcatgtcttggatttacgtctcccaagcatcattttgctatattttcaatatttgtctgcaaaaaaaaatagtttgggctttaggcagtccatagtgttggaccgatcctgagtatgagtgatgagatacatgatcgatgaacataaaattgaaattactttcgtcacgaactgccatgatctagtaatattagatttcttcaacacaaaccctttcaaatggcaatttgttttcttacaaatttatcctcaatttacaaaaatatgcaggtcaaacccataaaattcaatttaatctacaatataatccgtcactaccacccccaaatttatcaaagtactcccacatgaggaacgtgagagtgttctacattaacattctattttttggttgaatcatttgtgcttatctatatatttttgaatcatttactttgaaaaaataaagattttgttttatatatctatatagatgatgagataatacaattttttgaaaatagagaaaattaaataaagatgagagggctaattaatattattgaaaattgttttgttctattgaaaaagaataaaaacatccaacacagtaaatacatttttatgatactttacaaaatcaaataagctatttgtgtaaactttgaaaaaaaatacgtgaataaataacttttttttttcttctcactgataaaaagatttcaaagacggtggcgcacataggtattgcgtgtgcaacgcttacctcacatagttttgacacaagctagacttgttaaaccacatgccatcattttcatttctttttatatttcctgcctaatcaatctagcggctcccacagaaaattactctcctccataccaatctttctttattttttgcatctctatctgtcacacaccaattcttattttatgtatatatattgacgcatacatctccaaattaatcaatagcttatctagttcttgactgttcaacgatcaatg

SEQ ID NO: 30299 - DNA, 3003 bp, Unknown
  misc_feature (1)..( 3003): 2750-1469P.txt file - cDNA_ID_3028895; gDNA_ID_2214610; Annot_ID_187349
acttctttgtgggatcttaaggaaaaagattgggatcgtaaggataagcaaagcaaaaaccaaatgcttgaaagtcttctttcaagaaccgaacctctttcagagtgtgacttggttcttaagaagaagctaattgaggagttgttttcataagtaccgaacctctttcaaatgtttaatttctttctaagtacttctaggatttgtttcaatgtcacaacaatgacatgtttaatttgctttgtctgtttttattgcaaatcactttgcttatgtatgatattgtcttaatgttatgtatgatattgctttaatgctttttatgatattgttttgtctcttatcttatgtcacaagtcatatttggccttatatgtcacaagactttgttgttaacttttgcagtttatcatcacgggttggagacaaagatagacaagacacgtaacttgcaactcatgttccacttgatgccaaaagagacatatgatttgtttgctttgttgtcttgtttttagctttgagtctatcaacaatttaaatatgaggtacttttagactaaatatatttaattaaggtatttttattccaataaaaaatattaggtattaaacaacaaaaaataatagatgattttttcaggatttttttgccaaattattttttagtttattatataaaaatattatgctttatttaacatatataaaagataaataatagaatatttattatattatttagtaatcacaaatgatttaaaaatgctaagactgcaaaactactattttttacggtaaaaatgtcatttaatcccccaactttcaaaaaattggccattttatacatcaacttcgtatgtggctgtttaaaacatgaactaaacgttgactaatttttaaaacatgatctttcattgatcaggccaaaatagacatgccgttatcagtcattaacggaacttctaacgtccgttatcatccgttaactttattagtcaagtttcaaattgtggccattttaaacatcaacttcttatgtggccatttaaaacatgaactaaacgttgactaccatttaagacatgaaaaattcgtttacagggccaaaatagacatgtctttatcagtagaacctagaaacccgttaatgactgttaatctgtccaaaacaacgtcgtttgaaaataatcgaaagaacataaagatttttcccatatgaaattccatattaaaaagttttaagcagaacccaagaacatagtttgataaagcgataatcgcagtgccagtaattggaaacaaataaaggtgttttcgtttatatatttgttttaaattttaaaaggaatcatggaagcaaattgaagactcattataagattgttcgtcttgtttgggcggttgtagaaatagatttggggaactagggtttcatttagaaaacaatcctgattttcttttgattattctcaaaacaaagtcgttttaggaatactaatagactcgttaacaagtgataatgaatgttataagtttttttaatgaatgatgacaacatgtttattttggcttggtcaacgaatttctcatgttttaaatggtagtcaacgcttagttcatgtttaaaatggccacatataaagtcgatgtttaaaatgaccacaatttaaaacttgactaataaagtcgttaacggatgataacggacgttagaagttccgttaatgactgataacggcatgtctattttggtatggtcaacgaataatcatgttttaaaagttagtcaacgtttagttcatgttttaaacgaccacatacgaagttgatgtataaaatgaccattttttgaaagttgggggattaattgacatttttccctattttttaccaccttttgcaacaataaccttttatgttgtacatttttaaaaataccccttccctttaacagaatgaccaaattactctcatctaataggaacatgtaattggaaactgaaattttctagccaaatttatttttcccgcaaaaaaaaaaaattccgccaaatttttttcccgccaaaaaaattcccataacaattttttttttcagccaaaaaaatgcttttaaaaatccttgtgaaatatttttagcggaaaatagatttacaaaggattttaaaagagttttaaaagatttactagggatttaaaagagttttaaaatatctacaagggattttaaaaagattttaaaagatttacaagaaattttaaaaatttttaaaaagatttacaatcgaaccgacccgaacctgattggacccgaaccgagattttctatttattctattgaatcctagaataatatacccgatatacccgtacccgaccgggtattacccaaacccgacctgcatacctgaatgtcctgccctactacaaattttgatatacagtattgctaaaactttatcatcgttttgttattaatatgacgcggttaaaaaaatatgagaagtctacaaatttttagacgtagatgagataataaaaaggaaatataacttttctctattattggtatttagtttttataaacaaaatgtttacaaaaaagaataatattttttttgtaataataaactctgtaaattgtgtacttttgtgatatataagcttcaactttctatatactttttaatctttgtttttttttttaatttaaaatctttatataagcaaatataatttatattccactccgtttaaagcaccatcgatgaaaattcccggtggattctcgccggtaggaggagatgtctcaattttcactcaaatcttttttagtttttaccaaaaatatattaaagtaaaaggcaaaaaatcttcaaatttattcttaccaaccaaacaaacaaaaagaatccttgcaaaataatcataaattttaaatattttcccatttaaagagatatgcaagtgagaacttttgagaggcgcaacaacaagatg

SEQ ID NO: 30300 - DNA, 3003 bp, Unknown; identical to SEQ ID NO: 27839
  misc_feature (1)..( 3003): 2750-1469P.txt file - cDNA_ID_3028906; gDNA_ID_2214610; Annot_ID_187342

SEQ ID NO: 30301 - DNA, 3000 bp, Unknown; identical to SEQ ID NO: 13274
  misc_feature (1)..( 3000): 2750-1469P.txt file - cDNA_ID_3028921; gDNA_ID_2214610; Annot_ID_187334

SEQ ID NO: 30302 - DNA, 3000 bp, Unknown; identical to SEQ ID NO: 25054
  misc_feature (1)..( 3000): 2750-1469P.txt file - cDNA_ID_3028937; gDNA_ID_2214610; Annot_ID_187330

SEQ ID NO: 30303 - DNA, 3000 bp, Unknown; identical to SEQ ID NO: 13288
  misc_feature (1)..( 3000): 2750-1469P.txt file - cDNA_ID_3028969; gDNA_ID_2214611; Annot_ID_187386

SEQ ID NO: 30304 - DNA, 3003 bp, Unknown; identical to SEQ ID NO: 25057
  misc_feature (1)..( 3003): 2750-1469P.txt file - cDNA_ID_3028977; gDNA_ID_2214611; Annot_ID_187378

SEQ ID NO: 30305 - DNA, 2614 bp, Unknown; identical to SEQ ID NO: 13278
  misc_feature (1)..( 2614): 2750-1469P.txt file - cDNA_ID_3029005; gDNA_ID_2214611; Annot_ID_187362

SEQ ID NO: 30306 - DNA, 3003 bp, Unknown; identical to SEQ ID NO: 26421
  misc_feature (1)..( 3003): 2750-1469P.txt file - cDNA_ID_3029020; gDNA_ID_2214612; Annot_ID_187424

SEQ ID NO: 30307 - DNA, 2543 bp, Unknown; identical to SEQ ID NO: 13299
  misc_feature (1)..( 2543): 2750-1469P.txt file - cDNA_ID_3029125; gDNA_ID_2214613; Annot_ID_187450

SEQ ID NO: 30308 - DNA, 3000 bp, Unknown; identical to SEQ ID NO: 13300
  misc_feature (1)..( 3000): 2750-1469P.txt file - cDNA_ID_3029129; gDNA_ID_2214613; Annot_ID_187445

SEQ ID NO: 30309 - DNA, 3000 bp, Unknown
  misc_feature (1)..( 3000): 2750-1469P.txt file - cDNA_ID_3029133; gDNA_ID_2214613; Annot_ID_187444
tagctcccccttcaacctcccaggcatctatcaattgccatgaaggtcctccaataattttttttgtagaagtgttagtatcatttcccataatcacaactcttaacaagttttttttttgttttgtcccttttcttctatgaaggtggtgcacgctctatctcggtatttgataatgacattggtagtggttcaatttctcctatgattgtgactggtggcaaaaatggtgatgtcggtttgcacgatttccggtttattgcaaccggaaagatgaagaagcaaaggaaccctgacggtggatcttcgactgatggagatcaaaacaagaatgggatgctttggtatataccaaaggctcacttaggtgcacaccctaaagcctattttcaccttcatattccaattttaccggaaaaatatcctgaaatttgattgacattgatgcaaatttcagggagtgtgacaaaaatagcgacaatcccacgcacaagtcttttcttgacgggaagcaaagacggagaagtaaaactttgggatgcgaaagctgcaaagttgattcatcattggcctaaactacacgaaagacacacttttctgcagccaaactcgagaggctacggtggaatcatccgggttagtgaaccaaatcacctaaagcataatcctttcatcgtattttctcacagtggctttggtttcttagtaaaccagaatcaaagtaatgtcggtgtatgtaatcgaatttgggtatgtgttacgaatttggtgtaggctggggtgactgacatacaagtttgtccgaatggatttataacgtgtggtggtgatggcacggtgaagttcgtcagcctcgtagattcttcctatggcgatgctaaataaaaagaagatacattttccgggaaagttttgcagtcgagaaaacgagttattgctaccttgcgtgtgtttattgaatacgtgattttttgtgatgtagtttttttctctatatggtttaatatttgtgtatatacaaatatattaaagattatgaagcagtagaatcttgagttgaccataatccagattttaatttatctttgacttgacttcaatctatactcggaaatatcatctatttatctttgacatagttttcgttgactttgttgcatcagatttagaccagattaaatcggactgattccaattagattggtgttaagtgtagtgcaatagaaccgaaaataaacattatcaagatttagttcgttattgtaattttttttctttctttttggtgttggtttggtattagctcgatatagtttaataagattatgaaaaattgacggctaggaacctggccactatcgtattacgtagtggaatattatcttatggttgattattaaactgctccataatttgtgttgtagtcttgtagacgaaatgatatgaatcatcaaaatgtttgattaaaaccccatttgccaagaattattcctaaaactattaagttaaggcaaaggtccatttcattaataattattctaaagaagttagttgtatatatagtatatatatagactatggtgttaattatgactgaatatattagtgctcacataaagcatcttattagaatatcttagattgcttaaataattattaaccacgtaataaataaatctcatgtaacactatcaattggagaataatggagagagacaattaaccataatgacttgaagacacttggcttcacctaacattcaatttcctagacgaggccactatttacattctctttacctaactttcagaactacattaaaccaaattgacatgtaaaaaacctaattttatattttcaacatgtctatttaccattggccactttattacttaaatgaaaacgatgtcataaaaaatattagtagaccctaacttgaaatttaaaatttaatcgatcatttaaaaatcaaaatcattcgacgcaattactacaagatttttatgttttaaccaaacatttatgacgtaatctaccatcgcgcgtaatcgtatagtgataactgataagataaaaggtcttatccgttaaaaaaggaaagggaagccttttttagatcttcttttttgtcgccacgtgtaattaatatctaatcgaacggctgtcaggtgaaatctatgggcaaatctgtggactcaaatactcattaacataactatgggtcctctcagaaaacggtgccgttttgcggaagcttgcgtgctgaatgacacagagactaagaaaacgataataaactgcaaaatgattcaaaagattttaatcgaaagcaaacaaaaattctctgacaatcagaaaacaaaaaaaaatcagaacaactcttatcttcttcacgagactgactaaacaatcatagatttttccgttttttgggtttcgtctggtgttactctctccttctggttagttctttttttccgaattcttacaaattattgcggtttcattaagatgaattatgatttggatcaccatccgttgtttttgtgtccggttttgattcttaggtctaatcgcgtttcatgttttttttttgtgttcttctgggtttgataattttatagttgaagttttatgaaatttgatttcaattgcaaataatgatgatttgtttagtaagttgataaattgacaaagaatctggctttggtttttgtttgcttctaagaaaattaggaactaattcttcaatttacctggaaagcaaaacatatcagattctctaaaaagtagttttgtaataagcttttttggtgatggatctgtcggcaatcagaaagattcttcctttgaaataaatgattcatattatttttcctataaatagattcaaaacggttaataagattttgctaaatctacctaatttctaaatcacattgatcttgaattgaattctcagtctcttgtcttatctttagagttatggtgaaataatg

SEQ ID NO: 30310 - DNA, 3003 bp, Unknown
  misc_feature (1)..( 3003): 2750-1469P.txt file - cDNA_ID_3029264; gDNA_ID_2214615; Annot_ID_187517
aagatcgtaacccccgatggtgcttgccttctttattccacactcatctgggttcggctctgataccatttgtaacgccccaatcgcccctactagtgggccccacgtcctctctcttccccatgggcccactcatgtccgacagtcggtgcgccatgttcgggaggctttaaagacttgttaccgaccctacaagtcaccacacgatctttccccatactttgtcttcactcgtatcgttcgaaaatcacttctcggaaagtcacccatcctgagacaactccagcccaagcacgcttaactctggagttctctcaagacctttaaccgaaaagataagtgcactttagtgacatagatgaccaaatcaattattttaaatctctctggatgcaccaccatattcctgaaaccggggtgttacaactggaaagaacagttcctacgcttttcctttgagtctcctttaaaaatagttttgtaggaaattggacgaaaatgtttccgactattttcctaccactatatttcctttcgttttccttctattttcctacgagatttcctacgatttcataagtcgtaggaaattgaatagaaatttccttcgaaaaactgacgaatattttcgacggaatataaatttggtaggaaattggaaggattttggtaagtgttttgtcttacaaaaatttggtaggaaattttgtcggaaaatacaatgttttcttgtagtatatagccacccattatcatcttttgttttatttgcagatgatttagatgtcttttgatttccttttcctgtgatttaatttaagagttgtttgagaagaagtaatctaaaatttgtttagcatttgtaacatatttgttagtttttatggattgctgtcgaattttaatatttataaaaatattattagacttggtggtaaatcatttggtgtattgaaagatcgtttataaccaatgtacctttaagctttccagtagctcttttcgccaatagtattgcatggagcatttgtcaggtttttctttgttcctctacaaatatataatattagtattgttccatttgttaaatgtagtttactattatttgccgacgtattaacttgaatacccaaaaaactttttttttatatattttatttatatatgtatccagaaaacttagtttatagtcgtttggttttcctcggcgtacactgatgtttgacatgtaaattgtactctgaaatggagaatttgtataggaataaagtaagtttgtttgtttattttttaaagtagtgatcgtaaatgcattatttgatactattattgagagatggtaaccttactttgtctttgattggtgcattgtggttcttcatgagtctctttttttcttttctttttagctgcctgagttgaagtttgtaagtagccttttctcttacctaaaggttctcgcttcatgatttttaattgtttttttacttgatttctttatttcgtaccatcagtttgtggttttatttggttttcttatgagattgttgtctttagtgtaatgatgtagtaaaaagcttgtaatagtgagacgaattcttttcgtgttcttttgttttgtttagtataagttttaagtataaccaatattaaattctccacattgttttttagttaatgagtggttatatcctcgatagattaagggtcttgtgatttagatgttttacgttacacatacgaatttattgtctttggtattaatatattttcaaaaactaataatattgaactcctcttatttctaagaaattggagtctttgggaaatcttttatattaggttgtctttattataatccggtagatatgtttttaatggaattacatgaatacatttgtcaagttattccttttaattatttattttaacaatattataatagctacttgacaaatcgtaattagttaaattccccaatgtcttcagttttttttgggttgcctctttggaaactctctacggcaacgtcttcgctatttcggttcttaaaattatgattatatggctgataaataaatgtaagagttggaatttatttgattaagaaacttccttacaacatcaaggaatataaactgcatagaaaaagaaatagtaaaaaaaaaagaaataacaaaaacagctttgctttgacactgtgataacccacaactctataagcattaaattaagggtaaattatatacagtagccgttgacccacttttattttctgattttgacattgtgggctgggcctttcaattcttaacctttcagccaaaaactaaccaaaatgcccttgacgcttcctgaccgggtttggacgtacggactgcgtcgttggaatccaattgaagcgtacactgttcaccgacgggaagtgcattaaatgttttctgggtttcggcgaatttgacactgtaacttggaattaaaatttttaaaaaaattgttgggctcagatgttttaaatgctaaaaagttttgacaaaactaaaactcatgattacctattataatagagattatattataagatatttacataattgagattagaattttggacaaaaaaaacgaatccaaattgtgttacggtgaagaatctgaagttttcagttgctgtttaacaaagtttgaacgtttgaacgggagacaatctgtgatctaggtaagaaattcgtgttattcttatgaattacacctgagaacgtgatatgaaagtaatgatccgtttttaaaaatttctaagttcataaattgttttgttggagattctttttgtctttgtagatataaatgaaagccctttgatctgttttgttaaatttctaagttcataaattgttttgttagagattctttttgtcttcgttgatataagtgaaagccttcaaaaagatctgattttttgtatttaatgttgttctgacctgaggaatttatgttgcaggtatg

SEQ ID NO: 30311 - DNA, 3000 bp, Unknown; identical to SEQ ID NO: 13317
  misc_feature (1)..( 3000): 2750-1469P.txt file - cDNA_ID_3029395; gDNA_ID_2214616; Annot_ID_187536

SEQ ID NO: 30312 - DNA, 3000 bp, Unknown; identical to SEQ ID NO: 13322
  misc_feature (1)..( 3000): 2750-1469P.txt file - cDNA_ID_3029433; gDNA_ID_2214616; Annot_ID_187524

SEQ ID NO: 30313 - DNA, 3003 bp, Unknown; identical to SEQ ID NO: 25070
  misc_feature (1)..( 3003): 2750-1469P.txt file - cDNA_ID_3029439; gDNA_ID_2214617; Annot_ID_187573

SEQ ID NO: 30314 - DNA, 3003 bp, Unknown; identical to SEQ ID NO: 25071
  misc_feature (1)..( 3003): 2750-1469P.txt file - cDNA_ID_3029443; gDNA_ID_2214617; Annot_ID_187572

SEQ ID NO: 30315 - DNA, 3000 bp, Unknown
  misc_feature (1)..( 3000): 2750-1469P.txt file - cDNA_ID_3029476; gDNA_ID_2214617; Annot_ID_135817
aaccacacgcaaaataatcgtaagtagagacgttgtttctgatgaaactaaaattttatggtggaatgatctaggagatgagtcgggagaagaatcaggaaccttttttctcggttttgaagcatttggaaataacggactaagaagagaagatgaagaatatgcctctgagacaagcgagaacagcatagaggaagaaggtactactcgtatcggggaaatcagaggaacagaggaaaacagagaaactgagacgatgatacaagtagaagatcaggcactagtcaacacataacctgtactaagaagatctcagagacaagtctcaaggcctaagtacttaaaggattatgttctacttgctgaagaagaaagtgaacatctgctctctataataaacgaggaaccttgggattatgctgaagcaaaagaaacacgagagtggagagcgtgtgaggacgaaatcacatcaattgagaagaacaagacatgggatttagtggaacttcctcaaggagctaagccaattgggctcaaatgggtgtttaagctaaagaagaacgcagacaggagcataaacaagtataaggcaagactcgtggctaaaggttacgtacaacgacatggcatagactttgacgaagtcttttcccttgtagcacgaatcaaaacagtccgcttcatcattgcccttgctgcttcaaacggatgggaggtgcatcatctcgatgtcaaaacatcattcttacacggtgaattaaaagagacagtatttgtttcacagccagaaagattcacagagaaagggagtgaaggcaaagtatacaaattgaataaagcactctatggattaagacaggcgcctagagcatggaacaacaaatttaacaagatacttagggaattaaagttcatcaagtgttctaaagaaccatcgctctatcgtaaacaagagaaagttgatcttcttttagtagcagtgtatgtggatgatttgcttgtttcaggttatagcttaaagctcattaatgatttcaagaagggaatgtcatctaagtttgagatgagtgatctcgggttactcacatactatcttggaatcgaagtaattcagcataatggaggaattatgttgaaacaatggagatatgcagaaaagatcctagacgaaaccaagatgagtgattgcaacgcagttcacattctaatggactccggtttgaagctgtcaaaggcgggaacagagaaaggaagtcatgactcggagacagagaagaacattgagccaaaagagtatagaagaagcattggatatcttcggtatctgcctcacacacgacctgacctctcatactgtgttggcgtgttgagtagatacatgcaagaacctaaagaaggtcatggagtagctatgaagcagattctgagatacttgcgtggcactacctcctacggactactttcacgcgaggagacaattcggggctaataggtttcagtgataacagtcacaatgtagacgaggatgatgggaggaacacaaccggacatatattctaccttgatggctctccaataacttggtgtacacaaaagcaagaaaatgtggctttatcgtcttgtgaggctgagttcatagcagctacagaaggagctaagcaggcaatttggttgcaggagttacttggagaggtaacaggaaaagcatgcaagaaggtgaggtgctcattgacaacaaatcggcgatagcacttgccaagaatccagtatttcacggccggagcaaacacattcacaagaggtaccatttcattcgtgagtgtgttgagaatgaccaaatagaagtggaacacgttcccggagaagaacagaagacggatcttctaacaaaggcacttggaagaatcaaattcaaagaaatgagagagctagttggagttcaagatttgtcgaaatgtgatttcaagcttaagagagtgaatgttgataagcttgaagttagcttgagaaataaactaaccaaatcctaagagatttaggataagattgtatttaggagatatctaaatttagtagttatctaatgttattaggagttatctaatgactaggagctttcatataaatagagataccaagttgtggtaatcctattgagaagtttagagtttgagagattgagagttttggtgagagctttaggttttgagtaagtttcttaaagattaataaagagtgagtttttatatacaccattctcttgttctataattcgatactaaaaaatagtccaatgtctattaataatatctcgcaacccaatacataactgtcatgtaaatatttagttttttttatattttttctttttcaataccgacgtcaagattttgtgcatatatctttagaagcattaaatgctgctgcatcattacgtatctaacaatatctgctttaataggggtaaaaacgtcagaaattattgtaaaggaagaaagatgtttaaatatagaattatctagcacacttttttaatttctttttttctgagtatatatatatttaactcaccaaaagaaaaaaatttaaatgtttggcaagaaagatagtaaaagaaaatgaaacaaaaataataataaatttagaaaatttgttggcttgacaataaaaaaaaaacttttttcaataaatagaggatgtttatgaactaaaacttaaacaataaaatgtttttgaagaaaaattgaattaggttggtattcaattttaaatcatgacagcaatgtatccacacatgttcaaaaaaaaatgaatctagggaattgtgtcaattaaccatgtatgatttcaatatctaaaatctaacaatgatgaaagtaaaaagaaaaaaacaagtttgcataaaaagaagaaacagaaatagaaagccaacacaaaacagtaatctctcagactacaactttactcacttcaccagctctctctcacttgatgacaatg

SEQ ID NO: 30316 - DNA, 3000 bp, Unknown
  misc_feature (1)..( 3000): 2750-1469P.txt file - cDNA_ID_3029476; gDNA_ID_2214617; Annot_ID_187562
gggtccaaccacacgcaaaataatcgtaagtagagacgttgtttctgatgaaactaaaattttatggtggaatgatctaggagatgagtcgggagaagaatcaggaaccttttttctcggttttgaagcatttggaaataacggactaagaagagaagatgaagaatatgcctctgagacaagcgagaacagcatagaggaagaaggtactactcgtatcggggaaatcagaggaacagaggaaaacagagaaactgagacgatgatacaagtagaagatcaggcactagtcaacacataacctgtactaagaagatctcagagacaagtctcaaggcctaagtacttaaaggattatgttctacttgctgaagaagaaagtgaacatctgctctctataataaacgaggaaccttgggattatgctgaagcaaaagaaacacgagagtggagagcgtgtgaggacgaaatcacatcaattgagaagaacaagacatgggatttagtggaacttcctcaaggagctaagccaattgggctcaaatgggtgtttaagctaaagaagaacgcagacaggagcataaacaagtataaggcaagactcgtggctaaaggttacgtacaacgacatggcatagactttgacgaagtcttttcccttgtagcacgaatcaaaacagtccgcttcatcattgcccttgctgcttcaaacggatgggaggtgcatcatctcgatgtcaaaacatcattcttacacggtgaattaaaagagacagtatttgtttcacagccagaaagattcacagagaaagggagtgaaggcaaagtatacaaattgaataaagcactctatggattaagacaggcgcctagagcatggaacaacaaatttaacaagatacttagggaattaaagttcatcaagtgttctaaagaaccatcgctctatcgtaaacaagagaaagttgatcttcttttagtagcagtgtatgtggatgatttgcttgtttcaggttatagcttaaagctcattaatgatttcaagaagggaatgtcatctaagtttgagatgagtgatctcgggttactcacatactatcttggaatcgaagtaattcagcataatggaggaattatgttgaaacaatggagatatgcagaaaagatcctagacgaaaccaagatgagtgattgcaacgcagttcacattctaatggactccggtttgaagctgtcaaaggcgggaacagagaaaggaagtcatgactcggagacagagaagaacattgagccaaaagagtatagaagaagcattggatatcttcggtatctgcctcacacacgacctgacctctcatactgtgttggcgtgttgagtagatacatgcaagaacctaaagaaggtcatggagtagctatgaagcagattctgagatacttgcgtggcactacctcctacggactactttcacgcgaggagacaattcggggctaataggtttcagtgataacagtcacaatgtagacgaggatgatgggaggaacacaaccggacatatattctaccttgatggctctccaataacttggtgtacacaaaagcaagaaaatgtggctttatcgtcttgtgaggctgagttcatagcagctacagaaggagctaagcaggcaatttggttgcaggagttacttggagaggtaacaggaaaagcatgcaagaaggtgaggtgctcattgacaacaaatcggcgatagcacttgccaagaatccagtatttcacggccggagcaaacacattcacaagaggtaccatttcattcgtgagtgtgttgagaatgaccaaatagaagtggaacacgttcccggagaagaacagaagacggatcttctaacaaaggcacttggaagaatcaaattcaaagaaatgagagagctagttggagttcaagatttgtcgaaatgtgatttcaagcttaagagagtgaatgttgataagcttgaagttagcttgagaaataaactaaccaaatcctaagagatttaggataagattgtatttaggagatatctaaatttagtagttatctaatgttattaggagttatctaatgactaggagctttcatataaatagagataccaagttgtggtaatcctattgagaagtttagagtttgagagattgagagttttggtgagagctttaggttttgagtaagtttcttaaagattaataaagagtgagtttttatatacaccattctcttgttctataattcgatactaaaaaatagtccaatgtctattaataatatctcgcaacccaatacataactgtcatgtaaatatttagttttttttatattttttctttttcaataccgacgtcaagattttgtgcatatatctttagaagcattaaatgctgctgcatcattacgtatctaacaatatctgctttaataggggtaaaaacgtcagaaattattgtaaaggaagaaagatgtttaaatatagaattatctagcacacttttttaatttctttttttctgagtatatatatatttaactcaccaaaagaaaaaaatttaaatgtttggcaagaaagatagtaaaagaaaatgaaacaaaaataataataaatttagaaaatttgttggcttgacaataaaaaaaaaacttttttcaataaatagaggatgtttatgaactaaaacttaaacaataaaatgtttttgaagaaaaattgaattaggttggtattcaattttaaatcatgacagcaatgtatccacacatgttcaaaaaaaaatgaatctagggaattgtgtcaattaaccatgtatgatttcaatatctaaaatctaacaatgatgaaagtaaaaagaaaaaaacaagtttgcataaaaagaagaaacagaaatagaaagccaacacaaaacagtaatctctcagactacaactttactcacttcaccagctctctctcacttgatg

SEQ ID NO: 30317 - DNA, 3003 bp, Unknown; identical to SEQ ID NO: 25077
  misc_feature (1)..( 3003): 2750-1469P.txt file - cDNA_ID_3029569; gDNA_ID_2214619; Annot_ID_187614

SEQ ID NO: 30318 - DNA, 197 bp, Unknown; identical to SEQ ID NO: 336
  misc_feature (1)..( 197): 2750-1469P.txt file - cDNA_ID_3029569; gDNA_ID_1564001; Annot_ID_148663

SEQ ID NO: 30319 - DNA, 3000 bp, Unknown; identical to SEQ ID NO: 25074
  misc_feature (1)..( 3000): 2750-1469P.txt file - cDNA_ID_3029581; gDNA_ID_2214619; Annot_ID_187609

SEQ ID NO: 30320 - DNA, 3003 bp, Unknown
  misc_feature (1)..( 3003): 2750-1469P.txt file - cDNA_ID_3029601; gDNA_ID_2214619; Annot_ID_135839
catctgcaccctcagggatttctccacagtcatggatcacaacatcctgagaaggacaagactgttcctctatgctaacatgctcaatcgaccgaacaacacccattcctttcgtaacccttccaaacacaacatgtttcccatctaaatgagaagtgcgagttgtcgtaatgaaaaactgagagccattagtgttgggaccagagttagccatagagagcatccctttcctctcatgtttcagctcaaaattctcatcgtcaaacttcaagccatagatagactcaccaccagtaccatcattagctgatatatccccaccttgtatcataaaccccttgataacacgatgaaatcgattcccctgtaaacaaatacaccaaataccataagtacatcatcctatagtacaatttcaacctaaagttttgatctttacctcaccactacaaactacagtaacctaattgcaatactgaaacaaagtcagaagctattcagcaatacgagcaaaaacccattaaacctcaaatcataagcattcagaaccattctatagtacaattgcatcctaaagttttgatctttctttcacaactaattgcaaatttaaccaagttttgatctttataaaccccaatgacgaatgacccattaaaccacaaaccctaaatcacagaaacaacaaatacccatttctacatttcatacataagagagtataaacaaagatatagagagaaagagagaaccttgtaatggagaggtacaccagtatttggacctaaacccttctcaccggtacagagtaatcgaaaattctcagcggttttgggaacaacatcatcgtaaagctcaataacaatccttccttcaagctcacctccaatgctaatgtccatgaaacactttgacctacccatcttcttcttcttcttcttcctcttgctttcttgaaaccgaaacaaagacgagacagagagagagagagagagagagagagagagagagagagagagagagagagagagagagagagagagagagagagagagaaagaatcagaggaagagacaaagaacaatggtgtgaatctctgtctcagtagcttccgtctctaaaagactgtagacggggacttgtctcttattaaacgcagaaatcaaaacgacagatagaagaaaaccctaggacccactttcttcctccaacaaattttgtctctttttatttatttttaacttttaattaatttatttattacttgctgccaaaattaaaaaataagaaatttattactcgtcccttcgggtacattccataagagtggatagtaggtgattgcccactatggccactacacaataaatatttggttttattatttctttttcttaaaaattatttaatttttttgcaaaatattattctttttttttagggaaaaaatctaaaaaaaacccaactattttttatttaaaactttaatacccaattgtttttgattggaacctaaagttccaaaatattaaattttgttcaagaaaaacactatttaattgttcgtggttaaatcattcatgcgcgttaacagacgttaatttggctgacggaatcactaaaccggggttaatggttaacaatccgcggtttaattgactaactaaaagactacagtaccctcatttgttttcccccaaatcgatttgggattgagaaaccctaactccccaaatttctaatttctctccaaaaaacttagaaattgaaagaggcgatgattcgaagcgtttgatcgggtatatctgcgttcgatccagttggtaaacagtcgaaaagatgaggtatgtcgatttgtgtgttgtgggtctgtcgatttgaatttttagggttcttaagtttgaaattttctgggtttgtttgaaattgggttaggggttatgaatcagttaggttatagtttgtttaccactactaatcggttaatttctattttccagtgatttcgagtgtttgaaactcaacataaactatagaggcgatgtatccttcacggaccaagggttcgattactctggaggggtcgaggcgaaagacatggtgatggatcctgatctgatgacatggtctatattcgacgattcttgcaaagaaaatggagtcaatggtgaagtcgaatcgatttggtacaagcttccagaagaggaaatctattcagcaagagttatcggtgccgacaaagatggtgggataagggagttatgtcgtgaggcgatgattggtggggaagttgacatatacatcgtcaatgccgtctctgtacctgcagcttttccgcttccaaatgatgttgtagaagacgaggaacttggagttgaggatgatgatgccgaagatatcatagacgaggagcctgcagcagaaactaatgagtgccctgaaagagtacaagctaatggagaagatccagtagaagaaagaaggcacgatgatcctcggtttgaggctttctttgacgaaattcacaatggtacagaagctgcagatgatgttgttgatgatgctgcagctgaagacattaacacagtaccagaagaaaccgttgctgaagaggttgaagatgaagatgaatttgagagacagtgttatgatgtagagcgtccggatcatgcaatggacacagatgatgaatgggatgcgtatgaccaagcagaaagatcatcatctcgacagaagttttcgaaggataaacctccatacatttggatgttgcagactttcaatagtggttaagaggttaaggatcaactcttgcggtatgtattgaagatgaattatgatgtgaagttgtgtagatggggtgcaaataagttggcagcaatctgcagccatgaaaattgtgagtggaagatatactgctccactcataagcgttcaggtatatggagagtataaacttatgttgataagcatcaccatgctaagagtgggaaagcaaaaatg

SEQ ID NO: 30321 - DNA, 3003 bp, Unknown
  misc_feature (1)..( 3003): 2750-1469P.txt file - cDNA_ID_3029601; gDNA_ID_2214619; Annot_ID_187600
tttaagtacctggccttgtcgaaacaatgctttaacattgttatcttcatcacgcatagcaaattcagtgtccaacaacgctccttttgcatctccgaatttgagtttgcaggcctgccacaacagccagttacaatacaatgagataacatagtaaaaaaaaatcggttatacaggcacaacaaagcaattaagttggacaagtgaaaacactggcaacgtaaacagagatgcaaacaataattcatatgagcaatgtatgtcccacaagcataatctcagagaatattatcctgcttatgtcaaggtcaacctaccctactttttcccaagaaattaatcaaacagcagaaaccaacataaatgacaggtctgcagtgtagagcacttcaaattaatttttagttcacaatcaattgcttatcattctatcgacggtacagctcatccgtaagaattaagcagattcaacaaaaaaaattgtaatgttaaaaacccaacagagtaagaaatttaagttcttttggaaaaatcaacgactccaaagacaatcaatcttcagatggtacgtaaagcacacacacatataaggtagatatgttcaacttacaagaaaagatatcaacaaggatgtatgtagctttaaaaaaggtgtaaaagcatgatgaacttacagcactattagtgaagatctgcgactttgtcttacgcaaggcagtactcgtctctacaagatcccaagtagagagtgagtgggaacattggtatggatagtataaatattttttgagatgaagtaagtggaaacatatatagagagaaaaactgataaaccaccttcatcaatgccctctttctcccagcaaatatccagatagcgtaaagccttacggtactttctaagagccatcttatagtcttgtttctgagagtaaatcaaggtcaaaaacagatcagactcacagaaatgaaaatatggaacagacaaacgtatatattcaatttaaaacaatggaaaaagcaccttaaagtgctcattcccatgagccttgacaaaatcaacagtctccatccaccaagataactcagctgggctttcattcagatcaataggccagtcagggtacacatcaccatccttgaaaaagtcacaaatcccatcatctgcaccctcagggatttctccacagtcatggatcacaacatcctgagaaggacaagactgttcctctatgctaacatgctcaatcgaccgaacaacacccattcctttcgtaacccttccaaacacaacatgtttcccatctaaatgagaagtgcgagttgtcgtaatgaaaaactgagagccattagtgttgggaccagagttagccatagagagcatccctttcctctcatgtttcagctcaaaattctcatcgtcaaacttcaagccatagatagactcaccaccagtaccatcattagctgatatatccccaccttgtatcataaaccccttgataacacgatgaaatcgattcccctgtaaacaaatacaccaaataccataagtacatcatcctatagtacaatttcaacctaaagttttgatctttacctcaccactacaaactacagtaacctaattgcaatactgaaacaaagtcagaagctattcagcaatacgagcaaaaacccattaaacctcaaatcataagcattcagaaccattctatagtacaattgcatcctaaagttttgatctttctttcacaactaattgcaaatttaaccaagttttgatctttataaaccccaatgacgaatgacccattaaaccacaaaccctaaatcacagaaacaacaaatacccatttctacatttcatacataagagagtataaacaaagatatagagagaaagagagaaccttgtaatggagaggtacaccagtatttggacctaaacccttctcaccggtacagagtaatcgaaaattctcagcggttttgggaacaacatcatcgtaaagctcaataacaatccttccttcaagctcacctccaatgctaatgtccatgaaacactttgacctacccatcttcttcttcttcttcttcctcttgctttcttgaaaccgaaacaaagacgagacagagagagagagagagagagagagagagagagagagagagagagagagagagagagagagagagagagagagagagagaaagaatcagaggaagagacaaagaacaatggtgtgaatctctgtctcagtagcttccgtctctaaaagactgtagacggggacttgtctcttattaaacgcagaaatcaaaacgacagatagaagaaaaccctaggacccactttcttcctccaacaaattttgtctctttttatttatttttaacttttaattaatttatttattacttgctgccaaaattaaaaaataagaaatttattactcgtcccttcgggtacattccataagagtggatagtaggtgattgcccactatggccactacacaataaatatttggttttattatttctttttcttaaaaattatttaatttttttgcaaaatattattctttttttttagggaaaaaatctaaaaaaaacccaactattttttatttaaaactttaatacccaattgtttttgattggaacctaaagttccaaaatattaaattttgttcaagaaaaacactatttaattgttcgtggttaaatcattcatgcgcgttaacagacgttaatttggctgacggaatcactaaaccggggttaatggttaacaatccgcggtttaattgactaactaaaagactacagtaccctcatttgttttcccccaaatcgatttgggattgagaaaccctaactccccaaatttctaatttctctccaaaaaacttagaaattgaaagaggcgatgattcgaagcgtttgatcgggtatatctgcgttcgatccagttggtaaacagtcgaaaagatg

SEQ ID NO: 30322 - DNA, 3003 bp, Unknown
  misc_feature (1)..( 3003): 2750-1469P.txt file - cDNA_ID_3029658; gDNA_ID_2214620; Annot_ID_187656
aaaacaaataaaatgtgataagaaacaataaaaccattttgaccaaagttcttatagttttaatattctttaattgtcatttgttagtgactaataatattacattaaacctaatgtataaatagaagccccatcttctacgcctttataattagcaacaaccaaaaacattcatttgtcattttgtctcctcttttgttttctctgatcactagtatggctgtattcagagtcttgcttgcttctcttctcatatctcttcttgtcctcgacttcgtccatgccgatatggtggtacaattttaacaaccaaatatattttcttatttgattttattttttcacaacttttgtctacgttctaatggaatttttttcaaaatattcatgcagacgtcgaatgacgcccctaaaatcggtaatatctctatcatataaacacgtacgttgaatttctatatacgtgtgtttaattgaagttttggttggaaattgtatgtatttgtagattgcaacagcaggtgccaagagcggtgcagtctttcgagtaggccaaatctttgtcacagagcgtgcgggacttgctgcgctaggtgcaactgcgtggcaccgggcacatccggaaactacgacaaatgtccgtgctatggtagcctaaccacccacggaggacgcagaaagtgtccttaaaaactctgtcgctgtttgatttgatttcgtttataatactttacttttatgagagtaattgtggttattttcttgggaattattaaaaagcaaaagaaagagaatgttatacgtcatgtgcaactcttcgatctttgttttagtgtttatccaatttgtacttgttggtttggttcctggttaacattaggtctgaaaaggtattgtttttcattatacaattcactaaataggcatcgtacttgcatataaaataaagaatgaagagagaagtaaaagagttttctttttttactcatggaagttaggcaatgggtttaaatatggtaacaacagaattggaggggacttaatgaactatgacgtaaaactgagagcgattgaatatgtaacgttaccaacaataccaataaaattatgaaagatagtatatgaaattacgtttaattaatgtttccgggttgaatgtattatatatagaagtaacagtacgatttttattacatttttgtacaagattcctagaaaggtataacctctataaagttaataatagtcttgagtcttgactcttcgaggcaaataaattcaccgcataattaatcgttcaactattattctatattctatataacatgagcttcaacaaaagaagcatcaatcatatcttcaacagtatactgcagtgtaatgtaacatattcaagatcaaaccggacaaaaaagcaagataccgtcgaaacaatcaaaccccatgtatcataaactcccatcttctctttcctaaattccccgtcgcttgcacaatccgcaattcaaaagcaacacaacactagtcacgttaagcaaatagtacatcttccagagttcagtgtgggacaatcctgttgatcacaaagagcaataaaaaaggttgtttcaagcaggagggaggatattgaaacaaatggaagaagaaaatgtttctgttctttgaaaattaataaattcacgtaataataggagaactatcagtcgaagggtaagagaaaataaattaaatataatcatcatttcaaaagttgaataacttagtttattttaaaaatgacgaataaccagaactgggtggattcgaaccaccaacctctcgtccactagaagaaaacgagcgctctaccaatttgagcttacagatctatatcacgaataccctaccactacggcccacagccaataggaccaacacttgactctttaactctattttaatcacatattaaaaatatttctgtttttagagaattcaatatttaaacaacttctaattgaagaccaaaagatgaacttgactaaacatgaacggtgatgctaaactgttttcaagacacaatttcacgagaacaagagactagataggaaaattgcaataagcttttctcattatataaaatgttataatgattgttctcttccacaacaggccacaataaactaagaaaataaaatgtaatgaactataaatatcaggaatttttgacttagcacataaccagatactatcttttgatcaagatacctttcaagaacaaatcaacttcagaaaaaaccaacgtcagctttgcatagcttcaattccgtcgtctaccagcttcatagttactacaggaactggtggttacagacatatacaaactacgagcaaataaaaatgttctttaccatattctaaaaagcttctaaacggatagaactaataaaacaataccaatgatacatacaaagaacccgcaaaattgtttaacagcaattcttaataccatcattttcaatagattaaatgacaacttgtaaaacaataattgatcaataagataaataacaaaaccaataaaattaaaatttcatgattcgcataagcgttgatacaagttaacaattagggcaaccggattatggtttatttaaatccagaattcctcttgcagattatgtttaccttattatgctaattaagaattcgatttaatatggatatgagtacctgatttaactctcgaggttgttgggcaagaagatttgtaatcgcccactgctccatattggttacaaactctgcttatgatcggtttttgagtgtatatgagcatttaagaaagatatgaaatgtgaaagagcagggagagagatagagcagaggcaagacgacacacacagaggagaagagatcccgggaaaaaataataacccgtgcgacctcctctccaaaacccacaaaatcttttttttattgaggatcagttttttgacctgccatgcaagcgcacctgacatg

SEQ ID NO: 30323 - DNA, 3003 bp, Unknown
  misc_feature (1)..( 3003): 2750-1469P.txt file - cDNA_ID_3029664; gDNA_ID_2214620; Annot_ID_187654
gaaagaattttaccatctatgaaatttgtatataattaaacactatgtaaccaagtgattaattatatacggatagcttgagaaatcattttggtagattgagaaacttttgtctcctggttacggatagcttgggaagggtctctactttatacctattctggtttctggcttaaaagaaatttacaaatttctaccaaaacaatcatctctaattacgaatatgtagtgtgtttaatgtactgtatatatatttttttgagttttagaccaaagatcagattctaccaaaaatgactgtgattcttttaactatattgtagatgccttaaataaaagaaattcaaatacttttgagattagtctaacatataccccaattatcaaagaacaaacatattttctgcgcaattggcgtagctactcctttaggttattttgaaaattatcaaagaacaaatatattttcgttctaaagtttaatatccatttgattattttgaaaatttggttcggtttcggttcggttccggttctttcagttttaaaatttagttaccatttagttattttgttttgaatatttttggatattttgttattttgggatattattggatattttcggataatttttgcttatttttgagtattttattattttctatttcggttcggtacaaatttggtattttattattttggtttcggttcggtacattcagttcggtttatttgcccaggtgaagacgtagccactaaaccataagaacaaggcccatacttatcgcacatgggcttttaactgtttattatatataaaaagcccatcatgtggttcgttacaattttctgttaaaatgtttggcccattgtcgccgtagattgtcttctccgttcgaaatcgcatccatcgccgtcgtcgtcggtgacgaaaaccaccgcgtaaaaccgtttcctaaatcagatgttcaatcttagaagtatctcttagaagctctcttgtatgaaaaaatgggactgttaagcataatccggaagatcaagaagaaagagaaggagatgcgtattcttatggtgtatgtcatattcttaaatcgttaatcttctccgatctaatcgtacattatcatgttgtgctgattttggaatgtttttttggcagtggacttgataattctgggaagacgacgattgttctgaaaataaacggagaagacacaagtgtgattagtccaactcttggattcaacatcaaaaccattatctaccaaaagtaaagctctatttctctgctcttgtagtttcgtgttcttcagagttggtttaggaatttcatcgaacatgttataggcaatgatgagtttgtggtgaataatgtgtgtgtaggtatacgctaaatatatgggatgttggtgggcaaaagactataagatcgtattggaggaattactttgagcagactgatggtttggtttgggtggttgatagttctgatcttaggaggttagatgattgcaagatggaacttgacaatctcttgaaagaagaggtatattcataaaagtatcaatatctattcaatcaaaagcttttgtaagctgaagcttgggttgctgtttttggtgaagatgattcatattcaaatcttggttttaatggcagaggctagctggttcatctttgctgatactagcaaataagcaggatattcaaggtgcactaacacctgatgaaattggcaaggtaagggttttgaaactcataagtcgatttggacataggggttatcgggttgaatcattttgtctctcggtcgggtttctcaacttcagtgaagattagtgggttaagtaagatatgttttgagttgtatattgtgtgttaaactgagtttcatcttcttgcttatgaaggtgctaaacttagagtccatggataaaagccggcactggaagatagtgggttgcagcgcatacacgggtgaaggtttgttggaaggattcgattggttggttcaagacattgcctccaggatttacatgcttgactaatcgactactgcattgcacaatcaatggcttgttatactcaactatatgcagtgactttgtattggctctaagtttttccttcagttctattgtaacgatgattagacaaaacataaatatttccaagacgaactcttctcattttgtttcattgaaagagacttaacaacaaaatgatgtctcatacaaccaaataaaacttattgataaaaatccaaccataatctaccacagatagatgaaagttgtctctgcagagtaagaaggaagaagaagcatacaaagagagatcatttggacttctttccttgtttcttcttgacgacttcatcagtgtacattatgcctttgcccttataaggttcagggggtttgcaactccttaccgttgcagcaaactgatgcactctttgcttgtcgattccagtgcagcaaaccacattgttcttgaaacaaaagactcgaaccgctggaggaaccgcaagttcgacttcgtgactgtaacccaatttgaggtataagaaacgccctgcttcctcagctctagctttgtatccaactccaacaatcttcaagaaccggaaaaacttggcttccatgtctctctatcctacagagaattaccctgccaaagaggaaaatttctcagcttcttcaaattaagaacttggaaaccaatagagttcaccattatcataaaacgatgctcaatcaaaatctgaaggcagtagattttgtctctctagccactcaaatcacacaagtaaatatgaaaattgaccaaccatgctacgaaaaattgccatttttttcattactttgtatctcagagacgtagaaacgagcgatgagctaacacagtaaatacgtcgaacactttccgtgcactatttcaagaacaatataaacggaaataaaaactccagataacctcatttacaagaacatg

SEQ ID NO: 30324 - DNA, 3000 bp, Unknown; identical to SEQ ID NO: 13359
  misc_feature (1)..( 3000): 2750-1469P.txt file - cDNA_ID_3029670; gDNA_ID_2214620; Annot_ID_187648

SEQ ID NO: 30325 - DNA, 3003 bp, Unknown
  misc_feature (1)..( 3003): 2750-1469P.txt file - cDNA_ID_3029682; gDNA_ID_2214620; Annot_ID_187645
cgtaagaaaggcgcagaagatctctcgaagataagatcccaagatttggagaactagtccgattctctaaccatgttcaaaggtgaaaattaaaaagaagacaagaacacctgaatattctttgataaatgtacttcttttcacatctctaggccagccagtaacttcgattcaagaactcaatcatcccaagagatcaaagagatttacacaagatgaactagtttacaagaggctgcacaaaagaaaagaaaaaaatggtttggttagtgaggaatcatcttgattaatttttcattttaataaatgaacatatcattgtcaaagaatgttattccgtggcacccacgaatgaacatgttttagagggctaaaatctctgattatgccaaagtacatcttttttagtactgtgtgtcgtctgagatttgtcttattgtctaataattggaatcatgttctgacgtacacctactagctaaaggcaccagacataaatagtgtttaatattcagcaaaatcatcgtccttttctatagatgctcaatataaaccagtaaatgtatagattacccaagttgctcaacgatcttgaagccaataatggcatgattcgctttttgtcacactccggtgattaaagacttcaacagagctaatcagatcgaaaagacatctatcactgcaaagaagtacttaactatatacttttctcgatcacacaagatggaaaaattgcaagaaatattacacacaagcttaacaattcacctacaactacaacactacaacagatactcaataaatttcagtaaatataagattacctgaagttgctctttttttatttattgaataccatgaggttttaagccgaaacccgtaattctccaaagcccgaaatcacatcatgtaatattagtttcatctcaaacgtcactcgaaccggcgacctctaagcatgtaaattgcttaacgatctttggagccaagaatggcaaaatcacaatcccacaatggaaacaatataaaagttaactaagctaatccaacaatgcaaagaggaactctatagagattatattattttcaatcatacaagaaaaaaaaattgcaaaaaatattaaacacaagcttaacaatcacatgctttatgaatagtatcggatacgatagggggttaattcgacactaatgatgatgataagatccaaaatgctgaaagaggtaagggagggtccaatagttattggtaaactttacggacactagcaagaaaaaggaagcctcctaatttccttatagcaatggtcaagagaatctcattccactaaaactattaaacctttattatgtcctttaagggactagactctaatgatcattatcatatcaaagcttctatcaaaacttttgtcccttcactaaaattttatgtggtagctaaaagaatggtcattctaaaaatctctcatttcaaagtatatattcttccaactggcttataaccccacacattgcttttctcctcctacatataaggagctccacactccctcaaactaaaccaattcaagtcatctctatccgtcaacaatacaaaccaaccttctcaattcctctcttttcatccacattttcactagctaatggcttctagttcaatgagcacctcatcatggacagctagagaggacaagcaattcgaaatggcgttggcgaaattcgacaaggacactcctgaccgttggcaaaaaattgcaagggcagttggtgggaaatcaactgaagaagtaaagcgacactatgaattgctccttagggatgtgaatgacattgagtcaggacgctatccacaacctaggtaccgtaacactaattgaagccattaataaaatgcctttctatcaagaagaggacatttgagagaatctataaagaactaagaatttcgatgtatttcttatattctatttgctttctttttttgtttttttttttaatttctgtttggttttcagatatataataatctctctcaatatccatcctattctaatccaatcaatttaagttcatatagtaacagtctcggaacattctatcagttttatggattaagcatacgaaaaatcagaaatcatcgagatttgatcgatcaaacttcgtataagtcgaagtcattattatttatttatgataaattataaatcgaagttgatagagaaaagcaagacttatttttgcactataaaccaacatcaatgcgtagcatgagatcaataaacataatcttcacactgaaatcgaaggattcacgaaacaaaattattgatgttcaatgaaagaggagaagatgaatgtttcgaagttcggtaacggagtaattatgactgctaatatccttcgggttaccgtgaactacacgttatgtaagcaaattttgggcgggaacttttacactcttttgtttcttaatatacacatttatttttaaaatatttcagttgttgaaaattaactaatacactacaagctcaaatatttatatatttctctatatagaaataaatttatggacaaaaaaacgaaaatatgcttaaacgtaaaactaatataaacgatattattaaacacaatttgtataggggaaaaaaaaacgatcaaagattcaattctcctgtcaaaggatcaaatgtgaaaaatggccttacaaatgggctaaaatatgggcctatatttaatttttggcccatatctggattcgagtagtctccaaacaaccgatgtgtcatacatagctcacaagtcagtcataactcataacctagccaccgtgggtttatgctcgggcctaccggagagacatttccgacgactgtgcacaatcatttctattaaccttgagagtaccattttctcattccgaaatgtttgaattgtaaaaggacttttgtttcttgcttggggtttaggaggctgctttttagtcgtatttcaatg

SEQ ID NO: 30326 - DNA, 3003 bp, Unknown; identical to SEQ ID NO: 21273
  misc_feature (1)..( 3003): 2750-1469P.txt file - cDNA_ID_3029686; gDNA_ID_2214620; Annot_ID_187644

SEQ ID NO: 30327 - DNA, 3003 bp, Unknown; identical to SEQ ID NO: 21038
  misc_feature (1)..( 3003): 2750-1469P.txt file - cDNA_ID_3029713; gDNA_ID_2214620; Annot_ID_187633

SEQ ID NO: 30328 - DNA, 3003 bp, Unknown
  misc_feature (1)..( 3003): 2750-1469P.txt file - cDNA_ID_3029834; gDNA_ID_2214623; Annot_ID_135916
atgtttgggcctttgtgttgcaaactgaaatttatggccctctgttttggctttaggatatatttacaacataataaattacacaattccaattagagatttgttcttagttttgaggctttttgacttaaaatttgagccatgaataatctttcttcttttttcatcatagataatcatagatagagtatagaaatattatatttgatttttttgtgtgtgtttaaacctgaattatatttgatctaagactaactatttcaactgattatgagtccatcaagtgaaactacctataccacatacgacatttatggttttttttttaatcaaacaaaaaaaattattgtatattttggttaagagatatgaagtgaaatcacgtgtgagtaagaagaaagagacatgaaatcatatattaattaattattgtaaattttgcacaaaaaaaagaattaattatatataaatatatatatatatatatatatatatatgtgtgtggtatctacataattaattattcttcttgtgattgtaatattttgtaatatttttcactatatgtaaatatgtgtgagttattcgacatttatggttttatagtttccaaaggtatcaatatcactgtttggatattgaagctaaagtaaagagagaacgtaaacgaaagagtagagagaaactaactcagttaactaataaaaccaattgtacaagtagattgattaattcaagaaaacaactaatttgttaacaactccgtttaacaaactaacaaactcacaaaactaaaactaaaacaaatttgttaaattattatatatttttaacacttttatgtctttgtagtatatattattgaattttcttgtcaagtaaagtttttggatttgtttggataaaactgggagtttaggaaaatagagcaaatcagcaaaatgcatcaaatgaaaaaagattgaagatcacgaccgaccttgacaatcgtaagagtcagtacataagatgtccagaactgatcggttacatacttgtaccgatcattataaaaaatgtttcttagtttaggattccgactcattgcatataaattcttaacactttgtaatcgtataggcagattgttttgtttttttttctgtgattatctagtttttctatataaaattttataaacaaaatgatcgtttgaagaattagagcatatttgtcatttgttattttgactaatccatctccattcaaattgtccaattatgtttagtcaaatgagtttgaaaattttgcctaatttaatcatccaaatgagcaaaagaataaagccacacattacttactaataatattaaagcccacattaaaataatttctcacgtaaaaaacaaatacttacacaaacctatataatctagactctacttcacttgtttgccctaaaccatctatcatctctctttcaattcatctacaccttatttttatatttctcaaatacttttcgagaaaattatataccctttttaatatacgacgaatgaaatcgcaggaagataatcttctacttgttcttctactcgaggggataaaaaattacggacttaagagatgggataagatactagcatcacttcttctatcccagcgaagtatcgctaaatgtaaaaaaaaattctaatctttcgttaaacgaaaggtaaattattttctcgaaaaaatttgtgtatagaattaaaggttttctttagtcaatagctaatcaatcttatcatttattttctactagtttcttatttgcacaatacatttgagaaaattatgttatgttttcaagagttttgggtttttgtagagtattagataaaatcaatattttctctcttgagactagtttcttctttgcaccatacatttgtgttctttttcattttctcaaagctgtttgttttaccgaattttctcttgggttgtggagaatattttttttttttagtttttataacaccttatcttatataaaaacaaaagagtttgtttttacaagggatgatggatgatgaatctatagatggtcgtagtaccacactctctatggactcaagttgtggagaatctttttttttttagtttttataacaccttatttgatatagaaacaaatgattttgttcttacaagagatgatggatgatgaatctatagatggtcgtaccacattctctatgcaccctatgaatcaagttgtggaatcaatcaaagttggccacatatagttatgaaatgattttgtgataaaaacacaaattaatttctatgtgaatcacaaagaaaatatatatatatatatataattcccatttgaagtttaagcacagaccttagaaaaatatgtaaacaaagccgatgtctatagtccaataaaaacaaatttcgccgggaaaaggaatataaaaaatttgtcacatttaccaaaaaataataggagagtttatatagtttcaacgtacaattaatgatctaggttatcgagttttaatttccatttctcctaattttgctgacttgagctacatattattgagcattcttgttctttcagggtttatagagagattggctgataattactgtttgttatctgagtccccaaacgatttactgatatcaacaacgtattgatgatgtattgttttagaaacacatatatgtaaaaaaaaaattcttgattagagtgatatcaacaacttgagacatggacaggtaacaggttgatccacaattctatctttacgtcataataataacaaaaaattcgtaaaaagatgagttttgttaattacttctcttattataatcaaagttttgatttttattttccaataagtcgccgggaaaagtaaaataaaaagccgtcacgtctccgataaataatagagtatcgttagataggtagcttcaacgtaaggaatctaaattggttcagctcaaaaaacgaaaacgatg

SEQ ID NO: 30329 - DNA, 3003 bp, Unknown; identical to SEQ ID NO: 30328
  misc_feature (1)..( 3003): 2750-1469P.txt file - cDNA_ID_3029834; gDNA_ID_2214623; Annot_ID_187723

SEQ ID NO: 30330 - DNA, 3003 bp, Unknown; identical to SEQ ID NO: 26003
  misc_feature (1)..( 3003): 2750-1469P.txt file - cDNA_ID_3029843; gDNA_ID_2214623; Annot_ID_187725

SEQ ID NO: 30331 - DNA, 3000 bp, Unknown
  misc_feature (1)..( 3000): 2750-1469P.txt file - cDNA_ID_3029855; gDNA_ID_2214623; Annot_ID_187717
ccgagaagatttctctcgaaccttagctgagagattggtagccgatttcgagaaggttctacacgagctcgatacgcttcccgcgagggttcacgccaagatggctagtggaaaagttaacggtgttaagaagacgccagaggagacgcaaagagaagtcacggcctactggaagaagtttgtggacactaagactgacaagaacggcgttccgttagtagcaagtattaccaatcaatgatgggccaaatgtatattcaaattattgggtgcagacaaatttttttttagctaaaggcccaactacaccatagcaaatcagcaccattcgatctcagaccattcaaacactgtaataaaaacatttttagttttagttttatttttttgcaaaacacgtataacaggtaaattattattctcaataaaaaaacgtattataggtaaattattattatagccaacctaattatgttgtcaagtttgaaaataaaaataaaagagaggaatatattaaagaaaccctacaagtaaaaatcaaattttagtttcttgttttttttagacaaacaaaattagtttcttttttctgcatctgaaaatactttcctattttaagtagaggccaattaaagaatgtgggtccccgcgaataatatcggcgcaaattttttcgtcttttataaatgggccccacaagcgtgcctacatttgggcccattaaagaaaataatcgtactcgggggaacatgtctagaaactgataaatcgataaaagtaatacatactgacaaataatgaaggaaacaatataaatgaatagtagtatagttatagaaagaaatattttttaggttttaaattgacattatgattatacactcaatcgcattagacacactgtagtcacatcactattttgtacagttcgaaatagttaattgtctcgtggttctacaaaagcagttttatttataacattttcttttgttaattttgttttccgatcaaaatttttggattttacctacaaaataaaacatgaagcgaaatgaactcaaaagagtttattatctcattacaatatcatataattactctacctctaacaatattcacccatactaaaccattactatatattatgataaattcatcgtctaataacaacaattctaatacactaaacgaacacgaccaaacttattctatagtgattacattgcttcaacagtttccaccattccgaacaatttcatcatcctatcaaatcaaatcgataaagtcaaaccatgtcaaaaaatcatatatgaaaacaaattgaaataaagggatgtaataatggaagaaggtaatcgtgataggacgtgacacgaccccaccattgtgaagaatgaagaaaagcatacaaaagaagaacggttgttcaccaaatcagaagcaaaacagaatcaagatctataataagctagacagaatttcttctatacatgacttttttgatcaactaaagaagaagaaaaagaagatattacatagttcattatttttgtttgaaactgaggataatggtttaatgaactgtgaaatacatcactttttgaaaatgtcatccctaatttctatgacttaacaatccaattacaacaaatattgttaatcttgactgaccatatatatgttctttttactcatgacgttgatatcagtaaaatgtaaaacattaaacgttatataacagtaaaagttataacttatatcagcaaaagttatatcagcaatattttaccactgagctaacgttagtaaaacaaacacaacatccacttcataactcaggaacagtgaaatgaacgtgttttatatcctttttttaatcatttgtaacaactataatttgaagatgatcttagattatgtgcacatagctcattacacacatgattattaattccgaaaaattgattacttaatatttttttaaaatgatttcacaatattgttaataacatttaatcacgcaatcaaccattatatatatttaaatttcaattacgtttaaaaattgccgacattatttactattcacatgtgatattttcttattctagtttaatcttgtgtgagtcaaattataagattatttactaaatttgcttaaagcggaacagtaaaaataacagcatgatgtgataccataacctttagcattaaggtcccccatctaaccaaaccctaacaaaattcaaacacatgtacggagttagacaggaacatctctaatattaacgttgaaataataacaaaattgatacatttgttttttgaatttacgaagttagataacatagatcacccgaatacttgtttttttttttttttttttttttttttttgtgtgtgtgtgtcttttctagtagttaattactattgaaaccatccaagtagcggagtcacataaatttaatatagtatgcagattatgtaattgtgaccatatgatatatggcaaacatattactaatctaaatatatatacatatatatatatatatatatatatatatattattgcatggttataatatataacctaatgattgtgtattaatctcggggttgtgtatccatccgaaaaattcaaattttcataaaatgtgtgtttgttaaagagaaaattttttttagcacctttacatttctcaaggaggaaaaacactatccatccaacatttcttcttttgctttatttctttttccgttgactgtattgagtacaaattcgtcttcatcttctaaacctctccactactttttacttaactttttttttcttccaagtttattgtttattctcagttacattcactttagacacacaatccaccaacataaataggcagtgatataagttaatatcatagaaaacaatcagaaaataattcagaagagaaaacacaacaaaaaaaagaaagaaaaagaaagaaagaagaagagatg

SEQ ID NO: 30332 - DNA, 3003 bp, Unknown
  misc_feature (1)..( 3003): 2750-1469P.txt file - cDNA_ID_3029858; gDNA_ID_2214623; Annot_ID_187716
caaataggcaaatcatcataatacatctgaaagtaataatctttttcaacagctcttcgaaagtgttcaacttcttctctactaagcttctttttacagtacacctctgagtctttctcatctctaaagttaagcttgtatggagcactaacaagcctatccccattcaaaacctcaccaagagcttccttcttatctttcacaccctctacacaaaccaaaacaaatgcatattgacaccaaaatacacaaatccgaaaaaagtgaaaaaccacacataacagagacaacattgagcgtgctcgtacctggaatacaaaaggggagatcgaaatagcgatacgtctcactgcaacaatcatcaaacacaagtaaaaatcagtcatataacaatgcaatcgaagatctatcacattttaagaacacgaatcgaattttttcaaggtcagatacaaaaattcaataccaacgcaagcttctacagaaatttgcaacgatcaatttatcactcatcaaagagaatcacagatctaagctaccgacaaaggaactgagattagagaattggatttacctgggattgtgaaaggggccgaccttgttggcgtagagaggaacggagtcaccgtccttgtaacggtggtcggaggcatcggatctgacagtaccggcgccggagaagatgagagctccgataaagaggagcagcgtcgttggtaatctcatgatgatgtgtgttaatgtgagaggaagaagaaaatcgtgagatctgagtttgctttatatttttgagagcaacgcttatggcaaaaggacgattatattacttttatttattttatctctctttttaacgaattttcttctactaaatgcttaagaaaaaatattgcgaataaaaagcattatgtaagaaaataaaatctgcgacattttaatattttttttagaaattgaaatgattatttttatatattttatttttggttgttttcttaaatcttctaaacaaaattcgtattaattcacaaaattttaaattatttaatacgtttcgtaagaaacttgtgaatggcagaggcaagtgatataaactgaagcaaataaaactttctataatcgatattttttgttacaattgtcgttttttttttaataagtagcaattttctattggtagagtgattctctcgttcttgtgctttctactatttataggagttttattgcattccatgtgactataacaatcagtaatgttctttttactctttaacaaaatcatgatgatgaagatacaaataaaaaggtggtcaaaagaaaaaagatcaatagtgcctcgtttttttttttcacaatagtatctcgtttatgaaattgattaaagcaaagcaagtaaaaagtattatcaattggaatataaaccaaattttttgtacataaaatgaatgatgtagtaatttatatacctgattatcttaactaaactcaattttttgcaaccaaaccagataaataagaacactataaaattaagatgttaattacacagacaataattttatttatttataaagtttatttttgtaacagctctgatacttattgattttgcaccttctttgatggtggtggcgaatcatacactcatcagcgaccatgatatgtaatccatcaacgagttctctctgaatcttctcgcctggaaccagttttccagagcataaacataagccttagaacaaaacaaacatctactatcccctgaactactaatgatagagtaatcaatgtaaactcttttcctattgtagaatttaccattagacaaattattatgcatgttgttagcatctctactcttgaaaaatcttcgtaagctgattggaaaatcaaagaataacaaactaactaactaacaatcactactctataagcaaatcttgaataccaatagagattctttatgttggattctatctttgagcatttcattaggatcgacggttggtcgattaatcaatactaacccaaacagtcttttaacatgcacacttgataccttgtaggtgcttctgggtagcatgaaaatgataattggtgttattctgatatgcgaaattgaaaatgttgttgtgcatcagctaagcataattgaaagtttaaaaaatattataaatttaacgtgaagaattgaaaggtatcagattaatgttttggatcagccgaatagagtcaggctaatccaaattctcaaatattttcgaaaccttaaacacatcaaactccacgaagtaaacacactcacacacatatcaaaatccacattataaatgtatttttggtaggctagtcgtctaattctaaaatagccaatttacatttgcaattgtttattcaaaaaagtacaacagtaagaggtcttatcaattaaatcataagaaaaatatgtcccaaaatgtcaaaaaaccaactacgaatatttcttttccttttaaggccaaaccaggttttggaatacttattacaaataaactcaatttcaataaattcttgtacacaaattaagcactaatttcattgtgaagataccatagtcacattcacatctatatgacatcaatctataaaatccaaaacaaactatatattatatttatattatttttttgtcatcattatatttccattaatttatctaattctggttctaatatactcttggtcagaaaaaatataaacattgaagaattggtcggctgaaaattgtgaaaaatatatagcagaaaaatatgataatgttatcataaacaaaattaatagtaaaatttaattttaatttaacactacagtactatacacgtgtgtatgtatagctctataagtatttactctctttcagctatttattttttcagtgaacgagcattcttcttcttcctctgtgttgttgcttcttagatatattcaaataaaatgacgactgtaatcgacgcgacgatg

SEQ ID NO: 30333 - DNA, 3000 bp, Unknown
  misc_feature (1)..( 3000): 2750-1469P.txt file - cDNA_ID_3029892; gDNA_ID_2214624; Annot_ID_187755
aacatcgttgacaaaatcttcaccataaccgacgcagaagtcacaaccgccatcattccaacgctcacggtcctgttcatgtaaccaatatcagctcttaaaccgcagatgatgtagaaaagaggcattagcattcccgagaggaaatcgtggagcttctcttcgatcatttttcgaatgatgtggtcatgagggatcgatagaccgaacaagaatgctccggtaattgagtgaaccccacatacttcggtgattaagctgcaaataatgactccagcgagagtgtaccatacgtgagtgtctcccacttgacctccttcgacggtgttgttgaagatccaagccactccaggttggatcacaaagtagcagagaaggacaaaagctatggttgatgctaatgagtatggcaacatttcgttgcgtacacctaacaaattaaatatggttttcgttagtactataattcagtaactatgcgtgtgtgaggaaaaataacacaagggaacaaccatatttagttaccagatttggaaaaaatcgccattccaaaaatgaagagaatccaagtgcacaaatcagtaacaacggctgcacacattgcagtatgtcccatatccgtacgcaagagcttgagatccgcaagaatcctagcaagatcagggaaatttgtacagccaaatgcgatcgaccagtacatacaacctgctaggattttgtcggcctctccgttactgggaaggtagtataagccagcaccggcaagtaaagccgcaaggaggccaacaatggctatgatcactggtttgatgtctttgatctttatcatcctcaagtccaagccgagaccgaggaggaaaacgttgtaaacgagagctaagtttgcgaatgtctcaagaagcattgtatatttataagggaatataagtttaaggaccacttcgttattgccgagcacagtcgggctgaacagtaatccgcactgtaaacaaaataatcattacaattattataggatcatattataaattatgtacgagattaatttgaaaaagatccaataatataaatcgtatgttgcaagtggacaaatcttaaattttttatcattttggttttatcttaaaatcaccgttttcgaaaaaaaaaagaagcaaaaagctgaactttcgttagaacaatgaagttaattgttagcaaaaatttaatcaagaatttgaagatgaagactctttaggacatagctaacaaagaaaaaaaaggaaacataggtttgcaatagttgtgggtaataagtaatgaaaaaaaacagtttaaagattgataatggttagttaaatatgttttcaagattgactactcacaagtatttgagcgacgaaaggaggaagacatagaggcttaagaaaatagtagagtatgcggtaggtaagattagcgacagacagttgcgtcataaagaaaggagctgcggctgaaatggtgttgcttccatgcattgccgtttggttataacatacgactctcccaaaccgcgacgaacttgcatcaatagattcagctgcgggatcggccatttattggggggattttccttaatagatttaaacgggattctctcaaaaaaaacccaaggttttggccttttccctttcacaaaatctttgtgtttcatcatctgttttgttttattgcattaataggtgagagctacacaatctgtttttccttttttttttttttctctaatcttcttctttgtcattgctaattatagtttttttttatgtttgatgtcaaatagaaaagtactagtaatttagctgtctttgtattctcttttgcaaatgaaattagtcaattttggttggttttcttgtttagtctgttataaagggattataaaatccaattacatgctgttttccttgttatcaaataatagtactacatgatatcagtgttttttggatagatgagttaatatctcccttagtgatacaatgatatatttttatttcatttaaggaaaaaggctaaaacacagggttgcacatgtaatcatgatgttcttggatcaagaaattagacagataatgatgcaggtttgaatatttaaagattacttaacaaaactaaaataaaaactttcgaccataaataaaaaaagagagggaaaagaaagccaaacctagctggaaaagttaatccaaatggtccagtctcagaaaccggccttaaccgccaccggagattctccaccggccattaccttcacacaccccagaaaataaataaatggaaaaatatgtaactttctataagatttgacaaagtctacacttttaaggtgatgacttcaagtttaagcaccacacattggtgaaaggccttttggctctgcagtaagagatggaaacaaacgtaaagggcactattgtcttttaatgaaaaagaggaaagaagttcactttcacagcgaaacagtacctggccatggccgatcaagagaaaagttggtgcagtagcaatatcaaaatgtaaagcagacaactttattgttctaaaagcagagatttcacattttgttcaacgtacgaggaccccattcatactcaaaaggaagcatcataaagctttgaaaaggagaaacatatgaagagtgtgaccttacaccaaacagttttctatggaatgcatggttttcaaagcaaatgacctaagagagaatatctgaaagaagttgatttgccgccgcctttactgcatcttaagctctaaaacctgcaaaaaagagttaagagacttagtggagacgagaggtgactaggtgagggaaaagtcactttctaagttaagaatctccagtatcttctgattcagagtcgcctatttttttatgattcatctctttcttcttaccttttcttttgatctatctctctgttctccaactgctgcagattctcagtgtaagagcttggaagagcttgagttatg

SEQ ID NO: 30334 - DNA, 3000 bp, Unknown; identical to SEQ ID NO: 13394
  misc_feature (1)..( 3000): 2750-1469P.txt file - cDNA_ID_3029896; gDNA_ID_2214624; Annot_ID_187754

SEQ ID NO: 30335 - DNA, 3000 bp, Unknown; identical to SEQ ID NO: 13395
  misc_feature (1)..( 3000): 2750-1469P.txt file - cDNA_ID_3029900; gDNA_ID_2214624; Annot_ID_187752

SEQ ID NO: 30336 - DNA, 3003 bp, Unknown; identical to SEQ ID NO: 25090
  misc_feature (1)..( 3003): 2750-1469P.txt file - cDNA_ID_3029912; gDNA_ID_2214624; Annot_ID_187746

SEQ ID NO: 30337 - DNA, 3000 bp, Unknown; identical to SEQ ID NO: 13390
  misc_feature (1)..( 3000): 2750-1469P.txt file - cDNA_ID_3029929; gDNA_ID_2214624; Annot_ID_187737

SEQ ID NO: 30338 - DNA, 3000 bp, Unknown
  misc_feature (1)..( 3000): 2750-1469P.txt file - cDNA_ID_3029935; gDNA_ID_2214624; Annot_ID_187735
atatctatgaatttacccacatggtaagcctgattgttttcttgtttgatctcttgtctgcagcggcggattaacctgccctgcatctgattttatcgaagagacatttcttctttcggttaagcaagctctccctcagcacggtcttttcatagtgaatttggtcacgagatcacagtccgtcaaagatatggtagtatcaagaatgaaaaaggtaaagcaaatgtgattcattccttgtaaattctctgcatattttcacaaatctgatctgatactattgcacggaaattgagtcatagaattgatctctattgttttgttttttgccaaggttttcgatcatttatttggcctgcaactagaagaggaagatgacgtaaacgtagtgctctttgggctttgctctgaatctgtaatcagcgagaacgatattccagaatctgcagttatactggagggattgctcaagtgccagagattggaaacgaagcaaagcatcatagacgctacaaagaagctgaaatgctggaaataaaaacattctttattatttcgttttaaaaagacgtgtgagatatatttctgttataagttaagattgaaatttttgagactatattatatacaatacacctagtttcgtccatacgcaaatggaaaatgaagcgtggagtttttttcataacctttatgattgttagacctaccaacttattgaagcattcaatttggatgatagtgaagttggaatgtaagttaaacatcaatgtcttgattaattttgtgcatttttgggaactatccgtattgtttctgatttgagtgatcttccttattgttgctaagaaatgctcgaatggtgattagcataattgctgtttattcattggagctataataattatggttgtaatattgtaatttgggaaagaaagcctttgatacaggccgattttggtacgtacgtaagagagatataaattgaaacacctaaaccaaaatctggtcgccgcgaagacaaaagaaaaacatttgtggcaaagaaacaaattcagaaaccgcgtgggtccgatatggaacgctgatcaattggacatttgtaaacatttcaaatattttgcatgtaatcaatattgttgttatattttttgccttttagttatagttaggtttgttttttctgtttgtttggttagattcaactatttgtttatgcttttcaattttgggttagtatttagctgtttactttggagaaacaaaagaagatagattctgttccatataaacaaaaagctgtgtcgttgaaacttgaaaatgtgaatatactcggatatcaaccaaagggtacgctgcattaaccaacctccctcgtagaaaatttcaaagaaaggataacaaaacaagaaaaagcacaaagttgaaaaagaagtgacagatgcagaagaattggtcaaaatcattttgacaaaactacataaaaaacaatcaaatgtcactttcaaaattattagcttatttattattttattatgaaaataatgaaagcgacttctatctgggactggtaaaaggacctctctcaccattggttgtacattagctgtcaaatttttacatttccattacattccctaactccaaatatatacactaaactaaattcttcaagttacttcctaattactactatagtaattatttcctaaccgtcaaatagtactgaataacacatataatatagtttcgattgattaagagatttgaattaaacagaataaagttttacgattatatattctaacaatttatttgtctcacaaaaaaatctatagatttaatgagaattaaatgaagaggacgaaaggaaaaacaaaatgaagaaaaagacatatgaaacgtagtcccctcttttctttgctttcttctctacataaaactaaaactcctctctttcacgaccctttaagtaacgacgccgttttcatccaaacacaaacctctggaatcgtgtcaccgttggagctccggcttcattaatggctttcttcaagacctgaagacaaaagaaagtaaaaatatatatacactagagagaccaagatcctcgtttatgggtttcatcgtgtcttgtgcttagggtgacataaatacccatttagagagcttagaccaagaagttttagagtttgtgaagttacttgttggttagtctgctgtttctggcaaatgctgagtctcttctctctgtaagttcttttttcttcatttactctgttttgttccccatttttggtctttttgacttaacttagagtattttaaggcaaaataaaatcatgaatcttttggtattttttgttctcatcttcttgtggggtttttctattgaagtttgcttagctttgaatcttgtctaatggagctaactcgatccaaaataaaaacacgtataatgattaactagttctgctcattagatgaactaaattaatgagttaattccgtagtttcatgcatcctacaatgtattgtctatgtatggaagcaaagtatgatatcatatttaaacatctatgattgtgctactaaactttaaataatactttaagctgatgtgatcttatatggataacctctgaccattatctactttctttgaccattgctcttgttttctaatccaaaagtcgtatcttccaatgcattagttggtccaaacctagatttgcatcccttaatttgtagtagttaacatctaattttgatgttaaaaccaagacaccactttgtttgtctggtctgagaatatctcaaggcgtatagttttgtccttatgacgcttgcaaaagcaagttgttgagttgtaatcttatgtttttttctgcaacttgccttggatgaagccatgagattatctttataaatggtagcaagtaaaccggtttcttatgtcgaaaaaccgatcatttttgttttgtttgatgacaaggaatg

SEQ ID NO: 30339 - DNA, 3003 bp, Unknown; identical to SEQ ID NO: 26434
  misc_feature (1)..( 3003): 2750-1469P.txt file - cDNA_ID_3029964; gDNA_ID_2214625; Annot_ID_187790

SEQ ID NO: 30340 - DNA, 3003 bp, Unknown
  misc_feature (1)..( 3003): 2750-1469P.txt file - cDNA_ID_3029980; gDNA_ID_2214625; Annot_ID_187786
tcctcgagacttcatggtgaacaaagtcccgttccccttaccctctcctcagatcttcaacctggatcaaatcaatgcacttacaaccgatacacttgtatctgacaacggttagtcattattcatagaagtgaaatgagttattttccttgagttaattgagtctcactttttattgtacaacaatggctatttcagccttgaagtttcaggatctggaccttgtcccccataaattgaagggatatccggtcgagtttcttatccaatatcgcaagggtggtcctaacttcggttctactgtcagtgaaaagataccaacagacttctacccttgatgctgcttctctgctcaaaggtcatttcctggactaattttttcatgcaagtgtcacaatgagattgcggaaaccagatttgctatgttgatgactttcatttacttctgtcaataataaacgggtcctcctctttgttgtgttcttgaaaaaattataacacatcaacatcattataagttagagaggggacaatatatttcttgatgtggttggtcccttaggatttatgcaatgtctggttcgtttcgaactccatgtactacttcccttgagtaaaactaaagccatatgctttcatctttgcattacatatagctcggtgttgtatgttttacttacgacaaaacgtatcaacatgcatctgtatgcaatagaggttaaaccctgagtaatttgaagtttcctttacatggtcaagaaggtatttcgactccgttatctcccagtaatgaaacattgatgtccattaacccatcttgaggccttcggtatccttaatttaggggtgggtaaggaatctagtttatgcaaatcgtagaataattcactttgcttctggctatagaaaaagtaaagaactttagggaaccccaagaaccaagcaaagcatatagagcaaatatcatctctggagagacaggatagactcatttttgcagtctgtaccaaaatggaagatgacggagactatcccgaacccgaatctggcagtggtggaataaacttaaacgggagaaatgttggtgcggtgatggtggcgcctagggatgtagacatagcgagtcaaagtggttgcaggatcaatatctacgtgaacagcaatgttcaagcaacatgtggttcagctttgatcggtagcaaggttaagctaagagatcctggtgttcatctccatatagatgacgttaaaatgacccgcgacgataccatatctagacagaaggagatgaccttgattaaggttgggttatgtttggtctgtctttttaacatgtttctagtattcattctcttcctctcctcttggttccggaaggaaagtggttccgtatagatctccccatcaaccgatgatcatgctaagaagtaagaacgatctcgcctataattgtttcctcgatttagttatacttatctatgtcctaatttgtagattattccagaaagttcctatctataacagtcaaaaacacaccatatgttgtcttaattcatatcattccagattaaatcgaagattaatgctatagtccaatcatataaactatgtagtagtctagtgggacaaacgacgtgacgatatcaagagggtacaggattaaaagctatgaagtacgttaccaattacaatctcaagattctcaaccaccggattataactacaagtaccgatttggcgatttgacgaatacagatctatcaattagctagaaattttctttccatgcattttcccaccctcccattagatgatgatgattagaagaccacgatctcattggtgttcactgattcaagagcatttcaagagaatataattcttaattatgaatttgttcaataattaatccccaccccacttttccaaatcacccttacatgttcaccaattgtaacaaataattaaagaatcaaaagtgatttcttttttaatacttattgttgggaaatacttaatgctagtccataactctcttcaattatttaaaggaggagtaagtaagtttttttgcaagtccttttgtggtatccatgtgagttatacattggggagcacaaacttccccactcccacaagccacgtttgtcgcttaaagtttctaagtttttttaattttcgctctttttggtttgttatttatgagtgtatggaagtggagtctcccccttgaacacttcaacatttacactactaatcccgacttagacgacaaacattttttctaagttcgaatgtaattctcctaattcgctttgacctgtttttgaattttatactattcaattttaatttagatatttatctactttagacttgtagaaaattgttttcaatacgagcatatttattacctactatggaaccatttacggatttaccaccataaattagacaccagtattcatataaactatctctaattttgaatttaaacaaacgaaaacaaaacttaaatcttcaactggctaacaaaattttactcatcaataaaacaaagcagtgcattttgttttgcattctaatgtctcttttctcttattcgacctacatcaatagtttcatacaaacaaagtcattttggagcatttttggtctttgtttagacttaattatttatgtaattaggtttgcaaaaaggctagtcatctgctttatgcttactgtcaatccgtcatcattagttggacatcatgcacgagatttggtctcaacaaaaatattaacctatttctacacaacattcaaactaaggcagtcaaaacttatgtacttattgaaatactaattgattagcagagagacgttaaacaatgagcttgaacttgaagtaatcatgttacaacgtgttttggttcatgcttagtgcttaccatcaaattctgcgatttgtgttatttccaacgtatagcatgctacaaaccactcacatgattacacatg

SEQ ID NO: 30341 - DNA, 3003 bp, Unknown; identical to SEQ ID NO: 25099
  misc_feature (1)..( 3003): 2750-1469P.txt file - cDNA_ID_3029987; gDNA_ID_2214625; Annot_ID_187784

SEQ ID NO: 30342 - DNA, 3003 bp, Unknown; identical to SEQ ID NO: 26435
  misc_feature (1)..( 3003): 2750-1469P.txt file - cDNA_ID_3029991; gDNA_ID_2214625; Annot_ID_187780

SEQ ID NO: 30343 - DNA, 3000 bp, Unknown; identical to SEQ ID NO: 13423
  misc_feature (1)..( 3000): 2750-1469P.txt file - cDNA_ID_3029995; gDNA_ID_2214625; Annot_ID_135952

SEQ ID NO: 30344 - DNA, 3000 bp, Unknown; identical to SEQ ID NO: 13413
  misc_feature (1)..( 3000): 2750-1469P.txt file - cDNA_ID_3029995; gDNA_ID_2214625; Annot_ID_187779

SEQ ID NO: 30345 - DNA, 3000 bp, Unknown; identical to SEQ ID NO: 13418
  misc_feature (1)..( 3000): 2750-1469P.txt file - cDNA_ID_3030010; gDNA_ID_2214625; Annot_ID_187769

SEQ ID NO: 30346 - DNA, 3000 bp, Unknown; identical to SEQ ID NO: 13439
  misc_feature (1)..( 3000): 2750-1469P.txt file - cDNA_ID_3030103; gDNA_ID_2214627; Annot_ID_187850

SEQ ID NO: 30347 - DNA, 3000 bp, Unknown
  misc_feature (1)..( 3000): 2750-1469P.txt file - cDNA_ID_3030153; gDNA_ID_2214627; Annot_ID_135979
ctcttcgaaggagaaggtttcgatgaatcttcgtcattattattaggctcgccgtatatagcaaagtcttcatcatcagatgaggcaccatcggagtcgtcgaaaaaatcaaaccggctagaaaattcatcatctgcttcttcgtcacttgcttctttgtcagatgcttcatcgacacctgattcatcgtcccctgcttcatcgtcccctgcttcatcgtcttgataatcgtaacagacaccttcaaacccccgacccggaacttcgaatctagattctgctcttgagtcagattcaatagggcgtttcgaaccccttcctcttgatccgtccttccgactaatatcacttgaatctttcgccgtaaactccacacagagacgtagctgctcgaatttcgtcaaacctagataacattgcaactgtcgatcattggagatataaactggtggagtatcgaagggcatagttttcagagtcttgttggagaacatgtaactcagccgtaactgatgggtcgactgattcactccgtaatcatcgatcaccgtcttgaaaagactatcgtaaactgctctttccgcttctagctgcacaactctacaccctctttcgtcggggttaaatacgaatctctgtttctttacccacgaaccggaaacaactatgaccgtagcgggaccagccatatcaagagaaagatgaaagaaattgaagatgtatgagaagatgaatgaagaaaagaaagttccggtgatgttgtaacgttcaggcggtggacacaatctgggaaaacgatttaaagcaagagacttttcgtatttccgtcgaggatgctgacatggaatgatgacatggattattacagccgacgccgttttgaagtgatgacgtggcaagtcagccaccaaacgaacatttcataacacagccatgaagcaaatctttaagtcagccgcaacatgaatactattacagtaattaaaacaggaaaaaaaacaaagttaattcagccgtggtatgtcgtaactcaactaactcaaccgtaacgttcaacaactcggccataactgcatgatattatagtaattaatcttttaacaataagtcagccataacatggctgagttatatcgtaaaccagctattggcggctgatttatttcactcgacaataactcagccgtaacatctttccataactaagccgatcaaaactataactcggccgcgtcgaggaaataagtcagcctttttctcataactcagccatattgttggctgggttattgtataacttcttataactcggccgaccatccttaactcaaccataccgttgcctgagttatacaataactcaggcaacattttacaactcagccgtaacgtctggctgagttatactcatacttcgccgttttgttatgactcatatatttttgacgtaagtcagccgcaacataccgtaactcagccggctgagttcatttaatccacgtcagcaaattctgacgtggcagtggcattccctgtaattacgttttttccggtaacgtttagtaggggcacgctgggtaataaaaaaaactcgaaaatataacagtaattaaaaaaagttctgtcgtgttctggtaataacacctaatttcttacccatcacagttaatctcccatttaattttttaccagactacatttacgtttgagttttgttacctattgtatttggattttcatttttatgcttccttcaattattgtaacactaattgttattcaattctatagaggtcaactgaatcgctttaagagttaagttttgattacttgaagactgttgactatatggtgtggcaaatacaacatgattactaccggagcttcacctagtcaacagtctccacttttggacctacagatgcactatctccggatagaaagcttctccactcttggaccgacagatgcaccatctccgggtagaaagcttttactggactgtatttgtgaccttaaggttcttttgctcaaccccaattttagtacgtaacctaacctcaaaattggccttacttttcgacgatatttagctcaactctgatctgccattcattaccttgcagctgtcgaactatcaccaacattcaatcttgcaaaagggaattagggttgcacatagtgggataattgttcaactttggtccatcgttaaagctttggcccaatactaaaagtaatggattctttttccaaaaagaaaaacacaggtttgttattttatctttatgttgtttgtttgcttgtcgttggattcttctggatttcacgaccaaacgcagccagtaatagttgataatagctgataattctatcgattgaaaattgtaatcgttggtgacaattgatataattagtcaccaaactaacaacatgcaaacaaacaattttggtcgctattgctggttgatcaggtccatagggatgagacatgatcatgaccaatatgggatggggacttggttaccatttcatatttttgacacccgttattacaagaacacatgcacaaaccttatttaatttgtctttatatgctttgctgtttatagtatttgacaacttgtgtattacttttaaagtaagatttttaaaacaaatactttattacttaataggttacattgatagtatgatatgatttataaattaatagggtaattattgaagatttgcttatgcacaattggttactttagttatcatttgatcttccacataagttttagtattatctgcaactcgttacttgaccttaccattttcttaataattaaatgttaataaattcatgtatatctaatatgattattataagatattatgtgccattttagatactatgccaacaatagtaatacaaatgtgtgcatatataaaatctgaaacacaaaagccaataacaaagaaaaacatctaaatatctatccaaaataaatg

SEQ ID NO: 30348 - DNA, 3000 bp, Unknown
  misc_feature (1)..( 3000): 2750-1469P.txt file - cDNA_ID_3030153; gDNA_ID_2214627; Annot_ID_187827
tcagccataacatggctgagttatatcgtaaaccagctattggcggctgatttatttcactcgacaataactcagccgtaacatctttccataactaagccgatcaaaactataactcggccgcgtcgaggaaataagtcagcctttttctcataactcagccatattgttggctgggttattgtataacttcttataactcggccgaccatccttaactcaaccataccgttgcctgagttatacaataactcaggcaacattttacaactcagccgtaacgtctggctgagttatactcatacttcgccgttttgttatgactcatatatttttgacgtaagtcagccgcaacataccgtaactcagccggctgagttcatttaatccacgtcagcaaattctgacgtggcagtggcattccctgtaattacgttttttccggtaacgtttagtaggggcacgctgggtaataaaaaaaactcgaaaatataacagtaattaaaaaaagttctgtcgtgttctggtaataacacctaatttcttacccatcacagttaatctcccatttaattttttaccagactacatttacgtttgagttttgttacctattgtatttggattttcatttttatgcttccttcaattattgtaacactaattgttattcaattctatagaggtcaactgaatcgctttaagagttaagttttgattacttgaagactgttgactatatggtgtggcaaatacaacatgattactaccggagcttcacctagtcaacagtctccacttttggacctacagatgcactatctccggatagaaagcttctccactcttggaccgacagatgcaccatctccgggtagaaagcttttactggactgtatttgtgaccttaaggttcttttgctcaaccccaattttagtacgtaacctaacctcaaaattggccttacttttcgacgatatttagctcaactctgatctgccattcattaccttgcagctgtcgaactatcaccaacattcaatcttgcaaaagggaattagggttgcacatagtgggataattgttcaactttggtccatcgttaaagctttggcccaatactaaaagtaatggattctttttccaaaaagaaaaacacaggtttgttattttatctttatgttgtttgtttgcttgtcgttggattcttctggatttcacgaccaaacgcagccagtaatagttgataatagctgataattctatcgattgaaaattgtaatcgttggtgacaattgatataattagtcaccaaactaacaacatgcaaacaaacaattttggtcgctattgctggttgatcaggtccatagggatgagacatgatcatgaccaatatgggatggggacttggttaccatttcatatttttgacacccgttattacaagaacacatgcacaaaccttatttaatttgtctttatatgctttgctgtttatagtatttgacaacttgtgtattacttttaaagtaagatttttaaaacaaatactttattacttaataggttacattgatagtatgatatgatttataaattaatagggtaattattgaagatttgcttatgcacaattggttactttagttatcatttgatcttccacataagttttagtattatctgcaactcgttacttgaccttaccattttcttaataattaaatgttaataaattcatgtatatctaatatgattattataagatattatgtgccattttagatactatgccaacaatagtaatacaaatgtgtgcatatataaaatctgaaacacaaaagccaataacaaagaaaaacatctaaatatctatccaaaataaatgaaaaacttttcaatctttctattcgtgtttagtctttgcatgtttgaccatgtatccagctctggattcaagatcacgaacgaactcaaatccaataaacttcttcggattggatgttattccaaagatgacatattcggtccaaaaacaataccaataggacaacatgttgaaatcaattttactattaatttttggcatacaacacgttttatgtgtaatttggaacaaggacctaactataaacattatcagaaatttacagcatacaaggtttccggttttatggttgaggaaggcatataggactagagagcaagagaagatggaatctatttagacaaagaaagcggcaaacatattggaaaatcgattaatttgcataaaatgtatgattggttaaattatgtttaacaatctacctaagaacaaaaaatattttatcttatcatcttgaaacaagaaaatttaccattcttcttttccttcttccccttttcttctagtttttatcattcaaaagcaatctcataatatttggttttaatacatttcacaaaccatctctaataacaaaattcaaatttcttgaaatcccaattgtaatcataaaaactagtcacaatggctattacgagaggctatttaaaggacaatttcgattataaatccaaaatgtaattcaaatccgaattgtaatcataagaaatcctaattgtaatcaaaattttatccaaaatctatccgtttcacccaaaatcaaagaaaaaaggatcaaaccatcaaatctaatatgaaataaaatcctaattaaatacaacacaatcaatagaatgaaaccttaaataaaatcctaattaaacacaacacaatcaatagagtgaattaaaatcttaattaaacacaacacaacataatggttggatcgtaaataagtgaaaaccccttgttttatttgtcttttactattttttggagaaaaaaaactagataaacatatttttttttttataatgggagctaaatagagaatgttttaacccgagaggcccgagtagattaaaatccgaattcaaccttttcggccaagaagaagaagaaggaaatg

SEQ ID NO: 30349 - DNA, 3003 bp, Unknown
  misc_feature (1)..( 3003): 2750-1469P.txt file - cDNA_ID_3030163; gDNA_ID_2214627; Annot_ID_135970
tatttttgacaggccatactggcgatgctatttcccgaatacacaagcagtgatctatgttgttgactcgagtgatacagatagaatcggggtggcgaaagaggagtttcatgcaattttagaggtaaagtactgctgaggcttcctcttcttatactgttgtattattttgtgatggacttcttgcatccaaaagtaattgaggtaaaacgatgatgatgtatatcggtagttgaatggaaatacaatattggttcagtttcttgtttaggacttgttatagatgcttgtaagttgtatatcaagtattgttagccttctaataggtgatactgaaattgaagtatctcggttagtactggacggaaagaacaagtgatcatttctctctgtagatcttgctagctaatcttaaactctcagcaacaatgcttacttgagtttacctctgccactgtcagcatttaactcgcactatcttttcaactatgttttataggaagatgaattgaaaggtgcggtggttctgatatttgcaaacaagcaggttagtagtctctaaatgtttgctcttccgattagtttgggctgattcatctggaaatctgtattggtttctgttgctaaaaagctttagtttgttttgcatgcacaagacacttttttgctgatgaaaaatctataactatttggtctgagtttcattaaatcgacttaatttaggatcttcccggtgcactcgatgatgcggctgttacagaagccttggagttgcataagataaagagtcgtcaatgggcaatcttcaaaacttgtgctgtgaaaggcgagggacttttcgagggattggactggtaagcacattctgaaaccgaaccattttcttggtcccattattgaaacactgaacccatttctttatgcatttcttctcaaatattcttctctcatttccatcttgatcttcaggttgagtaatacattgaagtcgggaagtggctaaaatcatcgtcatacaccaatctgtcacatttctcaagagtgtaactttgatcatttttacttattggtttgtttagtatcttttttttatcttagttcttcatcttaaagagttaatatcaatgacatgttcacttaatattctctttttgttgttttgtttcattctgaaagaaaaaacccaacacagatttttgattgagacccataaggggtaatatcatcactttttaacatgaaatattgaactgattccagacgaaacactgaattggttccaagtggtgtttttgccgacttggattcagaagctcaaacgtttggggttttagaagtcctaatttatgtaatttgtctgctccttaattaatgataaaattgttgacactattatgccatttagtagatagtaagatttttttttaatgttttcaaagaggcaaaaataatttgcaaggaatatatagaactagcaagatactagcctaagctatttgattaactttcctgctaataatgctagtatgctaccaaaacaaaacacaagcgatttgtgaagctctttcttaaagagtccggctcggcgtttagagaatgtaacttgacggtggctctctttcttgatcttaccatagaatcttttatatggcgggtgttgagcaaattaacttaaacaaatttgttttattatcgtaactcaataaaaattacgatttctagtcataaacaaaaggctgtacatagcattaggcctgctacggatccggatatccgggttttttggagtatctggatccgtatccgtatccggcggatatgtagttttaggatccgcatccggatccgtaaacctcggatatccggatttcgaatatccatgaaaaaaccggatatccgcggatattcgagatccgtttatttttgggaacaaattcaatttcctatttcaccaaccagattgaattcaccaccaaaagagatcgacgtgtgcccgacatcagactttgcaaggcacataccaccaagatctcgtctttaacggtgtccaatctgctcctcctcattcatctccgccatcgacactttgaatcccatgtatcatcattcccgtaagtaaacttccgtccataaatttacgacggtggaaccgagatgaatatggtggggagacggtgatgaagattacatggagatgagatggagatagtgaaggaaatggtgatgaaggaaacattcacggcggcagaaaaaatatgttatgaaaccctaatagttaagtcccaaacaaactcaaattccatcattttgtcgtagtgggctaatattggactattgggcttaacattgataatgtgtatttgattaagcccaggatacaaatataacttaagcccataatacaaatatgtagacatattgaacggatgcggatattcggctctgatttttttcataatctggatccgtatccggatccgccggactcgtatccagatccgccggactcgtatccagatccgccggactcgtatccggatccgtcgcacctaattattcggttttccggatcggatcacggatccggattcgaatacccgcggataacggattttagtcccaggcctacatagcatctacggtaattattaactattaagtaaccatgggtaaattcgaatttccttgccgacaaaaagaaggaactttccattccttttgtgaaagtccgtgagaacatgaacccaagttaatacaccttcacatgattagccccacttctcctaaatgtctcgtaaactccaactattcggctaagattcactaacgtgtcatctctctattcgctattcccagatctccatgacccacttcactccctgcgcgtccggtacaatcgccacttccataacaccaagagtcaatacaaaaaaaaagccgactccattattatccctctctctacaaaaaaaacagtagagagagatatagagagcatcaatg

SEQ ID NO: 30350 - DNA, 3003 bp, Unknown; identical to SEQ ID NO: 30349
  misc_feature (1)..( 3003): 2750-1469P.txt file - cDNA_ID_3030163; gDNA_ID_2214627; Annot_ID_187818

SEQ ID NO: 30351 - DNA, 3003 bp, Unknown
  misc_feature (1)..( 3003): 2750-1469P.txt file - cDNA_ID_3030165; gDNA_ID_2214627; Annot_ID_187816
cgaacaaatgcatgtgcggtcacgagggtagaatggtaattttcaaggaggatggtattggtgctggagaggagaaaatgggagacagagagaaagccaaagaaaatgaagaaacaacgagtcagtgagcttttttgttttcttttcttctctcagtcttgtctttttttttttgttggggaattttccttcgtgttttcacgggaaatgtaaaatttactgagagaaaattttgggttatgattaatgaatgtttgcttgtaatttcctatccccaatggtggaaaactcgtttttagtttttgtaattctcaaaagtgtgataggtaacctttctcatacagctttaataccaatcagtaatagagtaaactaaaacggaataacataatagtacttaaaattcttacaattttatgtcatcactaagatctacaaaaaaatgaatcatagtatcataacactatgtttgcccaaaaaaaaaaaaaaaagtatcataacactattgatcataaattcaaagcttgcaatgtttcgatggaaacgtgattcatcccgtacacaaactgtaattttatatacattttcagaaactaatgtaatgcattaacccttttgtattacgtatatattctcacattttatattttgtaaggagattcgtttagttactttaattatgaattgttataattgtgtctcctccatgtatttgtgttactttcatattttccttgcatttatatattttatttaccataggatagttctgaatttgctatcaacttggatattttaaattaattgagactccatctagttcaccgtcaaattttaactatacttgtttaactatacttgttatataacgagtgaataaactggaaatagtattactattaactatgaacttacattcgtaatattcgaaaatatgtgcgtgagttagtcttgtcacaagaaaaggaatcatattctttttttcattaaacaaaaattggaaacacatattatggtataaatcaaaagataattcgattacttgccccatttgcctgctttactttcaatttgataatatcccatcaacaagagtcttgttacatgaccaaattttcttctgttctcacgttattaagtattttgaagtgaagtgcactccaaacaaacgtctaaaacttaaggtttgtataatcctcaatcaaaaacattttacaacttatttctatttttttatattggggtctttttcccagctactaatatacgatcacttaagtaattttttgtaaaaatcattaaaaatcctaataaactcatttgcgtagttcaattacacacatacatatgtagtaatataaatattattttccgttttaaattatcgtaaatggaatgtcatttagaattttaattttattcaccacaaatgtttttttctgttttaatatatttgtttgttaaaatttatattttcgtcgctaattagtccactgaaattataatccacaggctagataatccactgatttcaacaaaggtgaaaaaattatataactaatatttgtccattagtagtagctaattaattgaaaacgtttgttctctgaatcgaaagagctgcataagagaaaggggacacgtgtcaaaaacagagtttaatatgaaagcgaagacaatgattctgttttgacttatttgtcatttgctgagctgtctttagaggcgccgagtagccgcgtctcccgcaagaaagttccaaagcaatacttcttctttcattgcattcatttccccaactgtctcaaactttgtgccgcataagcaaaaggtacaaataaaataataataaaaataaaggatggcgaaaacaaaattacttgtatcaaacaagaacattttgttaatttttccgagtgaaaacatcacttgatatggatatgcgattttagttgttgtaagtttctctagcataattgataattcctattaacatcaattttgatatagcattaggacttcaatgtttttatttttagggtttgttctttttgacttcattagtctagtggtactttaagaccactttttcacctcacacatggatgatccagacctagtcaagctaggagtgacttttatgtttatataatttatacatgttaaattattttagttttcttttttaaaggagatgaatttaattcggtgtggatcccgtctctagaaaatatagggtctttgggcttgaacttccaaatattcgaataacaaaaaaaattattttagtttttaacccaaaaagaaaacatttgcgatcaaatgttattgtaaacaacgcacactaaaaagacatttacccttttcggtgaagagacacagggacagctacatgcgacccaaaaaatgagcttaccctctatttcacatatgtaagaatatactctaattagactcagcatgtagtataaagaaggtgttgacaaaaaagctcaaataattcgataaactaacaatgcacgggtactaattaacaaggaattctcataaaattgaaggtaaatttaaacaacaataagagcatcccaattaggtaagagatttagttaagtaattgcgatcaaggaaacaagtacaacagaagtggaagtctgtctctatatcactttcttccctgatgcataaacttacctcttgttcacaaactttgttaacattttgataatgcaatgaaatgaaattagaaattcaaaacaaaaatagagaaaagtacaaccagtggactatagtccaattagtcaaccaaagtaacaatgggccgagctgataatatttaggcccaaaaaaagcctctggacgaatcagagacactggaaatgaacgttcttcttcgcactaactctcaaagaagaagaaaagatctgagaggtggtcgaatgatccaagagaagaagaacaatctctcttagatcgtttgatctgatccaatcgaagaagaagatg

SEQ ID NO: 30352 - DNA, 3003 bp, Unknown; identical to SEQ ID NO: 26440
  misc_feature (1)..( 3003): 2750-1469P.txt file - cDNA_ID_3030185; gDNA_ID_2214628; Annot_ID_187893

SEQ ID NO: 30353 - DNA, 3003 bp, Unknown
  misc_feature (1)..( 3003): 2750-1469P.txt file - cDNA_ID_3030224; gDNA_ID_2214628; Annot_ID_187880
atctttacatatgtatgtatgtatgtaaccattgattcatgctatgtttattatttatgtatatgaattctgaagaatactatttagaccaacaaggatgataaaaataaaatgattatttgttaaatggatctttcatttttaaaagaaagagaaaaaaaaaaaattatccaaaaaattgtgaaacaaaatatatataaatttgtagagattttttaattattatggaagaagaaaaaaacaagttttctacgcatttgttttaacaaccgtgtatttgagggttttaaaaaaaaggagaaataaagaagaaaaattaaaaatggctttaaaaactttaaaaaaaataaagcataaaaagtttgattggtagaaaaaaaaactgtgaggactttagaatactcttaaagtcctggaagtcatgtgccaatcaccccctttaacctgaatacgccaagcgtttttgtaaggcttaagcgatttcaaaggagtaaatggaagaggattagcgagcatcatttaaaaaaaacaaaattagaaatgaatgtatgagtctaagatgagtgagtagattgaaatgaggggtccgatatttataagaataagtggttaagtaaaaaacaaatacgcaaaagatattattcctgaaaatcaagtttattccatatcacaaaatctcataattataggaaaatgtttagcatttaccgtaaaagtgggtatgtatatatggaatacgtgtggaaaatgtaagataattccaaatgaagatccaaatggaatattagatgtgctataattatggagaagtgatatattcgaatgctggaaacgaagatacgcaataaattaaatgaaattaatacgattcgttgcctgatatatagtcagataatttttttgcatgaaactacaaaatcgtacggctagtaattaatctattcaatggctaggattaaacggagaatccgacttttttaaaaaagaataaaaagaaccgcgttttttttttgggaaatacgaaatcgaaaggctaaaaacaactcaattcaatggccaggattaaaggcgagtacccaaatttttaataccaggtaaaatgatccgcgtgttttctaagtgaaactgcgaaagcgaacgactaaaaacaattcaattgaatggccaagattagaagttatgacccattattttaaaatctgggtcaaaaggatccgcgtgttttgtaagtgaaaccccgaaatcgaacagctaaaaacaattcaattaaatgaccaagattagaagttatgacccattattttaaaatttgggtcaaaaggatccgcgcgtttctaaaaaggtttttttcatgacataaaatttttaaccttatggcaaatttattattttagcgaaattcatgcatactttattaaacgtaattatcaaataatagagtagattataattgaatagtataaacatattttcattttatttttgtttttgtttaactaagctcacagcgacacaattccgaatattagcaattggagaaagaataaaagacacagagcaccatattattcttttagcccaaaaatttccacaagtacaaatccggcaaaaacacatacatagaccaatttttggtttactgacgaaattttcagatcagaaaaccggatttgattcaagtgggtccctaaaccgtcggttttaaacaatattttcaacgatgagctttttcaagtcaaactagcgaaacagctatcagacctagacaaaacattagaaacacaatcatgatgattatcttgatcgtctttagatggactattaggcatagatctaagcattcttggtgaatctaagctttttctcaagatctgtctcatcgcagagatcaaatgtcttgtcagattcgatggtgggcttgaggatttgaacttattacacttgttcatgtgtctcgccatagcttcttcttctgttgttaaaaatctttttgttctcatgactttgtacttcacagcttcagaacaaaatccagagatccatttccctatgtaacgctctcttatcatctctgtgtacgattctgtacactcgtcggttaatccgcaacagtcacacgtcaccgaatctagctcatcgctggatatttgtgtcaccggaaccgttgagataattattacatccggtgttgaaattaacattgttggatcactaagtacactatcagacatggtttcttgatttaaaaccctgttgagaaaatttcgatcaacaatctgattcttacttcaacataagaaactataaagaaaccaagaggagaagttttatcagtagcagaagatgagaagataacgcaataagcttgtgatatatcttctttgttttgtctctgtttctgaaacagagaaatggtttttaaaaagggattcttaaaagaaattggaatacatttttttttttttaacgttcgttttgccactctctgtcttctaaattactttcatctccgagaaaaatttcacaaaacaaaaccattgcaaaaacagagtattaaaaatgctttttatctttggcttttcttgaaaacaaatagaaaaagttaccgtttctatttacttcacggaaaaaacattagaagttcataaaaattcactcgaatctctcgttacttcagaagagagaaaaaaaaaagtattgttttggaaatatatgaggaagagaaaatgagagaagaagtagtgcaggcgaaggagaagcaatgtttggtgttttataagagagacgatagtagtaactagtgacgtggaatattgattttaattttttagttttattttatttattgaacattttatcaaaacgccgcgtattagagaggatgccctagtttaatgtcttggtataaaagcctatattttgcatttttcatccgactctctgcgttaggtttcattttagcggcagacgagagagcaaaagcaaggagaaaccctaaccatg

SEQ ID NO: 30354 - DNA, 3003 bp, Unknown; identical to SEQ ID NO: 25108
  misc_feature (1)..( 3003): 2750-1469P.txt file - cDNA_ID_3030244; gDNA_ID_2214628; Annot_ID_187874

SEQ ID NO: 30355 - DNA, 3003 bp, Unknown
  misc_feature (1)..( 3003): 2750-1469P.txt file - cDNA_ID_3030267; gDNA_ID_2214629; Annot_ID_136020
tcaaaaaccgatactctcttcttcaatctccctctcttatctctccaagctaattctccaaaccgtcttttctcaaaccctaacgtacggattagggtttttgttcgttgattccaaaggttacgactttcaatttctccaccaaattctctgtaaaggttaaagatttctactttcttttgagttcttagcctgattctttaaccttttcgttgtcattcgtcggaattttggagtggtcaaagtaataatctttatcacaattcaagctttttgagagttgattggttaaaattgtttctttttgtttttgcgagtttaatttagtttgagatttgtcttcactggtttctggttttgattagaagttgtttctccattgtttaaaaagtaaggagtaatgtgtagttgcagtagttttttttttttttataattgagaattgtggattatgttctgattctaatgattgtttaataatttgtttaattaaaatatatgattaggtgacgatgaatgagaaaggagaaaagacttgtcctctatgtactgaggagatggacttgactgatcaacatcttaaaccttgcaaatgtggttatcaggtttgatacattacaaccacttttcctcacaatgtggctctcttgtttgtttattgtcactgtttgagtagaatgtgtgttttggggtcttgtttatagtctgaaaccgttgggtgttgatacgtttcattaagggtattgcaatttgctatgggcagagttttttctcaccctattcttttgagtttaagcaccaaagaatctaagcttctgttaattctgtatgctgtatatattaacacatgcctctgtggagagttgtcttctgcttgaaaaggaccacgatgtgtagtctcagatttcgaattgttttataggttgtcccacattgtctataagcatcttgtgaatggaccttttcttataatcgatgtttaaagctgacattacccagccttatattgttgcctgttcatttatgtttgaattattcagtgtgccactgtggtgatctataagaaaccctttttatgtaaatacatgtactttgtgcagatatgtgtttggtgttggcatcatattatagagatggctgagaaagataagacagagggtcgttgtcctgcatgtcgtacccgttatgataaggaaaagattgtagggatgacagtcagctgtgaaaggtagatctgaagctgaaaacaaacccttttttgtttctgtgaaacgtgtaaaaacttatctttttcttgttctgataattcactaggttggttgctgaattttacattgaccggaaaaagtcacagaaggcgaagcctaaacctgcggagggaaggaaagatctaactggtgtgagagttattcagagaaacttggtttacgttatgagcttgccttttgacctggcagatgaagatgtaacttaaacagccttaacttatctccttggcactcacatttgctttgaaaagagataacctttttcatatcattaatctgggttgttatgtatgcagatgtttcagcgaagagaatactttggtcaatatgggaaagtcgtcaaagtagcaatgtctcggactgcagctggggctgtccaacaatttccaaacaatacttgcagtgtgtatgtatccgtatttctttacacattcgaatgattgtatctagttcttgatgaactaatatttgtgagtccatatagctaagcacaaccccatttctttctgcggtctatttgacatgtttgcttttaacaaacttcattgagctaacattttcgtttttgtctaaaattgaatttcccagatatattacttactccaaagaggaggaagcgattcgatgtatccgatcagtacatggatttatattggatggtagaaatttgaagtatgttatgttttctttttttttcaaaaatagttatggtagcctgtggttcaatttctaatatatttttggatgtcgttagggcatgttttggaaccatgaaatattgtcatgcgtggttgagaaacatggtaagcagatattgacttgcttttgctcactaggtccctctatatacttaaatacaaatccaattgtgtttcgtggatgcctttttgtttcagccttgctccaatgctgaatgcctttatttgcatgagattggtgcccaagaggatagtttctcaaaagatgagaccatatcagcgcacatgaggtaaattaatttcaataatctctgccttttagttaaatgaaatagattgtggttgattcttgtttttcgttgatgttgatgttgggctccgttagtgaagtatactttaattgacattaatattgcatttagctcatgttttgtggatgcagatgtgaacttgttcactagctggttttctttgaaagttttaacacccatcctttcttgaagctaggagagatttgattttatatcagtaatttcttctgctctatatgttgtgctcgttaggtggttatctgattcccgttctgtttgaataggaaaatggttcaagatattactggttggagggatcattatgtgcggcgttcagggagcatgttacctccaccagttgatgattatgttgataatgagtctagcacaagaattattccaaaagttgttttgaatgtaagttgccaactcttcttggagcttcctgaattttttctgctctcagcatattcacatgccgttatactttatgagaaggactagatgcgtttatgtgtgataaattctgcttttgacttctttcttattcgcccttttttttcctttgcagaatgtacatagtgccgcgaaaaattctcctccaaatgacagcaacagtcactctgttactcttcctgctggagccatgtggtacactgaattcttatgataatgttttttttaattgctttgtctgagaaacttaacttgtttttcaggggaatg

SEQ ID NO: 30356 - DNA, 3003 bp, Unknown
  misc_feature (1)..( 3003): 2750-1469P.txt file - cDNA_ID_3030267; gDNA_ID_2214629; Annot_ID_187911
aactcctctgctttgtctttttttttttgaatctttataaccgaatctttcaaattgatatttgttatgccgtagtagtaaatgtcagaagtggacaatttagatctctttttggagggtttcagttttttttttttatataaaaatatacatccttgtcatggatttttggaggtttgagatataaatggaaccttatgttggctatacccattttataaacaatacataatcttttaacattagagttgtaatggtggtgatgaaatgtatttgtctcggattccagatcgtaagattttgatggtgaggttgtgttatgtatcagacacttcgtcctaaaaattgaacaagttcttggctggtcgagcagacattttattgttcaatcaatcctgcatctaaccgaaccatatgaacttttgtttgagttcaacaaaaccgaatcaaatccaaattgaaatcagagattaaccaaatgtcagatggtaattctgatctttatttattagtagtaaaaaaaacaaagaggctcgttaattgtggttctttaaatagagcggcgactttgactcgttcatatatttgaccaattgttatcttcaaaatatcttagctagcatcttatatccaagtagagcaaatttcatgcattgacttcaaaaagaaaaggagggagagtgacctttcttgggtgtatatttgtatgcatagaggaatatattactctaaacgtaacaatctcatcaagtttgggtttgaagaatctgttttcggctcacaagttggtgaaatgcattcaaagaccaaattggagacaaagatcattcaagagattatcttttccagacagtcatgggtattctgaatagcctcgctatatggaagtgtagcatgttggagataaagatagagaagacaccatcatgcacaagtccaacaagttcatgcttctctaacctctcatatgtgttaatgtgagattgctcgggtctaatggatttgacgtggttgttgtttactccaaaccttattgatcttaaggttggttcgataaatgaacaagtatttgatgatataataagaacaagcatagtgtcgaaaacttagaaagcttccattcgactctaaaagtggtgttgttggtaaagaacttgtcataaatcacgtagacgaggaattgatagaaagagttaaatgggaagacgaggccacaagacttcgtttctcatcttcttcctacaaattccaaaaagaaatgtccaaaactatctagctccgcgggaacgtgtgtaactacaaaaatgcataagttaattaaaaagtcagctccttactaagtccgtcttgtccaagtacttcgctccgatatgtttctaagtcattattctttgtagattcataataaacccatctctttcttggtattccaaacattccttgactcatattttgatattattgtattcatccaaactttttgtgtaaaccaaatcactataaacaaaagtcataagaaagttaagaatttcatttctttgaataaccgctcaaatatcaattatcttatcattcaaaattgacattaaattcatcattaagcagaataaagctataataatccaccactagctagaacttattggttcaaccgtaaagaagtgataataacctaaataccattaaataactcatcaatgcttgaatgatttgagaccgaacccaccttcccagtactggagcgttactttccactttctagactaaagaaatctgagtagacactcaaatcattcagatatttccgcaggtaaaccaattttagaaatcccaagttgataactaaaccttaagtagctcaagtcgaattaaaccccaaatcctaaatctgagtgatattttttcccgaaaataattggtttttacgatatgaatttatcaccgtaacaactaccttactaacaccatgtcacaacaggtccgagacatcgagacacaactctccacataaaaactggactaaactaaagtgttcgacttcaaactcaaaataaaccggactaagtgtttgaaattaaattaataaaccaaaaaccgttaataaaccggactaaagtgttttaactttttaaccatcactaattaccaattatccaaaataaataaaccagaataatccgaaataataagaaaaataggttttagaatacctagaaagtaactggtcgcatgagataaatgtacttttaacatgaaaaaataacttgccgtcaaaacaaaaaaaaagaacatgaaaatgaaaaataaattaggtataataattattatttaactatattaattgacaaaaaaaattgaatttgacatctttgaaaaaacaccagccattggcagaacaaaaggtttagccacagtttttttttttctcctcgtctcttcgcaaatcctcttcttccttcgattctctctgaaaatctcttctccttcctcaaaaaccgatactctcttcttcaatctccctctcttatctctccaagctaattctccaaaccgtcttttctcaaaccctaacgtacggattagggtttttgttcgttgattccaaaggttacgactttcaatttctccaccaaattctctgtaaaggttaaagatttctactttcttttgagttcttagcctgattctttaaccttttcgttgtcattcgtcggaattttggagtggtcaaagtaataatctttatcacaattcaagctttttgagagttgattggttaaaattgtttctttttgtttttgcgagtttaatttagtttgagatttgtcttcactggtttctggttttgattagaagttgtttctccattgtttaaaaagtaaggagtaatgtgtagttgcagtagttttttttttttttataattgagaattgtggattatgttctgattctaatgattgtttaataatttgtttaattaaaatatatgattaggtgacgatg

SEQ ID NO: 30357 - DNA, 3003 bp, Unknown; identical to SEQ ID NO: 26441
  misc_feature (1)..( 3003): 2750-1469P.txt file - cDNA_ID_3030271; gDNA_ID_2214629; Annot_ID_187910

SEQ ID NO: 30358 - DNA, 3000 bp, Unknown; identical to SEQ ID NO: 13463
  misc_feature (1)..( 3000): 2750-1469P.txt file - cDNA_ID_3030283; gDNA_ID_2214629; Annot_ID_187901

SEQ ID NO: 30359 - DNA, 531 bp, Unknown
  misc_feature (1)..( 531): 2750-1469P.txt file - cDNA_ID_3030287; gDNA_ID_2214629; Annot_ID_187900
ctatgaagattcctaaaattgcatggaatacgagtttctatgttttttgttttcattatttttagagttaaggaagattcctaaaattggaatagattaagaagtctgatctgatctcgttgactttaaatttggacagcctgtaagcttaagattgtctaacgattgtctgtactaattgtatagaacattgttgttttaaatactaattgtatagtatattactattagtagtaatatatcctccattagagacattaactagtgtttttttttttaataatgagagcagtaagttttacattaattagtgctttaaatttggacagcctgtaagcttggagattgtcggtattacttgtatatacattagatgtaatattaccgatgtagagagcagcactaagtttacattcatattcaaaaagtcaaaatctatcatctactcgttacgcagataatctttctctcgacatctctatggattcgaagacagagtcgaagctcctatcgctcacatctcaaataatg

SEQ ID NO: 30360 - DNA, 3003 bp, Unknown
  misc_feature (1)..( 3003): 2750-1469P.txt file - cDNA_ID_3030296; gDNA_ID_2214630; Annot_ID_136032
aatgtggtaacatctcagaagctctcagtgtttttcacggaattcaaacaagaaactcgcttacatacacagcgataatcggaggtttagcccttcatggagatgcatccactgctatatcatacttcaacgaaatgattgatgcagggattgccccagacgagatcactttcataggactattatcagcatgttgccatggtggaatgatccaaacaggccgtgattatttctctcagatgaagtctagattcaacctaaaccctcaattgaaacattactctataatggtagatctgctagggagagccgggctattagaagaagcagacaggctcatggaaagtatgccaatggaggcagatgctgcggtttggggagcattattattcggttgcaggatgcacggtaatgttgagctgggagagaaagcggctaagaaacttctcgaacttgatcccagtgatagcgggatctatgtgttgttggatggcatgtatggagaggctaatatgtgggaagatgcaaagagagcgaggaggatgatgaacgagagaggtgtagagaagattcctggttgtagttccattgaggttaatggaattgtctgtgagttcatcgttagggataaatcgagaccggaatctgagaaaatttatgatcgcttacattgtcttggaaggcatatgaggagctcgttgagtgtactattttcggaatatgagattactaataactaatgggactgaatgaaactgctgagttttgtattaaggcatctttggtctaaactagtatagaaatgggtttgagggcaaaaaaaaactcaaatgacatctcctgtgtattaattggccagtttaataaaaacatagtaacattaagagtgtcattttacatttttcaacatgatttatacactgagtttttttgatttaacattaacctaaaactaataaattatttattatttgttaaacagaaacaaatatatacataattaaaaaaaattgtgtgaatatgtcaaaatgatactctttattaaacggaaggaatattaaaaaacccatatttaatgaattaaaatgtgggtcaatatttattgatatcctctcttcttttggtaaggattggtttggtgaacctcaaatacaatgacctccatgtgcgtcccatttcctgatttcgaattctataaatttcttaggaaactagataccttccgagtcctatgtattaattaattgtgaccgtttctccgaagtgtaataaatttgcatacgaaaattgacaacctctttttttggttcaaccaaaaattgacaactaaagatggggacaacataatctcttaaaaacggcaacgtatcagtaccttttagagtttcagaacgcaaggtcatgatgatgacgacttccgtagtgtcagtcacttttcgagtttcagataatttcttgtttgattgctaaaaaatatgaaccaatggcctgaaattgttgcctccctttctcacaacaattctcttatctcaagacaccaactcactataatattttatccactaaagtgttgttatataacaaaatacaaaaaatcaaaacaaaaattgacatctaaattttaagtaaattatgcataatttagaattatattgctaatctttttatcttaatttattaattttatccttaaattattagccgtagagtaactatagcattgagcactacgacgacactgatcacattaaagtattaaacaataaatgaataaaagatgcatgcttttttgtaaaaaaaaatatagtatgaattatttggccaaccaacgtgaatgtgaagataaggttttgtatgctttttacaaagtcaaaaagtgccttgaccatacgttaggtttaaaatcaagagttgaataattcactcacaaattcatcgtgacctttaaaagcctatcaataaatgtgtgttagttacactatttgattatgaacattgaccaggattaatgtttggttctagctagatcattcgcatttcataaatagtacaattttttcattattgttatcaatagtattaattatagcattatttcttgtatacgttacataaacaaaattcttgtataaatatttaactagttgttgaatacaataacaaaaatctaactattcatattatacaaaaataatcactattagtattaatgtatcttattaatatggagtagtaattatttttgtatgttatgaatatatatttagatttttcttaagatgtttttaatagtaattatttttcataagatgtttcttattaatgtatttttaggattttcacacatcttaaaaaacatattaaaagttgattagaaatatattattcttcttgaagtttacacatcaataataactagtaataaatattgcatagaaattttaaaaatgactatcttttcgaatcaaaaaaatttcctacaaaatacaataataaacaaagagagtagtactgttcatctaaatactgtataatggatgttttaccaattttaacaattacgtacaaaagtttcacacctttataaaaaaaatttgatcaattatccttttatcttctttatttttgccagctaatatacactgcaataatccaaacttaacaaacatttaacattacttcagattcatcattcaataatttcacaaacccataattttaccaaattactacactaatcccccattggcaccaattctataattagaaaatttatttctttatttatttatttatttatttctatttattaaagaaataaattatagaaattggaatgcccaccaccaccagagaccacacttgcacaaattccatctataaacacaaaagcctttagtatcattctcgaaaaccaccaaaaacctctttataacccaacaaacaaagtctctacttcttcttcaatcactgaaacacaacaccaaaaaagaaaaaagtatg

SEQ ID NO: 30361 - DNA, 3003 bp, Unknown
  misc_feature (1)..( 3003): 2750-1469P.txt file - cDNA_ID_3030296; gDNA_ID_2214630; Annot_ID_187929
ttgatgcagggattgccccagacgagatcactttcataggactattatcagcatgttgccatggtggaatgatccaaacaggccgtgattatttctctcagatgaagtctagattcaacctaaaccctcaattgaaacattactctataatggtagatctgctagggagagccgggctattagaagaagcagacaggctcatggaaagtatgccaatggaggcagatgctgcggtttggggagcattattattcggttgcaggatgcacggtaatgttgagctgggagagaaagcggctaagaaacttctcgaacttgatcccagtgatagcgggatctatgtgttgttggatggcatgtatggagaggctaatatgtgggaagatgcaaagagagcgaggaggatgatgaacgagagaggtgtagagaagattcctggttgtagttccattgaggttaatggaattgtctgtgagttcatcgttagggataaatcgagaccggaatctgagaaaatttatgatcgcttacattgtcttggaaggcatatgaggagctcgttgagtgtactattttcggaatatgagattactaataactaatgggactgaatgaaactgctgagttttgtattaaggcatctttggtctaaactagtatagaaatgggtttgagggcaaaaaaaaactcaaatgacatctcctgtgtattaattggccagtttaataaaaacatagtaacattaagagtgtcattttacatttttcaacatgatttatacactgagtttttttgatttaacattaacctaaaactaataaattatttattatttgttaaacagaaacaaatatatacataattaaaaaaaattgtgtgaatatgtcaaaatgatactctttattaaacggaaggaatattaaaaaacccatatttaatgaattaaaatgtgggtcaatatttattgatatcctctcttcttttggtaaggattggtttggtgaacctcaaatacaatgacctccatgtgcgtcccatttcctgatttcgaattctataaatttcttaggaaactagataccttccgagtcctatgtattaattaattgtgaccgtttctccgaagtgtaataaatttgcatacgaaaattgacaacctctttttttggttcaaccaaaaattgacaactaaagatggggacaacataatctcttaaaaacggcaacgtatcagtaccttttagagtttcagaacgcaaggtcatgatgatgacgacttccgtagtgtcagtcacttttcgagtttcagataatttcttgtttgattgctaaaaaatatgaaccaatggcctgaaattgttgcctccctttctcacaacaattctcttatctcaagacaccaactcactataatattttatccactaaagtgttgttatataacaaaatacaaaaaatcaaaacaaaaattgacatctaaattttaagtaaattatgcataatttagaattatattgctaatctttttatcttaatttattaattttatccttaaattattagccgtagagtaactatagcattgagcactacgacgacactgatcacattaaagtattaaacaataaatgaataaaagatgcatgcttttttgtaaaaaaaaatatagtatgaattatttggccaaccaacgtgaatgtgaagataaggttttgtatgctttttacaaagtcaaaaagtgccttgaccatacgttaggtttaaaatcaagagttgaataattcactcacaaattcatcgtgacctttaaaagcctatcaataaatgtgtgttagttacactatttgattatgaacattgaccaggattaatgtttggttctagctagatcattcgcatttcataaatagtacaattttttcattattgttatcaatagtattaattatagcattatttcttgtatacgttacataaacaaaattcttgtataaatatttaactagttgttgaatacaataacaaaaatctaactattcatattatacaaaaataatcactattagtattaatgtatcttattaatatggagtagtaattatttttgtatgttatgaatatatatttagatttttcttaagatgtttttaatagtaattatttttcataagatgtttcttattaatgtatttttaggattttcacacatcttaaaaaacatattaaaagttgattagaaatatattattcttcttgaagtttacacatcaataataactagtaataaatattgcatagaaattttaaaaatgactatcttttcgaatcaaaaaaatttcctacaaaatacaataataaacaaagagagtagtactgttcatctaaatactgtataatggatgttttaccaattttaacaattacgtacaaaagtttcacacctttataaaaaaaatttgatcaattatccttttatcttctttatttttgccagctaatatacactgcaataatccaaacttaacaaacatttaacattacttcagattcatcattcaataatttcacaaacccataattttaccaaattactacactaatcccccattggcaccaattctataattagaaaatttatttctttatttatttatttatttatttctatttattaaagaaataaattatagaaattggaatgcccaccaccaccagagaccacacttgcacaaattccatctataaacacaaaagcctttagtatcattctcgaaaaccaccaaaaacctctttataacccaacaaacaaagtctctacttcttcttcaatcactgaaacacaacaccaaaaaagaaaaaagtatgtctcttcttccccatctcatcctctacctaacacttttgacggtggttgttactggagaaactctccgaccaagattctacagcgagacatgccctgaagctgaatccatagtaagaagagaaatgaagaaagcaatg

SEQ ID NO: 30362 - DNA, 3003 bp, Unknown
  misc_feature (1)..( 3003): 2750-1469P.txt file - cDNA_ID_3030308; gDNA_ID_2214630; Annot_ID_187947
atttttgcagggaacgcaactaacggaagagaacgagcgacttggcatgcaagtacgtggatatatatatagtcttgattattttgaattttgtatgtttgttatcagtttaatgttaaatttggaatatttttttttggttacgtgtagatatgtaacaatgtgcatgcacacggtggtgctgaatcggagaacgctgctgtgtacgaggaaggacagtcgtcggagtctattactaacgccggaaactctaccggagcgcctgttgactccgagagctccgacacttcccttaggctcgggtaaccaattaatcaccctttctttttacattcttttgagttgatagctttacatgattttttttttgtttttaaattgagacaaagaatataaaaatatatactttaaacgaccatatacatgtatgttgtccatatttattggcattgcaagatatggatgacacagaatcgtaaataaatttggtttatttgttgtatatttgtaattctaacaaataacatgttattttgtatattttacatgatatcatgctatttgttaaaattacctgtcataaaaaacaccacttatttatggtttgttttttgaaaattctggcacaaatctaatcatctacaaaatcactctaaaaaataagttattgatttaatgtatggtgttgtgcagcttaccgtatggtggttagagatggaacaattcaaagaagttgatggagtgaggagagtaatgtaaatctttttaactcggtagtaacaagagacaatgtctaagtagtgaattctcaaatgtttgtgtaagtttctgcctatggaagaggctttcatttttatgattttcactatgtatgatctctcttcactgcatttctggttagtaacgcttgtcaccgataaactttctcgttatggaaagttagaatataaaatattgtagaattttgattatcgatatactcttggttagggatcaaaaatatattttagtgatgcctcaaataactaataatcatcataggactcagtctcattagaaattttagtgtaacaaaagtgtgattcgaattcatcttgttgttttgttgaatttgttgcaaagttttacaagttttctcagaccagagatttcaagtgtcttcattggtgatgattctggtgaattgatgatcttacttgtgtgtgtgacacttgcaatgtgtcttgtttgagaaacacatttgtagtttagttggagctgtgcggttggatgagactgagttctatgataataaattagaagcaaagtttcaaaccatattcatacgattcattatgttagcaacaagaaatatgaatatggtttgaaactttgcttctaattcatcattcgttacacaacgtccaaaatctaaaaaagtttcagattttctcaaaattcagtaaatgggcctctatataatgaggtttgacgttttagagatactttgcacaagaaagaaggttctggtcggatcgttacacaccgacctttgaccggttcatcaaaacgtgtccggttttatgtttaaaccgtcacaaaggggaaaaaagttctttaagattcaattacttaatgattaaattctttgcttgcttcaacatctttacaacttttttattaaacaaaacgacattttcacattcctttatccactaaaattctttgtcagattaatctatatatacatttttgcagctattttagcaaataaatcttagagttagatttatttacaactcaatgccattaacattaaattttttttccaaaataattaattttacattaaatttttaatttaaattgtcaatcacattatcaatcaaatttaatccaaacaaacttcacatcaatcccttaaaattagcataaacttcacattaattatttagacatgaaaatatttatttaaagatttaaatcttctaaatttttgcttttagagttattatatcattacctaaaaggcaaaaaatattaattttttaaatattattatttatatatttaaacttcataaaacattattaatatttgaatttataaaaagtttaatctatcaaaactaattaacattattatataatatataaaattaaaaaaatctcaaaaaaaatttcgtcatattttgtgattcgaaattttaagaatgaacatatatattaaccaattggcgaaaaatgtgtgggttcaacgtcccgcaacgactaaaatattttgacaatgattcataaacatattataaataagatcaatattaataaaataaatagtttttttttgtggacgggtttggaaggacgggtttggcaggacgttacttagtaacaatagtaaactataaaataatttacaaaattttatatatattaattttaaaaaatgaattgtctccgcggtataccgcgggttaaaatctagtttaatttaataaaatcatacatttctgacatgttctgtaacgtttgatgattcataagaatcatcggaagagaatccttccgacttctcctaccacgacgctggcactataacattcgtgtaaacaccattcgtacatataaatcaaatattgaaaattttgtaacaattttttttttaatagtctttaaaatatttttaccaaaatactattaaggtagagagagagaaagaagagcgaagtttgctcccacccatgatcgctcttctctaagaaagaaagaaaaaaaaaagagattcaattgttgcacgttctttcctcaattctgattttgatttacaaccaaaaaagacctttaagtttccttgtgggtctctctaaaaaccgaaacttttctctttctttttcttttcttattaagatctagactctacagagagagattgttggttcacacacatatcaaagttacaatctttctgggaatttgaatgaatacgatcaaaaagagttgaaaaaacgaaaactttacgacgatg

SEQ ID NO: 30363 - DNA, 3000 bp, Unknown; identical to SEQ ID NO: 13479
  misc_feature (1)..( 3000): 2750-1469P.txt file - cDNA_ID_3030312; gDNA_ID_2214630; Annot_ID_187945

SEQ ID NO: 30364 - DNA, 3003 bp, Unknown
  misc_feature (1)..( 3003): 2750-1469P.txt file - cDNA_ID_3030325; gDNA_ID_2214630; Annot_ID_187937
tggagttaatccagcggaaggaccgggagcaggagcatcggtctgaggaggagaagcaaccggggatgttgttggagaagtggtaggagctggagttggctcgttaactggaacaggcggtgaagcaattggtgaaggtgtttctgctgtcactggaggaagcgccgttggtggaggagtaacggtggttggtgctggtgcaggagcttgagcgagacatgaagtggccaagaaaccaagaaagatcaaagcttgcattgccttagaattcatttttagattatctcttctttgtctgaatcttgaaactctctctgtttaatgttataaactcttctttatttttgttgatggtgtagaacaatgagagaagagagctctatatatacgcgatggttgggaaatagttaataattaattattggtgtgacactaatcatgcgaaccacatacaaaaatacaacatggcttagcttttcaatggcggtttaaaataattgttgtcttttttctttcttaaacttgacgtgtttgagtttttgaagttttcttgaagaatcatctacatgaaggagcaccaaacggatacacagatctctgccacgtgttttctcttaacgatgttaattctgagatcagttaagtattgacacgtgttatgtttatattggtttttagatatgatttgactctgcgtaatttgctttttggttaaccgcgttacaatgccaggcgtaaattaacttgagttttgcctaatgtttcgtggaaataacgcgtttacgagtaaataattaacattatacgaaaaatgggtcattatttaagttcatattcatatatagtatgtctatcaaaattttcaactgttaattattttagatgtatattataatcgtttctgttgaaaaaagttattttatatgtttcgttgtaatgtgttatctggactgattatacgagcaagggctggcaaaagctgtcatattttcatgttaattaaattaataaattagtagatcattatagttatatttatggtttttattttgttgcaatattctagtgacagattacttggtggccattattgttacaaacttacaacgaaacagtcaagcaaacgcgcattgttcatattctacagctatatcattattacggtgtgaaatgcttcatttcaataagaacctacctaacaattatttatattccttgaataataaattgttagactcttgctttgaccttaatatgcattgtatcagtatcttcttcataagaaaattataagttgaaaacttttttcctgccagctttgaccaaatgaatatattaaaaagttaccaataaagaaattttaattaatttgattagtagtacaagtttggacgaggccttggcaggcctctctttctagcttttcgtggatgtggcctaacctcgtaacttttcgtattttatcaagcccaaagtagctttccgttatcacttatatgaaaaaatctaagatctaaggggagttattgattagtattttaatttataatctatatacattaaagaaaatagaacatcttgaaacctctaaataaatacaccgtgcttaaaaaacttcacgagatattcaattgatttttttttgtttagaatattaaataatcaatactccattagatgtcatttacccaaaaaaaaaaaaaaaaaactccattagatgttattattgtagattgtaccaataaactctgatatataagtccaacaaaactccattagcagtagtgttggtaagctccccatattcttgggctttagtttcagaagatttcatgttatccgtcggcttagtttatggaattatcttgttaatcgccacttttatataatttcatatataatctatcttttagtgcaaaaaaagtaaaaaaaataatttcaacgaaactcaagtttggaaccgcaatccaattattttaatcaaatcattgactaccgaaatatttttccaccttcaaacaatctaaaaagaaaaataatttttttgatcaattcaccaacgttatttagtttataaaacatgataaaagatcctccaaaaatataaaacctagactttccttaaattttaagaagtgtacttttgttcactcaatttattatttctctgccaaattctctatattcttcacacgtaattactatctagttctcgtccatttcctttatcattttctcattgtcttgtaaattgaccactctaatgatctctattatttcctctagaatagagtatgatttatctccaatctatcactctatatatagagtaatcctacaattttctctattttaaagtaacatatagaatgaggatggagagaatgtactatatcatagagttttagaggacaaaattaaagtgggattggagatgctaagtatgtaaatttggttcggttagctatcataagggaccgagtgctatatgacaatgtattataggtaaaagaagtgatattgtctcctgtagatttagtgtccttaaccgttcatcaaatctatgtgaatctcagtagtaggtagttgggtgaagaacgtgtgaagtctatacaactcatattactcctcaaacattttctgataatatattgcatacattgaacctctttttaaattcaaaacatcaaaggtattgatcttacatagaaaaaaacatagactcttatgttcatgtccctattgatcttagtcatacctcataattgtctaacaaagaaaatcaaaggtatcataattatcatcatatgtaatgtagggaacaaatctgtatttactggtatatatatataacacaaaaaaaattaccaaagaaaaaaaaagagcaaagggaacgataccattagtcccaataccaatccttgcaaaattcaaactcaaacaaaccgtttatctcacgcgccgccgtactcgccacgatccgtctttggagaccaatttatg

SEQ ID NO: 30365 - DNA, 3000 bp, Unknown; identical to SEQ ID NO: 13478
  misc_feature (1)..( 3000): 2750-1469P.txt file - cDNA_ID_3030346; gDNA_ID_2214630; Annot_ID_187926

SEQ ID NO: 30366 - DNA, 1295 bp, Unknown; identical to SEQ ID NO: 13501
  misc_feature (1)..( 1295): 2750-1469P.txt file - cDNA_ID_3030371; gDNA_ID_2214631; Annot_ID_187974

SEQ ID NO: 30367 - DNA, 3003 bp, Unknown; identical to SEQ ID NO: 25122
  misc_feature (1)..( 3003): 2750-1469P.txt file - cDNA_ID_3030375; gDNA_ID_2214631; Annot_ID_187970

SEQ ID NO: 30368 - DNA, 420 bp, Unknown; identical to SEQ ID NO: 306
  misc_feature (1)..( 420): 2750-1469P.txt file - cDNA_ID_3030375; gDNA_ID_1563583; Annot_ID_147943
  misc_feature (197)..(197): n is a, c, g, or t
  misc_feature (258)..(258): n is a, c, g, or t
  misc_feature (264)..(264): n is a, c, g, or t
  misc_feature (268)..(268): n is a, c, g, or t
  misc_feature (275)..(275): n is a, c, g, or t
  misc_feature (286)..(286): n is a, c, g, or t
  misc_feature (304)..(304): n is a, c, g, or t
  misc_feature (307)..(307): n is a, c, g, or t

SEQ ID NO: 30369 - DNA, 3000 bp, Unknown
  misc_feature (1)..( 3000): 2750-1469P.txt file - cDNA_ID_3030379; gDNA_ID_2214631; Annot_ID_187968
cttttggcagatgaagcaaccggatcttcagatctgcgacgagatccagcggcttgacgaatttctttcactgataaagccacagatcggtttctcgatctactaagcatgttctcaagtggtttttccggcgtaggcaatgctacagaagacggatttggattcccggtttgagatttcgaagacggcgaatccatcaccaatcgtttcttcgatttgaatggaatggatctagaagagcctggtgtactcatttttatcaacaatgtctatagagtgtcagatgcagagaggagatagtggaggagatagatgaagacgatgaagacgacggaagaagaagaagggtttagatttatttaggtctttggcgcgcaatcctacgtgtaccaaagccacgtatacctcccgcgcctattaacccgttgcttcccgcgaaaacacttatctacgaagaagcccattaattaggcccattatgaattgctgtctctgaacgaatctaatagatgcaaaccaaagagaccagatttctttttttcaacttgtgattttttttatatgaacatgatttatataaggtcgtcgtgcaatgtttatgctgcttgttcagtatttatagtttttttgaaaaatcaaagataatctcatcataaggaatcttatcaacagtaaaatattaagataaaacagttagcccagcaaatcaaatataatcaatggtttagtttatgttttctatgtttctctttctaaactttgaatatatttaccacatccttattttaaatcatagaattaaacagtttttaaatgattatgatattttttctattgtcatttctaatattttactaacaaaactttaattttatttgtctattaaatgttatatttttccggtattgttatttctgtatatacttgaactttttcttattaaggttcgtcgtttccattttattttatattatatttgctaatgaggaaatctatataaaatcatgaaataaatattgattattaaaagaaaacacataaatattaaacattgaatattaccacatccctattctaaatcaaagaattcaataaattttcaatgattatgagattcttttcaattgtcattactactattttcttactaacaaaacttcaacttttctttttattaaatgttatactttccgatattattatttctctatatactcttatttaaatttgttgttttatgtcaatatatgaagttttgatgattataataataaataccaatttttatttcttttatcggtttatcgtctagttgacaaaaaaaaatataatgccgttataaaataattataactttcatgagtttttatttttgattaacatttaaaaaattaaaggagctagatgtatcaatttgtattatattatgctctgagactaaatattgatcttgataccaagaatctgatctagatccaaaatttatgtcaactgactcactatcatattttcaaaactcaattttaaagttagtaatataatgtacatcttaactattgtttttttgggtctgtttagaatctgggccggtgcccactcaaaacaatcggcccattatacaagttgttaaaataaaattcaatatatcacattaaagaaaaattacaattttttggcttcaagacttttttttttgtgtgtgcaaagacttttttggattcaagctaataaatgttagattacctttttaaccaaagatcaaagtaaaaccaaaatcatagaagaggaagagaactcgtgatcacgtttctttggttaagtaatgttgtatagaagagaagagaagagaagaggaagaagaaaagcccaaatcgaaaattgaaaactagtactccaaactccaaagcatcaatattttatcactcctcttttcttccacgcaaacccaattctcttcgtcttcttcttttgcttttctcccctaaattcgtcgatcaaattcttgtcttttcaacttcttcatcgaattttccattgcccatagcctctgtatttgattcctccttctctaaagcttcggatattaagacaattatatcttcctagctgcttatagaccttcgctttctaattgctgttcctttcgtgggtctctggtaagttttgattttctcatctgctgttatcgagaaaggttgattttttttgattaatcgcactgtgatttaaggttggaggagattatagtgttagcttaagggtttttgaggtttcaatttagaatcgtattgctcctgatcatttccctgttaaaagtagataaaccccttgttctattgggaaggaattcgccgtttttgcttcgtcttcttgtgaaaaatagagttggttttaggtaattgactttgatcaaggtctattggttgtgcaaaggttgcgtgaatcttgtgtcagcctcttgattgagtatagattacttcgtcttcgctttctctgcaccatcaattgtcatcagagtgctaggcatttagtgcattgtccaaagattctgcttgtgcatgaatgctattgttgaaaaagaaaggaagtgtttgaaatcgaatagtcttttgagtgtcaagcaaaggataggtgggtctggtttatatccatcatggtggaaaacagatatagaaacatttctttagcaggttatgccacgagttccgtatccttggtttgtctttctgcgtttaaggatttgatttgccttagtgtctcattggttagtatattcattgtatgtgcttctagcttgaacattttagtggcacttttttgtttgcatacataaattatctctgtcattaggtgatttgcattgtggatgctttatgttattcatgtttgatgcaggatttgtagttgcattctcattgcgcactacactttcttcaaatttccgcgtggtaagcagggaatggaccggctgttttggccaatcgtctgtgtttacaaatg

SEQ ID NO: 30370 - DNA, 3000 bp, Unknown; identical to SEQ ID NO: 13496
  misc_feature (1)..( 3000): 2750-1469P.txt file - cDNA_ID_3030387; gDNA_ID_2214631; Annot_ID_187965

SEQ ID NO: 30371 - DNA, 3000 bp, Unknown
  misc_feature (1)..( 3000): 2750-1469P.txt file - cDNA_ID_3030397; gDNA_ID_2214631; Annot_ID_187960
gtatcaataccaagcaagtaccctgagtagtcattagaagggatcaatggaggttgtggaggaaggtttaagtgaaagagcgggtcatacgtgaagcaagaacccgccattatatcagagcttggtaatgacatagagcatctaggcaaatgcaagaggctgagaagatcagggattggagttgttgttgtgtttggatgtgaagtgttcatgaagaaattagagttgtcttcagaaacaccccaattcgattcttgaatcatttggttgatcaaatggttgttgttgctgatgttttggttctgagtttctgagtttgggagagagataacagaagggaaaacagagaactcatccattgttgggagcttaagatcgtcatcaaagctgtttgttgtgcttccaagcggtggttgaaactggtggcttaccgtaaaagttgtttccgccgcacagaagccgccgttgttgtccaccatcgaattaggatcaaaacatgaactttcctcatacattttcaactgatttttttctgcaaccaaaactaattttcacaaccataattaatctttaagacaaaagccaatctaagttaatttcattaaataaagaaagtttgtataaactcagttaaaacctaatctcaaactaattcccttaagcacctttcttttagattggaaaagaaaaatcctctgtttttgtgttttgatagcttctcttctatcacttttttagtattgattcaaaaatcagactttgtttagagaatgaaattatctaattaccaaaagttagaagatgatgatctttttccttctttgtcgtctttgaaggttaccaccagctatatttcagcttcacaatgtcaaatcaaagatcatttcaacatttagagcttaaatcaaatgtaggaaaaaagagagaagcttttttggtttgctttatttctgtttgatggagtttgggtgtgtgtttgtgtcttttgggtctttcttgttcccataggagagggttttttggacgtgtttgtattgttttggacagctctctactaaatacttcaagacagaggaaacaatttttcttttcttttttttcttctcccttttatgaatgagaacaaaatggttccaacctttaatttctgacacaaacaaagctttaattctttactaagacatgttctaatatttggagaattattagaaagtttagttattttcttttaaacgtaattcaagccgtgtatttataaactactagagtttggagcaagaaaaattaaaactaatgaaatatgttggaactaatagatatattttactttccagttccacttcttattctaaaatgttccccaatgtcaaacaaatagtggatacatgatgataatagactgaaggaaatggaccttaatatgagatatgataaataaacatataaaaataatgcaatctccttcctaattgagatttcagttgggtcatgcaatctcgcttttggccacaacggcaatggaccccacttgcaacctcctaattccttacattttttctcaaatggtcaagggtatttatgtcattttgactccagtttggtaacatttttctttttgacatcacagtttggtaacagttaagcaattaggaattaggaatggtaggttaagtatacaacctcataaaatggttttgctctcaatggaatcggaaggggatatgcggaaacaagaaagaggttttttttgttttgttttagaaagcaggtatatgatagaactattatacatacaacttaaattttactacaccgaagaaagtgagaaaaagaaaccacaaatgatgagggaaactttacacactaccactttctatattgttcgcaaggattagactcgaattcaagatggctacaacaagagcttatacagaatttgctagactagtttaagaactctctcatcatgctcatcaacattctcgttatctactaaagagaagtttcttctccctcttaacattactaatatatcaaccttttacgatcttaaaccatattcagtttacctaagctttaggttgtgcaatctgaaacaccagaggttatacagtttgacatagaacatgaaactgtgtttacacaaatcaatccacagagaatacgaattattcattacattaccataagttttgaatagacatagcaatcttgcttgctctcagttcgctcgttcgcgtaacacttcaagatcaacctcagtaggatcagtagcttgaatctcatagtgaatcccttgaagctccctacttaactggtctttagaagtcgagtaaagcaccttggctcgaattccagaggtcgaaggagacctacaacatcagtagtcccaaatcaaaatgttttagtctcaacacatcaaaacccttatagacttactaatggtaaaaatcaaactaaccaagcaaagaagaagattttgctcttttgacaattctcagaagtaacgaaatcaaagtcataaacagcgtatctgcagtcattatcaggaagtgaagctaagaaatcatcgtagctctctgtaggatttccagttttctcaacaacaacttcttttttggattcatcaatcttgaagaccacatagcgatgagtttttttcctttgaagctctagaaatgtggttttgctctcatctgcaacacccattccagatattgcatttggctacagatataaaaccaaaacacatatcaaaaccataccaaaagattcgatttttaatccaaaattcatcgaattgacttcatctagtgatcttaaaccctcaataagagtaaaaatggagatgggtttagttttttttaacatcgacttcataaaaatcaaatttttaacattgaagatgcttgcgacatagacaagagtacatcgattttaagcaagaagagaaaagtttttttttgtaattttaccctgctaagtcctctgaaagacatg

SEQ ID NO: 30372 - DNA, 3000 bp, Unknown; identical to SEQ ID NO: 13514
  misc_feature (1)..( 3000): 2750-1469P.txt file - cDNA_ID_3030426; gDNA_ID_2214632; Annot_ID_188001

SEQ ID NO: 30373 - DNA, 3000 bp, Unknown
  misc_feature (1)..( 3000): 2750-1469P.txt file - cDNA_ID_3030430; gDNA_ID_2214632; Annot_ID_136077
aatatatttataatcagttttaatatgttttcttaatctatgtgtgttttttctagaaaatcaattaaaaagaaacagatggaatattaacatataactatgccatctagaccttttccaattctattttcattttatgtttcatcagtttggcttttaactcatatatatatataattttattcttcctacaatgtcacattaaaaagttcaaaccaaaattctctctattgtttttgcaagttttagtattgtcatctcattaaatcagtagatgatgattaggactcttggaaagtttaacccttttagattattctatattctattcttaaaaggacgtttgtgttattacaaaaagaactaagagatatgtatcatattagtattaaaagaagaagagaatgagcaatgaagagccacatgcggccggcatggtccctccttatacgcatttctctttctcccaaaacatttgaccttagagaaacagcatgtttttccaccttcttttgtattttattataatttcatattccattaagttgttgtttaatataaatataaacactaatcaaactcaaccagagttttctgatgttaattatatattaaactttgttttatcacaagcatgtcaacgggatttgtgtgcggcggattctcttatatatctatctctgttatccaaattccttttacatacaaattttcactttaatctcgttgcttttgataacttaattactatacgaatatcttactcttatcatactgactactgagtgtataaatattactagttgacatttttagaaaatactgaactagttaatttttgtatcgattaatctatccacgttaagtgttgtgtacaaacaacttctacatgtacacagaataacacatggttaaaagtttaaaagttgaagacttgacaataatatagagacttgttggtaaaaagatatggaaagttcaccattattgatggaaaattaagcgtgacatgtgaaacattttcccttagattctggtccttgttaactgcataaatgttcatgttctttgttttgccgctttggttggattccactaaagtctaatcatccaaaatctttggagtgtattaatacatgacatattcggccaattcaagaaaacctgggaaaacagttaaaaataaattatttacataccgaaaatcgtaaacatggtaggtaaaaaacaatcaaattacttaaaatatttcttaaaattttaattgatttaagattttaaaattattttttcatagattaatagtaattttcaaattaccacatatattccatgttccaaaactataccaaaatcataaaattcaagatattcagatttgtgaacttctctcaaactttagtttgcgatattttgagaaaccatttcacaattgtgagatttttaagcaattttgttttttgggtgataatatctcaaggttttttttttcttctttagatttggtaaaagaacttttgcacacaaacaaaaaaaaagatttggtaaaagaacttttgatatttgtctattactgttggtggacaaaaccgttttgcaaagtatacaagaaatcttggtgtattaatttttcatcggattgatataattagggcttaattagatccaagcatgtactttgtgaagttaaattcgggcaatgaaacaaccacacaatattatcataaaccactatggaaagaaattctttaagattggttaagtacttaagtttaatatgaacatttgtttagtcttcttttagttctcaaatctcttaatttacatgactgattctttggaatgtatagactatgaaattatgtttatatatttgctaggtattagcatctctggtttggcatgacactactatatatcctaaactatatatattatgagaaaaagttagaattcaaagatttaattttaataattacctattttttgtcatgacaattattgtattttctaatatttttctatctatattccccaaaaaaataacatttgaaatcccagtgaatctccatgaataggagaaaaatattgagtcaaaacaccatcaaatttgtttctaattattgtctgtaatttcctaccaattaaagataaatctcataaacagaagaatctataatagtgctgtctataatctactacctaattgagatgaatctcctaaaccgggataaaaccggtttataatagtgctgtctataatctactacttaattaagatgaatctcctaaaccgggataaaaccggttcaataaccctgataaaaagaagagggcggctgctaacgtgcgcatcgggtatttatgagtagaatcctcctcattcctcatcacaaatacaacaacaaaaaattgtgtgtggactctttctctcttctttgctggttttgaggagaatcgtgtcggctaaatttgtgtcagacacaccacactctgagtaatttttctcatttcttcgatctctctctctctctcactctgtttttctcaatttaataatctcttctcttctctttcttcttcgttatatatataaattaacaaactttcttcttctctggcaatttcagttgcaaagtcttcctcttcttcttccaccagagacaattccatcatcatcatcaaatagacaagggaagaattcaatttcccctttctttattggcgcgaagatctttcacagaatcaatcaccaacgaaaaatcgagaatgggttcgttacttttctctctgttttccgatgattgaatccaaatttgtatcttatgatttgttttcgtaactgggttttgttcaattttgagtcttttgttgttttgatcgttttagggtttactctctgtttttttcccaaaaggggtcttcgttgttattgaatctaatggaattggttttttttttttgtggacagatgtttgcttgagctattcatataatatg

SEQ ID NO: 30374 - DNA, 3000 bp, Unknown
  misc_feature (1)..( 3000): 2750-1469P.txt file - cDNA_ID_3030430; gDNA_ID_2214632; Annot_ID_187996
gcaatgtagaaaaaaaatgctatgttttcaatgaattattttctaattgtatactctctatgttctttattaattgatttttaagagaaaataaattgtttcaaaaagattgaatttataggttttctatgcaccatttattcgttcttattgatgaattttaaacttaagacaaataattgaatattattggtttagaactatagaaaaatgtaaatcacaaaaattaatatatttataatcagttttaatatgttttcttaatctatgtgtgttttttctagaaaatcaattaaaaagaaacagatggaatattaacatataactatgccatctagaccttttccaattctattttcattttatgtttcatcagtttggcttttaactcatatatatatataattttattcttcctacaatgtcacattaaaaagttcaaaccaaaattctctctattgtttttgcaagttttagtattgtcatctcattaaatcagtagatgatgattaggactcttggaaagtttaacccttttagattattctatattctattcttaaaaggacgtttgtgttattacaaaaagaactaagagatatgtatcatattagtattaaaagaagaagagaatgagcaatgaagagccacatgcggccggcatggtccctccttatacgcatttctctttctcccaaaacatttgaccttagagaaacagcatgtttttccaccttcttttgtattttattataatttcatattccattaagttgttgtttaatataaatataaacactaatcaaactcaaccagagttttctgatgttaattatatattaaactttgttttatcacaagcatgtcaacgggatttgtgtgcggcggattctcttatatatctatctctgttatccaaattccttttacatacaaattttcactttaatctcgttgcttttgataacttaattactatacgaatatcttactcttatcatactgactactgagtgtataaatattactagttgacatttttagaaaatactgaactagttaatttttgtatcgattaatctatccacgttaagtgttgtgtacaaacaacttctacatgtacacagaataacacatggttaaaagtttaaaagttgaagacttgacaataatatagagacttgttggtaaaaagatatggaaagttcaccattattgatggaaaattaagcgtgacatgtgaaacattttcccttagattctggtccttgttaactgcataaatgttcatgttctttgttttgccgctttggttggattccactaaagtctaatcatccaaaatctttggagtgtattaatacatgacatattcggccaattcaagaaaacctgggaaaacagttaaaaataaattatttacataccgaaaatcgtaaacatggtaggtaaaaaacaatcaaattacttaaaatatttcttaaaattttaattgatttaagattttaaaattattttttcatagattaatagtaattttcaaattaccacatatattccatgttccaaaactataccaaaatcataaaattcaagatattcagatttgtgaacttctctcaaactttagtttgcgatattttgagaaaccatttcacaattgtgagatttttaagcaattttgttttttgggtgataatatctcaaggttttttttttcttctttagatttggtaaaagaacttttgcacacaaacaaaaaaaaagatttggtaaaagaacttttgatatttgtctattactgttggtggacaaaaccgttttgcaaagtatacaagaaatcttggtgtattaatttttcatcggattgatataattagggcttaattagatccaagcatgtactttgtgaagttaaattcgggcaatgaaacaaccacacaatattatcataaaccactatggaaagaaattctttaagattggttaagtacttaagtttaatatgaacatttgtttagtcttcttttagttctcaaatctcttaatttacatgactgattctttggaatgtatagactatgaaattatgtttatatatttgctaggtattagcatctctggtttggcatgacactactatatatcctaaactatatatattatgagaaaaagttagaattcaaagatttaattttaataattacctattttttgtcatgacaattattgtattttctaatatttttctatctatattccccaaaaaaataacatttgaaatcccagtgaatctccatgaataggagaaaaatattgagtcaaaacaccatcaaatttgtttctaattattgtctgtaatttcctaccaattaaagataaatctcataaacagaagaatctataatagtgctgtctataatctactacctaattgagatgaatctcctaaaccgggataaaaccggtttataatagtgctgtctataatctactacttaattaagatgaatctcctaaaccgggataaaaccggttcaataaccctgataaaaagaagagggcggctgctaacgtgcgcatcgggtatttatgagtagaatcctcctcattcctcatcacaaatacaacaacaaaaaattgtgtgtggactctttctctcttctttgctggttttgaggagaatcgtgtcggctaaatttgtgtcagacacaccacactctgagtaatttttctcatttcttcgatctctctctctctctcactctgtttttctcaatttaataatctcttctcttctctttcttcttcgttatatatataaattaacaaactttcttcttctctggcaatttcagttgcaaagtcttcctcttcttcttccaccagagacaattccatcatcatcatcaaatagacaagggaagaattcaatttcccctttctttattggcgcgaagatctttcacagaatcaatcaccaacgaaaaatcgagaatg

SEQ ID NO: 30375 - DNA, 3003 bp, Unknown
  misc_feature (1)..( 3003): 2750-1469P.txt file - cDNA_ID_3030481; gDNA_ID_2214633; Annot_ID_188035
catcagatataagattaaaaaaaaagcaaatttcatttctttttaaagaaaatattacgtgattagacagttatttggaaatgatataattgtcctttttacctccaaaaacaaagaaaagtgcctcatccctgaaaagtgcctcaaaaagaataagattttgtaaaagtgtctaaacgtgtcacattcccaaaataaaatataagttgtcaattcaaaaagttccttattacactgatatactaagtattttcttatagtagaaagagtgttttatatgaaagcaacattgtttcttagaaaatattaaatttttattttgttgatccaaaatagtttatttatatttgagaaatttaatatatgagaactgtaaaatacaacgtttggagagaacgtaacactagaaaataccataaagaacacaacccgtgcactcacctcattaccgtcatcgacaagaccattcgagatcgcatcaccagtctttattatcaaggcaccagcaaatatgcaaaccttcagaacggtgcaggcttcactaacgtgataatttgtaatgttctgttttgagatcatctccaggcctagctaactttatgctaggttattcagctgtgtatgtttaaatgcggcatgcgttactgttttgataaagtagctttagaagaatgtagtgtgttgggaataagagtaattttgttttgtgtttaccaaattacagcacaacacagacatattcattcttcatgctcgtgatagtgcctagagaattaacgacttgtgatcacattattagaggaaactcctaactaataaggattaggataaacaacactacatgtggtacactcaacaactcaaagattatctcctgaaaccttatccaactgttcttcggccccaagcagtgatgtagatggctggtcaaaggcgaggacatggtctgactgatggtaagaagtgttcaagcctgattctagtattgggtgacccactacaatatcaggtgtataaccagctgcacctctcaccaatcgaggcttctttgataatctctcctctcctgtgctctcatctggagacccaatgttacaccctgagtctggtgttaaaggctcccggtaagatgagagagactcgtcaactgagagacttttgtctggtccacagtccttgccagacttgtcttgaagaggagactcagatgttggggcaggggttgcaggatctgaatcgcccgttactggggctgagggttcgccgagtactccactgagtcgttgttgctcttcaattatcttcttcaagtactttccttgtgcttctatccgtagttgcagctgtctttgcacctaagaaaaaatcacatcaaagaataatgtcatatgtaatgcaaaattcagtgctacactgaaaatcctactaattgtttcgttgttgcttgtctttcttaagtaggaatggtgaagcatacttctagttgctcgtgtaatcgtttctgaacttccatctgcaacttgagggcttcagttatctgcattcccctgtaatctcgaaacgatattgatcacttaatctgcggcgcgaggtaatatatatatagcatcacaaatcaagctcaaagagggaaatttcacgtacgacgagccgtccaacccagagagcatatctccagattctttcttatcagtttttttccctgaaaattgaaaaaaccagttttcaggtatataggaaactggtagaatgagaaagaagatgaagaaaatcaatgtccacactaccttcagaagacgaatctggaagatactttgcaagtcgatatttctgactcaaaatacacaaatgcaaaaatcagcaagggtaagagaaagagagacgagacaagatgccacacagtttgagaatacctgtaagtgactcttgacatgatatatagttaagccttgtacacccatcactctaagaacgcctttgggtgtagctcctttggaaatcaaaggaagaaaaatgtttaggaaccctaagcaaacagacgataggctttccctctcatggatagtagtaaagcatacaagaagagcaatttgattatattggtgtgcatattattaccacagatattgatgaggaaaacatgagttactaaatttaccatagactatacaagaaaaaaggaaacttactatcagggccaccaagttgagcaacggcatcaacgaagcgttcatgtagctcatgcgtccaacgcagacgttgtttggatgcatgactagaattggggcctccgttgtctgcttccatcagggctaagatataaacacgataaagggaaagtaatgagtagtggcaaagctaggaaatgataacatatgaggactggccagagagaaagagatagaaatggaaacaaggaagacgaaatagcgcccagaattagctagtaaaaacagtccaagtcaagtttaagacttgctccggcagatccaccacaggacaccaaaatcagagacatgttcactaaaatcggaggaatttgtcgccgagaaagcaaaaagaaaacacaatccaaggttatggaatctacgaacctgtgggtggtggatctatacacgacgcccctccattttcggaacttgctcttctccaagctaaatcttatctgaaatagaagatattgtgttacagactagtttactgagtccggtgggttacagggcgggcggcgatggagcagagtcctcctcaaaaaaattccagtcttcttcttatcgctcgatcgacgaattccaggcagtggcattgactattgctgcatttctttctgggtaagccgggcctctcggtataggcccaaaccattctaaggcccaaaccattatattaagttggttggtccaccaaagtcagcagcagctagaacaagagcgactctgcagctgctcttctcccgcttccttcctgttagttagcctcagagatcctcgttccccgataatg

SEQ ID NO: 30376 - DNA, 3000 bp, Unknown
  misc_feature (1)..( 3000): 2750-1469P.txt file - cDNA_ID_3030542; gDNA_ID_2214633; Annot_ID_188016
cacttagtggcttgggtcgagagaactcgcccggactttaggcagtccggatcggggcctttcatgcgtactgatgcaaaaggggagtgttatcgcatacgcatcaaggcaattgcggaaacatgagaagaattaccctacgcatgatttggaaatggccgcggtagtatttgccttgaaaatttggcgatcatacttgtatggtgctaaagttcaaatctatactgaccacaaaagcctaaagtacatattcacccagccggagttgaatctaaggcaaagaaggtggatggagcttgtggcggattacgacttggatatagcgtaccatccgggcaaggccaaccaagtcgccgacgccctgagtaggaggcgctcggaagttgaggcggaacggagccaagtggacttggttaacatgatcgggacattgcatgtgaatgccttgtctaaagaagttgaacccttagggttgggagccgccgatcaggccgacctgcttagtaggatccggctggctcaggaacgggacgaggagataaaaggatgggcactaaacaataagaccgagtaccaaacctcgaacaatggtacaatcatggtgaacggtcgagtatgtgtgccgaacgatagggcattaaaggaggagatcctaagagaggcccatcaatcgaggttctcaatccatcctgggtcaaacaagatgtactgcgaccttaaaaggtactaccattgggtagcaatgaagaaagacgtggccagatgggtggccaagtgcccgacttgtcaactggtcaaagcggagcatcaagtaccaagtgggttgttacaaaacctacctataccggaatggaagtgggaccacataacgatggacttcgtcaccggactgccaacggggatcaagtccaaacacaatgcggtatgggttgtggtagaccgattgactaagtctgcgcacttcatggcgatctcggataaggatggagcagaaatcattgccgagaagtatatagacgagatcgtgcggttacatgggattccggttagtatagtgtcagaccgagacacaaggttcacgtcaaagttttggaaggctttccaaaaggccttaggaactcgagtaaacctaagtactgcctaccacccacagacggacggacagtccgaacgaacgattcaaaccctcgaggacatgttgagggcatgcgtcttggattggggaggaaactgggagaaatatctaaggttagtagagtttgcatacaataatagttttcaagctagtattggtatgtctccctatgaggcgttgtatggacgagcttgtagaacaccgttgtgttggacgcccgtgggcaaacgtcggttgtttggacctacgatcgtggatgaaaccacggagagaatgaagttcttaaaaatcaagttaaaggaagcccaagatcgacagaaaagctacgccaacaaacgtcgaaaggaattggaattccaagtacgagatttggtgtacttaaaggcgatgacctacaaaggggcagggcgattcacctcaaggaaaaagttaagcccaaggtatgttggcccgtacaaggtgatcgaacgagtaggggcggtggcatacaaacttgaccttcctccaaaattaaatgcgtttcacaacgtcttccatgtgtcacaattacggaagtgtttaagtgatcaagaagaaagcgtggaagatatacctcccgggttaaaggagaatatgacggtggaagcatggccggtacggatcatggaccgaatgacgaaagcgactcggggaaaatcaagggatttgttaaaagtcttgtggaattgtggaggccgtgaggaatacacttgggaaaccgagaataagatgaaggccaattttccggagtggttcaaggagatgggtaaagatcaacttgatgcggattcgaggacgaatccaattcaagggggggagacttgtaacgcccgcgatcctcaataggatcgttggctaggacttggtccgagagaagaaggtggagtctcggacaagtgagaaggagctggctataagctcggacaaaggggaaatcatgcaggctaagctaggatcgtaaagaaatcacttgggtcagctcgcccaaagctcaagctcagctggaaggagtgacagttactcaggtcgagtgacagtccagctcgggcagctggacgagtgacggttgagctcgaggcagctggacgagtgacggttgagctcgaggtagctggacgagtgacggacgagctcgaggtagctggacgagtgacggacgagctcgaggtagctggacgagtgacggacgaactgggcggttatgggcgaagagatacaactcttcggaaaggtgcaactcttcggaagggcgcaactcttcggaaaggtgcaactcttcggaaaggtgcaaggaacggatgtgttgattcgggagcatccattcgccccctatataaggaagggcgcccaggaccattctactcaccacaacacaccgaaaacacaagaaaactcaccattaaaactctctccctcttgggagaataaatagtcttaggattcggtagccgggctgtggccggcaataaagaaggagggtcggatcgacctaacctcgagaaggaaggtaagggatcctagactttgagtctaagggttctaggatgtgagttagtagtcggatccttgaaaggaccgactagagggctgagtagtatccgggtcatgtgcatcctacacaagactcggtccgggtaggggtcggctgaggcggggacgcggctcggcggaggaccggcgggtcttaactgacctgccgagaatcggccggactgatgcgcgatcttcccctctctgaattctctccactgatccgagtagtgtatggcatatagagcattgcatggacttgcatatgattaagtaaataagattacttatggctctatgactttcaggaacgaatg

SEQ ID NO: 30377 - DNA, 3000 bp, Unknown; identical to SEQ ID NO: 13517
  misc_feature (1)..( 3000): 2750-1469P.txt file - cDNA_ID_3030546; gDNA_ID_2214633; Annot_ID_188015

SEQ ID NO: 30378 - DNA, 3000 bp, Unknown; identical to SEQ ID NO: 13522
  misc_feature (1)..( 3000): 2750-1469P.txt file - cDNA_ID_3030550; gDNA_ID_2214633; Annot_ID_188014

SEQ ID NO: 30379 - DNA, 3000 bp, Unknown; identical to SEQ ID NO: 13527
  misc_feature (1)..( 3000): 2750-1469P.txt file - cDNA_ID_3030579; gDNA_ID_2214634; Annot_ID_188061

SEQ ID NO: 30380 - DNA, 3000 bp, Unknown; identical to SEQ ID NO: 13530
  misc_feature (1)..( 3000): 2750-1469P.txt file - cDNA_ID_3030609; gDNA_ID_2214634; Annot_ID_188049

SEQ ID NO: 30381 - DNA, 3000 bp, Unknown; identical to SEQ ID NO: 13539
  misc_feature (1)..( 3000): 2750-1469P.txt file - cDNA_ID_3030617; gDNA_ID_2214635; Annot_ID_188093

SEQ ID NO: 30382 - DNA, 3003 bp, Unknown
  misc_feature (1)..( 3003): 2750-1469P.txt file - cDNA_ID_3030697; gDNA_ID_2214635; Annot_ID_188095
agaaaactatatttgttcctatgtatatgtatgttagtctaatttaaaaactctatagagtcttgttgtaaacaaagcaattttctacaacttatatttagaaaaaaaaaatcacatgaagactaagatttatgaaccattaaattataatctagtgataaagaaactagtcagcttgacaaagatatggataaatgcaactttgtatcaacagtgatatataaaataacttatcaaaaattggaaataaaaaacaaatatcatccaattttgggcaaaatattaatagtttttgtgcccatatggtgacatcgaaagggtatgtgaagttgtgaacacaaaactatataaaatagagagagtgaggataagattactagtggatggacttcaaatttggctcctcttccaacctgtctttttctttgctacacaatatacatttttgtaaccccccatacacatttcaacataaaactatatagtcatccaattgaatgattttttttttcttttaaccaaggtatcattatcaaacactgtttcaaaaatcaataatagaatttggcaccaccaaacaaacattttttttgtaaaaatagacctctcaaaaatatcatagaattaaagaatactttttattttatttgtttgtccatcatcatcttcatcatcatcatttcgccgttaagtttctctctctctctgtttccacccattatagaattcagtgaatcaacaacaacaaggtaacacatctctctctctctctctctctttctctctttttatatttttgtgtcccaatctcttcttcatttctgtttggttgccgagaaaacgcaggaaacttttctgcaaaaaaactcggtgaccatattcaaaactttcccacgttaattctctcttctttgttttgtttcagattcattacttttctccaaaaaactttcttcaagatctgttcttttaaataattatggcggaagaacatcgatgcgagacgcctgaaggtcaccgtctctgcgttaacaactgcggtttcttcggaagctcagcgacaatgaatctatgttcaaactgttacggcgatctctgtctcaaacaacaacaacaagcttccatgaaatcaaccgtcgaatcatctctctctccggtgatcgcacctgttctcgaaaactacgcggcggagttagagatcccgacgacgaagaagacagaggagaaaaaaccgattcaaattccgacggagcaaccgtctccgccgcaacggccgaatcgatgcaccgtatgtaggaaacgggtcgggttaaccgggtttatgtgtcggtgtgggacgactttttgtgggagtcataggtatccggaggttcatggttgtacgtttgatttcaaatcggcgggacgtgaagagatcgcgaaagctaatccgttggttattgcggcgaagcttcagaaaatatgaatcggagccgttgaccgatttctatctttaccctgagaaaatttcgattgtctcggtggatctcagccgttcattatgttattgtattacggacacgtgtcgcaagattaaggttgagatggtttcgtaactttttaattattttctttgtttatttccgaagaaattaaagtttttatgattgtgtggcttttgcttgtaaaaaaaaaaagggtttctctttgggaaaaagaaaagaaaatatatgaaattgtgtctcgcgttttggataatgttttataccgacagaaacagtacaaagacgttttgatcatttcaaaacgttagatcattgaagaaaatgaagctcatgtccttattgacgtttgtttgctgattttaattcttagatttgtgaggaaaatggaatataagttttaggtcagttgatttagacttttatctgaatcagtttacctaatcatctctaaagcatttagctaaggttgtttgttcttaatgctttatggtcaaatgtttgtaagctttttaggcataatataaggccggattcattttggtaaagacgaggatacaatagcttcgaatgtgtggccatgtttcgctaagcgatcatcaacttgatttgtcttttggtatgtgaaagaaaaggaggttccatcaaacatctttcagctcacttgaaaattatttgaaatgtctttcatacatttatgatctatcaatgaatacaaatgaactactatttttctcttcaaataattattctctttctgttgacattatgaaatttagaagttttcacaataatcaaaagtaatataaaacgtcgaaaatatatttatctttatatgaccacttgatgatgaagactcaaaccaacaaaaaactagtgtttgttttatttccgtggtcaaatgtaataatatatttctgtgtgtattaggtgatatttagaatttttgtataatttccaaaacaagaaaatacttcaaataaatttcatattaatcttatcaaaacatatctttcatattttatatgaccattattggatgaagaagagtcaaaccaaatatgaactagagtagtagagttcaatttttttttttgacaacaatgttttctttttctggtcaaataaataaaccttttttgttcatattaaggtgaaagaaaattagaaattatgaacaaatgttttaaaaataatataaatatctagatcatattgcatatatttcatttaccaatgttaaagatttgtgtatatatagaaaagaaatcttcaacaaaattaaactgctaagaaattattaaaaaaatgtaaaagaaggaaaaatatctaaaacatgaagccagagaaacgaaataggagtattaattaattaaagaaacaaactcaattaattaattcaatggaaaccgctaaattattaaccgttcgccataattaaaatttaagagacacacaccttaaacctcacctatatattttccatgcaaaaaaaaaaaagacaacaatttcaaccatcatg

SEQ ID NO: 30383 - DNA, 3000 bp, Unknown
  misc_feature (1)..( 3000): 2750-1469P.txt file - cDNA_ID_3030734; gDNA_ID_2214602; Annot_ID_187081
gaaacaattaaacttttaaaatgttagtatattcttaggtagaatacgtggctgttattagttggatgcagtatacatatggaaataggaaaaaatgtacggagttagtttgtttaatatttttccttttctagatttttttctctaattgtgattttttctttatcatccaattaattgaatttttcaaaattattattcaaaaaaaaaattacgatggtaaaaaaaacaatgaattttaaagttattaaaatcacggaaaacaattctataaaagttatgacgttgcatgggaaatatacgggttcgggtcaatttaagtggatcgggtcatattttcttgagtaattaaaagttaatgatttaatttaatgaaaaaattaataactaatcaacacgaaatttgaatgtttttgttcgttacagattccttaacgccggaatattcggaagcacgaaagaaacaagccacacattgccacactccgccacaagagccgccatgcttgtacgaatcaacactctcctccaaggattttccggtatccgatttgagattctcgaagcaattaccagtttcctcaacaacaacatcactccatctctccccctccgtggtacaatcaccgcctccggagatctcgttcctctctcctacatcgccggacttctcaccggtcgtcccaattccaaagctactggtcccaacggtgaagctttaacagcagaggaagctttcaaattagcaggaatcagctccggattctttgatctccagcctaaggaaggtctcgcgctagtcaatggcacggcggttggatctggaatggcgtcaatggtgttattcgaaacgaatgttctctctgttttggctgagattttgtcggcggttttcgcagaggtgatgagtggtaagcctgagttcaccgatcatctcactcacagacttaaacatcatcccggtcaaatcgaagcggcggcgataatggagcatatcctcgacggaagctcgtacatgaaattagctcagaagcttcacgagatggatccgttacagaaacctaaacaagatcgttacgctcttcgtacttctcctcaatggttaggtcctcaaatcgaagtgatccgttacgcaacgaaatcgatcgagcgtgagattaactccgtcaacgataatccgttgatcgatgtttcgaggaacaaggcgattcacggtggtaacttccaaggaacaccaatcggagtttcaatggataacacgagattggcgatagcagcgattggtaaactcatgtttgctcaattctcagagcttgtgaatgatttctacaacaatggtttaccctcgaatctaaccgcttcgaggaatccaagtttggattatggattcaagggagctgagattgcaatggcttcttattgttcagagcttcaatacttagctaatcctgtgactagccatgttcaatcagcagagcaacataaccaagatgtcaactctttgggactaatctcgtctcgcaaaacttctgaagctgttgatattctcaagcttatgtcaacaacgttcctcgttgcgatttgtcaagctgtggatttgagacatttggaggagaatttgagacagactgtgaagaacactgtctctcaagtggcgaagaaagttcttactactggagtcaatggtgagcttcatccttctcgcttctgcgaaaaggatttactcaaagttgtagaccgtgaacaagtctacacatacgcggatgatccttgtagcgcaacgtacccgttgattcagaagctgagacaagttattgttgaccatgctttgatcaatggtgagagtgagaagaatgcagtgacttcaatcttccataagattggagctttcgaggaggagcttaaggcagtgctaccgaaagaagtggaagcagcaagagcagcctacgataacggaacatcggctatcccgaacaggatcaaggaatgtaggtcgtatccattgtatagattcgtgagggaagagcttggaacagagcttttgaccggagagaaagtgacgtcgcctggagaagagttcgacaaggttttcacggcgatttgtgaaggtaaaatcattgatccgatgatggaatgtctcaacgagtggaacggagctcccattccaatatgttaagagtatagtcctctgtttttttcttaccataaagtctttttttttttacatgtctgaataattttaccaaatgattgtctgtgaagtggttttatgtctgtctaatttaaatttgtgtgtaaaactcattgtaagttctcaaatgaacaatttttcttttacaaattaatgtgtgaatcataccttcttctttttatctcaatatccataacaaacatcggataagaaaatgttatcaactctaactcaatcatctaaacttaattagtcttactctaatggagttatttttcaaaatactagtaagtcacacactttagccatctagggttatagaattctttactaaattatgaaattaaaagtttaaaactattgttatgatagaaaaacataaatacaagttacaaccgaaatcatacattttgttgttattgtttggtagcacttttaggagtttacataaaaatcacctaaaatcactcaaggttagtaaatgaactgaaacaactcgaaatatatttgaactcgaatctaaactctattttcatctaatatgaaattgaaaagtgaaagatcacacaactatagttctgtagtaccagagtagtgagtgcaaccagccaaccagaaaaaaaagaaaaagaaaagagaatgagagagtacacaataaaggcccaaattaaagcccataaagcccataagagtaaatacaaacaatacaggttcttcaatacgttaagacaaaatagaattgatctctcttcttcattctctctcttctcgatctacccaaagtagcgggagcgaatagtaaaacaatg

SEQ ID NO: 30384 - DNA, 3003 bp, Unknown
  misc_feature (1)..( 3003): 2750-1469P.txt file - cDNA_ID_3030745; gDNA_ID_2214636; Annot_ID_188137
cagggacaagaaggaagtccaaggacacatgaataaggaaagcatgaacctgtatatgtgatatcagctcagcttcttctttagcagtcagaagttgttttgtctcaggtccccacaagaagagctgaagcgcatcatcattatcagccccttgtttatactttttcttcgcactagttttctgaggaacataaccctcatcgtccacatcgtttgattttggagcccgtctgttctttgctcgtctctctagctgccgcttcgatcttactatgtttcccttttccggtaaggacatagaagagctaaaaccaaacatccagaaatacaaatcttttcacattacagcccacaagtagcagattgataagatacacaaacaaggttaaaaaaagcaacctagtggagagagaatccttgatgttgtcagatggatttgcttcagtgtcatcaactaacaatgcagcttgttttgaagctgataaagccttctgagctagtgcaaccacatcacaaagctctgcatcagctaaaggagacacaactgccggcaatttcgtttcagatgttaaaggagatattaatctgcaaacaaaagaaaggctacatcattcagaaaactcaaaaggttgtatgaaaactgaaactggtgggtttaagagaggaagagacattacaaattccataaaccagtagagtgaagaagttgctgttcaaatttctcatcttctcgagatgaaaccaattcatcaaactgcctcctctccagagtcaactaaaaatgcaaggaacccaatcgcattaaacaagaggactagaaagttgacaactttatgattgattcaatctcttaggacaatattgctgctaataaaacacacctgggatgttctatcgtctcttaacgcatgtgacagaggcctagactcttcccgtggctcctgtgagagaaccgacgcaggaaaatgtcgagatagagaattgagatgacgtgagttaacaacaggagttgttgtttgatcatgaagcatcactactacagaaataccaacaaacgaacaaaaacaaatcagaaaatgctaacacaaactcgtatacatacactaatttcaaattgaaatccatgaacttcaaattccagtaactaacagagacaaatccagcaaagacacaatatttctatatgaagagtagctgaataagaagtaccagaggaaggagaagagtagctgctcttgagatgagtctttgtctgaaacgaaggagatgaagaaaccaagttcctcgtagcttccatttcacagaatcaccaaagaataaaagactctgtttttgcttccacgaatggctaaggaagaagaagaataagaacatgaggctactctacagagccatgacgaacagataaggcgacacacacactcccaattttttttttgtaaaaattaaaacttgtttgttgccatggaagtcagattttgttctctctccctttttttttttcctacagagtggatcatgttgggccttatattgggcttaaaagcccaaattatccaaaagttaattcgaatcatcttcttctccctcctttagtaaccctaagattctctctgtgaatccttgttcatcgtcactgaaattagtttacaaaatcgacgaattcggagatgatttttcagaatgtgtgcagaaatgagtccaacttcaacgctatagcttccgaatcgcgttcccaaacgcagttcggtgtttcgaaatcctcctcgagcggcggcggatgtatctccgccaggactaaagaccgtcacacgaaggttaacggacgaagccgtcgagttacgatgccggctctcgccgccgctaggattttccagttaacgcgtgagctcggtcacaaaactgaaggagaaaccatcgaatggcttcttagtcaagctgaaccgtcgattattgccgccactggctacgggactaagctcatttcgaattgggttgatgttgcggcggacgattcctcgtcgtcgtcgtcgatgacgtcgccgcaaacgcaaacgcaaacgccacaatcgccgagttgtaggttggatctttgtcagccaatcggaattcagtatccggtgaatggttacagtcatatgccgttcacagcgatgcttttagagccgatgaccacgacggcggaatctgaggttgagatcgcggaggaggaggaacgtagacgccgtcaccattagtaaaattaggcttttgatttagagtgttaaaattaggattttaaaagtttaggaggtaacagataaggataatttagtcaaatcatgttgtttagtttggtaatgttattttgccactaaacaactaataatattgtttgataatcttattatttggttttggaaacaaattgattaaaaaataatgccatatgtttataatgtttatattgtttttctcactattgatttgtgattttttagtaatgcttgaaatcattaagcaacactatttaaataaacaaaaatttctcatgaaatccaaagaatcatcatttgtcatgctcctccaatatagttatttctatttttggaaataagttataattaagaaaccaatcatttttctcacccattttttttttcatttgctagaaatctggacctccttccatgatgacccttctcaactctcttctttcacgcaagtctctcatttttcaactttccaacttttgatctcaacgtcaacatttcaagattttctaaaagagaacaaaaaaaatctacaacaagctcgttagctttcttttaatccttcatctccatttttcaagaatatactcattggttttctcaagacatgatagaaaaacacaagacatctctacggatatttctattggtagcttccaatgtatctattctattgttaggtcagagggttcagatatttcgattcggaaggttctgattttaaggcaagacttttgatataagaacaatg

SEQ ID NO: 30385 - DNA, 3000 bp, Unknown
  misc_feature (1)..( 3000): 2750-1469P.txt file - cDNA_ID_3030749; gDNA_ID_2214636; Annot_ID_188135
gtgttttagaaacttacgtttctgtgacgtagaaccttgtctgcagtaatgtctaagtaatacataaaaacattaattacatccttaatgatgaatatttcatatatgaaacaaattttcaaaaagtaacaagagttgtgagataaaagaatcaatacccactactacaagtgacttttcgaatcgttgttgggcaatatgaacctggtgaacaaaacatatcaccactactctcagcatcaacccaactatctgcagaaccacatgtatgattcaactttcccggaggaatttggtagttatatctgcaatgtaaaaactctttaaatcatccactaataagatttttcattaacttactcaatctagaaagctaacaacttacggctcacaaaatcctgttgttttattaagcttggcaagcgggcaatatgcgcctaacggacacgcttcgtttacataaatcagagaataaacaacaatgaatatgttagattaaagttttagtacttataatgttgatataacatatatgtatgtaaatggatatcttacgtatcatgcaagcaagaccttgtggacaaaagaaaccctcacaacaaggttgacatttacgagttctagatggaagaatttttccattgttgagatcaaatcttttttcatcatctgcattgcaactccatccaggctcacatccggaaacccatttagctaaattgcagttgatgttaggctttacatgaaccgttgttgcttcatctcttctaacaaaactactaaagtagaactttatctccgcagctgaacatagtctaagtgtgaggtcacctgcatatcacaagaccattaaatctcaatgttcaagtatttgaatataaaaacataaccctttttatgttgtttaccatcatttttcttgacacaattgcttaagaagtccagatttttatcaaaattaaatgcttcattccaatcgcccttcctgaattatcaacaaacgatatgagaaaaatgtaaaattcaaacatgggactacattagctgattttgaaaagacttacaaattcttgatgcaataacctaaatctcgatcaacgtcagcctttaaaacagtctttagattctgaagtcgagtatagataaggtttgtaaccgaaacaagagcttttgggttccctgttttgctgtaatcatctccatccagagatagtgcaaatgacataaaactcaagccaaaaacaaagaacaagaagatgtgttgtgtccaacaaacatcaaccctaactctcattgttcttatatcaaaagtcttgccttaaaatcagaaccttccgaatcgaaatatctgaaccctctgacctaacaatagaatagatacattggaagctaccaatagaaatatccgtagagatgtcttgtgtttttctatcatgtcttgagaaaaccaatgagtatattcttgaaaaatggagatgaaggattaaaagaaagctaacgagcttgttgtagattttttttgttctcttttagaaaatcttgaaatgttgacgttgagatcaaaagttggaaagttgaaaaatgagagacttgcgtgaaagaagagagttgagaagggtcatcatggaaggaggtccagatttctagcaaatgaaaaaaaaaatgggtgagaaaaatgattggtttcttaattataacttatttccaaaaatagaaataactatattggaggagcatgacaaatgatgattctttggatttcatgagaaatttttgtttatttaaatagtgttgcttaatgatttcaagcattactaaaaaatcacaaatcaatagtgagaaaaacaatataaacattataaacatatggcattattttttaatcaatttgtttccaaaaccaaataataagattatcaaacaatattattagttgtttagtggcaaaataacattaccaaactaaacaacatgatttgactaaattatccttatctgttacctcctaaacttttaaaatcctaattttaacactctaaatcaaaagcctaattttactaatggtgacggcgtctacgttcctcctcctccgcgatctcaacctcagattccgccgtcgtggtcatcggctctaaaagcatcgctgtgaacggcatatgactgtaaccattcaccggatactgaattccgattggctgacaaagatccaacctacaactcggcgattgtggcgtttgcgtttgcgtttgcggcgacgtcatcgacgacgacgacgaggaatcgtccgccgcaacatcaacccaattcgaaatgagcttagtcccgtagccagtggcggcaataatcgacggttcagcttgactaagaagccattcgatggtttctccttcagttttgtgaccgagctcacgcgttaactggaaaatcctagcggcggcgagagccggcatcgtaactcgacggcttcgtccgttaaccttcgtgtgacggtctttagtcctggcggagatacatccgccgccgctcgaggaggatttcgaaacaccgaactgcgtttgggaacgcgattcggaagctatagcgttgaagttggactcatttctgcacacattctgaaaaatcatctccgaattcgtcgattttgtaaactaatttcagtgacgatgaacaaggattcacagagagaatcttagggttactaaaggagggagaagaagatgattcgaattaacttttggataatttgggcttttaagcccaatataaggcccaacatgatccactctgtaggaaaaaaaaaaagggagagagaacaaaatctgacttccatggcaacaaacaagttttaatttttacaaaaaaaaaattgggagtgtgtgtgtcgccttatctgttcgtcatggctctgtagagtagcctcatgttcttattcttcttcttccttagccattcgtggaagcaaaaacagagtcttttattctttggtgattctgtgaaatg

SEQ ID NO: 30386 - DNA, 3003 bp, Unknown; identical to SEQ ID NO: 26447
  misc_feature (1)..( 3003): 2750-1469P.txt file - cDNA_ID_3030755; gDNA_ID_2214636; Annot_ID_188133

SEQ ID NO: 30387 - DNA, 3003 bp, Unknown; identical to SEQ ID NO: 26448
  misc_feature (1)..( 3003): 2750-1469P.txt file - cDNA_ID_3030759; gDNA_ID_2214636; Annot_ID_188132

SEQ ID NO: 30388 - DNA, 3003 bp, Unknown
  misc_feature (1)..( 3003): 2750-1469P.txt file - cDNA_ID_3030767; gDNA_ID_2214636; Annot_ID_136131
attatgttaacatcagtgacttttgtgtaagtgaagataaaagtatgcatcaaagtcagaggacatgtgttgatctcgtggataaatagactgatttccttgaaattacgacaccattattacaagacaccaaatataacttctatttacaaagtcaggtttttcgttgtgctctattcaacgggacaaggtcatggaaggtgtagtagctaagttaaccctaatgtcaggatcgtagtagcttctctgcagtctgcgaatattgtctccattcactgtttaggaaaaaccaagtgggccaatgactgtagtaactttttaaaacaaaggatttttaaccaaatccatttcgtttagttggacaaaatgattaattaggataataaaaagtagggtaggttttgttttcaacaaacgggcaaaatcaccgacgtgactttcggttaacaaacagattcgattcttgaaattagtttaggtgaaaataattcagaaataaattttcttctacgcatgagtaaaaaaaatatatattacatttccaaaataaacgtttttagtccaaaaaaaaaaatgtcagagtgatagaaaacaggaaagatgactatgaaaatccaccttcattgttagtgttacatggttatttcaagggttttgatcaacgacataatccattgtttttaggctttttcaggtgaaaccatagttaaaagttttttttttcactattatgatgagagtggagttctttttttgcatacgtattacacataattaaaaagattatatgacaatattgttaagccgttataatcaatcagctactatatgccctttattttgctaattatctcaaaaaaaatcatagagaagttgcactcgtcattgtactcttgacatttactaattaaaagatttcttctgcataagaaaatgaggagacaatttaaatttggatctctagaggcgtgattaaagcagttctttcccacaaaagatggctttcattatattatactactatttaatttccgtaccacagtgtcttactctgactctgattttatttctttttaattaaataatcacataaataattcactatcacgactttcgtttttccatttaaattaaactaaaccggttagattcgtttttcttcaccaggttaatgtgaaccccaatttttctattttgttaatgatgttttataattgtgattaatacaattagaaaatatctaataattaaagttgagaccataattaaaggaaagggaactattgtgtgaacatatatatattcttacacactcgcagagcaacccttcttcacttgggctcattggaatgtgatatcccaaaaagaaaaggcaaaacaaactactactaaaaaagttgagatagtaaaaatacaattgtactttatcatataataattcaatgtacaacaaaactcaactaccaaagtttgcttattactctcaaagaaaaaaacactgattaaaaatagcaaaagagatttgtttatctatatgaaaaataaacttatatagaaattcttatatgattagttgcaattgtaggtgtaacatttaatcgttgatttgtttttttttttggggtgcatttctcttgtagttgtaacaatatttcacacttaagactttcagacaatagtttaaaaacaaccgaacagaagttgcaggtacctataacttgtgtatgaatccatccacagttttgtaaacgttgactgtttgacattttgaatgtaattttatttaattagatcctacacaacaataatcacatctataatttgccaatacattttaataaaaccacttaacaaaatggttttaacttttaatccagtaattttctgtagttggtgtcatgatttataactactgtacacatttccaagatctaacgaacaatcataatcgataataattgtacctaccaaatttggtctaaaaaaatagaagaagtgattatatatatattcttttttgtttttgatgctaaatattttttttttaatgtgattatcgtttatcattgcacctcacggtaattattattgtttttccctgattttataaaaaagatatatagagagattattgagaccaatgaagagcagaaactgttgggagtcaaaaaaaacttatctccaatttctaacagtgttctatgtcggattccatcaatctctctctcttccatcatctgtcactttctttgttttctacgcaacaagaaaccgaagaaaaaaaaataacaatttactaaagtattaattcctttttttgtgtgacaaaataaaaacccactaaaaagcaaacgattccaagaacatggaaacaaatgtgtaaaaaggaaataaaaacatcaagcgtgggctgaaaatcactacacgaaaatccaaattttggtaattctattaaattttttaagttggtaataaagagaataaatacacaaattgactggccagtacacaagttgactgattaatcgcaaattatacataattaataattaaaaaacggtaaaaaacgttaataaataaggaaataaatcaaaacaaatgaagagtgggattagtaaagtattaaagaaagcatatagagcggaagaaaactgaagatggaagattataaaaataagtgttgtgaagaagaagctattcgatttttatagtcttgagttttattttattttaataagaaaacaaaataagatttttaaaaaatagtatattatttatttattaattttcttcagggctgttgtggtttttgaggttctctataaagcaaagtaagaaaacatctacacaaatgtcccaacaatctgatcagaaaaaagtagacgaagaagaagaaattaagtcacttgaacaatggcgttggtccgaaatgcaaggccttgagcttctccctcataacaccaacaacaactcacgaagctccagagaaactcaccggaaatg

SEQ ID NO: 30389 - DNA, 3003 bp, Unknown; identical to SEQ ID NO: 30388
  misc_feature (1)..( 3003): 2750-1469P.txt file - cDNA_ID_3030767; gDNA_ID_2214636; Annot_ID_188125

SEQ ID NO: 30390 - DNA, 3000 bp, Unknown; identical to SEQ ID NO: 13556
  misc_feature (1)..( 3000): 2750-1469P.txt file - cDNA_ID_3030782; gDNA_ID_2214636; Annot_ID_188118

SEQ ID NO: 30391 - DNA, 1066 bp, Unknown
  misc_feature (1)..( 1066): 2750-1469P.txt file - cDNA_ID_3030798; gDNA_ID_2214637; Annot_ID_188172
acgttttttcagctcatcgaactcacttatatattcgagaggatactccacaatggtcatccatcaatgcaagagttgatcaatttgttttttgtttttggagcaaacaatcaaatttattttcaaattgattttagatatttattttatttttgttaaataatttgatagtataaatattactccctctgttcctttttttttattgtttagaaaaatacacatattaaaaaaacatattaaagttaattttaaatgtattgttttttgtgtgtttacaattttctataactttaaaccaataatattcaaccatctttgttaaagtttacaattcattaataataactaataaatattacattgaaaacctaaaaaatcaatcttttgaaacatatattttttttagaaaatcaaacaaaaatgaacagatggagtattattcagattaatagataatgactatttataattttgaatttaattttcgtaattaatatattattgaaagcaatttaattatatacatttttaattaattagagattcataggaaacaattagtaagaaatatttttctacgaatatcttggtagaaaatcggtcaaaattttctttccattgttttaccaaattttcaatgaattttctaccaatttattttcgtaggaaattttctaccactttcgattttgtacagaacatttgctaggaataattttggtaggaaaatgataagaaacagccgtttcctacgaaattggtaagaaacagttgttttctacaattttcttacgaaattggtcataaaaaattataatttccattaatacaaaaagtaaatctaaaagaatgtaaaacctggaaagaaaaataaaacttagtagtatcaaaatgtaaaattcccccaagttagaagacgtaatggaaataacaaaaattggacgaagttgataaattggaaaattaacaattatgacaaaagctctaacatgtataaatatgtgcatgaatgaagaacattgcattgtgtctgaaaacccaaaaatattattcgatagcaatg

SEQ ID NO: 30392 - DNA, 3003 bp, Unknown; identical to SEQ ID NO: 25146
  misc_feature (1)..( 3003): 2750-1469P.txt file - cDNA_ID_3030802; gDNA_ID_2214637; Annot_ID_188171

SEQ ID NO: 30393 - DNA, 3000 bp, Unknown; identical to SEQ ID NO: 13576
  misc_feature (1)..( 3000): 2750-1469P.txt file - cDNA_ID_3030806; gDNA_ID_2214637; Annot_ID_188170

SEQ ID NO: 30394 - DNA, 3000 bp, Unknown; identical to SEQ ID NO: 13575
  misc_feature (1)..( 3000): 2750-1469P.txt file - cDNA_ID_3030810; gDNA_ID_2214637; Annot_ID_188169

SEQ ID NO: 30395 - DNA, 3000 bp, Unknown; identical to SEQ ID NO: 13569
  misc_feature (1)..( 3000): 2750-1469P.txt file - cDNA_ID_3030821; gDNA_ID_2214637; Annot_ID_188162

SEQ ID NO: 30396 - DNA, 3003 bp, Unknown
  misc_feature (1)..( 3003): 2750-1469P.txt file - cDNA_ID_3030824; gDNA_ID_2214637; Annot_ID_136148
ttatacattgtcagcatccttaagatttttttctgtatgttgtcaatgttaatttgtttaaattatctctaatgggttctaacttctaagggctaagcttctgaactggaacaggcagaaattttggtctcacccagtcttgcaacaactcaaatggttgattcagtgaccggaagttcatgtgacccacaggatggtggtctattgccgggaagcatacctccttgtaccatttccgctgaagagtcggatggaagtggaacatccagttcagtgcagctggcgtctaatattgcaatagatgagtctaggaattctgaagatagagtatcaagtagcgagtcaccatggtactatttacgaaaagaaagtgcagcttttgtttcagaaactcttcagagaggacgcagaaatctttggcaacttacaacaagccgtgtgtcagttttgctctcttccccaggtgcttcttcaacaagtatacatcagttcctaaaaaattatgaagacctgagcatctttatccttgctggggaagcgttctgtggatttgaagttgttgattttagggagaagctaaagggtgtatgcgaaaattatttcactgcatttcataggcaaagcatgcatgtaagttccgttttacaatgcctattgggctgacattgccaataccacatagctagttaatttcatgcatcacctctcctacatgataacgtgaaaataaagtctttgtttggtttttctcccttacaggcgcttaaaatggtcctggagaaggagacatggacgaaattgtcaccagatactgtgcaagctattaattttgctggtcttgtgggggatggggctcccctaattatttcttcccgcagtgcctcaggttcttccagattccctcactctgataagccaagtaactcaattgatccaagtggcaacaggagtggattttcatattggctgaaaagtgggaacccgttctcagcaaagttaactcactatagagaagatcaagactactcctcgatcaatggagaagatcatgaagggaatgatagtattcatgatgatgttgtgaatcccaagataagagacataaaacgcatcaacggaggtagtcctgtttcagaagatgaaaacgaagaccttcttgctgactttattgatgaggatagccagcttccaagacgaagttttacacgtagtcaatcaaggacttcttcttcacattttagtactaatgatgatttgacagctcaaacaggatcatccctttgtcttctaaggtaatatatgcggtttaggaaatgtttgaaattataatgacagccttccgatcgcatattttccctggcacttttatgacatggaattgcattaattgtgttcgatgtcttagatctatggataagtacgcgaggcttatgcagaagctagaaattgttaatgctgaattctttaaggtacaaatcctaatacttggaaattcgtagatttctctactctgctccctcgatttcatttctaacttttctcttacgtctgtttgaaattttgtagggaatatgccaattgtttggagtctttttctatttcgtgtttcaagtatttggtcaagaaaatactaattcaggtggaaaaggagtttccgactctttcaatcgtgagttactgattcgtttgcttttgatgctcttctttgtttgtaatgttactccccaccagtgtcagtatgagtcgtgttatgacttttaaggctacaatatctgcggaaagccattttgctcaacataagtatattttgaaatgcagatcgtttgaaaagctgcttatcacggatatcacaagagtgtgagcaatggataaaacctcacgtttcatcatcaccatcttcttcacttgcctttcccaacactgttcatagtcttgcggatgtgactccagcaagtcccttaaatacttctggtcacttatcaggcgtatcttttagtctcaaggtatataacttggggctaggttttcatcaatttgaactacagttaatactgttttatgttcattagttaccctaaatataactatcctaatcatttatactctagtatttgatatattgtgtgagaagaagagcagctgccttgctttcttcttatcatctcaaggttgtataataaaaggattatcgcttgcaggaaagatgtgctgctgtggacacagtatctcttgtggctcgggtattgcataaatcaaaggctcatctccaatcaatgcttatgtcaagaaatgggtctctggttgaagacttctttggtcaactggtatgcacctcttcagatcttattttttaagaaaaaccctggttggacgtattgcctcgcttggatttgctgttgacaacatgcatacaatcttattatacagacacttctgtagcatccaatagtcttttgcctctaaaaaatattgaattatacaggacatgattagtaccttcattgtgttacgttgctaaactaatttctcctatataaaatgaagaactatctatatacaatatgtggtatcaaatacatttgaagtagtttgattaaaaggagtgattcatcaggttggttccgtacctgatctgacagagcacttacataggacaactgcgaggatactgctgcatgttaatgggtaaattgccgatcttcttatgagcttgtgttttcgaaagaagtgattagataaattgcacctctctcttcccttgcgccttctgttcgattcttactaacctcaggagttttaaaactgttacattgaatgtatgcatgttcattcagcttaaactaattttacagatatgtcgatcggatagctaattctaaatgggaaatcaaggagcttggaatggagcataatgggtttgtttaccggatgacccctaactgaatcatgaaatatacttaaatgtaataaactctttgaactaacaggtatgttgatttgatg

SEQ ID NO: 30397 - DNA, 3003 bp, Unknown
  misc_feature (1)..( 3003): 2750-1469P.txt file - cDNA_ID_3030824; gDNA_ID_2214637; Annot_ID_188161
ttttggctgtgatatggtccagaaaatggttaatggagcaaaagtcacttcttggacttgcgtaagtttctctactcggattgaccgtggtttaccccaagagttctgcaaacagttgattgggatgtgtgtcagcaaaggaatggtctgtcttgtctcatgcttattgatacttgtcacaatttcataccaaaaaatttactaactcttttttttgttttaattctttgtgccaggaatttaagcctcaacctgctattccgttcatctcttgtccccctgaacatattgaggaagctcttctcgatatccacaaaagggcacctggtctccaactgttgattgtaatattgcctgatgtgactggatcatatggtaagtctgtgctaatgattggtaatatttggtgcaaagtttattccgacaatctgttcatgaagtactctttctgtctgcaggaaaaataaaaaggatctgtgaaacagaattggggattgtctctcagtgttgccaacctagacaagttaataaactcaacaagcagtacatggaaaatgttgccttgaagatcaatgtcaaggtctagtcatctgtgcttcttattgttttttatgatggtgtaaaacgggtatttgtattacagactgggggaaggaacactgttcttaatgatgctattagaagaaacatacctcttattactgatcgtccaaccatcatcatgggtgctgatgtgactcacccacagcctggagaggactcaagtccttctattgctgctgtatgtatatcttattttacttgtatctcattatactactgtttcatcataaaaggtaattctcttatttcaactacaggttgtggcctctatggactggcctgagataaacaaataccgaggattggtttctgctcaagctcatagggaagaaattattcaggacctgtataagctggttcaggatccacaacgtgggctagtccactctggtttgataaggtaagagcaaaacatctacaacttcttgtgttctttgatttttcacaagaataaatataatggacactgtttgtgattgcagggaacatttcatagcattcaggagagctacaggccagatacctcaaaggatcatcttctatcggtaagtggttctcacattccatgcttaaacatttcatagcatgagcaggtttggctaattgctttctctttatacagtgacggagtaagcgaagggcagtttagtcaggttctgctacatgagatgactgctatccgcaaggcttgtaactctctccaagagaattatgttcctcgtgttactttcgtgattgtccagaaacgtcaccacacacgtttgttccctgagcaacacgggaatcgtgatatgactgataagagtggcaatattcaaccaggtttctcactctctgctcttctctatcaacttaattcctttaatgatccagatttcaagtaacatatttgtatttccttatcaggtactgtcgtggacactaaaatctgtcaccctaatgaattcgacttctatttgaacagccatgctggtattcaggtattgcttccagaatctagaccaatttatgacctgttttgtctcagcagaattacaacttcctttgaatgtttgaatggtaatagggaacaagcaggccggcacattaccatgtacttctcgatgagaacggtttcaccgctgatcagttgcaaatgctcacaaacaacctctgctacacgtaagagacaacaacattgtacattttccttatgacatgttttaactctctgaaactaacaaaacatataataaaatgcatatgcaggtatgcgaggtgtacaaaatctgtgtcaattgtgccaccagcctactacgctcacttggctgcattccgtgcccgctactacatggagagtgagatgtctgatggaggttcgagcaggtccaggagctcaacaacaggtgtgggtcaagtcatttcgcagctcccagcaataaaagataacgtcaaggaggttatgttttattgctaatgattcacttcttctcttgccagttttaaaagccgttaataattatgaaaactatattcggctctcggttatctcttttgggtttggctgttaatattttgaaggatctggccaacttttgcgccttaggacttatgttatgcgttttggtttcagatgatgactacttttatcgtttgtgaaaagacaaagggttaattatgatttttttggacgatgatttggctcagttctttttacttatggtattttgtgctaatttcttgttacaatttattttcttcgacaatttcttttatcctcttaattgtcggcctctgcttcaactttccatggtttatcgtaatcttcacaatgaatcaaagtaatgttttcagtagaaactggttgtttttgaaaggagtcttattgggagtgatttagagagaatgagaatccatagaacaaaatcagttagttgataaagatttgattccacaacaacaacatttgctcaagttcttcatataaagagaaacaaaaaagacaattctgagatatttgcaaaggttgatcttataccgttcttttggatggatcaatttcacaaaaatcaggtttgatgattcaagagctttacccggttcaatcaccggtccggttttaaaaaacatttaacactacacagaaaatttggaagaagagtgttaaataaacactggctttaatcattttgttgggtaaaacaaaacaaaaacaaaaccaaagagagcgagtttaatcacaccattgtcgaaacaaatcaaaaggctcaacaaaagtcttcttcttcttctagatctctcttcccgatccgatttgtgactcgccggaaagaaataacacacagacagacattttctccgatcgtgaaattagatggatcaataattgatcttactggtataaagaagagatgagagatg

SEQ ID NO: 30398 - DNA, 3003 bp, Unknown
  misc_feature (1)..( 3003): 2750-1469P.txt file - cDNA_ID_3030886; gDNA_ID_2214638; Annot_ID_188209
ctacgggcctatttatatagtatatttatttgagtgtcagtgtcacactaatcaaggtttaattttaaaattgcagtattaaatattaatgaaggtttttatgcgagctgatagcggcctcaaataaatatattctcgattggatttctttaaaaaaaaaatcactttaaagttgacaaaaaaactcagtttaaagaaaattaaggtggaattatctagttaagtgttactctttaatatttggctaattgcgttggttcatgcctgtttaagaaggaaatataaaaagttttgacttaggaaaatgaaaatgaaaatgaaaatgatgcagcttcccagcttttttacagattccagatattgatcagatttttgataccgagatttctcttctctattgatttgatagagtttgggaaggttttcaaatatcaaagaatggaaataatgacaacattaatggaaatacattcagtaaacagtacctaaagttttatttttatttgaaattaaaataaagataaacgtatcatttacagatttggggtacagaaataaagtgcaaggaatcaaaattgtcagccgaacaacaaaaaaaacaagggcttttcagaaaaataaaaaacctttaaaccctttttttgtgtatccgattccgtcgcaagtacattcggactctttcacggcgtcaatgtctgagaacgcagccaacaacatcatggagaccaagatttgtacagacgccatcgtgtctgaattacagaagaagaaagttcatctcttttactgcttagagtgcgaagaacttgctcgcaacatcgccgctgaatctgatcacatcactctccaatccatcaactggaggtttttccctctttccccattttctgggttctctttttgtgtttctggatgatgtttattgggtttatgtgagtttaggttaagtaaaaatcatatctttattctgaaacaaaattcccttgtgttggttttcctccagaatctgtgtgtttgcatgtgtggttgtttgatttgaagcttatgtattcaaaaatcttatcttttgagcaagtttcagttttctatgtaagaatatagcagtttaagtgttttaagttctcttctctcttactgttaaatgaatctctggttggatagtttttggtgattcatagatggcattgaggatatgtgaattgatgtggtcatttgttatgctttcaggagttttgctgatggattcccgaatctatttatcaacaacgcacatgatatccgaggccagcacgttgcgttccttgcttcattcagttcccctgctgtcatctttgagcagatctctgtcatttacttgctccctcgattgtttgttgcgtccttcactttggtgttgcctttcttccccactggctcctttgagagaatggaagaggaaggagatgtagcaactgcttttaccatggcaaggattgtctctaatatccccatttcacgcggtggtccgactagtgttgtcatctatgacattcacgctttgcaggtttgtttatttatttctgatatccccgggggtttgctacatttatttgtggaattattcaagttcatcactctctctatatatgttcatgtgttgcaggaaaggttttactttgccgatcaggttcttcctttgtttgagactggaatcccgttgttgactaaacgccttcaacagcttcctgaaactgagaaagttagttcatgaaaaactgttactgatagcatccacttgtgttttcagtggctgttcttttttgtttttgctcaataatctaaatttgattccatttgtttgcaggtcatagttgcatttcctgatgatggagcctggaagcgtttccataagctgttggatcattatcccacggtttgtagctatctaaaactgatattttataacgcttcatttgaacatctttatgacctgcacaatatctaatggaactcaattttgattcataataggttgtgtgtacaaaggttcgtgaaggcgataagagaatagtcaggctgaaggaaggaaaccctgctggttgtcacgttgttatcgtggatgatcttgtgcagtctgggggtacactcattgaatgccaggtatcaaaattctcatatccctgcattttgtatcttcatataggttatagcaatcttgaataaattctgaatcacaagtgttgtgtcaaaactcaagagaggcttttgatcagaatctttgttatttctgatgttatatgagatttgttgagaatctagtttgaaattactcatcttaactgtttcactttctttttgtcacaacagaaagtattggcagcgcatggagctgtgaaggtgagtgcttatgtaactcatggtgtcttcccaaagagctcgtgggagcgtttcacccacaagaagaacggtaattatctgtgaaaatgaaagaaaaagtaactaactttgttcattgttctataaatatcttgcttgttgcatctttaaactgaagtcaatgttattgtttcttcgaattaggattagaagaagcgtttgcttacttctggatcacggattcttgtccacagacggttaaggccatcggaaacaaggctcctttcgaagtcttgagcctcgctggatccattgctgatgctctgcagatttgaagcagtagagataaagcctggttctttgctcgttttggacttttggtggttttatactcttaagagatgtgctttggatgatcatttatgaaataatcatatcacttttgctgaaataactagacagattgttgaaaccttgtactctgttcttgttgattgatcttcttttgcaatgaattgaatcgttaagttcagaaagaagaaaaactacacacgtgtggttgtcttgttcattatcaatggcgataatgtcacacgtgtgtaatctcctataaattatccaacctttaaacttaaatcgacaaaaatg

SEQ ID NO: 30399 - DNA, 3003 bp, Unknown; identical to SEQ ID NO: 15743
  misc_feature (1)..( 3003): 2750-1469P.txt file - cDNA_ID_3030890; gDNA_ID_2214638; Annot_ID_188208

SEQ ID NO: 30400 - DNA, 3003 bp, Unknown
  misc_feature (1)..( 3003): 2750-1469P.txt file - cDNA_ID_3030894; gDNA_ID_2214638; Annot_ID_188207
attcgagctgctcatgccgcaatgcgtgcactacagaacacacttttaagaaaaaggacactggacattcacttttccattcctaaagtatggactacgagagatattcttgatttgaagtttcagcttttctttagtacttttctcatcatcagcttatgccacatgataggaaaatccatcagagaaggatatgaatcaaggaactcttgtgatttttaatgtggacacaacagtatcgaatgatgagctccttcagctgtttggtgcctatggtgaaataagagaggtaatttaacttgtgcgttcaaatgtgcatatgctatgtctaagagattcttctctttgtttggtacataatgtaacatatcacctgcttattgattcttgacttgtaaatgcagattagagaaaccccaaacaggcgattccacaggttcattgagtactatgatgttagagatgcagagacagccttgaaagcactgaatagaagcgagataggtggaaaatgtataaagctcgaacttagtcgtcctggaggggctcgtcgactgtgagttttctgcactttgtatatgtcaaagaattgagttatcttgcatacactgtgaacggaaactttttgtatgcaggtcggtcccgtcacaaagtcaagatttggagagaaccgaagttacaaatttctacaatcaagtaggttcacatgttgctaattctccaccaggtaatctcatattgatcatttcttttatcaactttttctctcgattggttagcatgccttttccgtaattcattcaatctacttaataggtaactggccaattggtagcccagtgaagggctctccttcgcatgcctttacgaggccacatggtctaggaatggtcaggccagttaactcagacaatatgccaggactggcttcaattcttcctgctcatccttctagctttcatggattttcaccagtcagtaatgaccaagggctattgaatcattcaaaccaaactattctgaataagggattgatgcacaacatttcctatgggcaacctcattctttgccagagcatataacagggggaatttccaactccatgaggtttatagctccacactcctcaggattcgggacttcatctgatcaccgctatcgctggggaagccctcctcagcatatgaattatcctggttacactggagtgtcgtcgtcatcgtcatctactgaacgtcctttcactgtcaggcatggttttccatttgctgagaggcaggcttcattgcttggaaaataccagcatcatgtgggctctgctccctcaagcattcattttaatacacaaatgaattgctacacgggatcaccagagataccccttggatttagtgatatgggaatcaacagaaactataacagtgctcatggaaaagcaaaccttggtgttagtctaccggggaacagtagtgaacaggatttcactggctttggcatgtcttcaatgcctacagttcctttcggtgggagtagaggattacaatcagtaaggcctgaaccttttgctgagcagggtaggatacataaccacgagagtcacaatcagaatcagttcatagatggtgggagatatcatatcgacttggataggattgctagtggagatgaaatccgaactacattaatcatcaaaaacatcccaaacaagtaagcgttttattgatctcaatctaagatattcgagcaatgtttaaatttcaaatgctttgttttgtaaggtacacttacaagatgctggtggctgaaatcgacgaaaagcacaagggagactatgactttctatgcttgccgacagactttaaggtattatactataagagagagtgaactcatgatgcacttgtatgacctgagaacttactaacaatctagcttttttctggatacagaataaatgcaacatgggtcacgcttttatcaacatggtctctccattgcacatcgttcccttccaacaggtttctttaccttttctcttcagtattgtctttaaaacttctcttcactagtcatgaagttgactatgtattgtggatatggtaattatccgattcaatggcttgagattgttatagctaaaagatattcataatgtgtgtttctgcagactttcaatggtaaaatatgggagaaattcaacagtgggaaagttgcttcattggcatatgcagagatccaaggaaagtctgcccttgcgtcatacatgcagactccaagttctatgaaggaacaaaagcaattgtttccagaagtctcctaccatgatgatggtcaagacgccaatgatcacgtatgtttatccgatacaaaatctcatttttgtttttgtttttgatacatgatttcaaaatgcatatgcagtatcttcagatttttccaccgatttcaccttgtatctatgaatcatacaggagcaactgttttcaagcatttggaacataaccgcgcctgattcagattggtcttacacaatggatcttatcgaaaatccgagggagaacggtaactccaagaatgctgcagaagagtcctcttgaatccccactaaaactagtagttgggaactctaactcaccatcaaaggtaaactaagtgtacaggtctggcgcggttatggaagaaacagaatgtacagtattaaggcttgttttctccacggaacaaagtaaccagtttttagggattacttcactcgaagcaaccgattaaagaaacatccctattagtacattacgttgtatactttatattcggaaacttctctctatatcagtcatgtgtatataacatcctcttgcgtgtacattatcctttccatgtgaaagacatgatcagtatttagttgtacaacaggttcgttataagtttctgtctcaattagttatcattacaaaaccgttacacgtctctctctatgtagacatctatccatggtttcaatg

SEQ ID NO: 30401 - DNA, 3003 bp, Unknown
  misc_feature (1)..( 3003): 2750-1469P.txt file - cDNA_ID_3030898; gDNA_ID_2214638; Annot_ID_188206
atcggatggaataattggaaaaaaggaagagtttttgtttcacctttttgcgattatcttgctgcatcgtgactcaattgaaacacagactaaaaacccaggaattagaagaaccctagaattcgatctgaattggggggagggaaatagaaattcagatcagccgcattggccccatcgaccactactccaaatggcgaagctagaatccgacctggttctgctccggcaatcgatcaccgacagagacagaatcgcaggcgaatttctcattcacctctctaattcacccaattacccccaacgaaatcgaaacaacaacaaacaatcgcagttcaagataaatcgaggaattgaagatagcagagtgcgaacagcattgctttagacgcacgttttcgtcggcacgagatctgatcaccgacacacaagggatacagagagagagagagagagagagagagagagacgaagaagtagtgaaaatgaaaggagagagagagataaggaaggaatctagacggagatttatatatagaggttaaagtgtcgcgtttggtaagctgctttggtcactgtgatccaaaaaaacaacccattagtaaaacgaaaaaataaattatttgatcaagtgttaataaattaattaggacattattgatctggtcattattagtgtatgatctatttttgatctttattgccattcattcatgtcttctttatccaattctttcgttttgtcacgtacttatctcatagatataatgttaatagaatgttatcatctttatccttaaaagcttttttgctaattttagttgctaaaactttgttttattcactttatcatttgctatattgtatatactgctaaattatattttcaatctatatttcatcatcttcatttttgtaaggaatttttagcttattttttgtattaagtttctggtaatatgattctcaattattttgctgtaaaaaaaaatatatattattttgtttttttccattaatattgtatatcaaataaccttcaattaaaaacaacaatattaatttagcttttggttgtggcatgagtgtaatatagtaatattaggggtagaaaaaaaaacaaactctcacttaactagcccaatgggccatgccatttttttaaaacacgcagggcttttcatatccgaatagttaacgccacgtcatctctgacgcgtgagagatttgttgtcaaatgtaataaaccagctaatcattagtctgtcttactgtctccttcttgtggttaaaatcaaaagtcaaaccagctcacattagtgtaattatttaactaaattataaaaaagataatcatattttgattagctaataactaaactacttgacgattgagcgaatcttatatttagtcttacgggattaaacaaaaaatatcaatcagaccttgttacgtaagcacaaatcatagtgtttggttgaaaaacgaagaataatacatttttttttatagtgtgttagtactgttttactttatacttccatattcttttttcaatagacatgttttttctaatcttctttttggtgttaatttgatttaaattaagttaaatttttgttgttttatgtatttggccaaaatgatatttgcatcataaggttcatgtagaagaaaacatatcttcatttttttttactttctagtctttttcaatctagtggacctaatcctttttcaaaatgatcttcaaagaatttttgtacctagtcttgaataaatgtgaggaaatctttctttctttttatgtgaaaaaatgtgaggaaatctaatttacgtctttcatttttctgcgaacataaaatgggtaaggagatatggaaaatgtaagattcggtttgcaatttttctgcaaacacaagatctctgttttctgcaagaacagaaccaatttcccaccagggtaactcattttgaccacttacaagcgccaggcaataatccttcttcaaggcctttcaccactccccaagttctctgctttggatcatataagctctcaaaaatcataatccaataccaaaattcatgataagttatatgttttattcattatcaagaaattgaaaaacaacaattcaaaaagttcatcttttagaatcatatactagaaaacacataaatcaagctccattcaccaattattgatgaagtcatgaagataaatcgattattatcctctgatgcaacaacagcgtggaggatttccaacacaatgtccagtccggtaaatagctacattagtacagtcatagaagcatgcatgatcatcccgtctagcatcacatagaaaaaggcaagcaccatattttgctggctcgatcactgcacatatatacaactccacattaaaactataaatctgtagatacatgtccaaataacagttttagtttcttcaaggttcttaacaacatatacatatacacagatacatgtaatattgtattactaattctatatttttaagaattttttgtttcctgaattattgttttggtagtgatcaaagatagttgaaaataacaaaaaaaaataaacatcttcgcaaagaaacaacatacctgactcggcctcaacatcgtaataagaaaacgaaattgtcaatataattacaagaaaaacagttgcagaggtttttttgatacccataggttctattatcttttaggttttcgtgaaagtcttatttataggactatttttcttggaaagtttcaagtttttatcctctgtttttattttacagtaagtagatcttccataaataaatttgttattttggtaaagagagattttcatttctttttattatcttctttaagtagaaagaatcttaaaactactatacttgaatacttataaaaaaaattactatacttgaatatatcaaatttaatgcaaagttcatgttggagaaattaaatactaatatcaaaatg

SEQ ID NO: 30402 - DNA, 3000 bp, Unknown; identical to SEQ ID NO: 13586
  misc_feature (1)..( 3000): 2750-1469P.txt file - cDNA_ID_3030920; gDNA_ID_2214638; Annot_ID_188195

SEQ ID NO: 30403 - DNA, 3000 bp, Unknown; identical to SEQ ID NO: 13585
  misc_feature (1)..( 3000): 2750-1469P.txt file - cDNA_ID_3030924; gDNA_ID_2214638; Annot_ID_188193

SEQ ID NO: 30404 - DNA, 3003 bp, Unknown
  misc_feature (1)..( 3003): 2750-1469P.txt file - cDNA_ID_3030936; gDNA_ID_2214638; Annot_ID_188187
tgtggcatataaaattcattatttagtaatataaatacatcacacaaaagtataggcaagcttgggtggcaagaaaccagaaggcggcggtacagaatttttgcatataaacacatcagattttaatgcccaaatttctctcattttcttgcttcgaaaccaaatattcaaagagagcgagagagagagatagatcaagaaagaaagagtgatgcagaagcaagagttcttggaattgttcaaggccgcacaacgagcggctaagtatgcgagtgatgagaattctccagaggtctcgaggtgtatccaattcatgaagcgtttgaaagaagctcctgcatctcttgattgtgacgtggtcgttaacacaaactccattggaaacggaatccgttttctccgagatcacaaaaaccccctaattcgatctgaggcagaacttctttcagatctttggctcaagtatctttacgccaccggtagaaaacagaagtcgacagattctgtttagttaaacagattcagagaaattcagattcaggttttgaatgtaactgtattaatgtgttagagacttgggtttgaatgtatatgacattatattactgcttcttaatatggcagattttgaataaagaaaaggtttcacgagagaagattagaacactaatatgtatgacaaaagctttcttcttgattcaatgaagtcacactcatttcaaatccataaataataaagcttacttaagtactatagttggttaaactcacaataatatgacaatgttttgctactaatcacatcacttggatcagttattttttgttaaaaccttgacttggatcttacactttgatgacgctcttggaagcatcataagattcctcatttccatggtggtttgcaagttattactgttgtttaccacgcaaattttcactagctcaagacacggtaacttctccaagaaatgcttcatttgattcagctctcttgtcgttccttgatagctcaatatctccagcaccttcacttgagatgatgataggcaagaggttatgctctcgtcggtatcatagcaaacacatacatccccacatctgtttgttatgtagtgatcgagaccctgaagcataacaaagaaaaagagtaatgttaacgacctaccaatatatatatggtgtttaggatgtgtttgtgacatgagataccatgaagatgagggtttctaggtttggagagttcttgatcagaagtggcagcatttgccatcctcttgccttgtcattcccaatagatagactaacaaggctgtcgaacaatggcatttctttacatgagaaataaagcagcttcaacaaaacacaatgtgttagtctgttgtcactcaataacacaaaagttgaaataaatcatcaaaagccccaagtgaatctcattctcgataagcaaaaaaaaagaagaatgttatttataaggaaagaacaatatatagaggaggctgacctctagagtgtggctagataagtgaaggattctaacatttctgattccattgatgagatttctcatatcagcgggaatggaaccgagagatccatttcttactcccaccattcttgtttcatccatccgaagattgagtctagcttcgatgagggaatccaacttaacattaggatacttacccaaaacataaccagagtgtttgtagtagataagattaggagcatctaatgaaatactagtaaacttgcgatcaaatcggatgtgtagtctctttagagatggagaagacacggaacaagtccaatctacacatcgccgctcctcaacaaccagttcttcgagaacaggacagcgagatataagagttccaacaacattatgacctccaacaaaattaactgagtcaagacataatgtcctaagcaaaggaagagaaacatcttgagaaagcttgattgtaaaaccacgtcctactctcagcttaaccaatgtcttgctcttaaagatcattgcaggcactggtggagattttccttttaaagtaatgaacacatcaagatccataacaccatggtcaagaacgttgcaaatccaactttgaatgcgagatgaatcagtgccacctcgaacaccaacatgactctttagagtgagcttctttatagaagaaccacgttgcgtatctagcaatttgtcaacgaaagccatgtaatttctgtgaatctcaatccggttttgcttagtcttaggcacagattgacgatcatcaatatcaagattggaaaccaaaacaaacatgttcttccacctcttagagagtactgaggttgaaacagcttcttttgtggagataagagacagaatacgcccaagaacctcatctggtagacggctgattacatctttagcattcattgataccaaaaccttaaaaccacagcaattggattcagaaacagtaactagacagagttgatgagttcaaaggtctgttctttttcatacaatgcaaagtctaatacaaaagttatcatgtatctcttcaatcacattgattaccatagaaatgaaaaagacgaaacagagcagacaacataccttgctaaagtgctacttgctacagagtcgtgaaagctctccactttcaataccaatttaatcgtgagatcaaaagtgaaaacatcgaatactagggttttggaaagtttaagagaagagacgaagaaactgaaacaacttattataagcaatttcctccatttccacatgaggaaagagtaaagcagaaagactgatgaagaaaaggtaagtagtctgtttgggaaagaaagtcacgtgagagaagcgtgggcctttaagggtaaaactgtcatttaaatagtcgccgttctttacacttaggattagggcttctaacatttaaatagtcgtttcgttctccgtctctcctttcccgtcggccggtgataatttcgcaacccaaattccaaatg

SEQ ID NO: 30405 - DNA, 3000 bp, Unknown; identical to SEQ ID NO: 13594
  misc_feature (1)..( 3000): 2750-1469P.txt file - cDNA_ID_3030940; gDNA_ID_2214638; Annot_ID_188186

SEQ ID NO: 30406 - DNA, 3003 bp, Unknown
  misc_feature (1)..( 3003): 2750-1469P.txt file - cDNA_ID_3030947; gDNA_ID_2214638; Annot_ID_188183
actagtgatcgttatataatcaaattcaaagtgattgtaatgtattctctaacttaatttagcagttctgcttctctatgccttcttcaaaataattttccatctataagagactcttcagaatatttgtttcttttcttgcgtcattgaatattaatctgaacgttgtacaggggtctcactcagctatccctgattcacctctaggtccagacgcgtatcgagagtatgaaaccttacttgttcaggattacaatgaacatactaagaaaagcgacaaaatatctaaagacaaaggggtttctaagttctcttctgcacttgaatcccttactatggagcctattgaaagcgaaaatgtagatatttcatcaggtggtgcacaaggtttggttgtctcagttcaccacttccccttgattatttgtcctttcactcctcgagcgtttgtcttaccttcccaaggatcagtcgcagaagcgtccttgtcccgtcaacatgaggattctcttagttttggtttgcctcccataagtactggatctatgtctgacactgatgatgttcctcctggtgcaactcttaccgcacattttctttaccagctggcccttaaggtaaactaacactgcagtaaccgctttgaacttaattcacgatgttcatgaagtacgtgagctagaacactagaagatatctgtttcccttgtttgtcaataatttaatttcttctgtacgtttttcttaaatttgtgaccatgtcgtcacttttttaaaattgtagatggagttgaagttggaaatattttcacttggtgaccaatcgaagaatgttgggaagattctaacagacatgtcaagtgtttatgatgtagcgcgtcgtaagcgatctgctggcttgttacttgttgaccgcacacttgatcttatcactccctgctgtcacggggattcacttttcgatcgtatcttttcatctttgcctcgggcagaaagattttcttcacaagcacagcttaaacaaggggtcccaagcatcaatcgtccttctcttgatgttcaagtgccgcttggggaactgcttaatgaagaaccaagcaagattcgggattctggtcttcctgaaggaattgaagcttttttacgtggctgggattcatatacctctgctccacaaaatgtaggtttgtttaatgaatgtgacaagaaatctaccaccaactggactgaactactaaatggatctcttgtcgctactgaatgttttagaggaacaccttacttagaggccatgattgataggaaaacgaaggatggaagtgtactggtgaagaaatggcttcaagaggctttgcgtcgcgaaaatatctctgttaacgtgagagctcgtcctggttatgctacaaaaccggagctccaggccatgatcaaagcattgtcccaaagccagtcgtctttgttgaaaaataaagggattattcagttaggggcagctacagccgctgctcttgatgaatctcaaagtgccaaatgggatacttttagcagtgcggagatgatgttaaacgtaagtgctggtgatacgagtcagggtttggctgctcaaattagtgacctgatcaacaaaagcgctgtggcagaacttcaagcgaagaaaaacgagaaaccagattcctcatcacgagggctgctatcttttcgtgatgccctgcttcttacaatagttggttacattcttgctggcgaaaatttccctacatctggctcaggtgggcctttctcttggcaagaagagcattttctaaaagaagccattgtcgatgctgttctggagaatccatcagcaggaaatctcaagtttcttaatgggttgacagaagagcttgagggcagattgaatcgtctcaagtctgaggaaaccaaagaaattccctctgatgatcaattagacattgatgctcttgatgatgatccatgggggaaatggggtgacgaggaagaagaagaagttgacaatagtaaagcagacgagtcctatgacgatatgcagctgaaactggatttgcgtgatagagtagacagcttatttaggttcctccacaagttatcgagtctaagaacaaggaatctaccattaagagaaggctcattggcttcagagagcagctttcctggcgagccttctggaaacaaagggctagtctacaggcttataacaaaagtgttgagcaaacaagagatacccggtttagaataccattcttcaactgttggaagatttattaaaagcggatttggaaggtttggtcttggtcaggttagttagacctttctctctacccatgactttcattttcctacacaagatatacattaatgtttggcaatgctattgcaggcaaaaccaagcctggcagaccagagtgtcattcttgtctttgtcattggaggtatcaacggtatagaggtgagtttcttcatcacaaaagtcacctcgcattcacgttgtagggctatattttttataactgtctatgtttcctccattgttaaggttttggaagctcaagaggctgtgtcagagagcggaagaccagacattaacttggttattggaggaacgacacttctaacccccgacgacatgtttgagttattgttgggacaattcagccatttttgatatcttgcaaactgacctcactctcataatctctgttgttagcttgtaacattagaagaaacagaaatacccatgaataaattaatgatcgaatgttaaaatctacaaaacaatagttccattttcaagagataagaaaagattggttattaattgtgaataagagatttttcaaaaaaaaatctcaaattatttatatctttggtccctaaagttttataacatttacagaaaagcttttaagttaaaaatcagaaatctccttaaacccccaaaatcacatttcacacgaaaaacctcgagtgagtgaagaaacaatg

SEQ ID NO: 30407 - DNA, 3003 bp, Unknown; identical to SEQ ID NO: 25156
  misc_feature (1)..( 3003): 2750-1469P.txt file - cDNA_ID_3030951; gDNA_ID_2214638; Annot_ID_188182

SEQ ID NO: 30408 - DNA, 3003 bp, Unknown
  misc_feature (1)..( 3003): 2750-1469P.txt file - cDNA_ID_3030991; gDNA_ID_2214639; Annot_ID_136217
tctaaggttcctatttctctactttttcaacttctactacagaaaacaaaatcaaggacatcatcctagagattagtgtcaaattacgcaaaaacatgttcctactggagaagaagcttccatacataaatcttggtactattcaagaaaactgtgcttttcgaaaaccacaatgaagctttgaatttagtatgtcttagtcgttaagcgacactgtttagcaagcattctattcactaaagctcaatgattctctcgtacaagtttgatgaaacaagttttgtgttgtttacctcgtaactccttaagtaaacggaaagagaagccctttgaatcaacagtcacaacaacatgtggcttaaacttaaccgcagcatcaatagtctccttcaacttcacctagtatctcaaaaactagactagtcaatcaaaagaatctagagtagctttatatcaaaccattcaaaaggttactcacacggaatttatacaaatgtggcaaaagctcccatacacccattacagccaaatcctccattggaaacaacgaattcaatcctttcttgcacatcaaggatctatcaatttgtaagaagcaaagatacaaatgttccaactttatgaaattttcaattgagaatcaaaacttttcataagaaacttctaaattgggggaaacccaagtgcttaccctccaactccattgaaacggatgggtaaaggagagagctttttaagcgaggacataagacgagaaccgatgttatcgccggaaacttcgccggagacgatgaaaactctgagctccccatcgattgcagccttgtcaatcaccgatttagcagcttgaaatgatgagtatctcttagtgaatgttgagagagggaaacgaagtttgctctttgtaatctgaaacatcatttcggagaagagagagaatcaaaaactctgaaagagtgaaagtgacgttgttaaacaatgaactgcgatgaaagcaagatttctcatggggactttaatgggcctcttaagcccacttcttatcagcatgttattgaggcccatcagtcatagtgatacttgtttaggagacagtgatagttatagacttacagtgagtgattgtagatgttgaatggcctatgtttattgtttttggatctaaaacttatcaagtaagagtttttttcttctgttaaattagtactccatctgttcttttttgtttgattgtttagaaaaaaaaattgtttaaaaaagattattttttaggttttcaatgcaataattgttagttataattgataaattgtaaacttcgatacaaattattaaatattattggtttagagttattgaaaattgtaaatcacgaaaaacagtaaatttaaaagcaacatttcatatgttttcttaatatttgtgtttttcctaaaggatcaaacaaaaaggaacagattgagtattacttaggataagtttggggtttatagcaaaaagtttgatatttggggcttatagcaaaaagttggactgacaattataaaaatagtaaccaagactatcaaaatatttgataaatttagcttatctttttattaacctttaggattctgattttcttaaactaacttttttttaaggttggtcatatggataaaaaagattaaactgttcaattttgggttgtctgaaatctatataaaagaaaagctacaaacacaaaagcttattattccaaaaactctttaaatttattttctctttaagggaaaaatagataattgacttattcatcacaccatttctgcttttagatatttgtgaaatcctctctatgtttcttaatcgtctcatttaatcccggcgatagtaaatattgtaataaaagagatacacttccaatcatactttggaggaatgacatggtctcataattaagtcatgttgttggatgtttcgtgtttttcgtcctaatttatttgttatgtttcttgttgtgggctttagtttaaagagctatgttcatgtacttcagttctcattttggctataaaacatatacttcatgatcactaaaaatgcaaaaagggtgaacttatatcacatcacatcaaattcttgcatttaacaacgttaaggcgatggaatttgataaaactatgaaaatgttacttacatcaaactttaaaagcaaaaatatcatttatttttccaaagttaatcttaatattttgatggagataggattaaatctaaggtccttcagaatatttggcggattttaagagcaatagagaagaattctccactttttttttattattaatttctcgcagatgtaaaagcggataatttggcacgaaaactccgtatcgaaccacatcatatcacatttataaacaacatactccacaaatagctcgtttgagttgttgtttttttagtaaatcggttgacaaaaaaaaaaagaggattaaatctaaggtccttcatgtaatcaagatcctaatttcagaaagtttaactattttgagaccatatcgtttaaaacccaaaacattattccaacttgaattgatgatgagataagatatgtagaccctactcaactaaatatatcatttagtctctcgacagataattcctttcataaactgaaacctaactgaagaattaatacacaaatatttccctttttagtcatatccctaatcatataactacaaaaatttagagagtacacacatagcaaagtcaatccaacggtaaaagagagcagtattgatggagcggcaaacgaccaaacaacaaatcgtgctgaaaataataatgtctcaccagaatttttcagcattaattgaaacacacaacaaacctctccttattcaatgaaaccacatttcaaacactcatgttttcttataaagagaggcctctattcttttatacagctcatggaatcacactatcacaatcataaccacaaaaacaaacactatg

SEQ ID NO: 30409 - DNA, 3003 bp, Unknown; identical to SEQ ID NO: 30408
  misc_feature (1)..( 3003): 2750-1469P.txt file - cDNA_ID_3030991; gDNA_ID_2214639; Annot_ID_188266

SEQ ID NO: 30410 - DNA, 3000 bp, Unknown; identical to SEQ ID NO: 13609
  misc_feature (1)..( 3000): 2750-1469P.txt file - cDNA_ID_3030995; gDNA_ID_2214639; Annot_ID_188265

SEQ ID NO: 30411 - DNA, 3003 bp, Unknown; identical to SEQ ID NO: 25161
  misc_feature (1)..( 3003): 2750-1469P.txt file - cDNA_ID_3030999; gDNA_ID_2214639; Annot_ID_188264

SEQ ID NO: 30412 - DNA, 3003 bp, Unknown; identical to SEQ ID NO: 26455
  misc_feature (1)..( 3003): 2750-1469P.txt file - cDNA_ID_3031035; gDNA_ID_2214639; Annot_ID_188249

SEQ ID NO: 30413 - DNA, 3000 bp, Unknown
  misc_feature (1)..( 3000): 2750-1469P.txt file - cDNA_ID_3031039; gDNA_ID_2214639; Annot_ID_188248
ctctctcatcatgtacctaattgaaagtcaaatatattaagagtgaaacaaaaaaatactaaatttcaacttgcataatttgtcatctaattgaaagagacctcaacaagggcagccaagctaagcttcttgcaaatcttaagcaagaaggttatttctaggtcagccaatacagcagcaataagcagtactgcatctgcgcctttagtccgagcatagtagatctgccatggatctacaacaaactctttgcataatagtggacactgcaataatttgaaaaacatggattacacaaagtgttttgataataacgcaccaaaagcaccagaatttgttaagaaaataccttcacaccagcgctccttattgcttccaagttttcaaagcctccctgttgaacaacatcaagataagaactacaaatgttaaaaacttgttgaaaatgtgagtaagatatctgcaactgaatacacaagtgaacctggaaatacttctggtctgtcaaaacgctgaggcatgctgctccgcctttttcataagcttgagcaatctcgacctgtaagacgataagcattaacatcacagccagaggaatcatgaacaccttgcgggtttagataaaagaacaatagcaaatcatattggaaactgttcacaataaaaagaaaaatgttgatctatttcccaaggccaaagactacaatgctcaatgttccaatcttttatccattgaagaatcaacctttactcgcttaatcagagtccactaactcaattcgagaacacgatctaaagtcataaaggaaagaaacagaaaccagtataacataccgggtcaaaattctcttttaagattcctctacttggagaagccttcttaacctcagctatcaagccagggaagccagttcttttatgagccatcctaagagccccaacaaaatccctagtaggaggagcatcctctacagctttcttcagcacgtcaagcggatttagctccttcatctgaagaaccaaaagacaaccaccattaagaaaaactcacacaaagctctgaaaagaaaagtcttgtaaaaagaaagtctttacccgggaaacttctacgtctttgtaccatgtgatctcctccaagatattacgaggagaatcagcatcattgttatgcaatctcaactcaaatggtccagagtatcccaaaggagccttacttggtggttttctccttatcctaataccttgactaatagctaattcctcctgatacatctctacttcccattccttgattctaagaacatttcctttatcctctactgatgaagaagacacagctaagctttccttcaaatccgacttatccaaaacaaaaaggcaaacactttcagcaacagattgataacattataatcagaaacccccaattttgttccagatagggttttagactcaaggcaatcacaaagttcaatctaacaaccgtggacaacataaatcacacagaatcaaacgaaagactcgaactttaatggagggtgttcatagaatccaaaaaaggagaaaaatttggtcgcacctgttgagctcggatcgagaattgcgacggagccctaaagtttatcttcctgtccatggcaaaacctgaaattgaacgtctgattgagacagaattgttacaccgatacagagaaggtgaagccactttaattggaagtctctgtaccggaactagtccctccattgccggaaaaaaaaaagtttcgaacttttgaagaagaaagaaaattcaaatggtttttgtaatttatggtcaaacaaaagtttatatagaagttggattatgaatatttttggtagttggtgtgattaacacgtgggttaatagtaagacggcgatttttttttgcaatggttggtgaaaaatacagttgagcagagactggtctagtctttacctttgatttgtcacattttgattgtttttcgtttactacactactttggttaggaagtcttctatactttggttaggaagagttcaaattccttcaaaagttcattccttagttcattccttcaaaagttctcccttcaaaacttcttgtatagtaccttatgcacggttcatccacttaaatgcactccagttcctcgaagccaacctttttcttaaccttacttctaaactccatatataccaagttcctgacactcatctagggaacatgtaataattttgctcaatttcttttgttctataaatcttcaaagacattcgattacaaaagtattctaattttgctttctccaaacctaatttacgtagttaattcaaacttgaaaaaaacaaaaattaatggaacaattttacgagattgaaaaagctaagaaaacaattaataactaaatgtaattcggtgcatttagttatatttagctataattttataacaaataacatattttaaataacatatcttaaataatttgatatcaagaaaaatttagttatatttattaaaattatatataatttgttttttgcaaattttagacaaaatttagtaaggttaaactaatttttatttatgactatttttttttgttttttttttctttgaaaaccgaaggaaaatgatcaaaattcgtcacctttcctaaccaaaaacaaatagaataatcataaaatccgaaaattctccaacccgaattattctaattcaaataaatccaaatgtttatacctagatagtgatatgtcttttctgcacattctcatgtttcaaatcattagttaacatttagttcatatatataaataaccatacgttaagttgatgtataaaacatctttaaagttaagttatgaaatgacatatattgacaaaaaaaaataatgacatgtttcccgaaatcaaatggtcattttcaccatattatcactgtctaatgacgtcaggataatacttgaaaacgttgtagcaaagccgggagatg

SEQ ID NO: 30414 - DNA, 3003 bp, Unknown
  misc_feature (1)..( 3003): 2750-1469P.txt file - cDNA_ID_3031051; gDNA_ID_2214639; Annot_ID_136197
cggcgcttctatctcctttcttttcccttgacctcctccacgcgtcttaggcggcatgactgatttcgaatcggaaatagaacggaaatactggtgaaagcaagaagaacgctcgattgaatttaaagaaatagggaatgttgtggttaatttcagcggttactaaggagaagaagtcaaaaaatcgaaaacggttgtaatgagaacaagaaacaatttcgaattggaaaatccctggaaatattaaggttttttttatttgattttcaaataaagagtaaaagtggttcgggtggtttggttcggaaacgaaccatgatttttctggtaattaataggttcggataaggatatactagtaatatccatctatttcgaattaagaaaaaataaataaattatttctgttttttacaatgattttttggcttcctctttgcaaaaaggactgccagacgatttttcgattttggaagaccgtggagatcaaaacagtctcttttgtctactcagtcccctcttgatctggtacgtttacatctgcaatctcctcatctctttaacccattttcatctcttcccttagagtttcaatcatcgaacaaaattattctgatttggtcattgatttgcttaaagaatgatctttctagttcaaagccaagttttttcagtacccatctcgatatctctttgtcccttgttgcaaaaatgtcgaatctttcatatgtctcatgttgagtaaaagctgcatacaaagtgttcgtaaaaatgccgcaacgaaagttacttgacattccagatcagattattatttttacatatagtatgcctatagaattatttcttgaaaatttgggcatgtcaataaattcttgttgcatagcgcattagcagattctaagtatagcacagtaagtaagttgcaatttggtttgcatatcgatttagttttagtatggtcagcttcttattaggattatcaaggaacttaggacttgcggtctatgtggtgaagcttctgtgatgatctctgaagtgtttttgttgaggacattatgagagagagaggtatagtctccaccatgtccaggataggtgtgttcttgtaatagggcttctggtaaaagaaaaagagagacttttccacatgagcttaaatctgtcgcattttactttctgtgattgaactttatatgcaaaactgtccattaaaagttaatttctgcttgatgcttgtgttggagtagggcttatggttccagtttggctaaactgtgtttttctttatctttggcatagaaagaagatccctgtttctggttatgatgtctcgacagagtcagttatttacattgcttaggagaaggtttcattcaccgtctaatgatgccccaacggagaccttaagaaagaagatagccgatttgcaaaagagtaagaagcgaaggaacccaataaagaaccagtttctagttgaggttccagaatcaagatcatatttagacacagcaacgatgcctatgttcctcgctgttgtaggtatcgcattatttgcaaaggtgctaatgatggtaagccttcctctgtcatctctttgaatgcgtctttcttgtcagtgactttagcagctgttaagtagaagttgtttcgtaattgagctgttagattgctttatacttttttgtgcaattgaattaggaaggatctgtggaaattgctgattctcagtattggtttgttgttagatcgatgattcgaaatcgcaagaaatgattgaacgcaagataaagaatgcaccacaggggcaaggcacggtacgaatgatcgatcgtgaggagtgggatgagtttagagaagtaaggccaagaacaccttttgagtcaaagcttgctcgcccaaatgcacaaataagaactggagaacctgtgcgcaaggtaaaccgctctattaaatcaccaatccttgcagtatcttaccaaatcatatcgtcactcgatgaccaaaccttttgcttgtttcctttttaatcaggatgacttgaaaaactggacaatagacgtgctaacaaatgctcttgaacgaaccgaagaaagtgttcgccgtggttccagttagattttctttcctcaattcaattggagcttcctagttaatagacatatatatatcttgagaatttggtactcaagaacactctcggtcatctcctaagcgaacataggcatcatttaggacagttgagagaaggaacagaagctgtcttgtaacggagaaatctttgaaatggagatatgaatattcttactttgttttggaactgctttgtgtattcatatgtgtttgactcacacatttcatcaaaatgcttataaagggtttgattgataactcggactcggttatgggtgtaacgttttaatatttaaaatcgcaaaattggaaccgcttttttaaactgagtgaaatatagcgttttgaaaaaagacgtttctggtggcttctgaattgaaaaatcagcgtttttacttttcacaatattcaattggagaatctttagaacttcaacgaagtagcgtctccggaatttcaggtaaacgtggcaagaaaaagccaaacggagaagcatccacgtgtccctccattagccatctcccacgtgtccattaccgtaccgacgaaacattccttaaccaaaggcttcccgaaaaaggacagagtccacaagcttcggattgttcacaacttcaaagcatcgaaaaggtttaaactttacgtttttctctggaacccgattcgaagaaatcatcaagaagtttcctttcactgatttctcaatctattcgtaggtaacccaattccaaaaaacgtttcttttttctcgatgccttagcttctttggattctgttgtgatctaccgattttgaatttgcttgatcgatcatcggatcactgtgattagtgttattgttcctttcctttgtgtagctttcgcgcttatg

SEQ ID NO: 30415 - DNA, 3003 bp, Unknown
  misc_feature (1)..( 3003): 2750-1469P.txt file - cDNA_ID_3031051; gDNA_ID_2214639; Annot_ID_188243
ccgccatccgcaacctatcctttgatctagccggttccatctccattagcttggtttttacgtcttcacgtctaattaccccggttttgaagtacctgttggcgaagttcatattaccagcactctaataattagctggataggccttgcagttgaaaccagagatcaaagcatgctccctaataccatagcggatgggaactccattaacaacgaaccaaacctccttcttcttctcaatagatgtcgttcgaagaaaaagcatccacatcctcattaacttgtgggtatatccggaaggtaggtgatagatgtgcttgaaactcggatgctccataaaataattattttcaacattcgttagaggatgttccaagtcagcgaaggtcttcaacacctccgagatataacacctcgttgctaacttcatcttcttggtatactccgacgccgggaagtacataccaagtggctgcattgccatcgcttcctccatatcctgaaagaaacaaacattcattcatatatcactcaattgtaaatagtatgccacattattactctgtatttccaaaaagtattccccgaaattaccagtattacacaaatcgtactattcatatatcactcaattgtaaatagtactgccacattattactctgtatttccaaaaagtattccccgtaattaccagtattacacaaatcctactgttcatatttcactcaattgtaaatagtactgccacattattactctgtatttcctacaagtattccccgtaattaccagtataacacagatactcctattttactatatagtatttctcaaagttactagtactaactactgataaatcacaattgtagtattactctaaggtattacccacatccgccaatattacctaaatatcaacatagcatttcccaatgttactagtactgtccacagttcacaattgcattattacccaattagatcggtattacgaaatggaatacttaccacatttgcgatgtcctcgtctatggtcctctcctccacgggtttttccactatcacgtcctcgtctctctcgtcctcgtctccctcatcctccacggacttttccacattgacgtcctcgtcgctcgcggagctcctctcctcctcctcctcgataacggctaggccgtcatcttgtctctccgcctcttccacgggattagcacacgcgagttctttgtttgtctccgtctcctctgaatcggaatcggagcccaaggtttggctactactccctgattattcttcttcacttccttcttctttttcattttcatcttccacctcatcagtttgcatattctcttgagtttcttcagccggaatatgcttcagagcatcataaaacgtagaatcatcaagcatcgggctctccgtcgttggagccgtcgttggagccgttgtcgttagagccgctgtcgttggagccgcattggttgccatcgccgtcgcaatcgtttgtgccgtcgcagtcgtcttcgccggcgcctgaaccttcgctttcttcgccggcgcctgaaccttctctttcttcgccggcgcctgaaccttcgctttcttcgccggcaccttctccttcactttctccgccggcgccttaactttctctgtcttcgtcggcgccggcgcttctatctcctttcttttcccttgacctcctccacgcgtcttaggcggcatgactgatttcgaatcggaaatagaacggaaatactggtgaaagcaagaagaacgctcgattgaatttaaagaaatagggaatgttgtggttaatttcagcggttactaaggagaagaagtcaaaaaatcgaaaacggttgtaatgagaacaagaaacaatttcgaattggaaaatccctggaaatattaaggttttttttatttgattttcaaataaagagtaaaagtggttcgggtggtttggttcggaaacgaaccatgatttttctggtaattaataggttcggataaggatatactagtaatatccatctatttcgaattaagaaaaaataaataaattatttctgttttttacaatgattttttggcttcctctttgcaaaaaggactgccagacgatttttcgattttggaagaccgtggagatcaaaacagtctcttttgtctactcagtcccctcttgatctggtacgtttacatctgcaatctcctcatctctttaacccattttcatctcttcccttagagtttcaatcatcgaacaaaattattctgatttggtcattgatttgcttaaagaatgatctttctagttcaaagccaagttttttcagtacccatctcgatatctctttgtcccttgttgcaaaaatgtcgaatctttcatatgtctcatgttgagtaaaagctgcatacaaagtgttcgtaaaaatgccgcaacgaaagttacttgacattccagatcagattattatttttacatatagtatgcctatagaattatttcttgaaaatttgggcatgtcaataaattcttgttgcatagcgcattagcagattctaagtatagcacagtaagtaagttgcaatttggtttgcatatcgatttagttttagtatggtcagcttcttattaggattatcaaggaacttaggacttgcggtctatgtggtgaagcttctgtgatgatctctgaagtgtttttgttgaggacattatgagagagagaggtatagtctccaccatgtccaggataggtgtgttcttgtaatagggcttctggtaaaagaaaaagagagacttttccacatgagcttaaatctgtcgcattttactttctgtgattgaactttatatgcaaaactgtccattaaaagttaatttctgcttgatgcttgtgttggagtagggcttatggttccagtttggctaaactgtgtttttctttatctttggcatagaaagaagatccctgtttctggttatg

SEQ ID NO: 30416 - DNA, 3000 bp, Unknown; identical to SEQ ID NO: 13624
  misc_feature (1)..( 3000): 2750-1469P.txt file - cDNA_ID_3031082; gDNA_ID_2214640; Annot_ID_188300

SEQ ID NO: 30417 - DNA, 3003 bp, Unknown
  misc_feature (1)..( 3003): 2750-1469P.txt file - cDNA_ID_3031093; gDNA_ID_2214640; Annot_ID_136227
caacaaaactagaacaaaagtaagaaaattcttaaatcttgggagtggttagactacaagggttgttagcatcttgacgttttggcttcttggtctttctttttcatttaacactggttgttgttgggtatatatgaagtgtgtagtgtgatgtttttttaatttttttttgttttatacaatgtagtttaattttcttggccagaagactttgaccctatatagtcaacactcaacagcttacagttacagacaaaaaaagacgcgtttataattgaataaaataaaaaacaaaaggcttggccatgccactggttcctctctctttctttgacgcgcaattaaagctaatgtcagtctcaagcacaacccttatgacttggtctttgagtactaaaagattaaaaagttctcatgttctgagttctgacttacctatcttctccaagattgctcctagttacaataagtgagctatggagagaaaggggtaagatgattcaatttaatgtagtacaaacttcatgccattgatgacaccatgaggaacatagcttccgtattccgttgatgggttcaacttgtacattcacattccatagactcatcctatcccccgttgtaagacgattgtgcattgcgagccacactaggaaggagtacttgggagttgagtggaacaacttgtacattaatacgcattattaaaataaaactcgagttagaaaagtttagcgataacgatatggtttgtaatagcgtatcccctcctattaatgagatattctctcatatcaatcatcttaatgggagaggatacaatcagaatcaatttacatcaacatgattgatatgagagaatatctcattaataggagaggatatactattagttagcaaatgatcgtattcaaaataatgaacatttttagtttccacagtcatcgtactctctttgatgtgatagtggtgttcgtcctgttcaagtcatttaatcttgctatttgatcgttctcaagaatagcatgcaagcctaatgagtctgaaataacagagtgggcatcacattgtaagtattatattatacttttattacatattttatttagcaaaaaataaattttaataagagtagaattgaatggtggcatatttgtcttacaaaataaaaagacttgaaatggcccacttcaagaaattgggcgtggggatgtgtcttttaatcacaaatctataaagtacgatgaaattattttgttcaaccataaaacagctgattttggcactgaaacactcgattatatataggagtaccgtttggggttttgttgtgtgtgtgtgtgtgaaattgtacacattttccgcaaactgatcccacaaggccacaagagagatgattacacgaacatctctaaaattaataacacaagagcaaaccatccaatatacttcctccgtatttttatagttgatgtttagatttttttttttttttctaaattaaagaaacattgataatctatttagacacaaatcaaccaataataaaataattctatgatataaatagtcaaaaataattaatttagtattaaaattgaaatcatcatctaatttgaaacattttattttcttctaaaacatcaactataaagatacagtccatcagaattgttaggggtaaaaatttgagaagtcattttattttttttcacagatttctcataaattaatatactcatatgtaactaaaagaaaagacatgttaattaatttaagcaaatgtaacaaacttattcatgattacgaagttcaattgcaattttgttattgtctttatcatgtccggataatgtttcaatacgtccagcacttgattcctcatcctagcagtctagccaagaaaacttcaccgaccggactaatgcaaacaacccttgctccaagacacaactttacaaacaattaagactatctagttttagtgagaaactcccacattacctaaataatattacttctgcttaatttattggatattagatactattcaaccgtccgattagcgtctagcgaaattttaaacattagtattttctcaattctaattgataactttttttactcaatatatagaatacagtataagagtttttctttttgtaagtttgtgatggtattaaatgtagacatattatatacttccacaagtcatatataaaaatgtaaaatacagaatcttgtacgcaacacacgggagatagtatgagactcgagagagaaagagtcatcatcatcatcatcatctccttcaaaacaaaaattttatatacaaatttggctttaatggaacccacgttctcttctctgtctctctttctttacaatttccaagagaacattaaaataaaaacaacaacaacaacaacaaaagttttgttagtattactctttcactcgtttttaccctctcttagctgcattacattagctgtttctacttattctctctctctcttcatcttttgttgtttcacgtaaagtcaaacccatctctctctctgtctctgccattttctgaacatgaataatatcttctcatgctctgattcgtttctcattgcctaaacaagaagaacaatctattcttgttttagcttaaagtttttattgctacaaacaatggagttcaagagagacaatactgtcaggttctagatttttcatcttctttagaacattcatttttgggttctctcaatgatggaaaataaagttggctttttgcatttacgatcccaataaagttatgatcgttatacattgcattagtacattctttttggaatgattcgtttcttgatcttattttttaaacacaaactctatttttttttttggttggttgatgggtgtgacagattctatggagacgagaaacaaaccatagaagtaggagagaagcgagtaccattgttcaaatcaacaacggctccatttatg

SEQ ID NO: 30418 - DNA, 3003 bp, Unknown
  misc_feature (1)..( 3003): 2750-1469P.txt file - cDNA_ID_3031093; gDNA_ID_2214640; Annot_ID_188296
tgttattgcgtgcggaatatagttccaatccagtgtctaacatctgcataactatgtttacgtctccaagaagagcagcaagatgcaaaggtgtgtctccgtacgcgttacgggaagagagaagggaaggtcggagctcaataatcttggcgaccagttctcggtgaccgagctttgcagctacgtgcaaaaccgtgttgttggtgttctgttcctcgcttctctcctccagggaagattctctcgcttccaccaaaccaagaaaagctggaaggtcattttgaaggatggcatcgaagatcggatgcatctttttctcaacaaaactagaacaaaagtaagaaaattcttaaatcttgggagtggttagactacaagggttgttagcatcttgacgttttggcttcttggtctttctttttcatttaacactggttgttgttgggtatatatgaagtgtgtagtgtgatgtttttttaatttttttttgttttatacaatgtagtttaattttcttggccagaagactttgaccctatatagtcaacactcaacagcttacagttacagacaaaaaaagacgcgtttataattgaataaaataaaaaacaaaaggcttggccatgccactggttcctctctctttctttgacgcgcaattaaagctaatgtcagtctcaagcacaacccttatgacttggtctttgagtactaaaagattaaaaagttctcatgttctgagttctgacttacctatcttctccaagattgctcctagttacaataagtgagctatggagagaaaggggtaagatgattcaatttaatgtagtacaaacttcatgccattgatgacaccatgaggaacatagcttccgtattccgttgatgggttcaacttgtacattcacattccatagactcatcctatcccccgttgtaagacgattgtgcattgcgagccacactaggaaggagtacttgggagttgagtggaacaacttgtacattaatacgcattattaaaataaaactcgagttagaaaagtttagcgataacgatatggtttgtaatagcgtatcccctcctattaatgagatattctctcatatcaatcatcttaatgggagaggatacaatcagaatcaatttacatcaacatgattgatatgagagaatatctcattaataggagaggatatactattagttagcaaatgatcgtattcaaaataatgaacatttttagtttccacagtcatcgtactctctttgatgtgatagtggtgttcgtcctgttcaagtcatttaatcttgctatttgatcgttctcaagaatagcatgcaagcctaatgagtctgaaataacagagtgggcatcacattgtaagtattatattatacttttattacatattttatttagcaaaaaataaattttaataagagtagaattgaatggtggcatatttgtcttacaaaataaaaagacttgaaatggcccacttcaagaaattgggcgtggggatgtgtcttttaatcacaaatctataaagtacgatgaaattattttgttcaaccataaaacagctgattttggcactgaaacactcgattatatataggagtaccgtttggggttttgttgtgtgtgtgtgtgtgaaattgtacacattttccgcaaactgatcccacaaggccacaagagagatgattacacgaacatctctaaaattaataacacaagagcaaaccatccaatatacttcctccgtatttttatagttgatgtttagatttttttttttttttctaaattaaagaaacattgataatctatttagacacaaatcaaccaataataaaataattctatgatataaatagtcaaaaataattaatttagtattaaaattgaaatcatcatctaatttgaaacattttattttcttctaaaacatcaactataaagatacagtccatcagaattgttaggggtaaaaatttgagaagtcattttattttttttcacagatttctcataaattaatatactcatatgtaactaaaagaaaagacatgttaattaatttaagcaaatgtaacaaacttattcatgattacgaagttcaattgcaattttgttattgtctttatcatgtccggataatgtttcaatacgtccagcacttgattcctcatcctagcagtctagccaagaaaacttcaccgaccggactaatgcaaacaacccttgctccaagacacaactttacaaacaattaagactatctagttttagtgagaaactcccacattacctaaataatattacttctgcttaatttattggatattagatactattcaaccgtccgattagcgtctagcgaaattttaaacattagtattttctcaattctaattgataactttttttactcaatatatagaatacagtataagagtttttctttttgtaagtttgtgatggtattaaatgtagacatattatatacttccacaagtcatatataaaaatgtaaaatacagaatcttgtacgcaacacacgggagatagtatgagactcgagagagaaagagtcatcatcatcatcatcatctccttcaaaacaaaaattttatatacaaatttggctttaatggaacccacgttctcttctctgtctctctttctttacaatttccaagagaacattaaaataaaaacaacaacaacaacaacaaaagttttgttagtattactctttcactcgtttttaccctctcttagctgcattacattagctgtttctacttattctctctctctcttcatcttttgttgtttcacgtaaagtcaaacccatctctctctctgtctctgccattttctgaacatgaataatatcttctcatgctctgattcgtttctcattgcctaaacaagaagaacaatctattcttgttttagcttaaagtttttattgctacaaacaatg

SEQ ID NO: 30419 - DNA, 3000 bp, Unknown; identical to SEQ ID NO: 13626
  misc_feature (1)..( 3000): 2750-1469P.txt file - cDNA_ID_3031100; gDNA_ID_2214640; Annot_ID_188294

SEQ ID NO: 30420 - DNA, 3000 bp, Unknown; identical to SEQ ID NO: 13620
  misc_feature (1)..( 3000): 2750-1469P.txt file - cDNA_ID_3031107; gDNA_ID_2214640; Annot_ID_188291

SEQ ID NO: 30421 - DNA, 3003 bp, Unknown; identical to SEQ ID NO: 25165
  misc_feature (1)..( 3003): 2750-1469P.txt file - cDNA_ID_3031113; gDNA_ID_2214640; Annot_ID_188289

SEQ ID NO: 30422 - DNA, 3000 bp, Unknown
  misc_feature (1)..( 3000): 2750-1469P.txt file - cDNA_ID_3031148; gDNA_ID_2214641; Annot_ID_188334
agcgcgtgcattattcacagagagttggaggttggggaatatgtagctaggaaaatgtttatgctggattacaagaatggagggctgtatgtattgatgtcaaacctatatgcaacagaagcaatgtgggacgacgtagttagagtcaggaatatgatgaaagataatggatacgatggttatttgggagttagccaaatataataatttgaatctgtgaaacaacagaacaggttacttatacgttctgttaatacctcagtatttttacctgattgctttgcgatggtgaggagagttaactggagtgttcgaacataatatttgttgttcaagcttcattgatgaaggtttcttagaatccttgataaagccttgaagaatttattatagatcatcgaccatatctctatccggctgaaaacgagtatagaaactagttgtgattgatttttagatgacttcttgtgggagctgcaaatacatagaacatgcaggactacttagagctattcactggaattggtgaccaaggcgctccagttagtgtcctactgtccttgagcataatgtgagttttcttactgtcctcttgagttcttatcttcgaagcttgaattgtatgtattctaaaagacctcaagcattgacaaaagcaagtatatgttagccctttaaagatattagaatgatttttcatgttctagttttgttttcctggctagaaaaaacattgttgcaactggtgaagaactctctcagcatatgcagactcaaaaatgttgtatttgcatatctgttgggttcaacattcgaatttgatggctaggttagttacataggtcattctcagaatgttgcattcatatttagttttatggttgccatttatttgacatcagtctctctattgtgacactaatgggcttggagtttcttgagttgtcatgaattttctttatcagtcaataaggtagtagtaggtaatactgatattaagcacaatcttcatgactcagccgcttagtacatgcttttgagtgtttattctgaatccaaatgatctttctcaagttcaaacaatatttatgccgatttcctgacgtcatttgtttagatcattgtcttgatgtttttgttgtagttatcttaaaatgtgttcatgtaaatctttcgaattgccatttcaaaggggatggttatctgtattaattggctgatatctccttcgtctgagctctacatatgatgcaaatgatggatccacaactttaggtaagtcaactttgaaccaacaagttacattgtacatgagggtactaagcaaagatatataaatgatattgtgtctctttttctgtcttataattaggacccaagacctaactatgactcccactgcatctatcgacaccggtcaaaccatctctcttcatcttctcctctttagcctttcgacaaaacacaacccacgagttaacttccatggccacgcagacaccaaccagcgtcgacagacatagacagtaaccgagctttgcgtacgaccttccttcccttaaaacctcaaacccttggaacacattcaccacgcccatcaccacacacgcgtacccgacaaaatgatggtaagacttccagtacctccggaacttattggtcgtctttggtctgaacagcaaagccagtgtttgcagcgccgctgctgtgaaagtagctatcccgaggctccgatgtaacccataggtcactccaggggaattatggccgagcacgattccaatggagaagccaatggttcctaggaggaaaccggttagctgtattgctgcgtggatgtagaaccaagtgggtcctattgattgcatttggcggaggtatctagctgttactgctcccgccgggaggagaaaaccccacgatatcgcgttgactactccgtgagtcacttttaaagctcgggaaccgctgttttgattaacagttgcaaatcctatagaaagaaacagtgtaagatcaaaccttgctgaagtgagaaagaatttggtggtagtatgagagatcaaaggttgagaaagaatttggatacctgaagtgacatcaaaggtggagaaggaggagagatcggtggaagtagtaggatgaatggtgggagagtaaccttggacataaagacctctgttccaaacatggtggatcttagtattgttcgaggagagcttaacagaggcataaatctgaacggaagcaccattacggatagtggccattttaccaccgtagagagaagcagaggaggaagagagacggacaaggtcaagcggacgggaaagcagaggacctttctgaagcttgactgaagagtcaagaacgtaaggaaggaggatgagctgaccagaattcggatctggaaaggcgatgaggacacgagaaccagtcatctgcgccggggaatccgggttaatcccccatccaacccacccggaaggtgagatgaaagttccaaagaaacaaaggtcgagagtagcgttgtgtggatggtatgtccacgcgattgacgcttgttgtgttggaagagagatacatttctcgaagcttttcgtcgccgtcgtggtggtgcagtgaccagctagtgattcaggaagctttgttgctagaagaagaagcaagaatgatagaatcaaagtcgccattgtttgatcatctctgttttttttgttaatagagtcgagactttttatatgtgtagtgaaacttaagaaatatgattgtgattgtaaaagttgatattatgatttttcattgaagtctttgctttgaagctaagtgaaactcaaacactctccacaacacagttggttggttgtgtaatatttggacatctttttaattatgataaaatatgacgtggataaaatatgccagctcggataacagtaaacgacgtcgtttcttatttctgattgattctctgtagagaagaggaagagaagaagaatg

SEQ ID NO: 30423 - DNA, 3000 bp, Unknown; identical to SEQ ID NO: 13637
  misc_feature (1)..( 3000): 2750-1469P.txt file - cDNA_ID_3031152; gDNA_ID_2214641; Annot_ID_188333

SEQ ID NO: 30424 - DNA, 3003 bp, Unknown; identical to SEQ ID NO: 25168
  misc_feature (1)..( 3003): 2750-1469P.txt file - cDNA_ID_3031168; gDNA_ID_2214641; Annot_ID_188327

SEQ ID NO: 30425 - DNA, 3003 bp, Unknown; identical to SEQ ID NO: 25171
  misc_feature (1)..( 3003): 2750-1469P.txt file - cDNA_ID_3031196; gDNA_ID_2214641; Annot_ID_188316

SEQ ID NO: 30426 - DNA, 3000 bp, Unknown
  misc_feature (1)..( 3000): 2750-1469P.txt file - cDNA_ID_3031198; gDNA_ID_2214641; Annot_ID_188314
caacagtagcctccgtaaatgtaaccaacagacccacacacattacatttacaatgttcacgagaaaaacgagtaataggtaacaaaggatgtttgtgaattggtgatacctccactatttccatgatgattaaaatctctcttttgctctagtttttttttctctttttcgtttttcctctctcatttctcaaagctatacatacataaacaaaattaataccacctggccggccaacacaacgtgaagaccacgacacaacatgaaatcctcttaaagacaaatgacatcattaattaattaagatattgtatatgtaattaataccacaccacgtaaaactaaaatggttggatgtgctctaacagcaaccatgtgagagtctcgagacagctaaagtcaacgaaaggcgatgatactttcaaggttttattcattttaattagggttaggtacaagcacgacgaacgattccagaaacatatttattgagtggttgcgaattggtttcataaaattattgtcgacgaattaaaacttatataatacttccttttttctttaatgattgattttctagaaccaaaaaaattgtttcaatgattttttatatttcttatgcaaaattagttaaatatatattattattatgtctttattgcttctttttttaaaaatttattatcacaagattattaataaacacaaggtaaaaaatgtcattaatgtttttttatatgtatgtttttcaaaaaaaatcaatcattatgaaacaaagagtaataataatctcattacagagggaattggcctcatttcgtatatagtataattatcaaagaagtcatgaagtgaaacacattagttttgttagggatttttctctagaaagaatctacggggtatcgaatgagctattaatctatataatatatcaatggaggtgaatagtacgtaagaaactgagtcatcaacttttttaggtttccataatcccaacattatcatctacaaaattggtttatgatgaatgttgttaggaaaattactttaacagtaattgctcataacgaatgattagataactaaaattacatttatcaaaaaaaacaaaaaaaaaaaacaaaaaaaaactatggtatagcgtgggtgatcacctagtatatttaaaaatataataactaacacatgaaacagtgataaaaaaaagtttctaatcatgagtgatcataaaatacaattgtagcttttttggaaactgcttttttaatatcttccttctgacccgtattaaaaaatttcgatcgctcttccactttgtacttggttacataatttcatagaatataagtaagtatatatagtttataaatcctagaaggcacaaagaataattatccactattagtaattaaatattgtcaaatgaatttttcattattaatatttgtatatggtatttgtttaaatttagagaaataaaaattgaaattaaacatatatatataagaaacaacaaggaggaatatgtggcctagaaaatctctattttttttgtcctcactctcttataggaatacttatggactacattttctttactttcttctatttttggaaaataagttttttatatacaacaattagatgattgtgtcataagcattctaccaaaaacaaaggaaacaaaacaaaagaagaaacataaagtaaagcaaaaatgggtaaaagtgtaaatgtcactggtttcatcattcatatgatgattttcttgttgattttaacaggtaatatatatatacattgtgatatattaatctctttgaagtcttatatattcttactttttggatttatgactaatgtttaggcaactttaataaaaattcaatagctaatgtgaaaaaaaggaaccagaaaagtttcccttttcgtttggagtttctgtttgcatttatcataacgttattttatcaaacaaaaatgttctatttctcaaggatttatatttttgttttaaaaattgaaaacgtagtgtaattcatcatagtttaaaggattaaagtgcttcatgttttttttttaccattgtgtatcaatcccgacataaattttattgctcttgagatagctgagaaatggcatatatgttacgtgaaataaactttacactactaatcattttgtatgagatttaagtagtaatcctaaagttactgtacatcaagttagtagtcatgcaagtaatcatcatagctagagattattaatgtttttaagcatcatcacttttaaattgtggattaaccaaatttttgaggcaagagaatgtagatctaattgatcaaaaccaaatgattaataacttatgtataagagaatgatagatctaattgatttttttttgtataattagaattatttaaatgtatcttacatatcgatcactaatggattaggaatatatggacaaaagcataagaggagagtgcttcaagtaccgagccccttacacgcgtggatcttgtgacaattataaacacgtcaagtccgcagtatgcaaaaaagtttgccaacgtagaaaggattttgatggaagatgtgaactttttcaggacgaaagaggattgcaactaggttgcttatgtttttcttcggattgtaagtgacaattgcaaacttcaaatcctatgtgcaacaatattgtttattattaccaaccatcaataatatgtcattaggactttgtggtatacatatcatatgatatatccatcatatgctatcttcaaatcttatgtataagaatatttaattttttcgttattagtgtaacgcccgtgaaccggaaaatcggttaggatttgtttttaaatcatccggtttaattggttgggttaattggaaaccctagagtgtgcctataaaagaatgaaactcgaaattagggctttagttagccacttttcgttttataaaggagaaaaagagagaaaatg

SEQ ID NO: 30427 - DNA, 3003 bp, Unknown; identical to SEQ ID NO: 25169
  misc_feature (1)..( 3003): 2750-1469P.txt file - cDNA_ID_3031202; gDNA_ID_2214641; Annot_ID_188313

SEQ ID NO: 30428 - DNA, 3000 bp, Unknown; identical to SEQ ID NO: 26458
  misc_feature (1)..( 3000): 2750-1469P.txt file - cDNA_ID_3031210; gDNA_ID_2214641; Annot_ID_188310

SEQ ID NO: 30429 - DNA, 3003 bp, Unknown; identical to SEQ ID NO: 26463
  misc_feature (1)..( 3003): 2750-1469P.txt file - cDNA_ID_3031222; gDNA_ID_2214642; Annot_ID_188350

SEQ ID NO: 30430 - DNA, 3000 bp, Unknown
  misc_feature (1)..( 3000): 2750-1469P.txt file - cDNA_ID_3031250; gDNA_ID_2214642; Annot_ID_188372
gctattatattgctaatacatctttagctagcacatgaggttaaagacacaaacttaaagtcacatatttgaagatctgtacatacttcaagacatatattcaagtccaaaataagcattcttctaatggttggtccccataaactaccaaaacatttgttacatatcgctttctaattcgtcattgcaaaagtttttgtaccccaaaaattaatgcacaacggccaaacgaaaagaagttatctattggaaaaatatgtatgcaatatagtctataaatactgtccagtgtccacaaatattattatcaaagacctgtacagttcatatataaatatatatatatatatatatgaaaatattatatacctaacgttctataaagttttcggctatgaaaatattttcgtcgacggggtaaataatatgatttaaatgcccttttcgtacattttatatgtctatgaccacatattacttgcttcttttttttctttttcttaaaacacatattacttgctaaaatgcataatatgtgaatgtatatttgttaaatatcttaaaatccgcactgtgatcatgaattcatgataataaataaataaaaagatttcacgtggacttgtttccggaaccttcacgtcatcatcctaatgagagtcacgagtgtcacaagatctttaaaacttctattcttatcgattttggccgaatattactacaaaaatcaacattgaaacaagtagcaaccatattataattattctaccattgtcgttacacttggttaaaagacaaagaagaaaatcccaaagctaagataagaagttaaaaagcacaaacccaataatatattgacacgtcagtagtagtaaaatggatagttaacgtgtcaatacattattggtgacgtggcataattcgtagttaaaaaaggttacttcgagcggtggtagtggttacggtgtgacgcacgtgagccatgacggtggacgagtggagactcttggacgtctccacggcgtttggcagcggagaaaactccgtcccagatttcggagaaagcgcggatgatgatgccgtggtggtatggctcgttaagggagaggaagcagtggagaagctctctgagatcgtttttggagtaaatctcgttctcgagaatcatctgaagcatggactgtcggaaatctaggtaaggatcgtctgagtctttctcgacggcgacagcggcggcggagggtgttgccgaggaggaagaggtgtcagagaaccagtgggaggtggagggaacggcggaggaagaggaggccgtggtgggggtggaggagtggcagtggccgtaattagaggagtagaggcggggctttttgggggaagggttgaaaaaagaagacaagcttgggaacttacagttgccacagccgatgtctacgacagagactgccttaaggaccatcttcttcttcttgcttttgcctgtcgtcattgctttgctctttctttgtctctctgtctcttactccaagatgaaatagattttagagagagagtgtgtgagggagagtgagtctacttggattggtattaaagggtgcatgtggtgactgaggtggattaatgagaagtaaactcttagcaacaatatttaatttgatgttcaatgacagtttataatttcttttaaatttttgtgagcttttaaaaatatgttagtaaatgtctacattcatgagcattaatgtgacatatacttactccactgatctatgaaaattatgagatgtgaatataggattattatttaagttgactataatgaactataatggtatttcatatataattaagccttcccattacgatttaggttctagttggacgatctatatttttctttttgtcaaatctaaccttttttttcttcaaaaagtcagatgatctttagtatgtcatttgcattcaatagttatactatacggtcgttaattcatttcatacacaattattttaaactacgttttaaattttaattcgaatatattatttttttaggatttacacatggtgttaacaaatattacaagagaagttgtagaagtactcaataagagtttgttttacatggatttgtgttgggccttcatgagctttgtacagcgcctttacaacactcaaataaattgtcactcaagggatataaacccaaaggccgtagctcctccaacacaaatccagaccactctttgtttccagtattactattattcctctaagtacattagaaaggtgtataaactttgttttacaacatataatagaaaaataaacattactgttaaacaatacaaaactttacagaaaacgtacagtatgtttaattattgatagattaatatttagaggccgatgaaaggtggaagtttttttatgggaacctggtagacatagaatgttgtaataatattgtccatcaatctgattttcgatttgagattacctagtgtaaaatataagtaacataagtaacaactcacttatgatcactgcactattaagtacttcttcctcaattccttattactccaaattctacaaaaaaaagtttgttgcaaaaagatacaaattttaatttttctatacaaattttaagtgtggaaattgttaatcacaaaaaataatacatttaggatcaatttttttcatgtgtgaaaaacttagaatttggattaataaggaacggaattattttgagtttatgtttgtttggaaaaaaaaaagactaggtttgcttcaaattatccattgaataaaggatgtttagatgagattttaatggatttcaaaagatattctagtagtttatagaatttcgtatttagtattttttttgaaggacagcagaagaatatatatttattagtgtaaaatcagtcaaacttaattaatttgattcttcaaggactttttttgtaaattcatatgaagcgtcgaacaatg

SEQ ID NO: 30431 - DNA, 3003 bp, Unknown
  misc_feature (1)..( 3003): 2750-1469P.txt file - cDNA_ID_3031258; gDNA_ID_2214642; Annot_ID_188370
tctctttatttccacatttagtccttatttaaataactaactaattaaaattagtgcactattatgttagcagatttcggtttactagtatttagtattatatgctaagtcttttctatgttttttgcaatgcatttcaccattagctaaaaaagggctatacaaggtttttgtgtgatatgtatagaagtaggaactatatatacagctcatatatacataaaacgtatgtccatagtaataacgagcatatatgtataattaagtatcatatcatatcatatctattaaggttgaaatttagtaatttactttctcaatgtaacagaagcccaccatgcttaatgttgtgataaataatatgaataaatcaatgaactcctctaattaacaatttaacatgtatataataaaagtctatagaataaattgtacttgttatttagcagaaataaaaataaactgtacttgtttggtcactagtaacacacataaatgtgaaaggtggagagaaacatcgatttggtgtatggaggaggaagcgtggggctaatgggtctcatttctcaagctgttcatgatggtggtcgtcatgttcttgggtatctatctatctctatacattttttattattaaaaattattaaacaataaacaaactagaggtgttaatttatctatacattcaaagcgacaatgcatcattctttttttgttcttcccatgttcttgtcctgtctttcaaatgagtaacattatcataaatagcaattggactgcttcaaaatatatacttgtaaatgaataagataaaatacttttatcaaatatttcttggaaaatcaatatttgaaacaatgctctggactcgcttttcaatttgttagtttctttgccaaaatctaaggcctaaggggaacaaggcagctgtctttagttctacttaaacatagactttagtttcgaaagaaaggataagaatctttgaccattacaaattaagatgactcgaaattattgattccatatactatttataagtgataattatttacattagatgttgatattatgcgcaggatcattccgaagtctctagcaccaagagaggtatttacaaatctaccatacattctaactagcagtgtgaagagcttaacaaatgtatagtttattctgtatcgtccaaatatatattcagtaaaatatatgtgaattgaaacattttaattatgatgaatgtggggtttagataaccggtgaatcaataggagaagttataacagtatcgactatgcaccaaaggaaggctgaaatgggtcgccaagcggatgccttcatcgcacttcctggtttgtttgtttttattattctttttcaatctatgtattttgtaaagaataaaaaagatgtctatatatgatcatgaaggttaataaaattaatttgtttggtgttattggacaaacaaaataggtggatatgggacatttgaagagttgttggaagtcatcacctggtctcagcttgggattcacactaaaccggtaattaattaaattcgttggtgaaccccaaaaaaaaaaatatcgtttagatatgacttatgagtacacatacgttgagactcgagtcagtaaaaatacggttatctcggcaaaccattaaaaaaaataaaaaatagagatgttgtcatatactatgtattttatggagaaatagagattttcctgatgaacttacacaaataagaagaagcaaatttctttgttggctatatatgtgggcatgtggcatgggttgaagtctatattcacatggaataatgtcttaactcttacctcttgacaacaacaacaacaaaaaaatgtcttaactcttacctaagattttgtcccaaaaaaaaacactcctacctaagatcaaaaaaataaagagaatcatagttaaggttgtgaaaactactctaaaatcatatcgtacactaattaatgcatataaaaaagattagattaaaacatgtaatatacacacacgaagactttgtatacataatacatggtcaaaaaaatgcgaaacctgagaatatgaattaagtatataacataatgcgaagttaaaaaatgcaggtgggactattgaacgtggatggattctacgattcactattgacgtttatagataaggcagtggacgaaggcttcgtctcctccaccgctcgccgtatcattgtctcggctccaaacgctcctcaattacttcaacttcttgaggtttttttatttgcctttcattactttttgattattctatttaatactatagactaaatgaacgaatcccaaaataggataattaaattaatttgtaatcgcaggagtatgttccaaaacacgacgattttgtatccaaaatggtgtgggacaataccacggatgctttcactttggaaggcgactcgttttagatatagttcatttgtatcttagtctacttttattttattattaaaaatctcgttttttattggccatttcaaatttttgatttttgtataccatgtattgagcttatataacaatggaacttgccaaaatcaaattacttacaagccacatgattacataatggataaaaaaataacacaaaaccaagtccgtaaagtatcgacaactaattataagctaagaaaaaaccaatcattttccaagcattgagacttccattcttaaaataagaatatgaggcccaatgggcttggcaagaaagttaaacaaaaaaaagaagaagacaattttacaattttgtcaagttttcaattgaaataaaccggttaaatcccaatttaaaccggatcaatcaagatatggtaatccccttctccttctccaaaaatcacaactctgttccaagtcttatcctttcatcatcatcatcacttaccttcttcacagagagagagcttcatcatcatatgtaatgtgagatgtctcttgaacaatg

SEQ ID NO: 30432 - DNA, 3000 bp, Unknown; identical to SEQ ID NO: 13650
  misc_feature (1)..( 3000): 2750-1469P.txt file - cDNA_ID_3031275; gDNA_ID_2214642; Annot_ID_188361

SEQ ID NO: 30433 - DNA, 3003 bp, Unknown
  misc_feature (1)..( 3003): 2750-1469P.txt file - cDNA_ID_3031279; gDNA_ID_2214642; Annot_ID_188360
gagacaaaaacaatcgttttcaagtgttttttttcttcttgatttatatctcttaatcaacgttttatatcttttcttaaggtcctcataaaagtctttttctcatatcatcatatgtattggctaacggtttacccaataagacaaatacgctgttaaatatctggttttgtttaacaaaaaaaaaattgctaataaataaaccatatgattgagaaagattgtcagactgactatcaaaaacgcctaattgattcgatcccattatcttaagttccaacttgtcctcaaactcttttttttttctttgacgtctcaatatttaaaatgatctctcaaagttcaatacaagccaagaaacatatttgccaatattcaaaacgactttaattactctttcttggtacgtatgtatagataaactcgttcacattgcttaaagaaaaactaatccaacaaaattgtgaaaaattcatccttaacctcctttctcttacaaatcttcggcttcgaagagtgtatatacagtgatcagttagtgaccaaaaataacaaatttacaaggaattaaaagaagaattaataacgagtttaagccggagattagtcaagatttcgatttcttcggttataaaataaacaaatcactaggacattcttgtggcggccacggaggaggctaaagggacaacctcggcgaggggagtagacagaggagttggaagcggcgaagtccgacacacaggacacgtaggattgagtctaagccacgtgtcgatacatttaaggtggaagagatggttgcaatctggtagctgccgcagcagatgttttcccttgtagtctcctaaacaaatggcacaacacgacgccgttgttggtccctttgcttccgagtagagaatctttggatagctttgaatggtgtcctcgtcaagaccggggacaacgtcgatgatgacatggtggtgatggtgatggatacgtgttgaatcttggttggtttgtgaaggtgaagaagagagctggttacgtgtgcaatagtatgaggtgagggtgatggtggtgatgaggaggaggaccccgatggagacaccgattccgtatcgaaatcctcctatgtcgtccgtgccgaggaggccgttgtagtccggcatctcggacggtggcggtggttggaaattgttcatggcgggtttggtttgatggttttgtttaatgggtttgggaggaggaagaggagaaataatggagaggtttttggtcagcgatttgatataagacaatgtaaattgaagcatcttggggttatcaaaagtcaacgctaagagagagagagagacaaagggaggaaatgcatgtgaatgaggataagaaagcttgtcaaagcaaagcaagaattgtgtgacttgtggatggttaaaaaaatattcaatgtataaattttctaatattgtattggtaatactgtaatagtataacgcatatataaatatattgacccattaattcgttgtttatttcaaacataaaacacttagttgcacaattgaattggatacagggctaatgaatttaacgtgtgacatgtattaagatttgatttaggaatgtagggaggggccagtggctaagattagagaaggtttacgctgaattagtttgaagtcaacgttgtacttatatactaatcttgttgtttatgtacgtttagttatctcctttattcaggcttatttaagtccaatcatgtcacctaagcaacgtttagtttccttcacttgcttttaaagtcgcagtgttatcttattttagtattagaatatttaaaactttgaaatctctccatattagaagattaatataaagttttgtttttctcctaaaagtggcaagacaataaaataaaatataattgtaggtaaataatttgtatatactaggaaatccaaatttaaccaattgagtcgtgggcattaacatttgtattacataaaattatattttggcaaactaccataggataaaaatcattcacttaacggccaagttactaacacaaggcatctttgataatggaaaacaatctgttggacagttgttattaatgaagaaaatgcgtcattgcatgctcgcatgatgtatattttaatatacactagctatgatagtatataaacagatatacatgtaattaagaatggagataaatgaacgtatattatccaggggcggattcatttggtgaagaatgaatgtattcagtgaattttaattgatattcgaatacaccattgttattgaacacttaattattgccgccgctcttccaatttttcaattctttttttccccaatcagtagagtaactatgggcttttaaaacccatagctccggattcccaatcatatattctatagtctatgtcatctaaaacaatatgaatttagataaacaatttatgaccttcaagccatatatttgggccggatactcaaaacatatgaaattacactcaaacactaattgagctacttaggccaaatatataaaggaaacacttactactaggcataaaaagtttggaagaaataataagagagaaaaaaatgttataatcctgacattgtttttttattgttaactcactcttggaataagttgtccaagtctcatagttgactcagtttggtggtgtcacaaattagttccatcattactaatttgctatcagtttggtgatgtatcaaatactgttgatctagtaatttcacaaaaagcgcatatcttccggctaatgatattagatttactcatatgtgtaatgtgtatgtatggttgaaagttgaagctaaattaggtttaagtcactcatatcatatgtgtgtgttatcttgtatagtgtaatacaaaattcaatacaaaattttccaataagcaaaaatagtcgtcagtgcgagttcaactttaaactgtttcaaactttatattcattacgaatg

SEQ ID NO: 30434 - DNA, 3003 bp, Unknown
  misc_feature (1)..( 3003): 2750-1469P.txt file - cDNA_ID_3031294; gDNA_ID_2214642; Annot_ID_188354
tcgaacctcctactaaggaaagaaagaaaaagaaaaagaaagtgagctttgcagaagatatggtggagccgtcagggaacaacgaagagtatcgccggagttttcgcaaatcatcaaagttggaggatgaaagatgaagtcaacattcaacacatgaatttttctgtgtatttgttttccttatttggtaaatattaagtgtacaccgctcttcacaaaattaggagctagaccggaccacataccccattccatgtctttttttttttattatgccaagttgtcaatggacgtagatgtagatgtgttgttgatgttctcattcgtatctcgagtagcgtataattagtaccagccaaaattggtacactagcgtattaattagaaccagccaaaagaaagattcaagatgacgtagtacttgggcttttggtataaagcccaggcagatttggagtttacatttttggggagaacatatatttagcttcttttttgtttttttctccaacaacatgcattggttaaaatatggattatgacttacaacgatagtaatacaaatcctggtcgattaacaatctaatagtcgatcaatcatcactgctagaaacagtgccgcctaacagtacccctgaaaccataaatgggtttctagttaggtaaacaatataaattagtaactacaacataccaatgtaaggacgtgaatttatatttgtcctatcaatctttaattttataagaatgaattagtatgaatcaatggtaaattaattgcagggatactttgattaataatgtcatattacaagatcttcataatatctcgaatggccatgcatctcgcatctaccctaaaagtttatatacaatgcatgctttttctcaattattgtcaaatttatattctttctctaatagaaaaaaaccttttaaatcaccaattgacttttcttttcgaaataatggaatcatatatattgacacctaataaattaaaatgattaagaaaaacttaatagtgaagaattccgtttctgttacgagtgaggaggagctctatggccaaatttaatatcaagaaattgaaaatattaaaatgaataccaataaatgtttttcttctctatataatgttggtgggactgactgggaacggagcttcgaatcaaagaagaaagccaactaccaaagacagtgtcggttcgacggcgatggcaaatctaacggcaggagaaacgtcgccgtttcagatcatttattaacgtcgaaaacgagttttattaaaaaaattattttatttgatccaaaacgagatttatttttatattatcaaatcatacgttacgactttttacgcgctttttcaccacacgtaccattagcaaatcatacgttatgacttttgcgtaaaaggtaaaaacttgttttacatctgtctcacaaaacttgtaacttgtatattcattttattgatcaagtagatgtagatccccatcacaagatgtgtgttttattcattatgacgacatatttatgtgtgatatataggataaaaagataaaattagatttatgttggatgtatttgtcttaagtcttttaaacaaagattcttgaaaaatgacacaatgttagatcaaaagttttaatcgatacatttagactaaagacatcttaccttccttcactggttttcttacaatgatttcaatatgtagtaaaataaaatgtgttgtttattgctatatgagactcatgggtctagaaagtataaactataagtcatttggataggggtttctctataatttcacccacgaaaatggattacaatgtaacttcatttcataaacacttttaacaatgctataacattcgactatgtttatcaccgaagattcacttattaggctttcttctagtacatccagagaaaacttcgcatgtgttcgactggagcaatttaaaaatgaatgattttaagctaagtaaatgatttttagtatcttgagaatatggacaaacaaacaaaaagtttgtaaagaatgacaaagaggaaacccatgaaaaaaagatacaatatatggaagctcacagacgatgacggcatgagagttattatgacatacaaaccaatcgataaatctttaacaatttactgaaatatttgactaataatcttttggttttggaataatgaaccgatcgaccgtcatataaaatataaatgattggatccacgtacgttggtggccgagcctctgaaaacgaatttgatttatctattttgctaactaatcacctaacgtagtttttgtgtctcaatggttgtacaaaagataaagtctcaagaatttattaacaaaagaagtggccacgaagaatggaattttgttgtatcaatgaagcataagtagtaccatagtattttaaaattcgaaatgcaaatcaaatttcaacgtgacaacatatgttgtataatagttaatcatagtaaatagcacacattgcagctaataattggatttacaattgtttgagtcgtacgttttgatctgttgtttacaagaaaaaatacaaagatggaaagttctaacttcaagtgaagttcagatatcgaccgagtcagaacacgacacgaggctcgaagacagaggcatagtgctgagttgttcaacagaagcaagtaaaaaccttttgtctgagagagaggctccgagttaggcataagccaaacaacttgacacgacacataacctttgcttctcgtgtagacccaactttttacccttaccaaaaatataaaataaaatatgcaaaaaacacacccactcaaaaattaaaattttaatgaaagaaagaagaaacttcacatcagcatcagaatctctctttctctctctctccttcttcacaagcaaaaaaacaccaaaccatttttctttcttcattgtgccgacacttctttcccctctctctctctctctccaccgccatg

SEQ ID NO: 30435 - DNA, 3003 bp, Unknown; identical to SEQ ID NO: 25173
  misc_feature (1)..( 3003): 2750-1469P.txt file - cDNA_ID_3031298; gDNA_ID_2214642; Annot_ID_188352

SEQ ID NO: 30436 - DNA, 3003 bp, Unknown; identical to SEQ ID NO: 25172
  misc_feature (1)..( 3003): 2750-1469P.txt file - cDNA_ID_3031302; gDNA_ID_2214642; Annot_ID_188349

SEQ ID NO: 30437 - DNA, 3003 bp, Unknown; identical to SEQ ID NO: 26464
  misc_feature (1)..( 3003): 2750-1469P.txt file - cDNA_ID_3031306; gDNA_ID_2214642; Annot_ID_188347

SEQ ID NO: 30438 - DNA, 3000 bp, Unknown; identical to SEQ ID NO: 13671
  misc_feature (1)..( 3000): 2750-1469P.txt file - cDNA_ID_3031333; gDNA_ID_2214643; Annot_ID_188415

SEQ ID NO: 30439 - DNA, 3003 bp, Unknown; identical to SEQ ID NO: 25183
  misc_feature (1)..( 3003): 2750-1469P.txt file - cDNA_ID_3031349; gDNA_ID_2214643; Annot_ID_188407

SEQ ID NO: 30440 - DNA, 3003 bp, Unknown; identical to SEQ ID NO: 26465
  misc_feature (1)..( 3003): 2750-1469P.txt file - cDNA_ID_3031367; gDNA_ID_2214643; Annot_ID_188402

SEQ ID NO: 30441 - DNA, 3003 bp, Unknown
  misc_feature (1)..( 3003): 2750-1469P.txt file - cDNA_ID_3031374; gDNA_ID_2214643; Annot_ID_188399
gtaataatttcggcaacatcactatcaccacacaaatccttacgattttgacctacttttctagatgggaagtaagaaaacttactcatattttctgtataaccaacactcaaaatcatacttgtcaacattgctaaactcggatcttcaaaatcaagctgtaagagcatcttcattagaagtatctcaatgagatacccaacaaaaaaaaaaaaattttaaaaaaaagtatgagagaagggagaaaaagtaggagagaaggagagttgagtttctcggaggagaaactttgagaaactattctcatccaatttggacaggtgtcatcatactattagttcaactattaaataataattaatatatttgttttgattaaattattaatatatttttttttgagaaactttctttatttttactgatggagatggtctaaacatcttgtctcaccgccatggtatgaaccatctgctgcccaatctcctccgacatgcaatcgaaagaaaagcgtcctaacaaatacaattatcaaaaactctctaaaaatctgataaatttatgcgtctgaaaacaatttaaaaaattgagagaacaatcttataatagttaccttaaaaagctgagagaaattttcctttaataatcttttcctattcgtttaaattttattttttcagacttttggaaattttatgttctgttgtttaatataataataaaatttacatataaaatgctaataataaattttttgcctttttgttttttgaaattttattttattgaaaactattattttgtatattctaataattatattatacatttttactatttccatatcttgttgaattgaagagatcacttaagactttcatcaccttctaattattattataactatttgtataataataattactatattgagtttataataattgacacgtcataatgtactggatcacgtgcatcgcatgttttagacgagagtatcatatggcaactcgtaagaagaaaagctgaaaccagatcttccttcgttaactgttttcagctccagcttctgaaacaaaatatcatcagggttttatctcaaacaacaacagattatatagtttgtagatacgaggaagatcttggactaacctgctgtttggatcataatagaaaccgcgcgctgatggatccgtcgctgcaggagaagcatacgtagtaaaatctagctattgttagtccacaatctgtgccaacatttacaaagtattgctctttccatctcttgcaccaccacaaaaattatccggagtgaattatataggatatgtaagagtaaaggatcatcgatattgatacgaaagcgagagttataccataaatatataagggtaaatgttatgacctgacactcacagaatcaagaatcgtttcccgtattagaaattcaaagggaaacaacatgaagaaaaataagtaagagtttaaggtcttacaggagtgtctgccatgggaacgtttagagcttccatggtgccacaaagacagccatgttcaaggtcaattccctgtatctggacattaactctccaagcttcctccttgtgttaattagagacattttgcgtaccagaaaatgcatgcagcataaaaacatgtgtgttcctcatctttaggttcaatatgaacaaacaatctcttggagccaatgaatgttatacaatcccaactagatataaatgcacttgaattaagcatagatgtcaacatgaaaaagatatcaagccaatcaaagcagacaaggccaacttctactattagctattcttgtgatttcaagtattcataagtcagaacttgtcaagtctgagagaaatttcaccttttacatataaaaatccctaagacaatgtctttatagatatactcagattctgcttacacataaggttatgttcataaaaagagtgtgcatacataaccacagatgcacaagcataactaataaagttctctctagtcctaaccaatattcccaagacctctatggtcagacacttataaaattcaatttgttaaaccaaataaacagaatcgaaaaccacatctcatcatacccggttcggttttcttaaccgaatcaaattatatataaaacggattaggcttctccggttttctactgcgttttgtataaaaccctcacaaaaaccctttctccaaatccttcaacctctattatcgaacttgctatataacctttggacctgactttcctacttctctctaactccaggtttgtcttcctctcaagttgaagctgcggctttattagtttcctgttgacttatgttccttgaatccattcacatgagcttcttacgccgttttcattggtttacctattgacgttgacttgggtctaccatactttttcatgttacttgattgcatatttataaaacggtgctcctttttgtatagcattctagatgttgcttctgaaacaaagctcatctgctgttcttgtcgttgggaatacaaaaactccagtccttcacacttgtcgctccacctacagagttggaaccagaacgcactcgttcaagagtttgactatggcaaatttgcacaagcacttcttcgtctgggaaactgaatacggcttcatctgtgccttgtagctctcacgaggcttctcctatcaggtacctatgccccctgtattgagtataatggtgtcaaccattcttcttaagtattttctcgattcttgttattttcttggctattgtcagtttcatggacatgagaagttgcatagctgttgtagttaagattgcatcacaccaatataataaagaaactagctgtgtgcttccctgctcgtttctctgttactagacacgaagatttgaaaatagtaagactggttaaggtatttctaatgttcattttctttcctctttgcaagtgagaataacgagaataaacatgtccatg

SEQ ID NO: 30442 - DNA, 3000 bp, Unknown; identical to SEQ ID NO: 13666
  misc_feature (1)..( 3000): 2750-1469P.txt file - cDNA_ID_3031386; gDNA_ID_2214643; Annot_ID_188396

SEQ ID NO: 30443 - DNA, 2584 bp, Unknown; identical to SEQ ID NO: 13693
  misc_feature (1)..( 2584): 2750-1469P.txt file - cDNA_ID_3031419; gDNA_ID_2214644; Annot_ID_188465

SEQ ID NO: 30444 - DNA, 3000 bp, Unknown
  misc_feature (1)..( 3000): 2750-1469P.txt file - cDNA_ID_3031423; gDNA_ID_2214644; Annot_ID_188463
agtgttaaactaaaaaatcttacactcaagttagataagagcaacagaagaatatcgatataaacgatgaatataattttctcacgtaaaaataccaaaaaaaaaaaaaagtctcacgtattttaagaaggtaaacatgaaaactattttacaaaagagtcttaccaattttgtcttatttcagataaattaagaagaaaaaaaaagcaaaccgctcacataaccaaaaaaatggtaaaaaaaaataaagatcataagtgaattttaaacaacaagaagatccacacggagagacacaagcttgtcttcaggagtgttaatcagaatcaattgttttgaccaggtcgtcctgagctataaggtggtggtcttggtctccttcttaacactgctgttatcctcgccataaatcctgtttcttcaacctatataatgaaacataaatacgatgtttaatttattgcaaatttcatgacttctaacattaagtccaatataagtagtataacctttttagtttaagtgtgtttgaccaacaaaagaagaaagatcaaattttcaattagggtttaactaattcctagcttcctaaattaacttcttttttctccacgtttaattcctaaactatgtacttctgatgcatctttgattatataattattataagaacagattgtagtacatagagattagagagcttacagtttcagttcctgaatcttcttcttctactaaggatggtgatgatgatgatgaagatggtggtattgatgatgactcaagaccaagacacttcaatatggcttgaacaaatttgttacaaacagaacatggagagttgagaagagagtagtagtaatcttctttttcttcatcttctcttctacttcttctctcttcttctccattaacttccatgttttttgttttctttctcttcttaattcttcttcttcttcttcttctgctcaatgcattaagtgttgtgtctagtttgacctcacctgcttctctgcgttcttacacacacaccctaccttgcattaaatacccttttataaagaaaattaaaaaacaaaatgtattcaaatttttttaactaagactaaaacaactagggtgccaaatcaattaattaattaaatctcgtgaacaatcaaaataggtagataaaaatattgatgccgttcattgtaatctgaaccatttgcagatgaaacaaaaagaaaagaaaaaaaaaactataacaaaataacttcttttataaacagttaatttaattatatatttgggtgaaaaaatttaaagatcaaacgaaattttgtttcctattttaattcataaatgaaactgcggtatataggcggtgcagtctaaagatattgctgaatatatttaactagattaaattcatagttgggttgatctgaatgagatgtgttggcgaacgcatatagtttttgtttcttgctgttcataactttgcttatggaattttatttatgtctttctctatacctctttggaccagtgttccatttgcaatagagagtcactcgtgaaaaaaacaaataatgtgtgtgtatcaattattccctctcggccttatattttgtcttctttttgctaattatatactattgatttagatatttacttatattcatgacgtcttcttcttatattcttatttaatttgaagttagaaaattaacgttacaacttacaactattaaattattgttaattggttttataataagtatcgctcttgtctccattcacttgtcttttattgtccccagtaccaaactaccaaatacaattcatattcactaattaattagtttgatgcaaaggatgatgcaatgttaagaaaattgaaactctaccacattctaaaatgaagcaactctaccatatttaatttctttagacttggaatagtcacaatatgaatgcttaggtagttacggttagttaggagtatcacacagaattgaaaataccaaaccacaattttaatcaggtgattcggtactaatttttattaatgaataaaaacataaccgaaccaactcaaagcagatattaacctgaaaatgaactcaccaaaacaataatagaaagactcaaatcgagccggaaaccagattgagcaacgaactcatgggaatatcatatctatttatgtccagactattaatatacatacctatgacaaaatactatgcatgcaatgcaagactgaagtaaccatatttttttgggtaaaccattgataagctaaacttgaatatccatagtacttcatcgtactatgtatcaatagtatagtaagtttgacacaattacattcagtttgatttttatcatataaacctcccaacaatatttaaaaccgtatctatatataaatttatttgattaaatcagcctagaagtttatagttcagtgcagataaattcaaattttgatatatatcttaattgaattaaccgtcttttggttaaattattgttacaagcttacaaaatccactatacaccaagttggacttagatatcatatatgagattaacagccgattacacttgtacattgacctgacctatacaaacgactacaactttatgtatatatatttctctatttttggaaactcgtttgatttgttttcacatgtcgtgaaatttacagctttgtttcctactctcaaaaatagagcatagagctggctgatcacacttcaaattaaaaccaacaacgtatataaactataacccatgtgaacacaaaaatttagaccttttttcaaaaccattccaatttctaacaaaaacaaaattagaaatcctaaaatctgcaaggtgtatggaaggcaaaaaaggctaacaggattaaaaacagtttacattagttattctctttaaaatagaaagaagattttcgataaaaacgtcgtcgtatcttcgtcgacgtctccgtctttaatg

SEQ ID NO: 30445 - DNA, 3003 bp, Unknown; identical to SEQ ID NO: 21325
  misc_feature (1)..( 3003): 2750-1469P.txt file - cDNA_ID_3031427; gDNA_ID_2214644; Annot_ID_188461

SEQ ID NO: 30446 - DNA, 3003 bp, Unknown; identical to SEQ ID NO: 26468
  misc_feature (1)..( 3003): 2750-1469P.txt file - cDNA_ID_3031429; gDNA_ID_2214644; Annot_ID_188459

SEQ ID NO: 30447 - DNA, 3003 bp, Unknown; identical to SEQ ID NO: 26470
  misc_feature (1)..( 3003): 2750-1469P.txt file - cDNA_ID_3031460; gDNA_ID_2214644; Annot_ID_188446

SEQ ID NO: 30448 - DNA, 3003 bp, Unknown; identical to SEQ ID NO: 25189
  misc_feature (1)..( 3003): 2750-1469P.txt file - cDNA_ID_3031464; gDNA_ID_2214644; Annot_ID_188443

SEQ ID NO: 30449 - DNA, 3000 bp, Unknown; identical to SEQ ID NO: 13707
  misc_feature (1)..( 3000): 2750-1469P.txt file - cDNA_ID_3031490; gDNA_ID_2214645; Annot_ID_188487

SEQ ID NO: 30450 - DNA, 3003 bp, Unknown
  misc_feature (1)..( 3003): 2750-1469P.txt file - cDNA_ID_3031493; gDNA_ID_2214645; Annot_ID_188483
agacacgtgtacgtacgagatcgtgggatgggtcatggcgcgtggcaagcttgtggttcaactgcgttgctggaattttttttctttttctttttgtcgttgctggaattttgtttatccgtgacttatttgttttgaagctgtataattttgttttatgtgatgaaaattgaaattgcagcttcaaaatctctttcactaattacttaattaagtaaataatcatttatttaatagaaaatctcttgtaatttgtgattagtgaataaaaaagttaacagaacaactaaaatactaaaattaaatatcccttaaaattggaacaaataagaaagagtgcataaggaaaacaatttggttttatgcaatttaaattaaaacaaacaaaaacaacaagtaattggtaaatatgattggcacattcctcaaattgaagattctgttttagaggagagaacaaaaaaaaaacatatacactcaaaaatcttcataacaagatattattaaccaatcaaaatcattaccactaaaaaaaaaacacaattttagttgttaattagtaaccataatccagttcttctacctgttcattgagagatgctaactctatataagctgataatgtaggctaacacttctcatcatctcttagaacaagtattgataaacaacaattttttttttccatacaccttaaactcaataataagatggcaagcattgcttttgtgtttaaggttttatgtgtatctttcttgttcatatttgttgcaagtcgtcctactatccgaccaaaaacgtttaacgtccaacgtcatggttctaagccggacggaaaaactgataatgccaatgtatgtaaacgagaatttttctaattttttttttaccattaattagttatgagatgaaaatctatgcacattagcacaactataaacatatatgacaaatatacaaaccaaaaagataaatatatatttttaatttattgtattttaacatatatatatcattcttaacacatacaaaatcaggtattcacaagtatatggagtcgtgcatgcaaaagaaaaagtggaagtagtaaaatctatgtaccaaaaggaatattttacctcggtggtgtagagtttgtgggtccatgcaaaaatcctattgaattcgtcattgatggaactttattggctcctgcaaatcctagtgatattaagcaagatacatggatcaactttaggtacatcaacaatctttctatctccggttccggtacacttgacggccaaggaaaacaatcttggccactcaatgactgccacaaaaatctcaattgtcctaaactagctatggtaacatatcttaaactttttcacttatttacatttaaagcgtattacaaaacgtacatgtgatatttatacacaactttattagaatttttggtctttttcatttgagaaattaacaagtcttataataaacttgaatttttttatagactatgggatttgcattcgtgaacaactcaaatatcaaagacataacatcactcaacagcaaaatgggacatttcaacttcttctccgtccatcactttaatattaccggcgtcactataacagcttccggtgatagtcctaacaccgacggtatcaagatgggttcatgtagcaacatgcacatctccaacacaaacatcggtaccggagacgattgtattgccattctctctggaaccactaacctcgatatctctaatgttaaatgtggtcccggacatgggatcagtgttggaagtttagggaagaacaaagacgagaaagacgtgaaaaacttaacagtaagagacgtcattttcaacggtacaagtgatggtattcggatcaagacttgggaatcttcagcttcaaaaatcctcgtttcgaactttgtgtacgagaatattcagatgattgacgttggaaaaccaatcaacatcgatcagaagtattgtcctcatcctccttgtgaacatgagcaaaaggttaacattctattcaaaaaacaagcttcatcattctcttatttcatcaaaagaataagaacaaaaatataaaagacaacttgtgtttatttttcttcagggagagtctcacgttcaaatccaagatcttaagttaaaaaacatatatggaacgtcaaagaacaaagtggcaatgaatcttcaatgtagcaaaagctttccgtgcaagaatattgagctaattgacattaacataaaaagtaatggacttgaaaatagttcttccattgcagtttgcgaaaatgttgatggttctatgagcggtaaaatggttcctcaacattgtctgaattgatttgacgagccatcaaaataataacgatgtgttgtgtatatgatactttcatttatgaataaaccaaattatttgatgtataggataatgtttttttttataaccgaaattccaaattaaaacataaatatgtatataagctttcagataaaataaaaaattaacatccataatctacaagaaattgtattttctgaaaatcgaatagaaacacatgattaaacaattggacgaaagaatttctacataaatctctgaataaattcaataaatccggttcatctgaagaaactaaattgaaccatactctggttcggtttttaaatgggccgtttgagatttgagaaggcccatagttgataacattcaggcttcaaattgcaaatgatatacaaaaataatttatgcggcttattcgtaagaattactaagattaagggtacaattgaaatttcgattgaaccaacggcggatgtgaaatcaacaacagcgacgactgcagccgtgccgagcactcatctcttcttctctctcagtctcgctcgccatctccgtggagatcctcggacatggtcatgagatcgtaagagagaatcttcaaaaaattgaaattggaaatcgataagctaggagctaaggagaaatg

SEQ ID NO: 30451 - DNA, 3003 bp, Unknown; identical to SEQ ID NO: 30450
  misc_feature (1)..( 3003): 2750-1469P.txt file - cDNA_ID_3031493; gDNA_ID_1620849; Annot_ID_170295

SEQ ID NO: 30452 - DNA, 3000 bp, Unknown; identical to SEQ ID NO: 6143
  misc_feature (1)..( 3000): 2750-1469P.txt file - cDNA_ID_3031495; gDNA_ID_2214645; Annot_ID_188480

SEQ ID NO: 30453 - DNA, 3000 bp, Unknown
  misc_feature (1)..( 3000): 2750-1469P.txt file - cDNA_ID_3031499; gDNA_ID_2214645; Annot_ID_188478
gtttgctcctaaagatgaacatgaagctcagattcaatttgcgttagaacgaggaatacctgcaacactttctgttattggaacacaacagctcacgtttccgagcaatgcatttgatcttatacattgtgcacggtgcagagtccattgggatgctgatggtatttcttttgttccattctttttcctcttagcccatttgcttcaaggttccaatgatcattatggtttaatttgttaggtgggaaaccgttgttggagctcaatagggtacttaggccaggaggtttcttcatatggtctgcaacaccagtctatcgagataatgacagagatagcagaatttggaatggttcgcaacaatcatgttttttttatttgatcattcaacactgatgttgatctctatggttttaactgttacaattctgttttgcagaaatggtttctcttactaaatccatttgctggaaggtcgtgacaaagacggttgattcctctggaatcggacttgtgatctatcaaaagccaacatcagaatcctgttataataaacgcagcacacaagatccaccactttgtgataaaaaggaagcaaatggttcatggtaaaaaaactattacacaaaatgatgctttacattcacatataagtaatgtccactattttttgtaacatttccttctgattaattttaggtatgttcctctcgctaaatgcctttccaagttacctagtggaaatgtccagagttggcctgaactatggcctaaacggcttgtgagtgttaaaccgcaaagcatttcagttaaagcggaaacattgaagaaagatacagagaaatggtcagcaagtgtttctgatgtttacctcaaacatctagctgtaaactggtcgactgtgcggaatgtgatggacatgaatgctggttttggcgggtacatttacaatctctgaaactttaaccagaatccggtttatcccaaactgaaacttgacacaagtttttcttcttttcttctttttggtatagttttgctgctgcacttataaatctaccactctgggtgatgaatgttgtccctgtggataaacctgacactctctccgtcgtttatgatcgaggcttgatcggagtttaccatgattggtgtgagtccgtcaacacttaccctagaacatacgatctgttacattccagtttcctcctaggtgatctcacacaaaggtaaacaacagatctgagtttgtatatctatagagtttcagttctttagcagtagccagtaggcattcactgttttggttcggttcacggttagcttaaccaaagtcggagttgtcataccaaactcggtttgatattgcgaatagtgtggttaacctttaatatgtgttttttgggtcaatttcaggtgtgagattgtacaagtggtagctgagatagatcggatagtgagaccaggtggatatcttgtggtacaagacaacatggaaacaataatgaagcttgaatccatacttggttcgcttcattggtcaaccaaaatatacgaggaccggtttttggttggtcggaagggattttggcgtcccgctaaaccggagctcagatagacagaacgagagacataaacatactagcaaagtaaatttgtacactactatcaatgacgcaaccagattatatcacagcgtactatataacccattaagggggttttgttttgactttctgattttgttccataagaagaattgaacgaaaccgagtcactaaagactacataagatattaaagttaacgagaataattcttttgccaacaacatatattgttttgagcaaaacaaattgtttcttatatcttagattctcaaggttttgtccaaaaaaaaaaaaaaagattctcaaggatattttgtttttgtcacattggttcctataacaaaagaatatggaaatgttgacaaaataaaaatagtagaatgtgaattagaattaagataactaaaacatagaggggtttggttgatgacaagtgaccagaccacgaggatcccacatgggaagagaattggggacgaagaaagcaacagctaagcaaccttccactttgaaatagtctcacattacttaagatgacaatcattccttcaacctcaatcattcaaatatcatcacaccaaatctatcgtggctctcgttgaattttatttataaccgacacaaattgtaagaaataaccaagaaaatcaagaaggtggaaccattcgtccattccctacgccacaagtctttttcaacggtggatggctggctggctgtctaattgagccttttcttttgaaccccttttagttctgtaactacattttaccaggtataatagtatattagttaatattaagccgtattacacatttttttttttcacctaacgtttatatatatatataatattttttagttacagaaaatcctcaccactttaaattacgatgcaataagatcaatctaaatggataacttgtaaagaaaagaaaatgatacagtattcgtggttcggaataagtcaagtatgattcgaacatcgtacaatattggtatttgacaataatccttggagaaaaaacaaataaaaagtttctgcagaaaagtttaattttcataaaaatacaaaaagaaaaacgttgattggttgagaaaaatacgcacacttatttagttcttcttgaccaataaaataaaataaaatctcctaaaagtcaagtttcctcaatcgggcaaaacacggcggacgcgctttcttcaatcaaaaactcgtctgctaataagtctcttttcgtcttcagcttcttccgctttttctgattgcttctctgatctcttatctctaattctaatccatagtaaactcgatttcatcatcttctgctcacaacacttactgttgttgttgttgttgttattgttcttctcgattcactcgatcgatg

SEQ ID NO: 30454 - DNA, 3000 bp, Unknown; identical to SEQ ID NO: 6141
  misc_feature (1)..( 3000): 2750-1469P.txt file - cDNA_ID_3031503; gDNA_ID_2214645; Annot_ID_188477

SEQ ID NO: 30455 - DNA, 3003 bp, Unknown
  misc_feature (1)..( 3003): 2750-1469P.txt file - cDNA_ID_3031520; gDNA_ID_2214646; Annot_ID_188505
aaaatttagatataaaaaatcgacctacggtatactgcggataaaatattcaaaattttaaaatccacaatacatcgttacttaaaaaaatatatgttttcgtatctatacttcaaaaattgaaacctaaacaatagtaatcatgtactaaataatacagagattgatatctacatttaaaaatacaaattaatatgatatatcttcaattactctttaaaaaaataacattatatttttgtaaaaaatatagccatgcggtacaccgcgggttaaattctagtatagaacaaaaaaaaattcatagaaattcaaacgaagagtttattgacgtgacttagctacctctcgacgaggttgaaaaacatttactaataaggaaatgaatggacttttgaagaagaaatatgaagcatgtgaaaattttagaaggtagggcacatattgcatagacaaaatcataagagtatggaaagagacaccctatgaaagaacaaaacaaataaaacgagtgtttgcaaaaagatagaaagagtgatagctctctggaaaaagttgtgaagacaaaattttttatacaattgaaaagaatgtgagaaaaatatgagttgttaaaaagaaagtgtaacacccaaaattaaaagaaaatataggatcagattttgggataaattgatcattttgaaactgtctgatttcaggaagatttcttagaaactcgaaagtctggacaaaatctgtaaacaaagaaaaatcagaggactaaagtgcaaaaacgtgaaaaaggagagaaattcgagtttatcttttccgaaactgaagggaagtttttggcaattcaaaaattgaattatcttttaagaccagtatcaacatgcgactctgatttagctagctctattgagcaatctgtggcggccggcatcgccaacagatgtattctgtattctgttagtctgttagtggtattgaggtcggttaatgccgtggattgtacttccttatcaccttgataggggccagcattcctatagagtatattatgtaaatattctgttagtatatggtttgggtcaaccaatgctggggttgtaccattccgacatgcattgctggaaatctggtcgttctgttctgatgttaatattctgttctgctgatattattctgttatgctgatttgataatataatttggatagtataagctctgatgtgtttactttatttcaaattaattaaattgaaatttatgtctattagtacatacacgtgaatattattctgtacgggatcagaccgtgttggtacttgttcgtcgggtttgtagtctcactgggcaattttttgctcatataagttgtgattccgtgcagaggacattgaggaggtggagcgtgcaactgaggtttaaagtttttagttcaatcgtaaagcgagacttgatagaattttcttgatttaaataattttgttttcgacatttggagtttttatgaatttttaaacattaaacattattgaattttagtatttttattacattagttttagtaatactttcaaaattctaccgaattttggggtgttacagaaagtatagataagcttatgaatttatttgtgtatagtatcttattttaagaaaagatatactaactaatccagtgaatataaacgaaaatcaatagtgaatttgttgataccaaaatgagagagtcgtcaaaattcttcctcgtacaataatttatttcatgagatccaatcaaaatatcttacgtaaaaagacgtgatcatccaaactatcaaaacgtttacaacatttatcataatataagcaaaaaaaaatgttcttttgatgttgtaaaacctaaaagttgtattagagttatttgtagttatttattaaaattgaattatctgctacggtaattttataactcaagaaatttaaattattaacaataagtagacatattaaaacttctatctcaaaatattcagtaaatatttttaatcacactaaagtttattaaaagttctaaaaatagacccacgcgtagcgtgagttcatgacctattataggaaaaacttatacattaaaaacaaataaaaaaaaaagaaaacatgtatttattactcattagtgtttttatactataccgcaggtaaaagcatgagtatcatttcgaaacgcggttcactatatttatctatctaaaaatttgcttttttctttttcttttttttcaaaaaacgcaaagtactgttatttatcttgattagtgataaagtgccgtttttcaataaaaaaatttaaattccaccaattaaatgctaccaatcaatacattaatcattccttgttccaaggtatttatgaattatttgagactactaatttaaagtttcactctcgtaattgtaacaaattctagggaaaaaaaccccattcaagattcactagaaaatttcatcaatcttttcaaacacgacaatgtaattaggcttaattaccaatcaactcatcaaatatgaagggaatttaagactaattactaatcaatcatcaatttttagttttctgatataggaaaggagggctaagaagagtagacacgtggacagtggtgattataagaatgaatcaacggctgagatgaagttatcaaagatggttgggtttaaaggaagctgaagatcagaattggatttttttatttttttttattttagtcgtgaataattgttgaagttagttgttcttccctctttgaggtttctaggttttgagtaatatgattcatcctctgtgaagaacattgctcttgcaaggtggatctagtgattcccctgttttatgaacattggatcacattgttatctttttcatattaatcggaagtgtttttgggttgtttgatcgattgttgtggttgattaacagatcgtgatttgtctttatcaaaggtatcagagcttcgtttttcctcggaatcaatg

SEQ ID NO: 30456 - DNA, 1 bp, Unknown
  misc_feature (1)..( 1): 2750-1469P.txt file - cDNA_ID_3031588; gDNA_ID_2214647; Annot_ID_188558
g

SEQ ID NO: 30457 - DNA, 3000 bp, Unknown; identical to SEQ ID NO: 13739
  misc_feature (1)..( 3000): 2750-1469P.txt file - cDNA_ID_3031592; gDNA_ID_2214647; Annot_ID_188557

SEQ ID NO: 30458 - DNA, 3000 bp, Unknown
  misc_feature (1)..( 3000): 2750-1469P.txt file - cDNA_ID_3031600; gDNA_ID_2214647; Annot_ID_188553
ttaaaagccaaattgataacttgtcatttttatttgaatcccatcaatatgccatattatttttttctggcgatcagagaatattattgtttctgtgatctattttgccatcatcctttctaggtgtcagggtttgaaaatttgcaccgagaattatgttaatccaaggattattggtttcttccatttgcattattagttttctagctccttatatgatatgtcaatgactcaatgttacaaattgtcccaactgattttgtttctaagctcaaatattgtcacaacgtatttcattggatcctcctacgactggaatgctcataaggacataggtttggttatgtcttcgtttttttcaaatgagcttatgattataaaaactcaagattaggataattttctcaaaaaaatgcgtgtatatatatcattcttaagatacaagaaacattagttttgttaacagttaagatatagagtcggatttgattcttctaattgagtgttaacatgaagcctaagttgccattgaataaaatcacacatttccttcttcaacgccaagactctttcttttattttcttccaaatgaatcatcttcttgcagtgtatataatttgtgggatcaatgggtttcttaaaacccccttcccaagaaaagattactgaagattgaagaagatccaatagctggtggcccacttggacgtgaagattagcccaattttatttgtattaaccgactaatggtctttagtatacagtatatagctacgtttctcttaggtcttttgtgaattggttttgtctaggtcttacttaatctacaagttctgtttcttcgtctgatcggcaatcatgaatccaagtccaataacgattgatctcatcttggagatattgtcgagattgcctgcaaaatcagtccggaggtttcattgcgtgtcgaagcgatgggcatcaatttttggtagtccatatttcaaggagttgttcctgaccaggtcctcgactaagccgcgcctcttattcgccatcgcagagaaaggcaacaaagagaaagactgtgtgtggaggttcttctcgtcgccacagcttgagaatccatatgagaaatcctcatcgactcttgtagcaaccgctgaatttcatgtgagattctctccagacaatctactgatctgtcattattatgacctaaaatatttttcaattggttatgcctttggcttgatctatatctatggtaatcgaggccgggctagacctctaatatgtaaccccactacaggacggtatgccatcttacctaatcggtatacttacagaaaggcgtttagctttttcgggtttgacccaattgacaagcaatacaaggcattgtccatggtttatccatctggtcctggtcatagtagagttattacatttggagctggagatctgaagtggagaaggataaaatgttcattgcgacatgatattaagagtgaaggggtatgtatcaatggggttttgtattacttaggtgacacgtcggattggagtcgcgttaatggtaatcacgtaacgtctggttatatgatagtttgctttgatgttaggtctgaaaaattcacctttattgacgtaaaaaggttttgtcgattgataaactacaagggcaaattagctgtgatttattgggaggatgatgtcgacattcaagagctttattacaaaaagggtatagatgtcgaggaatatgtggagaataatgtcaacgctgatgccactaatgagttgtgtgtgtggattctagcggatgttgagaaacaggaatggtcgaaacatgcctacacttggaccgatgaaaagttcttccgtcgtttggtatccatcgctggagtgactgcttcgggtgaaatagtgttttcgatgcgcaagtgtaatcctaaacaaccgttttatgtgttttacttcaatcccgaaaggaacagtctccaacgtgttgaaattcaaggttttggtgaagccgttacgaaatcttgtgacgtttgcacctttgtaaaccacgtagaggatctcaatgtttacgatttaaaacaactcaagtcagtccatcctccattggtcgagccagaatattatgattcagattaagagtcagactgagaagggacaaggagaagaagactgacaagtgacaaggataaggagatagagacgagccaggtgaaagcaatgggcatgccattttatgctcttacttatgcgttttttttttaaatcaacattatctatgtttactgttttttttttctcttttgaacgagctttatatgtatccttcattttgtttggtctcaagaacaaggtgttgcagtttctcttagttctctgtcttaatctgagtatctattctttgaatttcagcatggtttcttctggatgagatctgtcctctgttctgtttcaatatcttgttgtgtttgtcggttgtgtgtgatgggactaattttcatgatgacactttggactaaatacttaaatgggatttgtacaaaatcgttcactcacttgaagaaaacattccttgaattctaccattcctggtttctattagtctcagtcttcatgtttaaagtatgcaacttcttgttagcttagttttgaaacttttggttctctgtaacaaagggtcttgtaagctgtctttgaaagagggaacattctcgttaacagtctttatgggtcttatgctttgttgcttctctaagttttttgtttgaacttgtgaatggcgaatagatgagatctgtcctctgttcttaacatcttattgattttgtcatttggtttaagaaatgggaccaataggcccaggaattaggtccattaaaagcccagtaataatggcgccaaaatcaagtgaagtccccgcctaattcatctcttctcactaaaaaagcgtcgaaacctctcactccgtctctcaatcaattctccgatcagccatg

SEQ ID NO: 30459 - DNA, 3000 bp, Unknown; identical to SEQ ID NO: 13736
  misc_feature (1)..( 3000): 2750-1469P.txt file - cDNA_ID_3031604; gDNA_ID_2214647; Annot_ID_188552

SEQ ID NO: 30460 - DNA, 3003 bp, Unknown
  misc_feature (1)..( 3003): 2750-1469P.txt file - cDNA_ID_3031619; gDNA_ID_2214647; Annot_ID_188547
gttttaaaaaatctcaaaacaaatttcgtcatattttatgattcgaaattttaagaatgaacatatattaaccaattggcaaaaaatgtgtgggttcaacgtcccgcaacgactaaaatattttgacaatgattcataaacatattataaataacatcaatattaataaaataaacagtttttttttgtggacgggtttggcaggacgttacttagtaacaatggtaaactataaaataatttatatatttttatatatattaattttagaaaatgaattgtcttcgcggtgtaccaatggttaaaatctagtggagtattaaaatcaaaacaactaacttctttagacttatggtggccaacaaagcaacaacgggaaagtggtctcctttcaactttttctttctcccccattttcatgaaatattaaaaatatctcaaaagagcataatacgacattaatttgcattaatcgtcaagttgcaattatgtgtctaatcatatttacaatgctacacaaataaatatattatagttatcaataaactctctaatttggcgtcttgtttctcccttaccatttgagaactcaatttttctccaagagaaaaacaagaattccaaggagagataattaagttatgggtatgtcaccattaacggtgaagaaacttggtttcatcttcatgattgtttcagcttctgctctttctgtctcctttgcaggtttcacttctctcacccactctcttctgttttgttgcagcttttctctatacttcatgtgcgcaagaaattctttagtccttgttagaaagaaatgatcacaattgtataatctttagtccttgttagaaagaaatgatcaatattgtagtttgtcgttgtgtaaagaaactactaaacaatgatgatcatgatttagttatactgtatgtacaattaagtaacctatttttcttatagatgtaacaaataaacttcttttgttatgcaggccgaccatcgatttttgttcataaaaaaataaatcttcgcgaagaggttagtctaactaacatatgaaggggaatgtgtttcatgtaactttgtgcataaataagcatacattttctaaatttgaatacataataaatcttttttgctttcaataaataattttggagctgaatttggttaaatgataatgtgactcagatggtggaaagaagcatgcatgagcatgagaggcttctaagaatgaacacaaaggattatgggaacaacagtccgtcacctagacttgagagacctcctttcaagcttatacccaattgatgacattagaattggttctaatccatccttaaataatatatacatatataggtagaattagtttcagtgactatatagttccatcgaaatttggagatgtaatataaataaaggtaagaagctagcttgagctatgctatactcttatatttggtgtgctgcatagattttggcattttgccatacatccatggcatcacaatcatgtgtctttgtttttggttttcaaatatatatttatgttgcatgcaatattatttatatgtatatatatatatatatatatatatatgagaatttgaattcttactattagacagagatagtctaacagtaaaaaatttgtgatttgagttctataacggttcgctaataatttctaatcaacctctagatctattattatgatattttctgagaaattccttaggcatgacgatttttaatctatatgaatttacatcgaattttattgtttttcttgttttagttaacaatttttctgtttagtttgatttcaacactaagaactttccgtgtgaacaaaagaactttgtgaatctgatccttaagtattataatgaactcttaatttgagggacttacttgaagtctaatttgatatatgtcaattaccaattaagaaagccttcccatttgtttgatacaacacaatcgaggtgacactagtatggccaaagagatagttcacgatagaaaatcaaaaatcaaactttgcctcaccaaagattgatgtagtagaaactaaaaacaccatgagaaactctcatgttagaaaatcaaaattcaaataataatcaaaataaatttatattcaagagttgtatatatatatatatatatactagagtcgtcggatgcatctaaaccatagtccttgattcatatatgtgacgttttcatctccacaaatgggtaattgtgttattacatagtttaaccaagacgacatcgtctatatacaaccatttagggcatgtgttgtccaaattatttttgctatgaatcatagcgtataacaatgtttgtaccaattttgtattattattcaagtcaaaacataaaaaaaatgtttgtttttggtcaatgacctttacgtaagtcacatacaaaataaaattgtaagaaagatgcatatagaatctttaaagcattctgaaatttgataaaagtagacattaataatgagagtggaataatataattatatgcttatatacatctttcttacaaattcattttgtctatgaccctttactaatttagataattacatactcttatcacctctctcttagttacagttaatgaattatgaacaaaaatatggtaatatgacattaatgtgtttaaccttcgaaagatatatcgatggcgcaagtaaaaaaaagagttgaaacgagtttttaaaagagagacaatttacatgagatatttttcgttttaattcttagaattgaaactgttagttactctcaattttgttcattaaacactctcattattgatttctcttatcagcactgatggtattagacctgtggcaccaatagcacctcttgaggggttttatgcaaatccaaaagttaaagatgtcaattggaattggaagtaattcaaagggcttttatgcaaaagtttgtttttctcataaaagtttaaatg

SEQ ID NO: 30461 - DNA, 3003 bp, Unknown
  misc_feature (1)..( 3003): 2750-1469P.txt file - cDNA_ID_3031633; gDNA_ID_2214647; Annot_ID_188542
ttgttttgaattatgattgagataaaggatatttacttctcaggtgatttaatcaaagcctctggagaagatctgtaggtacgtacaaatgtctgaacatgttatggttttgggtaaaggtaacaaaggaatcagcaagaattcttcagtcaatccatatgaatcagcttggttaggtcgttggactcagtcaggtagtgaagtgaagtttcatgatggtgagaccaattgctctaagcagttgataagacctgaagatgagaatcatggagtcgaggtcttgccgtttcctatgttcaaggtttctcaaaagagagagactactactactactactactaaaccgtctttccatgaagatgttggttcaagctcgagagctatggttaatagaatgccctggatgtatccgcaaggagagaacttcagttctagtaaccgtcttgacttcccaattcaagaaaagactactcaaaacttgctagagttgataagaccggtgaggatttacgcaacggttgattctgttaacttgcctaaagaagatagtcatcagttattgaaggggtctacagtttccatgaaactgaaagggaagatttttggtggatatcttgatctgtttcctaatcaagatcactcccacaatagaggaggagtaaggctgcagtctctagaaagctcaaaggatactcaagaagatggaccgagaaaaaatgaatcatcggcagagactaataccttagaaatggatagacttcagactatacatctttccggctccatttcttcgtcatcaactaaggtattgttcaatcgacatatctacatatctttactcaaaatgttgaaagttgtgattgtgaaagatgttgaaaattccgcagggaaaaggaataaaaggctactcagccattccaaggaccgaaatacctgacatgaatgaagaaccacctcttgttccggatagagagaattcagtagatggacatcagggagaaacaagcaactcggctactcaaagtatgaatgtggaacactttctgtccagagattgcaaacgtgtgcggttggaaccagaagtagaagccagcagtagatgggtcaagcgtctgaagacaagcccctcagattccagtgaaaccaagagcatgatgaagatgaaagaagcatcactgggagaaaaagagaacaataatctattccttgagatcttgaagtccggaatcaacaatctccaaccgagaaatcaagaacccgtcgtttcacagagcaatgatctgagacaaggaggagatgacattacacttctgcatccatggatccagaggtggtgcaagaagaaaactacatcaacagatcaaccaacagggcaagaagctagctttgagccagagagtcacaaggagttcgagaagaaacagtatccgagtattgcagccatggcattgatggggaaggctctgagcggtttaaacccatatggtcttagaaagaccaactctctcatggtttggaatgcaagggatttgaggtaggaaaacaaaaccatcatcctcatcttcccttgtttatcattacaacgtaaagtcaagaacatcaaacagaactagctagcaggcttgctacgatcaaatattttgacaggttctaccttatatgtcagtctgactattcttataatagtttcagtttatgtatgaataccttgtttgcatcataaatattcccttttaatcgttaccgcatcagtattttgatttgttactggccttacaaaaatgatagcataattcaaagtggtaagtaaatctgttctctcgaaaatcttgattcaagggaaaaagagtaacatttaacattaagtcaagcaagtagccctagtgttaatctgctgacttgagtgagtagaaaccatccttatcgtgcctttcaccatcaaatctcttatcgcctttctagcaagcgacccattgatctacgacagaaaccaatacaacattttacacatgatcaaattcttgagcacaataaaatttctctttcaataactcgataatcttgaacctatcccaacacattataaagagctaattcagtgaaaagagtggaggtagagagttagttagtttacccgaagacggtcagagagaatcgaaggagtgatcaatttgaacttaggagcttcagacataagcttgtcgtaagttgcttgatcgaacagaaccatgttgttcaccttctccttttgctttcctttgctccacttctgttgaaatcaagaaatgagaaacgtaaataaaacaaaacccaccagaaaccaaatcaaagaaacttactgatcaagtaaaaaaaaaagtgattgtgatttggtaaaggaccttctttttctgctttccgccaccggatttggcgggtttagaggatggtggtgggactttgtccttctttggtgcctggaatcagtcagagaaaccacacacgaaatctgtatgcgacgaataaaatcaaccatccgaaatacctaaaacctatataagccaaatatttttatttttattttggtaaggtttgttcgatttttttttggtagggtcttgttcaattttatgtagtaaaatatatttttaaattgtatattaactttatgttttattatattccaaactgggttataacttataattaaatgtaaaaatttaaatatttgtgaaatggagaaaagtaaaaatttatcatgacagacgtcttcatttcccttaatcttaatcttaacatagtaaaaatctctttcttcaatttatctatatataagattttactttagttatgttttaaaataataatatactcttaattgggttataaatgtgaaatctatatatttttaaaagggagcaaaatcaaatcttattgtgataaatatatatttcttcattatatatccttaacttttaattcttcagttttacatacagatctttacggtggaatttaacgatg

SEQ ID NO: 30462 - DNA, 3003 bp, Unknown; identical to SEQ ID NO: 25204
  misc_feature (1)..( 3003): 2750-1469P.txt file - cDNA_ID_3031637; gDNA_ID_2214647; Annot_ID_188540

SEQ ID NO: 30463 - DNA, 1919 bp, Unknown
  misc_feature (1)..( 1919): 2750-1469P.txt file - cDNA_ID_3031681; gDNA_ID_2214648; Annot_ID_188582
tgtagtagtactactacttggtttgcataatctgaatcaaagttttacaccaaaaaaaagaaaaaaatctggattaaagtaaaccccaattaattaatcatgcgtgggattgactcattttgacatcatagtatgtgtttagaaacattttttttagcaaatttctagtcatcaagagtaagtaacattagatggagcgtaaggaaaaaaaaaatacattaggattattatgattatggcattcggcccaaaatctcttagtattcaaaaaaaaaaaaaaaaaatttaaaackaataaatagctaaatagttacatgtagtrgkactactacttggtttgcataatctgaatcaaagttttacaccaaaaaaaagaaaaaaatctggattaaagtaaaccccaattaattaatcatgcgtgggattgactcattttgacatcatagtatgtgtttagaaacgttttttttagcaaatttctagtcatcaagagtaagtaacattagatggagcgtaaggaaaaaaaaaatacattaggattattatgattatggcattcggcccaaaatctcttagtattcaaaaaaaaaaaaaaaaaaatttaaaacgaataaatagctaaatagttacatgtagtagtactactacttggtttgcataatctgaatcaaagttttacaccaaaaaaaagaaaaacatctggattaaagtaaaccccaattaattaatcatgcgtgggattgactcattttgacatcatagtatgtgtttagaaacgttttttagcaaatttctaatcatcaagagtaagtaacattagatggagcgtaaggaaaaaaaaatacattaggattattatgattatggcattcggcccaaaatctcttagtattcaaaaaaaaaaaaaaaaaatttaaaacgaataaatagctaaatagttacatgtagtagtactactacttggtttgcataatctgaatcaaagttttacaccaaaaaaaaaaaaaacatctggattaaagtaaaccccaattaattaatcatgcgtgggattgactcattttgacatcatagtatgtgtttagaaacgttttttttagcaaatttctagtcatcaagagtaagtaacattagatggagcataaagaaaaaaaaaatacattaggattattatgattatggcattcggcccaaaatctcttagtattcaaaaaaaaaaaaaaaaattttaaacgaataaatggctaaatagttacatgtagtagtactactacttggtttgcataatctgaatcaaagttttacaccaaaaaaaaaaaaaacatctggattaaagtaaaccccaattaattaatcatgcgtgggattgactcattttgacatcatagtatgtatttagaaactttttttttaacaaatttctagtcataagagtaaggaacattagatgagcataaggaaaaaaaaaatacattaggacaaatgttaatttggaatctcttaaatttagatttttttaaaaatgtctatctgtttttcttctagataaaagtgtttcatattatccatatatattacttttaaagaaatctttttataaatagaatagtatttttgtagagtatatccggatatgttctgcgaaagaagaagaagctcacgagattagtcatgctgacatgggaactagctgtcttgagcaatcattcatctctcagatcttacacgtcctccaatcacagtttcacacgtcaccattcgcggcgccatgtatctgcttctctgatttctgataggtcccattttattctctcccacctactatataaactcccatttttcctttgtttttcttcaacccaaacaaaaaaacattttttctctataaatcctttattattgttataaaaactccgatg

SEQ ID NO: 30464 - DNA, 1919 bp, Unknown; identical to SEQ ID NO: 30463
  misc_feature (1)..( 1919): 2750-1469P.txt file - cDNA_ID_3031681; gDNA_ID_2214648; Annot_ID_136395

SEQ ID NO: 30465 - DNA, 3000 bp, Unknown; identical to SEQ ID NO: 13743
  misc_feature (1)..( 3000): 2750-1469P.txt file - cDNA_ID_3031708; gDNA_ID_2214648; Annot_ID_188578

SEQ ID NO: 30466 - DNA, 3000 bp, Unknown; identical to SEQ ID NO: 13746
  misc_feature (1)..( 3000): 2750-1469P.txt file - cDNA_ID_3031736; gDNA_ID_2214648; Annot_ID_188568

SEQ ID NO: 30467 - DNA, 3003 bp, Unknown; identical to SEQ ID NO: 25232
  misc_feature (1)..( 3003): 2750-1469P.txt file - cDNA_ID_3031744; gDNA_ID_2214648; Annot_ID_188566

SEQ ID NO: 30468 - DNA, 1673 bp, Unknown; identical to SEQ ID NO: 13756
  misc_feature (1)..( 1673): 2750-1469P.txt file - cDNA_ID_3031750; gDNA_ID_2214649; Annot_ID_188610

SEQ ID NO: 30469 - DNA, 3000 bp, Unknown
  misc_feature (1)..( 3000): 2750-1469P.txt file - cDNA_ID_3031762; gDNA_ID_2214649; Annot_ID_188607
gttaactaaagctgcagacatcgatatccgcccaatctcggtattgatgagcttgagctcagcaagaattcttgcaagaaccgggaatgcagtaacggagagtgcaacaccaaggaaaagtatataggtgccttgccctaagtggtcttctgatctatgcatagagaaagagaaggcagcaccaatgaggaatggtaaaaccataccaccaatagcgatggttagggctcgcttccctgtcttacgtacaaccataatgtccatctctacacccaccaagaataggaagtaaagtaaacccacattagccattgtttcaagtaccatcacacttctttgagggaaaatagtgtgtgcaaattttgtggagcgccctagcaccgatggtccaagaacaattccgccctataatttaagatcaaaatatacatttcaaaatgttagaaacctctcatccgaagtgatatgtattatttcactttttgccaattggttttgagttaaaaaaacttttccgccacgaatgaaaaaaattgagaatttatggttacttacaaggatctcggagatgacacgaggttggcgaaagggtttgaggataaagacgaagaaacgagtgacgacaacaaccaaagttagctgaagaacaaagagaggtagcgaaaagtcgagaggattatcgccttgccaaacaccattggtggtgatcatgcttggcgcataacatattatggaggcatccgtactaggttcttcacttgtcgccattttttcctaagaaaaaaacttgaaatgatcgaaaggaaatgttgtgtgttaatttgcaggaacatacatatgagagaaaggaaatggattcaaagtttggtggtattccgtatcatcctctctgctcaacgagtcaaaacaacatcattcatcatctctatttttggtcttcttttcttttattagaactattacaattattttcaggtgtttaacgtaactaaccgtttttttttaattcttgatatgtaaataaatattacattaacaataattatctcttaagaaaatgggttctacacttcttttgtttttttttacaaaattacaaaatataaatttccccaacacatatataaattcttggaaagaaactagtcacctattgtcttcaaattatacaattgaaaatgtttaattcctagcataagaaaaataacaatgagcgcaaaacatggagtaaagactttagttataccagtctccagtcagatataaaccaaacaaaattgaaaacataagagaagaaataaagtatgactatcataatttttaagattttataccaaaaaatcctataaattatccatttttgcaattttatcttttatttccaaaaaataagatataatcatatgatatcaaaaataatattgcattataattttttcactattttcgatgttgtcaagtttaaaaaatattaatatataagtgtgtgttaaattatagcccttgcaacgaaaagttcagctttattcaaaattttaaaaaccaagttatttgattgtataaacctttacatcttatattttaaaacaaagagagtaatttttaaaataactagagtcctgaaatttatgtactgtatatgacaagttcgtttatttttttgtgctgtttaatgttcaaaaataaataaatttaaaatctgttaatttataattgacgaggatgaagtataccacacaaacactggttaatacaaaagtatcgtagctctatcgttttccaaattagccacaaatatttctaattctaatctgctccatcatttaaaaatcttttagagtttatttcccttaacatttttgctttttcccattttttgtaattgtttatcatcatttccattttaacgacgaatttttagatgaaaacgtggctttattattgcttttgtagtgttttttttttgtttttcttgtttgggtcaaagattgcttttgtagtgtttagaatcctaaagacgtaacgccacatttatggttataaaaacacataattaggggatagttcaatcagtgccaaatgtcaatacatgtaaatttcttatgaaagaaaagtgattacaaaatacatcggtgaaagagaaaatgtcggtgaaagagaaaatgtcggtgccatgaacgggcaacaatgtgtaagttgttacaaaatacgtgatcaagatccaaaaaccatttcaagcaacatatcaatgtattcttttaatgagagtgatgagaaaaatattttgtaacttttatctataagatgttagttttttacgaggatataaagaagagatttaacagattttatctattgcttataaaacttccgtatagaaagcaaggttacttctattaatttttatcgaaattgtgtttaattttctttatttgtttcaaaggttgtttttgaatgttttttatatttcatgtaaatcgatttgccgaaaagaaaaaaaaagtgattttgagaattagccgtcggtaacttttattaatattaattgaattttttaaaaattataaattgatgaagaaatcacaagtatattacaaaatatgaaagtaaatatataaataatatcacaaaggaacacgtgactcttcatgtcttgggaaagttaaagagaagtgagaagaacaactgcatgtgaacctctctcactctccatccatctatatttggtataacaaaacaatggcccgtgaccaaactcaaaaatttcaactctcttcacttaaatccaatacaagttacagaaatctagctgtcttcttacttcttagtcttttgaaccatttatgaccaatccaatactaattcaaagtttcttataacaataacacatttagtacaagacatatataattggttttgttctattacttgtcctttttcttacgccactatagcattggaaaagaaagaaagagagagaacaaagcttcttcatcaatg

SEQ ID NO: 30470 - DNA, 3003 bp, Unknown; identical to SEQ ID NO: 25211
  misc_feature (1)..( 3003): 2750-1469P.txt file - cDNA_ID_3031773; gDNA_ID_2214649; Annot_ID_188600

SEQ ID NO: 30471 - DNA, 3003 bp, Unknown
  misc_feature (1)..( 3003): 2750-1469P.txt file - cDNA_ID_3031806; gDNA_ID_2214650; Annot_ID_188620
tcactacaaacgtacttaataacacttaataaagtatgtaattcatttgaatttggtattacttctttagtttcttcgatctgaaatatacatgatttgacactgatttttttttttttttttttttgataatatacattttcagttgttttaaaggaaattcaaatgtgtatttcacttgcactctcatcatcatttagctaggaggtttacaaaacagaagttcttgaccatgaaaactctcaccaaagtgtgttgggacaccgagaatcaaaaaaacttctcaattgttacattttgaaatagattttgctaatgtggccgatgatatgatcatggaacaaatggataattggttactaaaaactatagataatggattatgcacttatgcagtgtatcacctctgtttctaaaacagcaaaatatacaatactgaaatatgtaaagtattgggtaaaattgtcaacaaacatcttgagatatttcttccagaaaactgctacaaagattctaatcaccatcgacaagaacattaaactaatgtgattatgtgaacaaccattattcaaattatttagttcctatatcaatgaaaagaaagttcagaacgtcaatctcgtttgatacataattctaattttctttctcattgctttatttaagtaagatatcaacggctgtgattctctctgatgacatactgatccgtgcggattaaacccatgcaaaaaccacacgtgaatattccacattgtcacattgggatcttctaattactactagattcacatgtgcttatgctaattaacctcgcacacgttacactaaaatacgcctatcaaacttgttgggacgatgaccgttgtgacctcaatgaaattattttttcccatccaccaaatatgaaattaaaataatactgatactgattttacatgtagtactaattattagtatctatttacgcgtgaagtattggacttctctgacacgactgttaccaaaaatggagttaacggcgttaacattgctgttaactgcgtgtctgcttactagatatgttagtgggcccagtagagattttaacggttgttatgtgctgacgtggactcatctttcttaacgctgctaattaactccggcacaggtaacagtaaccagtacgacaccgtttttggggttgcattcattggcagcacagagccgcgtcgccaaacgttagcgttttaaaatccacccgctccacatattactcaccacgtgtctttatttaaaacccgcgtttccttcacgcgattctcatttaacggagccgtgactttttcaaaaattgtttaccgttggacaaatgtcttattgtcctcataatgtcagccttatttacggaaataccattggacggtggtcgtgaattttattaacaaagaagggtattttggagaattacatcagggacggcgtattggggcggctaaccccatccgactttatatgcactttatgggaaatttcaattaattaaaatatgtaaaaactataaaaatatgaattaaaaatttgaaaattcaatgatacgccttttatttttgactgtgaaagtcttaaaaaaaattgtttttaaaaaacccaaatgattcaccttttcttaaaatgtaccccgtttgtcttcgaggagagatctctggtccacaacttttttattagacaactcaaaaaaattatattcttttcttttctgttttgtattatgagtttttatttggtatttttgcactttatcccttctcaaagaaagctctacaaagcaaaacccaatttgaattaaacttcatatttaccataaatgattacaccatgaggcgatttttataccattttcaagttttgtgaaaatattagtgagtttgtaagttgtgattttatgggttttttttgttgaaaagaaattgtagtgttggtaagaatagagttgagctgacacagcacctgtgactatttgtcgggacacatgtgtaagaagcaaagcctctcatgctttcttgcttctctttgttttcctctcgtcgtcttttatatatccttcaattatcatttttatgtatatatctttttgctagaaatttaaacatatatatatatattaaactaaagaatctgtatctcctttttacattgaaaagaataaaaaattaattatggtattagcctaacagtaccgattatcaaatataaatgttgttttttttttcgtctgaaaataccaaaagcccgcatttatatttttattttgtcatcagatattatttaaaactcaaacgagctaaaattgcgggaaattacgagataccgtatttacattttacattctaatattctatagaaaggaaaattttgacaggtatttagattactgtttttgcaaaattaaaatctcctaataaaaaccaataatacaaatatcaccaaatatgatagaagacaacacaaatacactaaaaaaggaaacatattaggtaacatgatttattataattttgccatctaaaatatggtttactttaaatatgtagacttctggaccatataaaattaacataattttggaaactatatccaattatatcaatcaaatattaaaaaactatataaattttaattattatatactctaaatatctatacagctggacatataaaaatttaacaaaattttggaaactaatacccaattatatccatcaaatataaaaactaaatcaatttaaagatattaaaaattgttgagaattcgttaaaataatttaaaaaatcgaaatataaacgacccaaaaagacagatggaaaccatattcactctctcttcttcattagcctttcgtctccttcttctcttctctatctctctttagcttctctacgcaagcttattatctctttctcttaaagctttttctatatacaaacagaagcgtttgatactgtaaaaaagatttagaaatg

SEQ ID NO: 30472 - DNA, 3003 bp, Unknown; identical to SEQ ID NO: 30471
  misc_feature (1)..( 3003): 2750-1469P.txt file - cDNA_ID_3031806; gDNA_ID_2214650; Annot_ID_136412

SEQ ID NO: 30473 - DNA, 2054 bp, Unknown; identical to SEQ ID NO: 13770
  misc_feature (1)..( 2054): 2750-1469P.txt file - cDNA_ID_3031814; gDNA_ID_2214650; Annot_ID_188628

SEQ ID NO: 30474 - DNA, 3000 bp, Unknown; identical to SEQ ID NO: 13769
  misc_feature (1)..( 3000): 2750-1469P.txt file - cDNA_ID_3031825; gDNA_ID_2214650; Annot_ID_188623

SEQ ID NO: 30475 - DNA, 3000 bp, Unknown; identical to SEQ ID NO: 13775
  misc_feature (1)..( 3000): 2750-1469P.txt file - cDNA_ID_3031838; gDNA_ID_2214650; Annot_ID_188617

SEQ ID NO: 30476 - DNA, 3000 bp, Unknown; identical to SEQ ID NO: 13765
  misc_feature (1)..( 3000): 2750-1469P.txt file - cDNA_ID_3031842; gDNA_ID_2214650; Annot_ID_188616

SEQ ID NO: 30477 - DNA, 3000 bp, Unknown
  misc_feature (1)..( 3000): 2750-1469P.txt file - cDNA_ID_3031868; gDNA_ID_2214651; Annot_ID_188651
attaaaagtacttaccgtatggtcatgggtggaggctagcatttcgaaaaccttgcagtgtttctttgagtttccagagttattgataattaaaaagtcgatatagttactacttgcaagatatcatgcatggtctcttctgttggtttactagtttgtaattttcttatgtatattcttctatataccaaataggcaaaaatatatctacagttctttgaaagtaatctcatcatcatcatgaaatgaaaaaaacaaaataattctaatcatgatgactgatttcaaacattatacaatgtagtgatacgacaaatagaaattagtactagtacatattttaatagtatgtcaacaaaagtctcaacctcgtggctctacctccatgaagactcgtggcaaagatagagaaagaggtcatatgtgttgcagacatatgaaaatgaattctctttattatctctctgattcatttggttagttcgattcttcacagttaaccatttatttagtatttcttccgatgtcgatattatacgcgttggtggcgcgtggaacggtggttcttgcggagttaagcactacgtccacgaacgctagcacgatcgcgaagcagatccttgagaagatccctggtaacggcgacagccacgtgtcatactctcaggatcgttacgtcttccacgtaaaacgtactgatggcctcaccgttctttgtatggctgatgaagacgccggaagtaagtcttttgagcttttagtctgttactatgataacactaatactcaatattttgttccttattttggttaatgatcaataaattaatcattacttagtttagaagacagagaccagattcttgaaatttgaggttttatgaatttggtgtttatgatgagtaacaacctttgagaacagagacaatgaaataagaagagtctttaaaatgttcccaaagttgtgaagtagtagagattgagattcttttttctttctttctttagtttgttgttatgtgttaatgtacttgttttgagtgttattttcagggaggattccattttcgtttctagaggatattcatcagaggtttgttcggacttatggccgcgcaattcattcggcacaagcttatgctatgaatgatgagttctcaagagttcttaaccaacaaattgagtattactctaatgatcctaatgccgatacgataagtcgaattaagggtgaaatgaatcaggttttgtgtttctccataatttgaaacatatatagtgcaatggttatgttttgctggcttcaacggattctctgttttgtatggttatgaataggtgagggatgttatgatagagaacattgacaacattcttgatagaggtgaacgtcttgagcttcttgtcgataaaaccgcgaacatgcaagggaataccttccgattcagaaagcaaacacgtcgtttcaacaacacggtgtggtggagaaattgcaagctcacgtatgttttcatcaaccgtaattccttaccatgtttgcaccttaagcatgacttcaaatggtttaatcttttcgatgcattctcgtgtaacgtctcttgtaggctactcttaatactagtgttgttggtgatcatatacatcggtgtggcctttgcttgccatggaccaactctaccctcttgcgtttaattaagtgagtgaatctgtcatatgcgcgcaatttcgctgcgatcatggatttctttgtatgtattggcgcagcttagatcctctgtttctagctagctgtatgactatgactgagataagttttatttgtataaagcatacatggaagtgaaaacgcatttctttcacaagtgtttgaagtcttgttataaccatatatttgaactttggcatgtgtgtaaggtcatacaagggttgattgattctttagaaatggctaatgggagcattttgcacacgtctgacattgataagaaaatccactataccgttttataacactttaaccgctttaattcggttctgagaccagaccatgcgggcatggcctatgtggtggcgacacaaagaaaatggatttggaaagggggtggtcttccgcatcaacgataaaaggtgacctaggcgcatcacattttcatcagacgcataaccgttcacacccatttgcgtaagccatagactatggcccatagttggtgatgagaagcgtacatcctaaggaatgagtatgataacatcgttatccaaactagagtcacacacaaatatgttaatgacgtgttataacttataagaagctagcgcaccgaacgtggtgtacacgtagtttctgccataaaccaacatatggacagtttcgatataccaatacaatttgggtgattcggacccaataatattgtttccttatgaatatgatttttaatgcctttgaaattattattttatctaagcgagcatagaaggatctagaagatcataagataattaaagaatatatattctaatcaatcttatgatgttctacatcgtactatacgatcactcgatctttattgtaaaccattaaccctaatatcgggcatatccacacactgcctgtccgacgtttattaagatcctacggaagatttttttttccacctttccaaaatgctatttgaattcatatataataccagattattattatttttgccttaccaaaaaaaatataccaacatcttttgttcaaaaaaacgaaaaaatagaagttcaaaaaaaaattgcaaaagagaagagaagagttgataattatttggaggagaagagagttaactataacaaactttcaaaaaataaaacaaaacattttaaatagccctttttcagaaaaacaaaaatatattttaattaatattgaagtcaaaaccaaaaacttaaacctaagccctagataaaatagtagtactgttggatgttataaaaaaaactgccacagaaatg

SEQ ID NO: 30478 - DNA, 3000 bp, Unknown
  misc_feature (1)..( 3000): 2750-1469P.txt file - cDNA_ID_3031868; gDNA_ID_2214651; Annot_ID_136433
ggtggaggctagcatttcgaaaaccttgcagtgtttctttgagtttccagagttattgataattaaaaagtcgatatagttactacttgcaagatatcatgcatggtctcttctgttggtttactagtttgtaattttcttatgtatattcttctatataccaaataggcaaaaatatatctacagttctttgaaagtaatctcatcatcatcatgaaatgaaaaaaacaaaataattctaatcatgatgactgatttcaaacattatacaatgtagtgatacgacaaatagaaattagtactagtacatattttaatagtatgtcaacaaaagtctcaacctcgtggctctacctccatgaagactcgtggcaaagatagagaaagaggtcatatgtgttgcagacatatgaaaatgaattctctttattatctctctgattcatttggttagttcgattcttcacagttaaccatttatttagtatttcttccgatgtcgatattatacgcgttggtggcgcgtggaacggtggttcttgcggagttaagcactacgtccacgaacgctagcacgatcgcgaagcagatccttgagaagatccctggtaacggcgacagccacgtgtcatactctcaggatcgttacgtcttccacgtaaaacgtactgatggcctcaccgttctttgtatggctgatgaagacgccggaagtaagtcttttgagcttttagtctgttactatgataacactaatactcaatattttgttccttattttggttaatgatcaataaattaatcattacttagtttagaagacagagaccagattcttgaaatttgaggttttatgaatttggtgtttatgatgagtaacaacctttgagaacagagacaatgaaataagaagagtctttaaaatgttcccaaagttgtgaagtagtagagattgagattcttttttctttctttctttagtttgttgttatgtgttaatgtacttgttttgagtgttattttcagggaggattccattttcgtttctagaggatattcatcagaggtttgttcggacttatggccgcgcaattcattcggcacaagcttatgctatgaatgatgagttctcaagagttcttaaccaacaaattgagtattactctaatgatcctaatgccgatacgataagtcgaattaagggtgaaatgaatcaggttttgtgtttctccataatttgaaacatatatagtgcaatggttatgttttgctggcttcaacggattctctgttttgtatggttatgaataggtgagggatgttatgatagagaacattgacaacattcttgatagaggtgaacgtcttgagcttcttgtcgataaaaccgcgaacatgcaagggaataccttccgattcagaaagcaaacacgtcgtttcaacaacacggtgtggtggagaaattgcaagctcacgtatgttttcatcaaccgtaattccttaccatgtttgcaccttaagcatgacttcaaatggtttaatcttttcgatgcattctcgtgtaacgtctcttgtaggctactcttaatactagtgttgttggtgatcatatacatcggtgtggcctttgcttgccatggaccaactctaccctcttgcgtttaattaagtgagtgaatctgtcatatgcgcgcaatttcgctgcgatcatggatttctttgtatgtattggcgcagcttagatcctctgtttctagctagctgtatgactatgactgagataagttttatttgtataaagcatacatggaagtgaaaacgcatttctttcacaagtgtttgaagtcttgttataaccatatatttgaactttggcatgtgtgtaaggtcatacaagggttgattgattctttagaaatggctaatgggagcattttgcacacgtctgacattgataagaaaatccactataccgttttataacactttaaccgctttaattcggttctgagaccagaccatgcgggcatggcctatgtggtggcgacacaaagaaaatggatttggaaagggggtggtcttccgcatcaacgataaaaggtgacctaggcgcatcacattttcatcagacgcataaccgttcacacccatttgcgtaagccatagactatggcccatagttggtgatgagaagcgtacatcctaaggaatgagtatgataacatcgttatccaaactagagtcacacacaaatatgttaatgacgtgttataacttataagaagctagcgcaccgaacgtggtgtacacgtagtttctgccataaaccaacatatggacagtttcgatataccaatacaatttgggtgattcggacccaataatattgtttccttatgaatatgatttttaatgcctttgaaattattattttatctaagcgagcatagaaggatctagaagatcataagataattaaagaatatatattctaatcaatcttatgatgttctacatcgtactatacgatcactcgatctttattgtaaaccattaaccctaatatcgggcatatccacacactgcctgtccgacgtttattaagatcctacggaagatttttttttccacctttccaaaatgctatttgaattcatatataataccagattattattatttttgccttaccaaaaaaaatataccaacatcttttgttcaaaaaaacgaaaaaatagaagttcaaaaaaaaattgcaaaagagaagagaagagttgataattatttggaggagaagagagttaactataacaaactttcaaaaaataaaacaaaacattttaaatagccctttttcagaaaaacaaaaatatattttaattaatattgaagtcaaaaccaaaaacttaaacctaagccctagataaaatagtagtactgttggatgttataaaaaaaactgccacagaaatgaagaagcagatctcgtcggaggcaatg

SEQ ID NO: 30479 - DNA, 3000 bp, Unknown; identical to SEQ ID NO: 13784
  misc_feature (1)..( 3000): 2750-1469P.txt file - cDNA_ID_3031872; gDNA_ID_2214651; Annot_ID_188650

SEQ ID NO: 30480 - DNA, 3003 bp, Unknown
  misc_feature (1)..( 3003): 2750-1469P.txt file - cDNA_ID_3031892; gDNA_ID_2214651; Annot_ID_188644
aacaaactataactatacgatagggtattaataaaacaaagtaagagttctagatatcaaaatagtattatgaaaataaggactgagaatgtaaacgatacgtactcttcctctatatgtgcttgttgaagccattgaacaaaggcccaaggcctatttagaacaacatatccctgcacattatatacaattcatcatcacatgttttttttgtgtaaatatttctttaagaaaatttcatcatccttggaataaaatttacacatattatcatttgttttacgaggttttttcatgtttgttttaaatcttataatttcataaaagatgcttatgtttattaaaaataatgttttaatttttttttgataaagaagaagttttatcctcaacatgatttcgtgaacatgcattacttattttgacaagtcaatcaataatataatacaagatttgagattgtttttttttacgttactattttcaattataaaataaacctctaaatcgaaaaataacatcatgatgattctaaaatctagctataaccaatacacctttcaccaataacaaagaattaagtaagataaagaaccttgtcaacaccggagggaagagggtcagcaacgaaagtagggatctcatccatgagtccatcgggtcgacccgaatgcaagatccgggtatacccgcccatatccgacccgggttcgtccctgaacctgttgtaccaataatacatgacccgacactgccacgtgctgtacacggaatccgtggctgtcaccgccgtgtgaaacagtctctttgtcttctttgacggagtcttgacggtatatgtgatgtcatctccggaagaagctgatcggcgaccggggagttcttgccggagaggaggatcatcggagactatgtagttgtatctgattattagaaataacgatagagtcatgagaattgggaagaagtacttcccacggaatcccattttctctctttttctgtatcaaaaattcattcatgtgcatatgcatttgctaatgtgtatatattatatatttttgatgtttgtgacaaggaagaaggcataagacagtttcaagttgtatgaaaagtcgtcgcttattgtgttattttgaaatgaggagtagttgtcagaaagtggctggtcccacaacgttctggtcttcgtttcattttctatacatgtatgagttatcaattcagttttcctatgatttgatgttataatagtattgcttttgttgttcaatatgattctacttgtttttatttgttttctcactttgttcttgtcggggaatatttcataagcacgaaaggggtttgggttctggacaaaagatggctaattcggctactacgaaccaaatgtttggtgttggatccgaccatcggattttgggtaataaaagcccaaggaaaagaaagctcatcttaacaatgaagataaatcaaggattataaaaaaaataatcatttcatacttcttaaagaggtaattgatcgtttgtaaggaaaattacaagagtcaaaatgtatggttaaatctctaggaagctgttgtgaatagatgttctccattaatgttttctgcttagtgtaactcgtattgatttaattgttagttactttcatggcttatgtgatacaagccacttgtaagattaatcaaaagttgtgaatttagtagataactcatatcaatcgagtatttaagactagtacaacaattgtctcacgcatcaaaataaggtggcatgcttagttaaacgcaatgcacatgtcttttcagtttaatatttctttagtttctataccaagttaatagtatcgacttacattgtactcggtttccacttgtgatcttcaaattgatcttcattgttttggtttaaccaggaagttgctgctacctcaatgaacatgaaaatgattgagcatatgatttgctaaaccataaataaaccaaacaatttatttcggtttggtttggttcggttttcggttattttactcacccactacagaacaaaactgacatatagaacttacacaaaatttctaataaaaatttttggtttcataatcttaaaatacaaaataaataaataactaaaacagtttttatataaccaaactgaactgaatctaacaaactaaaattcattaaaatttattttagttgtatgagagatataaccatattatataaatataatattgagtgaattattatttgtttctatttttagacatttttttgaaacaaaaaatgtaacccttatttaccactacatatactttaatctagttagataatatatacacatttaagacaacaaatctaaatttctaatacacataatctaataattttcttatacatttatgttataaaatacatctattctaatatcacacataaaaggattacgtgtcctaaacctgaaaaaaaacacataaatgtctatataggagaatctgctgtacattaatatttttattttatccttgtttttcttttcaattttgtttgtcttctttcttgtatctgttccattgcataactataattacctaaaaagttaataataacatatgttaataccgtaaaacattaaaagttcaattattttctttgtgtgattaaaacaaacatgtaaatttcctaaatcataactgtactaatatttaaagtttagaacaataacaattaattaactcacgcggtaaaagtgaaatctacaaagattccattgtccaataattcacttcagaaattgtaagagaaaacctggttttgtgtgtatcatcaaagtctaaactcattacagaaaaactgcaaaaagtcttttgtgggtcatagattttctaaaaagacacatttaagtttattgtcctccttctctctctctctctccactgcaactctttctcactttcactcaagattgcgtcactgtagtagtagtagtaatg

SEQ ID NO: 30481 - DNA, 3000 bp, Unknown; identical to SEQ ID NO: 13787
  misc_feature (1)..( 3000): 2750-1469P.txt file - cDNA_ID_3031896; gDNA_ID_2214651; Annot_ID_188643

SEQ ID NO: 30482 - DNA, 3003 bp, Unknown
  misc_feature (1)..( 3003): 2750-1469P.txt file - cDNA_ID_3031910; gDNA_ID_2214651; Annot_ID_188637
aagactcgaatttgggacctctcccatattcagtcgcaaggttaaccaacggagctatcatctactttttcaaaccggtaaaggaatatcatctatttttttgttatgataacgtatgcaccaagtcaaattctaagtaagttactacacaattgtgtaaattgtgagtcatactcttgttgcatacgcgttttttccttcgtcttttgttttttcctctgtataatacttgtatcaagcatctactaaatcatcttataattatctcattggttgtttaagcacaatcatatagggcttattttgcacccttgttctaattctggtggcttttgccttttttctaaactgattaaatctccaatgaggcattgtttgttaagaaattttcacaaaacacacttttttaccctttgcttgttcttactactctactggttcctttgcaacgacgagtttctggtctgttttgaacaaaacaaaaccaaaactctgattcttacacactttcatatatcctcaaagccaattggttgctttatatacaaataaaattttttgataaagataagttgagtgtgtttttacttcctccaagcatagataatcaaagagaaccaactcttagacccgaagctcctctcatcttcttccctacaactagaccactccatcacagaagacatcctagaagaagaccaatgactatacgtactcgcccaaaacgacggtgttcgacaattctccttccgtaaaatgacatcgtctcttacacgcttgttcatcatcaaaacgtcgtttccttcaacctcttggttctcaaaccggagtaagaacacggcgggaatcttatccggtttaaccttatccttgccaccaaacagccagttgaaaacatcccatgatatctgtattgtcacaccatcgatcacgatctttgtgtttcctctgaatttccattgaagctgactaatctttaggacactcttatcgtctacgctaaaccggagactagcatcgtcgttaacaaccttaacgtcgatactaatctctctaagttttccttgaatcatgattttcgtagagtaaactctgtttccaaacagattctctttcttggacaccaagatttgtctcctcggtctctgtttcaagtttcctccaccgacaagaagacctacttcgccggatacaaagactgccacgtaaaacccggattccggatcgggtcctgatccaaattttgcgtgagtcaggtcccataccacccgaatatccggctttcgagataacttctttgatccattttttctccagaatgtcaagggtttgatttcgagccggaaggcgaagggaatggagtgacggtaacaatctagagagtgtagatagcaatttgtggagttgcatgagtagaaatgaaggtggagagagcgtcggaggaaggatcgagaccatgaaagaaagaaaacaccaacgttagtgtggtactgacaagttgtggtagcgtcgccggaggtggagatatacgatggatttgatggggatggaagagccgacggtagatcgtcgttgatggcggtggcggaaggatggaaacaggcggacaaaggggaggagccaccgcgaccaagagcagagattttcatttttaggtatagtcaattaatatgactggttgatcttatatacgcacatgcatacaaaaagacactaattatatgtaaggatatgactatttgagtatttatctatacttgagttggcttatgtgtctgaaaatgagttgtcatgttgtgaaaattcaaaagagtgggtcaatgtcgagaaattgaaagcaactttgtggataaattttatagaccgaaactgacgttcattgatattttgtgctggttttcacattatttatatgtagattatgttctagttcaattcttttgaagtcgcttgactttttgtctctttcctagtttccttaatcttttccacttatattagtttttaacgtttgtagtcacagtgaaagctaccaaaattctaaaaatggtaaagagaaatagaactgtatcttgttaaagctcggttttcatgttacttaacattacatatgttgtgtttgatagtataaaataataaatttgttatggataattagatgaaaaaattaaagagttttgcgataagtaagatatttgtttcttgttggtttaagagtcggtttgggtccatgatataacactaattaaccaatagttgtggccttgtgggaggtaaatgatccaacaaactttgctttactaactcacatcttttttcttttgaataactaagaggttttggcctaggccaatacatcctctcgggatgggactaaagcattttatagaattttctttcaaatgttattggaaccagcaacctctaggcttagctaaaatattttaccagttttgagctattgacacttgataactcacagtttttagatgtagtttctctaaatcatgcatataaaataaacatcatagagatcactagtagatgatttcatcaactagttctatattcgatacgattttacacgaaactcgtattttcgaaatgttgtacattgtatgatataaactttagaaagggaagatacaaaattaagttgctgactatatgctaaacctatagacacgtgaacaatgagatgacggcaaacatgtggatttaagtttgcttcggtttgtttcagtttgttctagtttgctacaacaaaactccaaaatattgttgatttggtggctacaaaaaaattataatataaaaatagaagatatgtgtttgattaaatatactaacatagttttgatcgtattaggtagagccatatttagataagtttgtggactgcgatgaagttatgaagccacacaatatgtatttttttttccctcatgcttgattcgttattttctctgtgatttgatatgtatgcaaatttatttattaatg

SEQ ID NO: 30483 - DNA, 3003 bp, Unknown; identical to SEQ ID NO: 16578
  misc_feature (1)..( 3003): 2750-1469P.txt file - cDNA_ID_3031914; gDNA_ID_2214651; Annot_ID_188635

SEQ ID NO: 30484 - DNA, 3003 bp, Unknown; identical to SEQ ID NO: 16578
  misc_feature (1)..( 3003): 2750-1469P.txt file - cDNA_ID_3031914; gDNA_ID_1620626; Annot_ID_162487

SEQ ID NO: 30485 - DNA, 3003 bp, Unknown; identical to SEQ ID NO: 26479
  misc_feature (1)..( 3003): 2750-1469P.txt file - cDNA_ID_3031944; gDNA_ID_2214652; Annot_ID_188677

SEQ ID NO: 30486 - DNA, 3003 bp, Unknown
  misc_feature (1)..( 3003): 2750-1469P.txt file - cDNA_ID_3031959; gDNA_ID_2214652; Annot_ID_188671
atttagtttaacctggattgtcttttgtagagctcagattctttcttcaaaacaaagctgtaatcgatgatgaacttaattaatatctaaattatgtaaagctgagataaacaggttgcgagatggacacctatactcatcactgacaccataggcaaagtgaatatcctcaaactcctcgagaacagccactgcacatgaattcataagtttcagagcttgctcatcatttggcttctcaaattcatgaacgtcagaaaatctatcaaaatccaagcaagctccatgagtcgtaatttgcaacacagaagactagtaatcactaacaaaatgacttctttctgaaaatgcaagttcagattcaataatcagaatattccctagacaaatgcaaccacaacagaacataataaaactgaacaggctagcctagctgaatcctatggagcgcaaggattttactagtctaaggcttcaatgcagtaaaaagactgacaaacttttacgaaataaaggtaagctatagacaattacctgtgaaagtgacagccatcaatcctaaccacgacccaagttaaaggtaacaatttgttctcaaactgaaacgacctaataaaatctggttcaatttttccaatgtctttcgtgaagtggccaagatcattatatagagagggctgctcattccaaaagcttcttcctgcaatattctctgaatgtacaaaaacagcctttctcctcaatctttttacaggattgccattttcgtcatgctttacagtttcttccacctgaatcaagttaaatgaaagtgtgttattggaaatttacaataagtcttagctacatagcatcacgcaaatttatgatgaacatcaagaagagcagctagatacatcagttttaaacctgaacatcaactaagctgaagtaatagtcttctacacattgctagattttactagggttcagacaattcaaacttacaaattacaatgcataagcctaaacgtacatgtgcatcaacaatattgtcaacaaactcaggttactaacattcttagagactcaacttaaaactggaagtctaaatacatacacaacacatagcaaagcaagtgctctgtatataatttctaacaaaagatataaattatcacctttttcttgaaaagacaagatccttggcgaaacaattcaggaagcgtcttgtaattgataccaaatttctgaaagagaagctcatttttctgctgtttttgtgtatcctgcaggcatccaatggaaatagaaatcgtgtgttcaaaccatgtaatatcattactaagcgtgaaacttggcttaagaaggtaaagggccattttgacatctgtattagaaaaaaaaaattatagtcgtagtgcagacaaaaaaacattgatctctgccatagaaaagcacgaataacacacctttagaatctcttgggtttcacttacgctctttccacttttaactaacatccagaaacaagtgtcatactgattgttggcgtggcctgcaaccaaaaaatgggtttcacttaattcacgaagatattcacgccaataagtagaactaatatccggaaaaacaagaaatcaagaataagtgtcaagtacaatatttatgttgtcagaatgtcttacagtcctgttgtctccacgcgagataagcctgaagaacctctgctgatgcacaacttacaacttttgaactgaaggacggagcatataataattttctttggggaaaaaactctttccattttgttacataaactgcagcaaagaaagaagctaccaacgacaaaatcttactgcatataaaaaaaaaaaacaagaaagtgaaaaacaatgagtcaatcagagaagaaaaaaccacatatcattgaggaaaaggttttcttcaagtaaattcactaaaaatatggaatcaactttaatcgaaaaaatacctggctcgtctctggtagaatcttgatgttttcttgaatacaaagctacaaaagacatgtaaacatataaatcttgtacaagatacatagaggtgaaataaataaagtcaatggagtgtatttaggacctgtattcgtcactgtatccataagcaaagattatgtcaggaaactcttccaaaaccgcagctgaacatgaattcatcaaattgagggctgtttcatcattaggcttctcaaactcatgaacttgagaaaatctgtagttatcaaacaaaggtaagcaggtgtaagtaaaatgccaaagaaaaaaaacattctttcaggaacaatgtcaaatcatgcttccaaaatccatcaaagatgcagcctttaatcattattttccctcaattattccagagatactacaatctacacaccatcaccattgacattggagtagtgataaatttcatatagatcattatattatacacaatctgtaaaatttacctagaaaaatcacgaccatcgattcgaacaaccatcaagttaggaagcatgacttcatcctccaattcgaatgatttcacatactcgtatttgctattcgccatatccctcaaggtttcacgaaagttttcttctttcttctttgcttctacgctatcgactttgaaactaccagacacaaaaaaaactgcaatcgaacaggatattaaaccgaaagctgagtcgacattgctctgtgaaagagaaaccaaactatatgagcaaagacggtttacttcacataaggagataaaaaaatggcagtattccttaccaatactagttcaggagcatataagattcttaatgcagtaccaataaagatcacaatcaattcaggaacatataaaactttccaataagatcattttctcaagttcaaaaacaatgaattcttagctagggaatcgtgtgcaggaaagtacagaatttcaaatcctcaccagtaagacaaggagaattaggacaagttttaataccttaagacaaatatg

SEQ ID NO: 30487 - DNA, 3000 bp, Unknown
  misc_feature (1)..( 3000): 2750-1469P.txt file - cDNA_ID_3031971; gDNA_ID_2214652; Annot_ID_188666
ctaccctttaccaacaatcttcagagctgaacactttccttacggcatggatcttccagacggaaaagctaacggaagattctcaaacggaaaacttatctccgacataatcgcaaccaaactcaacatcaaagagtttattcctcctttcttacaaccaaatctctccgaccaagacattctaaccggagtctgtttcgcatcagctggtgcggttacgacgacctaaccagtctctcgacacaagccattcgtgtctcggaacaaccaaacatgttcaagagttacattgctcgtctcaaaggtatcgtgggagacaagaaagcgatggagatcataaacaatgctttcgtggttgtgagtgcagggcctaatgatttcattttgaactattacgatattccctcaaggcgtctcgagtatcctttcatttctggttaccaagattttattcttaagaggcttgaaaatttcgtgcgggtaacgtctaaaatatttcttcatatatatattaccacaattagggttttggaacagactatagtgactgaaagttttatgataatttgtttgttttgttaatctctccggtgtatatgcaggagctttacagtttaggtgtccggaatgttttggttggaggtttaccgccaatggggtgtttaccgatccatatgactgctaaattccgcaacatttttagattctgcttggaacaccataacaaagactctgttttgtacaatgagaaacttcagaagctcttgccccaaatcgaagcatctcttccaggaagcaaattcctttacgccgatgtctataatcctatgatggagatgatccaaaaccctagcaaatacggtatgtacataaagatttttcttgctccacaagttatcttatttgtttatatatatatgattcgtgtgtgtggaatcgaaacagggttcaaagagacgaagagaggatgttgtggaacagggttcttggagacgagcttcatgtgtaatgtcttttctcctgtgtgtcaaaatcggtcggagtttatgttctttgactcgattcatccatcggaagctacctataatgtcataggcaatcgtctggatcctctgattcgtgggaagtttcaggcttaagtgatcatcacgatttgcaaaactgaaacaatgtttttttcttgtttcttaatgcaactatttgtcgacttttgtttttaaatcaaatgtactttggctcatatttgtgctttcaaattagccaaatatgccacaagtaaatgaattgatttcactttttttttaacatctaaaacaatctttcgtcactcattgtgatctttaactatatagtcttgaaataaaaattcattaatacatcaaggaggatacaaataagaccggaaagtttggccttaaatatttgccattaaaattgacagatttatatattttaatttgccaaactgttttatatatgtaggttagattgtatagaatttgacccacttttactttaattgaaaggtacaaaatcatatataagaagttggccgactctctaattatctcttctataaaacaattccaaatttctatgatgtacgaaaagactcgaagctttttcatagcgttttgaatcaaaatctttctttctttccatatttagtttttatcagtctactttatgactttctctttattctggtttccaaaatccatattagtcttctattgcagagtgtatctaacaagaagatatttcaaacccacaagacgtctaattacgatgtaaatgctaaggtttcatgttcttgtaagaccatctttattgggggtttctcataagagtttttcacaattaaaaatataaaaataatgaaaataaaggagagagagtatagaaagtttctcacttgagaaactttgagatactttgagatactttctacaacccatgatgatatttctcttctcactattagttcaagattttaattaaaataaaatttcaatcatataattaaattataataaaatattaatttctttttgtttgaaaaactttgtgagtttctcatgaaattgccctaaacataacttgctttatctcccatacgaggtttctaagatatcaaggcctcgtcttaataaaagacgagcatcatgcaaatgtctttttgctttgactttggttttagataatgtttatagggtcgcaaggtttggtgcacgttaatctgacaaattctgtttcttgggagtgtaatgagtatttagaattgatcaacaaaaatattcaacattttttttgaaaaactaaagtgaagacccgcttcaaatataaaaatcagtcgaactaagttttggtcgatctcccaacaaaagtatacaaccaaaaaaagtcacactttaagcttctttcactatttgttttcagatcccacaaaaagggaagtaaacaaatcgttaagaactcttcaaaacctccacttcgaacaatatgtttgcaaaagacacatgtcgttgagatttctacttcccaaaatacaaccgagtaggcgaagattacaataatgatctcatattttatattgaaaaataaaaatatttcaataatcatcatctaattcaaaaaaaataagaaaaaaaataagcaccagctaatctaatttaattataccgcagaatcaaagaaaatcatctggatcatggtcttaacatggcctacatgattaggttgagtaacaattattattattttcagcttttcaaagataacagcattgtttttcagttttatttttaatcattgggtgaaaagctcatcaatatctctatttaaactaaaagattcaaagctcttgacttatctatttgttagtcacttaaaaaggaaaaacaaactcaacaaagccagcaaggtaacaaaagaaatttcaccttataaattcatcaccaaacaacaacatttcttcaaatccaccaaaaacaaaaaatg

SEQ ID NO: 30488 - DNA, 3000 bp, Unknown; identical to SEQ ID NO: 30487
  misc_feature (1)..( 3000): 2750-1469P.txt file - cDNA_ID_3031971; gDNA_ID_2214652; Annot_ID_136440

SEQ ID NO: 30489 - DNA, 3003 bp, Unknown
  misc_feature (1)..( 3003): 2750-1469P.txt file - cDNA_ID_3031975; gDNA_ID_2214652; Annot_ID_188665
ctataggtctatagtcggagagtgttgtagggttagtgatttttggaatcatacatatgttagtatgatttatgctgggtttcataaatgatgtttcaaagaattttttgacttctaatataacatcgtatccgactatatcccaacaattcttataaaatcttgctgttaacccatcaggccctggggctttatcatctcctatttggcagatagcatcatatatttcggtgtcactaaactcttttgtaagatctaaattgactgtattagtgactgtggatttgaagtccgcaaagtctattggtgatacctttataccattggtgctaaagatatttgtaaaaaagtcctgagcgtggtttccaatttctttatctcctgtgaacatccttccttgatcgtccatgattgtgttcactcgattttgagaatatcttgtttttgtacaggcatgaaaatagccggtgttttgatcgccttccttcatccattgattacgactcttctgcttccaataaatctcttcgtcactaaaggccttcgctagtgactcttgaagttgtggaattagttgtctgtcaaccctccttgtactctccattgctctgtttaggctgctttgaagttttttgattcgttgttctgagtttaaattagaagcgtgtttcagtcttgccatggcttgtcgacaactactgatccgttccgtgataggtgtagaacgtgaattccggtttgtcctccagcttgtttgaacaatacgtttgaatgtcggtatgtcaattaagcggttatcaaaacggaaaagctttgatcgacggggaaatgactcgttgaagtgaactaggaccggtttgtggtcagagcccgtgaagtccaggaattctgtttcagcatatggaaatgttgcagtccaggctgaattaataaaaactctgtcaaggcaacatttgactgtgtgtgtatgtctttcccctacccaactgaatctatctccttttgatctcatatcttcaatgtcacaatgagaaaccatgtttctgaaatttctaaaagtccattcctctctcatgggaccaccaattttttcagcgttcgaaagtatctcattgaagtcacccactagcaaccattcagcatttcgattatctgagatatgttcaagagtttgccatagttgatgacgttcagattgagtagggtgaccatacacacaagacaagtagaagctcttattattaaatgttacatgagaatcaatgagtctttcatcctgagaaatcaaggataaagagacattgtttttccacataagagctaagccaccactccttccattagggggctgagttattacattagggaagcctaaatcatatgctagtttacatactttatcacactggtttaaggtttcaactaaaaataaaatatcatagttatacatacggaataagcgaaacaaccgcgattgagtcagcggcataccgatgccctgacagttccatgagatgatcctcatattggatcccttaggggtaccgggccccccgcgcctccgtcacgtccatcatgtatcgaacacgatcctgcagattcagtctttcttcctttcttgcaaagttgactcagaacgcccatttcatctgcagcttccacctgttggtacatttcttctaatcgaaccctctttctcttcatgaagacaaactcattttgtgcattgtcagaggactcaaggagcagatctttctcaaccggtgcgtcagttttaactcctgcaagtttggcgtgaaggtagcggagtctttcaactgtgaggtctgtgtcctcaatgacgcatggaaccgaataaccatctgaaagtttttgtacctggcgttgattcccctttgaaagcgaagattgaaggccgggaataagagtcgctggatccactgtctgaagagtatcagtgtcgcttatgtcatgttctttgttgtcgtcgtgatgatcgtcatcatcatcagcatcatcatcatcacttgtctccaccggatctgcccaataggagactaatattattttggggttctttttgtcagaaattacttggatttgttttttttttcaaaccacacagtaattaaaaataaaactttttacattggcattttggtcttaacagcattgtgattcttctcctgccaacaaaaattcatctaataccatcatcaattatatggattattacaattttgttttgtcatttcattctaaaaaatatgagtgatctaattcttgtaaaattttgatgtgtaacctgaaatattgatacactaatctatagccaattaaaaatgacaaaacataacattgggtaaatagtaacataaaaatatacatgaatcataaattttaaaagtatgctaagtatgtataagatttaaaaaaaaaaagattttaagagagttataacagtaacacacttgaaagccgaagttttgttcttccttgtctcagcgccgcgttttttctctcctcatcctctcgatgaattcctctcaagcttgcttcttccatttttctcttagaccaatctcgctttcgcatccctcctatgccttcctctcgaaacgtaagttttccttccccaaattaagtgcttgggaatcgaaattttaagagattgttgttacctagactagttcaggatacaatcgttagagtttcgttgcttcgaattgattaaaccctaatttcaaaagcacagacctgggtttttcactgttcctgcaaagttgataactttttcactgatactatctcttagactagttctcttaacccggaaattctctcaaagtatccaactttatgaacagaaacaattgttgaggcatgtgttttgaccttgataatgtttttgcaggagacccatttctgtgttctcaacccagaaaatgccttactacgaatttgaatatgtcaagaacgagacaagggcattctatacaaatg

SEQ ID NO: 30490 - DNA, 3000 bp, Unknown; identical to SEQ ID NO: 13791
  misc_feature (1)..( 3000): 2750-1469P.txt file - cDNA_ID_3031983; gDNA_ID_2214652; Annot_ID_188663

SEQ ID NO: 30491 - DNA, 3000 bp, Unknown; identical to SEQ ID NO: 13809
  misc_feature (1)..( 3000): 2750-1469P.txt file - cDNA_ID_3031995; gDNA_ID_2214653; Annot_ID_188706

SEQ ID NO: 30492 - DNA, 3000 bp, Unknown; identical to SEQ ID NO: 13812
  misc_feature (1)..( 3000): 2750-1469P.txt file - cDNA_ID_3031999; gDNA_ID_2214653; Annot_ID_188705

SEQ ID NO: 30493 - DNA, 3003 bp, Unknown; identical to SEQ ID NO: 25227
  misc_feature (1)..( 3003): 2750-1469P.txt file - cDNA_ID_3032003; gDNA_ID_2214653; Annot_ID_188703

SEQ ID NO: 30494 - DNA, 3000 bp, Unknown; identical to SEQ ID NO: 13807
  misc_feature (1)..( 3000): 2750-1469P.txt file - cDNA_ID_3032007; gDNA_ID_2214653; Annot_ID_188702

SEQ ID NO: 30495 - DNA, 3000 bp, Unknown; identical to SEQ ID NO: 13807
  misc_feature (1)..( 3000): 2750-1469P.txt file - cDNA_ID_3032007; gDNA_ID_2214653; Annot_ID_136463

SEQ ID NO: 30496 - DNA, 3000 bp, Unknown
  misc_feature (1)..( 3000): 2750-1469P.txt file - cDNA_ID_3032011; gDNA_ID_2214653; Annot_ID_188698
tttctatttcatattgaattaggagatgttactgtccgtcagattctctagacttttttttttaaagactgatctatgatcagaattccaattttttttttctttaaggaaatacatcagagagaaaaattattacgaaacgattctattacaagtaatgattttaacctttttttttttacaattgacaatcttttcacaacaaaaatccacaagaaacgttagacaatggcataaatttatttaaattaatccgtatatattcgccttctatgagaattgaattctataccactgtaaaattcttaaacgagataagattattttcagcatgtaaaaaatggtttgtggtttcaactcatttgggctattagttttacatttaggcttgcaaccttgtcggtttattttgtgtaggcttttggtagatttgggcttgcaaacccaaattaacttgttggccgacatacatttgtttctattacaaatttaacaacaaacgtcaataaatacacgtgaaggaaatgagaacgaccctcttaagtagtactggaaattgaaaaaaagaaatctagaaatgctaacatgtaagtttttgttaccaaaaatgcaatttgtatgtagccacaatttcatggccgacctgctttttttttcttcttctttctgaaaaccacaaatatgattacacgtggcctgaaaagaacgaacagaaactcggtaatgtgcaaaaaatatcttactcttaatacgtgtaattttggagtgtaataggtctatcgatctataaaacgatactattggagattagattcttctcatctcactttgttcatctaaaaactcctcctttcatttccaaacaaaaacttctttttattctcacatcttaaagatctctctcatggcgatgtctttctcaggagctgttctcactggtatggcttcttctttccacagcggagccaagcagagcagcttcggcgctgtcagagtcggccagaaaactcagttcgtcgtcgtttctcaacgcaagaagtcgttgatctacgccgctaaaggtgacggcaacatcctcgatgacctcaacgaggccacgtaagtctacattctttcttcttttagtatcttgcctcataagtaaggatcttagcaggcaatgtttatggtatactatattagtatagattttagtggaaatatgtttgttttgaacttattttatgatcatatttgactattatcaaagataaagattcatataccgtacattatatatctctatttttctagtttacatgtatagctctaagtttatttgatgattctgttgactacttttggatatgtgttttgaaacctttgataaatactaaaataaattttaatttgaaaatgatatagaaagaaagcttcagatttcgtgacggataaaacaaaagaggcattagcagatggtgagaaagcgaaagactacgttgttgaaaaaaacagtgaaaccgcagatacattgggtaaagaagctgagaaagctgcggcgtatgtggaggagaaaggaaaagaagccgcaaacaaggcggcagagttcgcggagggtaaagcaggagaggctaaggatgccacaaagtagggtcttacctaatcagttaatttcaagcacttaaactcgtagatatattgatccatatcctctctcttcatgtttaatagtacttacaataagatgagtctgttgtaatttctattaatttcacatcacaactgaaataagatatggtatccacagtcaccgtcacattctttaatgttttgcaaaatattcaatagacaaaattaaataatgagtaattataagtaacatcgccgtctagagtctttcaacggtgaaaggatgagagcatatgggagatcgatagccttgtctcttttgtgacgaaccaataaaagaggaactgctttttttcttcgcatgtccactatttactgtttggtatgacatcgaattggtatgatacattgttgtaccaaaaacttcaaaatttggtggcttgtaatcaacattgatccacttagccattccaagcagtgaattacaatccgtggaaggaaaaattatggtccggcaccaacaaattatcacctcatctcccgtcacaaacatatcatctagaagtcggtatgccacaccacataattaaggagcacattactcacatacccaaccaatgtgggacatatctaataagctcattcttggctggtacatgctctatttcatatttatcaaaaaaaaaaatattaggcattgtaaatagcgtttttgctgttgagcaaaatagttatatttgaaagtaacattggtatttataattatagtataacaattaggcattgaagtgtgagtttttgtttttgtttatttaacattggagtattaggttcttagaaatatatctatatactattagtagtttaactacagtttgtacttaattgaaaaaatgttaaaagttgttttaacctagctaattgctaaaaatgactaaatagacatacacaaagacttgtacattttcagcttaacgactaatacatttttcctttatatatatatctctatcgagtctagttattaatgttgaaagttgcaaataaaacagaaatgctaacatgtaaatatcgtagccaaaaatgctaacatgtgtataacggttataaccacaacttgatggccgacctcttttttcttttggtaaccatagaaatggttacacgtaactagtacgaaccaacgaaaactcttcttattcgatagttaaagataatagcaatgcgcaaaaatatctagcactcacacgtgtagttttggattctcattggtcgagagatctataaaacgatactattggaggttagatttttctcatctcactttctccatcttaaaactctttcttgtatttattttcctcccaaaaaacatctttaagagtcctcatg

SEQ ID NO: 30497 - DNA, 3000 bp, Unknown; identical to SEQ ID NO: 30496
  misc_feature (1)..( 3000): 2750-1469P.txt file - cDNA_ID_3032011; gDNA_ID_2214653; Annot_ID_136459

SEQ ID NO: 30498 - DNA, 3000 bp, Unknown
  misc_feature (1)..( 3000): 2750-1469P.txt file - cDNA_ID_3032045; gDNA_ID_2214654; Annot_ID_188734
cacatcacattttttgaatcgaattcacgttcacaatattcgtacggcatatatatatatacatcgtgaaggaagaaaattgtaagaaattccacatactttcaggcccttataggctaacacaactctatatatattgaatgagggttttctcaaagtcaagtactagagttccaaatatttgctagatatatgcgtaggctcctttctataaatgatggagtaatttatagttgaatatttgagtggttttgttgctaccatttatgagatgatctgatgatactttttaataatgacttaatcttctatataactgatttggtttaagataaagaaaaggataaagattgtttcatttagaaaccgaaaataaataattattggagttgttgattttggaatgatctaagatctcacagtcagctagttcagtctacggcccgacactctggttggtgagatgttggatcccttctcccagcatggagttacagtgagttttcatagttttcttctactattggaatattaaaaactagctaagtttaaatttcaaaaataacagaaaaagctagctagccaataagtttaatatataggtcaataaaataaatctatgagctcgagtaatatacaaatgttatattgaattgagtattgaatctctatatagagatggagatgaaaagctatatatgtacattaattttgaaactgatattagaggtttgacaatcagtggacgtgaagggccaccacacccacatgtgacttgatagcgactagaatggaaatgatatcatgtgtgtttgtaattaaaaatgaagtgcaactttcgtaaaaggactactggtcattaattatgattccaacactcatcatctttttcgctgtaaatagcatatcatatgtatatatgtacttggaacgattctcctgttaacttggaaatagctagggaaaacggtctactaatttcgaaaatcgccaatagaaacaacaaatcaaattcttgtgaaaataggctataaaattcagtatccccaaattaaaaggccaaaacttttatttgttacaaaaataatggtaatagatttcaattacaaagacacgaaaagcaatcgatttccaattagttctaacaaaacattccattacgcagtcattaactttggagctggtgttggagcttcaccataaccgtttttgtgtgtgtgtgtgtgtttacgtttgcatgtttatgttataacataaagttaaagcacaaacacaattacaaaaacgtaaagaaaaaaacgaagaagaccaatgctttgttgcggtggcaactggcaagagaccacaaacgcaaccgcgtgagtaaacttcaataattcttgctttgtaaaatttcatgaaaaaaattgtcactgttatcacaaacaattaaaccaatattttgattcaactggtggagtttattttcgttattattttggttaaaatgaaaaatctattttgttgtggatgagcttgtggtgagcaaacttttgtctttgttttcaactactagttgggaccatgaactgaaagctacagtttgaattcatttgctgttcctttctattactgaaaaacatctcttcatttgattttcttaacggtaataaataatgtccgagtttctcgtgggataattgatgatactccaacaatcaagtgcttgccgttttcatcgactcaatggggcacttgtaaagaaaaaaacttgggtcagaaatagtaagcctcataacttaaaataacccaagaataatgaagcttctaaaattttgggccagaaatagtaaaagaccaaatgtttgatgatgaagagactagagagatagactatgatctgcccaaaataaacattttagatctcgtgaataactatggcctcaaagtgaaacggttccaacgtcgttaaccggttttatgtaaaacgaaaatcttcctctttctgatttggttaaccgttcggttcatccaaatcgaaccccatgaaccgaacgaaaccgaaaaccaaaggagatcagaatttgtttttatttttattttacatcaagggaaatcataactgatttggtaatgtttttggatctgcatctgctgcataaatttttatgattgattctttgattattgattttaaaagtcaaacttatcatgaatttcgtgtggtttgttgtgtagctcctggtattgctatggcttaacgaaagtacctatggctatggctatggctaacaagaagcagtggattacaaagctctcgctaatatcattatacaatgcaaccttttttattactagttggtgaggtgttaattaatcccttctcccagcatgaaataaatgtggaatccaaaacagaacattttgaagacaaagttaattacaatgattttaataattttatcttctactgtattttaaactagctatgttaaatcgtggggtacgtatgtatgttcccatcacattttgattccttttggtgcttgtaaatagtttttcatatttcatatgacaaagagttttattctataatattctctaatgttacacccatgtggttgcacaacttgcagttgcatcttcccttttaaaagttgtattcttctctttgaataaattcggtcttagaactcttccacaagccacaagaggagcattcatttgttgacaactttgaaaaaggaaggttccaagacaactcaaaagtcttgtagtttccccaaaataaccccgttgacttcagttaatagatgctaaacaaatagaaaccggaagggtattctcgtatttcagaaaaacccgccgcgtgggttcgacggttacgactctctcaacttcattcattcatttgaaaaaaactcacttttctccttttaattctctcttcctctttctaagaaaccgaaccaaaaaaaaaaaaacccaactaaaaacttagtcttttgtcttcacaaaatg

SEQ ID NO: 30499 - DNA, 3000 bp, Unknown
  misc_feature (1)..( 3000): 2750-1469P.txt file - cDNA_ID_3032053; gDNA_ID_2214654; Annot_ID_188728
ttgataacttactttggttcaaaattggtcatcatttaataatacatgtatttaaattcaaaaaaataatacatgtatttttataaaggaaatttcaaaaaagaaatatcaaggcatagatgaatcaaatcaatcatgcaaataaatgtttgtttttcgggaacgtttccctcgcttttagttaaaggttcaagcaatatatataaccgagcaacaaaacaatgcaaagctaacaacaatccctagacttgtcctcttcacgcttgatccggcagatttgtgctcatcatcagcagctggagaatcggcatcagacgatgaagttgaggatttcggggcaggagctccggtgggagtggtctttgttccgaataactcctccggcaacaacacactgtccaccacgtaaactgctagaggaaactgttgccttaatgcattattgatccgagtctcaacaacaccggtggaaacattcacttggttgctttgtgcttgtcctgtgaaatttaacccaaaaacacctccgtcttgtcccgtagcctgagttctaacgggattacttgctaagagaagatcgcttagagagtagtattttggaatgatatggtagagcatgagctggatttgttgttgatatgtcagactgtttagggttccgggtttaagcttgttgaatgcgttatctgttggggcaaatatagtcatcccttggtcagagctattgagttgtacacttacctgaaacccgacttgagttgtgttgaggagttgtattaatgtggtaaattggtgaccagcttcaagaatcgctgtgagattgatgggacttttttcagtggttggagctggagcagtgggctggctttgaatgtatgggatggtgaaaaggaagattaagaggacaacataagagaatagtgacgaggacatggcttaaaatttgttatatttttctctatctctctgtgtgtgcttgtgctagagctaaccctttaggtattatatagaaagattttaaggagagatttaagacgacatgtatgcgtgacttgcaaaagaagttgatccattgtttttaacaacttagtctacattttacgataatgtttataattaagaaatgcaaaacaatactataagaaggttgacaaaatgtatatatatatatagaattgtatcccacatccgataagatcataagagatttgtagggcaatatatatcgtatatagtatacaaactcatggttcaccagttagattacacaacaacaaaaacaacttgaaaatgttagctggtcatggttcatgaatatctttacatttttctgtatttaaaatgatgtggatacgtgtatatagtcgaatatagtctggcattgataggcaacgtgggggtcatatatattataacaacgaaactgctctacatgacattggcatgggcaaaatttgggctggaactggaaaaatcctcgtagggcatgactataagaaaaggcccattaaaaacatgaaaaattaacaaagttggaatcataatcgactgacgaaactaatctgttaaaattatgtgactttcttaatacaaaatagcgttgtactggtttaggattaaaatcgttcggacctcttgtggccttgtgggcacatggtgcgccgtgcgtagctcacgtgaggactgacgatgacatgcagcaaaaataataaaaagaatacgtatttagcagcagattcagacaaactcatgtgcgtttcaaaaatgacgtttatatccccctaataattatattcactctatccactttgacaaaaagatcacgttaatttgaattctaagggtaaaagcgtcaaagtatgtctctttttccgaggtaatagcaataggcaactagaggagaccgataactcaagcaaactcagattcttgatagcgatttaatgaagacccaagagtcccaagaccaagggctgattaattaatgctgttttaaccatatgcatatcatggacacactttgttctccgagtcgactcgttctggtcaccttcttcctcctctgcttctttgccggagattcatcggcgacgaggcctggtttcatctacaccagacacagaggacgatgcacgccgcagtaaatcaatcaatcttgaatttcattttctttacaaaaatctttagctgagtcatatctcaactcgttggtggtgtttttgagcaggtattggagcagccagagggaagcatggccgaggatggtacctgagagatcaaccgtggagaaaatattcggagtgatggtagcaaaagaacggtggagatctgatctaacgctagtggaatcaacggctaggaatgacgaagaagggaacgcgtacggtgcattgctgaaacaggggatcgcagctctgatcaactcttacgcgagaaaaagtttctcttatgcaccatgggaagtgaagacgatgctgatccaagccatggtttcggagtcggcggctcgccggcaagccgaacatttcgccgtcgctaacgttgcttgtgactaaaaacactgagacagttacttttgtcgtctttaggttttgaatttaagctttttgtcgtgtaaccaaagtttgattccgatcagtttgctactagattatgggcctccgaaaggcccaaattaaacacagaccttgagcgctttgtagtgtttgggaacgactcttcttatatactctctatttacttattaacccgactcaggatatgtatatccgactttccaaacaaatctttaaaatatggtacagattcgaatctaatcccctcttcttttgtttgtttgtcaagtaatttttttgaactttccattttcttccaaacaatataaccagaaatatgtttttgtatcttaatcattctcgaggaccgattcttagggcttttgctgctctgtttcttcaaatcttgtttgtacaattcactacgaagaaggttgttctaatg

SEQ ID NO: 30500 - DNA, 892 bp, Unknown; identical to SEQ ID NO: 25231
  misc_feature (1)..( 892): 2750-1469P.txt file - cDNA_ID_3032076; gDNA_ID_2214654; Annot_ID_188717

SEQ ID NO: 30501 - DNA, 3003 bp, Unknown; identical to SEQ ID NO: 25238
  misc_feature (1)..( 3003): 2750-1469P.txt file - cDNA_ID_3032193; gDNA_ID_2214656; Annot_ID_188773

SEQ ID NO: 30502 - DNA, 3000 bp, Unknown; identical to SEQ ID NO: 13832
  misc_feature (1)..( 3000): 2750-1469P.txt file - cDNA_ID_3032205; gDNA_ID_2214656; Annot_ID_188765

SEQ ID NO: 30503 - DNA, 3000 bp, Unknown; identical to SEQ ID NO: 13846
  misc_feature (1)..( 3000): 2750-1469P.txt file - cDNA_ID_3032265; gDNA_ID_2214657; Annot_ID_188803

SEQ ID NO: 30504 - DNA, 3003 bp, Unknown
  misc_feature (1)..( 3003): 2750-1469P.txt file - cDNA_ID_3032281; gDNA_ID_2214657; Annot_ID_188799
cttggtgatctttccccttctctgacaagggtcctattgtgaccagagtatcccgaaacattgtaggccaccaaaagcctgcttgaagaactttggatactgttttgaaagttgcaaaatgaccaccatagctagagctgtgacaatacgatagtatatcagggacctctgttgcagcaatgcatctcctgtaaattccatcagaacaatgcttatatagataaggctcatcccaatgatatcgcctaatctctcgtaggaatctattcttgttgtaatctgtaaaattatcaggctgcacatctgcagctaggtaattaacaatgtcagcataccatgggtaatctttctcgaccgttgtgacggtgcaattctcggttggtgaccaatttcttgtcgatttagaagggtgtcgatcgacaggtgcaagggtgtcgatcgacaccatcgcgcaactacaaatatcaacttcctctgaaatatgagtgtcgatcgtcataatgggtgtgtcgttcgacactgaagcacgatcctgcaacctgtcacgtttgtagtcatcgtcttcagctgtatcaatcatgtatatgttctcttcaggcaagaaatcatttatagggacatcatcatcgatcctaatgcgtgacaaatgatcagatacaccattctcaactcttttcttatctctaacttctatgtcaaattcttgaagaagcaaaatccatctcaaaagtcttggcttagcatccttgttttgcatcaaatacttcaaggcagcatgatctgtgtgaacaataaccttggatccaacgagataagatctgaatttttcgaaagcaaacaccacagctaacaactctttctctgtagttgtataattcctttgagcatcatcaagagttctactttcatagtagattgcatgaagtttcttatccttcctctgtcctagaatagctccaactgcaaaatcacttgcatcacacattacctcaaaaggtaaatcccaatctggtggctgaacaattggtgtgttgatcaaggcctgttttatctgctgaaatgcatcatgacacttctgtgtaaactcgaatttgacttctttacagagtaaagcagtcaatggtcttgcgattctgctgaagtctttgatgaatctcctataaaaaccagcatgtccaaggaaattcctcactgctttgacattatccagcgcttgaagactcgtcatgacctcaatcttagctctatcaacttctataccatgctcagaaatcatgtgtcctagaactattccatcctgtaccatgaagtgacatttctcccaaatcaaaactagatgtttctcctcacatcttgctaacactttgcagagattctctaaacaatcctcaaatgatgatccataaactgaaaagtcatccatgaaaacctccatgatatcctcgatcatatctgtgaagatagacatcattcctctctgaaatgtcgcaggagcattacaaagaccgaagggcattctccgataaacaaatgtaccataggggcaggtgaaagtcgttttctcctggtcatctggatgaatcgggatttgaaagaatccggagtatccatcaaggaagcaatagtacttatgatttgctaacctctccaacatctgaccaataaatggtaaggcgaaatggtctttcctggtagcagcattcagctttctgtaatcaatgcacatccgatgtcatgtgattgtccgagtaggaattagctcgtctttctcattcttgactactgtgacacctccctttttagaaaccacatgaactggactaacccaactcctatctgagattggatagataatccctgcttccaacagtttcataatctctttcgtgaccatttctttcagattcggattcaaccttctcttatgttcgactgaagacttagactcatcctcaaggtgaatcctatgcatgcatacatcttgggatatacctgcaatgtcatcaagagagtagccaagagctttgcaatgattgcgcagcttgcttaggaataaggtgagctctgcgggattaagagaaacattcacaataacaagataagtagaattttcactaagaaaagcgtaccttagccctgctggaagtggtttcaattcgattttaggagctttggctggatcccaatctgaagtaggagtcggcgttgaagtcaaagatggaagagcttcttcaactgtaagttgcatcacatgttcggtctcatctagcagcttagtatatgttgaagtttcacagtccaaatctgcactatcctctatggaagagaccaaaactcgcactagtggtttttttaattccatctctcaaatactatctgaaactgaggaggtgaaaggatctgttaagaaggttttcccttctatgatcggtttcttgaccaaagtgttcatatcgaattgcatagttagatcaccaacattcagccctatgctcccttgtcgaacatctatgattgctccagctgtgtgcaacaaggatctccctaggattaatggatccttagagcaggtccattgggagggccttaacagatccttaaccaaaatctttgagtaattttgagaaaaaataaataaaaattttgattaaatgttaggatcgcacctaattttaggatttttgatgatgttaaggatcggatacgtggcatgttttcattggttgagcttttttgacaaaacaagtttttttcttctttgcctttttttttcatttatcgatttctctctctctcttgaactcggctgtgcaattgaacgattgattatcgccggaagatcttcatgcttttatatgatcaaatcggaagagattatcgcccggaagtcgtctctaatccactgtgctcatcatctcaaccgacggtgctcaacgtcgacgagtttggtgaacctaatcggagaggattgtgaatcatatcggagtcttgtttgaaaccatg

SEQ ID NO: 30505 - DNA, 3000 bp, Unknown; identical to SEQ ID NO: 13849
  misc_feature (1)..( 3000): 2750-1469P.txt file - cDNA_ID_3032291; gDNA_ID_2214658; Annot_ID_188828
  misc_feature (46)..(46): n is a, c, g, or t

SEQ ID NO: 30506 - DNA, 3000 bp, Unknown; identical to SEQ ID NO: 13853
  misc_feature (1)..( 3000): 2750-1469P.txt file - cDNA_ID_3032291; gDNA_ID_2214658; Annot_ID_136510

SEQ ID NO: 30507 - DNA, 3000 bp, Unknown; identical to SEQ ID NO: 13848
  misc_feature (1)..( 3000): 2750-1469P.txt file - cDNA_ID_3032295; gDNA_ID_2214658; Annot_ID_188826

SEQ ID NO: 30508 - DNA, 3000 bp, Unknown; identical to SEQ ID NO: 13847
  misc_feature (1)..( 3000): 2750-1469P.txt file - cDNA_ID_3032302; gDNA_ID_2214658; Annot_ID_188822

SEQ ID NO: 30509 - DNA, 3003 bp, Unknown
  misc_feature (1)..( 3003): 2750-1469P.txt file - cDNA_ID_3032325; gDNA_ID_2214659; Annot_ID_188852
cattttatggatgttgcagatattggagtgatgagtggagctgcaattttcataaaagacgatttgaagctgtcggacgtacaacttgagattcttatgggaattctaaatatctattctctgatcggttcaggagcagctggaagaacttccgattggatcggaagacgatataccatagtgttggcaggattcttcttcttttgtggagccctactaatgggttttgccactaactatcctttcattatggtcggccgttttgtagccggtatcggtgtcggttacgctatgatgattgcgcctgtttataccacggaagtcgctccagcctcttctcgaggcttccttagctctttccctgaggttcaatagatccaaattttactagtttatatgatataaaaaaaaagaaaattaggtttatattaatgtgatatgattttatatgcatgcagatatttatcaacattggtatactattgggatacgtatccaattacttcttcgccaagcttccagagcacattggatggaggttcatgttaggtattggagctgtgccctcagtgtttctagccattggagtgttggcaatgcccgagtctccacggtggctcgtcatgcagggtcgtctaggggacgcttttaaagtccttgacaaaacctcaaacaccaaagaagaagccatctcaaggctcaatgacatcaaacgcgcagttggaatccccgatgatatgacagacgatgttatagtcgttccgaataaaaagagcgctggaaaaggcgtgtggaaggaccttctcgttcgaccaaccccgtccgttcgacacatcctcatagcatgccttggtatccatttctcccagcaagcctccggaattgatgctgtcgtgctttactctccgaccatcttctcaagggctggactgaagtccaagaatgaccagctcttggctacggtcgctgtcggagttgtcaagactctcttcatcgtagtaggaacttgtttggtggaccggtttggacgtcgtgccttgttgcttacgagtatgggtggaatgtttttttccttgaccgcccttggaactagtctcacggtgatcgacaggaaccccgggcaaacactcaagtgggctatagggctcgccgttacgacggtgatgacttttgtcgcaacattctcattaggtgcaggccccgtgacgtgggtctacgcctcagagatattccccgtgaggctaagagcgcaaggagcaagtttgggagtgatgttgaatagactaatgagtggtattataggaatgacattcctatctctttctaagggtctcaccatcggtggtgcattccttctcttcgccggagttgcggttgccgcgtgggtcttcttcttcactttcctcccggagacacgtggtgtgcctttagaagaaatagagagtctcttcgggagctacagcgcaaacaaaaagaacaatgttatgagcaaagggaaacaagtagttgatgaacaatgagagtgaaacaaaatttgcttccatttcattatttggttaatggaacgtcgataccaaaagactcggttccgatccgagtcttcatcgggcgagtgtgaccaataagaaaattaataaagaattttacttgccatctctaaattcatgttgtatatctttaataagttgtttgcagagaacgagattaagaattaaacttttataatctgccatttcaattaataaatgcaacataggtttgattacaaccattttttttttttggaaaacttattaaggtacgtacgtttcggttactagattatttgctagtttagtttataactcaaaagtgggtttgatgatctacgatccttccaattagtctaatactcctatacaaaggtggtgtgatgaaattgttggtggaattatatttaatatcttattatcgttatgaaatatattgaatacatttgttaaaattagtaagtaattaactttatagatgtatataaatgtcaaaattgatatatgtggtaataaactttgtgtttatatgataagtctttgttaatttatcgaagcttgtagaattgtcgtttctatttaattggtttagggtttttgttgggttatgagcctaaatttatttatttttgttaaaaaaaagataacaaagtataataaattgcataaccacacatgccgactaaaaatcatttacacgtatattatatttacttcaaaagatgagtttgtacggtgacatgcatcatcaacaaacatatgttatatgaccagcaccaggaccatcaatccggtcactattctcgtgaaccgtccggccgtcagattttctttgttatgaataaagtttgctagttacacaaagtaattagagtaccctcattaagagtatttaacttgttacatagctacacataacaactaaattaatgtataagtaccctcattcttagcaacaaaaaaaataaagtaccctcatcaaaaattggattattacaaaatgacggacaccaacaagcataagttatatgaccaacattataatcatcaattaagtcactaatttggtgtacctcgcaagaaacttggtaaagattagaacctaaaaatataagagcaagtccaacggtgcatcttaacacatatcttagcataatatcttaggtttaagtaattaaaattaaatcaaaaatgacttaaatgctaagatttacatcttagctaaaatcttttatgtgtgctaagaagcatggacgtgtcctgaaatgagtggtccaaattaaagacaaaaccaaaaaataaaatcacgcgttcatcttctctttctctctttttttttttctctttctctcgttctcgagacatgcaaaacaaacacaaaaacttcaccatccgactcgatccgatgaattgagaagagatttgagtcggaaattcttcgttcatctgtggtcatcatcattaaccgaatatg

SEQ ID NO: 30510 - DNA, 3000 bp, Unknown; identical to SEQ ID NO: 13855
  misc_feature (1)..( 3000): 2750-1469P.txt file - cDNA_ID_3032337; gDNA_ID_2214659; Annot_ID_188847

SEQ ID NO: 30511 - DNA, 3003 bp, Unknown
  misc_feature (1)..( 3003): 2750-1469P.txt file - cDNA_ID_3032341; gDNA_ID_2214659; Annot_ID_188844
gatcgcttatcgtatactactcaccattccggtttcagttgctttggcggagagaactttttcaaaattaaagctcataaaaaaatatctacgttcgactatgtctcaagagcgattgaatggtttggcgctgatatctgtataacaagaactggttgagaagctcgattaccaaaaattgatgaatgaatttgcaggagcgaaagctaggaggattatgtttcgccaggaagaaaactgagatttctatttattttttttcttgttaacaatttttatgttcaattttcttaaacaaaataaatttcatattattttattttgcgaaaaaaatatatttgggcatcaattttgaatttgctttaagcatcaaatatcctcggaccggcactaaatctagggttaccattctgcttcttcttccatcttttcttctgctttcccatgatttaatttcctttgaaaattttccaatggaaacaatgtcctattctttccgctgcacgctgcattttatagattttttttagattcacccgtataactatgattaaataactctttatacaaacaatctcgacttggcccagtggtctaagtctctctcttttaccctacgcgcctactagcgcctggtttgaccttttacatctacatctttttctctctttttttttcccttcatttaaaccagatcgaaccagtttcgattcggttaaattatcgaaatagtcaattacaacatcacaatatcgactttttctactggttcacttggtatttttaaacgacacttatatgtaagatcattgtttctattattgttatacgaaccaatctaaatatgatttaattagctacccaatcaaacccctttctttcttaaaaacatgttattttgttataatctggataagtatggatcctaccaaaaaatctggataagtatggatgtaattatccatcactcatctatatccataagatatggataatgcgtatctctatccattattttctccctaagtctattatttcctcgctaagtctattacttctttgttaagtctattacttcttagtaagtctattactttttcgttaagtctattactttattgtaagaagtacagagaagagaagagaatgagtaagcaataagaaaactctcgtttcggtctttactctttttagttttcattcttctttaaatattttataacaggttatcagtaagagcgtctctccgggtgattgtctaaccgaccgatcgtctatttgttcaagcatcttttgaggtaatatttgaattatgttaaattcattttaattcattgcggcggacccataaatactttttaccgaattaaactacaacttaaaagaattagtaatttaaaaaaattaaattactaaataaaattatttccttaaaaaagaccacaaagtaggttaaatatttatgggtgaatcaaacaaaaaggctaaaacatgtcaaaaatagtatcaaaacacaaagtagaagaaaaatatgatcaaatttaaagggtttcgatacaaatttctaatttcaagggggtcaacagagaagaaatataaataatattttaaatatttaaagggctgtaatacgaatttagaattttccagggcatctcatcccttcccatctatactctttaccgtgtcaaaataaaacttaaaataattaataactaaaacttttaaaaaatctttatttactgaaaattaccacaaattaggttcaaactttattggtgaaacaaacaaaaacaaatacaaagagtaaaaacatataagaaatagtgttaaaacacaaagtagaagaaaaatatgataaaaacttatagcgtttacatgcaaatatgtaattttaaggagattagaaccgaaaaatataattaatatcataactattaaagggatataatgtaaatgtagaattttagtgtggttttcccctttaatcatctttgggtctgcccatacatatttcttatcctgaaatttgaaatagacatgcgcgattttcttaacaacttataaacaaatatgttcttatacatttttcttacacaacttttaggatatttatcttaggattttatttatttattttacgtttaaagattacaaataatttttagacgttaccgccacaaaaaacttatccacaaaatattttacgttattttattttacgattaaagataacaaaaacttatcggtttattaataattgtcttgtggatcgtcgtataccgtaatttgataacaattctaaactataaattataaatattctataaatagatacaatttggaaaatttaatatatattaactttaaaaaatagtgttaaaaatctagttttaaggttaatagttgagttatgttctaaatctttccaagtttatatatttttgtactttaatgtttactcatcaaaaataaattaacaaaaactcttatttcaaaagcaaagtcaatagtacaaaatatcaagttttttcagaaaaaaaagtgaattagcgtattgaattttaaaaagtgaaggtttttatatgagagatgatttttttttctataattaccataaatatctgatccttaactatgtcagcagaggatatacatttgttttttgttacaaaagagttgggttctaacttcaaaagagtgaaggtttcaaacagttaaaaaaaaacatttactgttaatatttataatttcatcaataatgggcagaaagttttataccaattaatattctacattcttattctcttatggactttcttacatttgcagcaacttaaagattccacttgataaactcccatctttctttttggatgctccaagtcacttgattaaagcttctccagaatctcctctataaattatgattcataccaaactcttgtagacaaaaccgattttcaaaaaaacaaaacataaaaatattttttaaaaacaatg

SEQ ID NO: 30512 - DNA, 3000 bp, Unknown; identical to SEQ ID NO: 13861
  misc_feature (1)..( 3000): 2750-1469P.txt file - cDNA_ID_3032436; gDNA_ID_2214661; Annot_ID_188877

SEQ ID NO: 30513 - DNA, 3003 bp, Unknown; identical to SEQ ID NO: 25247
  misc_feature (1)..( 3003): 2750-1469P.txt file - cDNA_ID_3032467; gDNA_ID_2214662; Annot_ID_188913

SEQ ID NO: 30514 - DNA, 3000 bp, Unknown; identical to SEQ ID NO: 28220
  misc_feature (1)..( 3000): 2750-1469P.txt file - cDNA_ID_3032530; gDNA_ID_2214663; Annot_ID_188925

SEQ ID NO: 30515 - DNA, 3003 bp, Unknown
  misc_feature (1)..( 3003): 2750-1469P.txt file - cDNA_ID_3032538; gDNA_ID_2214663; Annot_ID_188922
ctattttgaagtttttaatttttgaatttcgccaaaacgtttaccaaatttgtgagacttgcataaaacacgagtggtctattcagcctataaattagttgaatgctacaagcctacaagcttaaaataaatcgaaaattttatatattaattaaaacttataatttgtttagttctgttttctttctcagtgactgttgattttatatataattgtgtctgacctaaattgtattgcgtatgattgaaacttgtatgatttgtagaaaagagagagaggaggagtgtctatatgtttttatttctttttgtcttggatccattaccatatctataggtctcagattctatgtttacaacctaaactgttttcattatctatgaaatatttacaatttagcaaaaaaaacaatgacaatctactcatcaagaggactagatgatgactttcaaatcttttttttttggttttttttttttttggcaaagatgactttcaaatctttgcaaacaaaatcaaaatgtaaaaaatgagagagagaaaccaaaaataataatgagaaaatagtctattaagaaaagatgtacgtaagaattaagttaaaatgtaacactaaaataaaagaaaaaatcaaatgtatgataagaccctcatcaaaccattatattgaagtaaattatatatgtatgaaaatgaaatatcaaagagttcttttactctcacttatgacacgctaaattaaaaccactaaaaaccataatattaatttcacggctacaagttgatgcttcctcaaacttactacgttccaatgccgggcactgattaaatatggacttcacatctttttttttttttttagatattcatttccaaacggtctattgacagatgggctaagaatttcacgggttacaaaaaagtggtccaaatcggaacataatagaaacaagatcagtaaaacgacggttcaccggccggagacgcagccttcaccttctatatccgatgcaaatttaacatatttcgaacgaatctatgagatctatatgagaattttgcttcttgggttttatacggttcgggaaagtggatgtatcaagttgtgacaagaagcatcaaagaatatgactttgtccagtcatttttatggtatagtgatgatcgtcaatgatcataattggctaggaagaaagagcacatgtgcattcatatgattatcataattgtgcatatcatatgcttttatgggcatagttgtcgatagaaacaaaacatgcgtcgaggaaaaaacaaaagaatagttaaaacttagaatctttgattctcatgagccatgaggccatgtgctttttctctcccacgttatatgttttaccatccttataatttgctcccccgacttctctcactttcagacgaaaagaactgctgtcgcgatttttgaacaattatggaaaataatttagatgtgaaggaagccgtaaaaatagttattatactttttgtccatatatatagaattcgtgatgattatgttgtggatgacaattggtggtagatagaaacctttactatcgccattgttatgggctaattaatcaagtttggtaacaaatcaacataataggaccaataacaacaactactgcagatcttactattattctttttattaattcatcagtatattttattattttttcttgattgtttatccgattgatcttgtaagagataacttttgattattacataacttacttcaacatgttaaatgacacaataaaatagacaatttatttttgatatccttttgaaaaatattaaataaatatttgtaatgactgtgttgcactaaaaaatcgagataaccccatgagtgataatttggtaacataatctaaacttagagacaattaactaattaagttattatctgagaaataaattagacaatatttttattcgtgtgtgtaatttttgtggtataatattttttcttatattgtttcaattctacggatgttttggataaaaaggttaatcaaatttataaaatgtaaaattttgcttgaacaaatgaaccaaaatgtttactaattggctaattgctggaaaaaaacagttatataatttttgttaacaaaaaaaatgtttgatgtaaataattaattcacagctaaaagtcaatttcctcatttatttttgattaaagaaagtaataaaaaacaattaagtataccattcgctgtacaagagtcgtttagttctgtcggctcgacaaccgactcaagccggctcgagtcgctaagtgaatccactcgctgtctgtcggtggacaaagccggctccaatctgatcactctctctcaccagcacacacacagctctctctcttccctctctctctcccccgctttatactttgttgagtcaaaatcacagacgaagaagaagaagaaacctctctctcactcctctctcctttctctcgtcttattcgcttctcttctacgtaacagattgttcatcttcttctccttgttgcattgaggtgagttcaatttgatctatcaatgtctaaatgcatgctttttgaattatcggatctcttgtgtttgatttcattgatagagatccaattatgatctagatctgaagaatcctgttttttgagttcctattggttaaaaagtttcctcatttagctttagttcgaatctggaatgttaaacgattcggatcgagatttagcagtagtagaattcagttaggtagagtgatatttttatactattagtcttcaattataatataattgcattgagcttttcctacttcactgtatcgttttctattgtaaagattgatcctttttatatattatgcagggggtgttgttgatgttctgacgatctgatttgagtagatctgggtagggggcaaggtctctgggtctacttttgatttgagaattttttaagtgaagtgaagatatg

SEQ ID NO: 30516 - DNA, 3003 bp, Unknown
  misc_feature (1)..( 3003): 2750-1469P.txt file - cDNA_ID_3032569; gDNA_ID_2214663; Annot_ID_188937
tcatgtatgatttttaaaatattgtttattcactcaaattggtcaatttaaaataaattttaattaagctctaattttagttatattatggtgaagaaataattatgttttcctttaatttaatcaaaatataaaaggatatggtattcttaagtaattggatagatttttgtaatttctcatccgtaaaagttgtacatataagattaaacttcttcttttgttgggtcaacaaaaatataatacattcttattatattattttcttataaataaatatttaaatctcttaaatcatttaccttactaggaaatgtttgctaaaaattaaacatttacataacttcatgagataaggttgaaaatgatgtattacataagcttgttctattatatatacagatacaatctcatactgaaacatctattttcatatctaacttcaatcaaaaacttaattaggttttatcatgggttatcaagcagatctaaagcaaataagcttcttcacagatcaatgtggtttttgcaagaaaaagatttgtccaaagcttgatgacatctacatgtataagtacgttttttcatttttaaaaagcatttgatttagctgttttatcgtaatttatctaaattgtttttttgtctcgtcaatctagtgacactcccttctgtacggaggcatgtcgagaaaaacagcaggaggctgataaagggaaacataaattagagaagataattgaaaaagaagatgaaattagataaaaagttgaaaagcatactcataacaatgttgattgatttcatatattaacatcatcctaatttttattcttgtcaaaaaattaggaatgacaatagttttttccccctacattttagtagttaatatttcccattttaaaaagtcaaaccccatcatgtatcatatatattgtaagataagatatggtgaaatcttcttgatatatgtactagatttctatgtaagaaaaaatttataaagcacatattttattcttttggtaaaaaatttcaaatgtaaatgtttgagaccaaaaaaaaactttattttgactagttgtagattttttcttctttttccttttttttttttttttttttttttctttttccttttactatcttattctctatcttcttttttaatataaatatgggtgtgacaggtatgaaaaaaataaaaaaaattagaatttttttttcttctctcattttagtttatttctgaaaaaaatgagttaatttgataacaaataaaatttgtgtggattgagaagaatttagacgaaaaaaaattcttcaagagtatataccagtgcacactcgtaaaatcgaacactgttttgaaatagtattaaattaaattaaaaactagtctatagtattaaattaaaaactagtctatagtattctttcgcccaaagaaaaaaaaaaagaaaaaagtttatagtattaaactaaaaactaatctataatggcatgtcggaatttcttttaatcgatatatgaaacattgttcagggtgattttccaaatagataaatagggttcgagctcccgaacttatagcttttgggccttcctcgtcttcagtttggacagctacgtaggattctatataaaatcacaaaactttagaggcaagtgatgttcgtcttgcgttaggactgctccattgcaaacaagtattgtttatggatatttgtgaaatttctgagtgaaacaaacattttccttgttttcaaatttcaaccaagtctcatggtctgttttactaatattagtgtttaaaactctataaaacacatccttagtatttttcggattaccacatgtttgctttttgttgaagaaaatttatctctagtggctagacatacgaacatcgaaaatttagcaaaacgatttcttttaaatttcattattttcaaataaaacaaaaatcttaaaatgcttggatttttaaccatttaaattatcaccttttagttttttttcttttttttttcgtgtgcaaggattttattgattaaatgcgtttgagttatacagagccgaaaatgaaaaaatcttttcggatacaaagccgacgggtacatagaaacccccagagacatgaggccaaaaaaggcgaacaaacaaaacaagccttaaaagaaaatatacaaagataacagttacaagtaataggtaaagcctccaaaacaacaacactgaaaattcttcccaacaagcagccgattaacactttcatggaacaggtaacagctaccgaagtaatagttaaagtctccattttcttctgttttatagaaaatttaggtaatatttcatatatatatatatatcactcagaaattacacaaatattcaaaaaaaatctgaacattgggagcaaactttttgaagcaaatcagatcataaaattagataacccgtagttacaaaaaaaatacttattgttctataatataaactcagctctaatcagattccatttgctaatttaaccgtataaagatatttctaatttacaagattttaaaatacgagaatgacagtaggaattagaaaaaactaatataaagcagaagaatataatcgtcaacacgtgataaaataataacccaatggataatttaatactattacagaaccaaaacaatcaataagcaaaaaaaaaaggcaaagtcccggaacttgcgtcagaagaattttgactagaaagaaaaaaaatcaatttcgacggccatttttttctctcatcgtacggattcctatctctcactactcagatgcttccttcttcactttaatcacccttttcgattttcgttttccagctttttgattcctctgtttcaccaagtagacgaagtagaagaagaagaagaagaagaaagttttcacctttactctaaaagtttcactttttatgtctgctttgaagctctgagatcggagaaagcaatatctatg

SEQ ID NO: 30517 - DNA, 3003 bp, Unknown
  misc_feature (1)..( 3003): 2750-1469P.txt file - cDNA_ID_3032577; gDNA_ID_2214663; Annot_ID_188934
cgaaagcacctataaaagaaatgaacgaaacagagttttgttttccagcttaaacagttcagcaaaaacaaactgacttaaaaagaccaaggaggcgttttatgctatataccagaagtcttggatgcttagcaatgatccgtgcaatctcttcgagcaaactcttggggtaaacagatccagtagggttggaaggagagcagagaataagaagtctagatttttcagtcaatttagactcaagatcctttggatccaacaaaaaattgttagaaatcttggtaggaataaccacgggcgttgcatcagccaatctcgcctgttctgtgtaactcacccaatacggtgcaggaattataacctagtgaaatacaattcattgttacaaacaaaatcacatcgaaagaattcaacaaaagctcgaaagacacggttttaattacttcatctccaggagaacaaactgcaagcactgcttgtaagagactttgtttagctccattactaaccaagatctgatcaggcgcataagacaatccattctcctctgaaaacaaccagaatacaaacaatttgactccgtttcgacataactgatttacaaagcaaaagcgtttctttataccttttagctttcgacatattgcttctctgagttctgtaatacctgcatttaacgtatacctagtaaaaccttctcgaatcgcgttgatcccagcctatacgaaacaatcgattcagaacaaaccacagagagagacagaacatggcaaaaccagtaggagaaatgtattaacctcagctacgactttgggagtgtcgaaatcgggttctcccgcagctagtctaataaccggaacaccggattgaacaagagtggctgcaagatcggttataaccatagtcttggaaggttttaaggactgaactcgcgggctaagtgacatatctactgatgatgaaagagtctcagcatcatttggtttggccatagcgcagattctagatgacatattccctgacttacagtacctaaccattacagagacctaagtcaactacattgaccagtgattggagcaatgattcagatttctaatcaaaagagtgctcaaaagtgacgaaattgaatcgaagattagaatagagacgaaactcacgagaaggagagacggaggggttgttggaaccgaactgacccgattggtttctttgaatctgggaatgattcacctctggcggcggcggaggaaatgacggcgactgaactctgagaagccattggagaagttgggttggtgagaagagagataaagagtcgacctttgaggtgggatttgtaaacgagagaggcggagagaatgtgggaggagttggtggaacaatgttaagaaaatgaaattaaaaatattttaaaatgacatttatatatgttcaaaattagccaccaaccaaccctttgaatttgcaaaccagagttagaaagctagtcgccggcggctgatgatgtcaccgggaaagatttttcgtttgtttcattttatcagtcacacacttgtataactatattattcaatcattaaaccctaatcttaatcctaaaaatatgggaaaatatatatctatagctataaaaaaagttaatattcttaaggcattaggcataatctagttaatagactccaatcttgggatcaagtaaatgcctaaaataaggattataacttagaagctttggagtgagattgctacgagaataaacaaggatcacaacaacagacactcgatgccaaacttacttaactcttaatttaacaaggagagaagagaaacgaaccagggatcagattcaggaaagcaagtaactaagcaagctcttttggagaagaaaagaaagacaaggacaagtttctcggttttgggattttacgttttaactttacaaaacaggattaaaccgaaattgaaccgtacaaaacctgtgcttaataccgtcatctcaaatattgaaccgtaataaatcgacaacaatataaaattgattttggttcactaagaggaccagacttttctctcggacttgagacactggagagactgaatacgaccatgtcctcttcgctccattgctcgggtaaacttttaacaagggttcgaaatcgaatacacgaatatctcggtttgttcaattactgaaaccaatcgaattttttaatctgtttcgattttctagttttagcatttccggtttagttcgatttaaattattcggttaccgtttttgtttagaatcacagaaaaaggtgagattaaggaggagcgaaacatgacgaatccacttaattccaccgccgctaatcgctctaaccaggtatgttttccggcgataactcatcgtcagttttgattatgttccgacaaaagtgtgattccgttctgattatccattttctcagccgtcttctgatggaatcagcgacggtcaaatcaccaatgaggaagctgaatcactaattaacaagtaatgacttcatctttttcatgcgaatgtttcttccggatttactaattgggaagaagcaatgttgcttaaactaaatttgcatgctttaggatttagtctgcttttgaatgtggttttcttcacaaaatggttttttggttccaagccttttcaatgtttcatataggaagaactgttcagggcacaagctaaaagaagtaactgatagtgacacattctctgacaatggtaaagatgattcagataccaagaaaagattccattaccatcaggatcaggtatttgtctcattcaattactacgtaaaagacaacttgtgcttatacactaaatatgagcttctagagaagtaggcctcctttctgagtgatgttgtatgtttgctgtgtagcggaggatgagtttgacatcgattgtggcggtggagtctccttcatcgagcaacgctccctctagaaaaaccattgatcttggccatg

SEQ ID NO: 30518 - DNA, 3003 bp, Unknown; identical to SEQ ID NO: 26487
  misc_feature (1)..( 3003): 2750-1469P.txt file - cDNA_ID_3032579; gDNA_ID_2214663; Annot_ID_188933

SEQ ID NO: 30519 - DNA, 3000 bp, Unknown
  misc_feature (1)..( 3000): 2750-1469P.txt file - cDNA_ID_3032581; gDNA_ID_2214663; Annot_ID_188932
agtgatatttgcacttgatcaagtcatttctctaggggacaaggatgttaaagcgtcatgttgtttaagagagggactacacaagacaagactttgccactcttccttatcaatcttcccgtccaatttgcttcttgaaatgtctacaccaattgatgtttatagagaattaagatgagaagcttagaatatgtcaatggagaccaagatcaagcccaccttcttgcatatgatgctcaatttacaaaacaagcctgaatgtgaggttgatacgagtgccctctgcctttgcacgctttggcacagaatgaatccagtctctttgagtgtatcctctcatcaccagcaacgatccatgtttcaatgtcaaactttgttgatcctctctgctgcttctctttaacctcttcttagctggtccactgtctcctgttttccctgcaggttcacaccaaacaaaagttggcttgttcctggctatgcaggaaaacactttagcatgactcaaatgtcccattaccttgggaagattcttcatctttctttttcttcaacacaaaatcacgttcacatccaaacgagactgaagcaatttctggagttggaccataaatcttttcatcatctgcatgccaagccacataatcactggcacctttgtatctatttaagagcaagctgttgaatctgcttccaggaagcaccttgtaaatctgacaagacgaaatagaaacgttttagttcaaacaaccactagaacacagggacatagcatagttgttttcaatcttacagcatccagaatctccttgagaggtgggaaatcatcccacgaataggaggtaggtcgatatccactgtacaccaacgcagtcaatccgctacttgcaacataacaagtatctctcggctacaggtggcaaatgcatatgtattagaaggccacaaacacaagttatacaggacttcacatgattgtgacttagatttctgagatacaagttgaatccaagcatggaaatggccctggcaatctttgttcctcacattgcacaatactcaatgtaacccgcgaggagacacaataaagcttcaatggatcatatgtatacaaaaacaaatgacagagaaagaggaagtggggaaacctggaggcaagatcgaccaaagacacgaatagtaggcctggtccaaggaatatgcttgtcgagataatcgaagaaagtccaagattgttgaaatggaagaaacctctgaatgtaaatgaggtcgcttccatggccaagatcaatggtttttctagagggagcgttgctcgatgaaggagactccaccgccacaatcgatgtcaaactcatcctccgctacacagcaaacatacaacatcactcagaaaggaggcctacttctctagaagctcatatttagtgtataagcacaagttgtcttttacgtagtaattgaatgagacaaatacctgatcctgatggtaatggaatcttttcttggtatctgaatcatctttaccattgtcagagaatgtgtcactatcagttacttcttttagcttgtgccctgaacagttcttcctatatgaaacattgaaaaggcttggaaccaaaaaaccattttgtgaagaaaaccacattcaaaagcagactaaatcctaaagcatgcaaatttagtttaagcaacattgcttcttcccaattagtaaatccggaagaaacattcgcatgaaaaagatgaagtcattacttgttaattagtgattcagcttcctcattggtgatttgaccgtcgctgattccatcagaagacggctgagaaaatggataatcagaacggaatcacacttttgtcggaacataatcaaaactgacgatgagttatcgccggaaaacatacctggttagagcgattagcggcggtggaattaagtggattcgtcatgtttcgctcctccttaatctcacctttttctgtgattctaaacaaaaacggtaaccgaataatttaaatcgaactaaaccggaaatgctaaaactagaaaatcgaaacagattaaaaaattcgattggtttcagtaattgaacaaaccgagatattcgtgtattcgatttcgaacccttgttaaaagtttacccgagcaatggagcgaagaggacatggtcgtattcagtctctccagtgtctcaagtccgagagaaaagtctggtcctcttagtgaaccaaaatcaattttatattgttgtcgatttattacggttcaatatttgagatgacggtattaagcacaggttttgtacggttcaatttcggtttaatcctgttttgtaaagttaaaacgtaaaatcccaaaaccgagaaacttgtccttgtctttcttttcttctccaaaagagcttgcttagttacttgctttcctgaatctgatccctggttcgtttctcttctctccttgttaaattaagagttaagtaagtttggcatcgagtgtctgttgttgtgatccttgtttattctcgtagcaatctcactccaaagcttctaagttataatccttattttaggcatttacttgatcccaagattggagtctattaactagattatgcctaatgccttaagaatattaactttttttatagctatagatatatattttcccatatttttaggattaagattagggtttaatgattgaataatatagttatacaagtgtgtgactgataaaatgaaacaaacgaaaaatctttcccggtgacatcatcagccgccggcgactagctttctaactctggtttgcaaattcaaagggttggttggtggctaattttgaacatatataaatgtcattttaaaatatttttaatttcattttcttaacattgttccaccaactcctcccacattctctccgcctctctcgtttacaaatcccacctcaaaggtcgactctttatctctcttctcaccaacccaacttctccaatg

SEQ ID NO: 30520 - DNA, 3000 bp, Unknown; identical to SEQ ID NO: 13877
  misc_feature (1)..( 3000): 2750-1469P.txt file - cDNA_ID_3032585; gDNA_ID_2214663; Annot_ID_188931

SEQ ID NO: 30521 - DNA, 3000 bp, Unknown; identical to SEQ ID NO: 13872
  misc_feature (1)..( 3000): 2750-1469P.txt file - cDNA_ID_3032585; gDNA_ID_2214663; Annot_ID_136547

SEQ ID NO: 30522 - DNA, 3000 bp, Unknown
  misc_feature (1)..( 3000): 2750-1469P.txt file - cDNA_ID_3032595; gDNA_ID_2214663; Annot_ID_188927
gcaaagctgttagaaagagctgtacaaaaaagatgagaataaaattttttataacgtttttaatagtttttgtgattgataactgttaaagtttgaacaaaactgtactatgttaccattcaaaccctatgactttcacaaatgtagtaaatcttcacacagttcaacgtaattttaaaatttcacaagcttttgacatgtagacttcaataaaaaaaaaagaatgttttggtgtaggtctgtatgatgagacatttaatccctaatgtagataaaaagtataccaggaaatgattgcaaggcagaaactattgtggccgttgaaagaattcacgtggcatgatgattcttttgtgtcgatcccatcttaattatggtgagcgtttggggataggattccgttagcagcctttaataattaagttcatgttctcaaggaacaacagatccagattaaatatttttcatcatgattttagcgcaaaaaaaataaaaaaatcaggaatctgttttaaaattcactaattgtttttaaaggaactgaactgtcctggtaattaattaatggtgcttggttgttctttagaaaaaaaaaattttttctaaagacgacgagaagtaaaatgatagaatccttaaacaaaaagaacaaaaaaaggtaaaatgataatgattaggttatatattcctcatgcacgacatcttcctacatgttttttacgtcgcagttctaagcatttcatttctctattgattattacattattgggtaattcattttgaaattgagaagttccttttctgcaaaccctaattgatgataatgtcacgataaaatttgaacttttttctatctttcgatgaagtggatagtacttgctctatgtctctgtagatatcggtcacgttgtgggtggagacaagtttgattcgttgcacgtgaagtcggtaaccagtacgaatagaatcaattatagattttttagtgtaggcatttgtggattttttaaaaatgttatttttacctatttgctatttttaagatacttaaaaatgtatttatttacgattagtttttacaataatatatattttatactaaatattatatttcaaaaataaatgaaaccgattaaacataaatataacgaataaaatacatattaaatcatatttttatatttttaaaagaagcaaaattcataaattcttttaaaaatcaaaatccactgatgccattaaaaatttgataaatccgtaattgattctttattaaggcaacataaaatttgatgtgcatgcaaatcaagtctaagatatcgtttgagctatcgttcaaaaaacttgaccaacaaaaaaattactaaaacttatttttattattataaaacaagctagcaaaacatttgagattaagttgtaatatctgcatcagaaaaaatggcatatccacacatgcatgtgaacatgtgagatttctctttgtcttctatttaattatacaacatgtaacataatttttccaaaatattatgtgaaacatagtataatctgatttcactgcgaaataaacgaagtgacttgcatatatcaccaccaaaatctttacaatattagttgtgacgaaaaagtaaacaaacattaaaagaaagtagtgtcgacatcatcattcatcatatatgtggataaaaatatctgaagagtcaggatctcgtgatcacgaactcaagaatatgatgcgtttacctcaaatctcaattaatcaaattttttttttccctaacacacaaaaactacattatgagattttttttcaaaaaacactattatgggaatttgcttaattgttttcttttggactaaatgtactagacgctgactgatcagtagaaagctgttaactaccttagccatgtggcgcttattaaactacaacagctagcagtgaaacctaataagaacaaaacgtgttcgattttggtttggcgatactttgtctcattataaaattgcatgttttataaataaagatcaaataaaatatggtgattatatatatatatatatatatatatatattgctgaaacaaatccgtgcataatatatcgcaagtcttaataaacttaaaaaaaaaaaaattgtttatagaataacaaataactaacactaggattgtttttgttttttttaccgtcatagttttatcatactttttccttttgcaaagtttcaataatattaaattgtaaatggttcaaaccaaaaaagtgtaaaaacaaagaagcaagcatgtgaatgtgaattgttgggaaaaaaaaaggagatttatatactcatgtttcaaactcccattaccttgcaccaagatgatataaaagagcactatacaagatttctatcttacaaacatgggcttccgaaatttaatgatattaggaggcagtaatatttttctatatagatctaaagatgctataagtaaagtttctctattttagaattcaccatcttatgtgttgcatgcatgatgcattgcatatagttaaatccattaacgcgtcatagacaataatagatcattggccctcaagttcttctcttcagcagtaaagttcgacttcactttcttacaagaggttagtatatggaccagtggaccaaacaaagaaaacatttgattaattaccaaaaacaaatatctcaatattcttttgtcagcatgatcaaattggaagggaccacgtggcgcttgatgggaacgctccaacgccaaataaccaaaagatatccaaaggaagccaacaaggaagtatagtggaactcgcactcaatggtttcgactcggacacacacaatatctgattttacttttcttttttttttaattgcaagtttgccactataaaatcagtccatacccttagttaacaacccacattcactctcatttccatcaaaattataacttcattttacattttgattaatatcctaaaatg

SEQ ID NO: 30523 - DNA, 3000 bp, Unknown
  misc_feature (1)..( 3000): 2750-1469P.txt file - cDNA_ID_3032619; gDNA_ID_2214664; Annot_ID_188968
aattacagcaaggctctaaaatgtattcagttctaagaaaaaggtacactattcagaaatataatttgttgtttggcccccaaattttctggaccgctaactctaatttcacgtctgactacaggctatactgctatagcaaccgagccactaaaaataaaattgttttaaaacaaacttaaaccaaaacataaaccggagtgtcacttctattctgaaccgtaaatctaccctctaaacccaaaatttcccattttttactggttatgttagattaactggaatctaccttaaataagttttttgatttcaaatttttttctggttatgatcaatttctcaagtaatcagtttttttaagtctcaatattattcgttatcatatccaccagacgtattggaccattgttgtcgaatcgcaaaactaaggtcgagaatgtggctatcaaacttgggagtgtattatattcaccactatgaacaaatggtatggtcttaatactgcacttcgccgtatactcgagggttataacattgcagttccagagagcgctatttgttcgacaaaatgccgaggagatattgatggttgctaatgttggaattgttgtcacaagctgcagagattggtttctttcagtaatagaatggataaagtactctcttttttttttgtcttaggtcattagatcttttaagtagtaaaacagtggcagctgtatcatctagaaacatttttgccagctatcgatgttgctttctgccttaagtaatgttggcttattagttttgtttcttgtttcacttgatcaagtatgcttacactgatcacttgaaattactctcagagatttgttgccacgtgaaagtgaccgttaatctgctacaaacattgttatcggttctttactgatacaggttgctgtggtttatcatgcaacggaaaaggctttgttgcggcttcaactgtatgcatatgatgcacaaaagagaaccgtttctgatgacaatttacgttttggtgctccatgaaggcatcttccgcgtattagggatctcagagggagctaaaattcagctgattgatttttcccaagttctcctcaaaacagaattagttgggtgacaatagccttgagatcaaagttgttctttgttttaccttaccagaaaagaaaccaacgatcatagcatcactgaagaataaactggtcttagccacatggcccacatctacttttagcaaaaccctaattatgatctatgtggtttttgctgtgacttggagtgaactcaatcctctcagaacaacaaatctgttttattagatgtacgtagcaagtgttttctatcattcatgaacagagtacatcgtaagcaaatcttgataaacaaatctggtttgactcaaactcagaatagtacaaaccaaagcagattaaccagttttagctaaaaacccatcaagaatttaagtataggcattctaaacacaatgagagaacaatcattcctcaacgaaattgacttaagcaaactaaacaaaagactatacaagtatgaaaactcatacgtgtcagtcaagaaacaaaataccaaaagtgtaactgaagcatcatcttcactggtagtgaccggaatcacgaatcgagccatcatcgttgaagccaaagtcttcatcttcgtcgggaagatagccttgactgtcttcttgatcaaagaacaggtggtttaactcgtaagactcgtcgaaaaaagagctaggttcaacagaatcttgaggaagattgtcgttgtggccgtcgtgaccagaatcttgaggaagattgccgtcgtgaacagaaacttttgcaggaaccagaacaaaacagagactaccttgctccaaaccgtcaacaacagagtcggcgtggccacccgaaagattgacgccgtcgtgaacagggttcactcctccgcaacggaaaacccagagagagaaaacgtcgcccaccttgaacgttttgtcgttcttatcaaccaccttattccaacctttaacaaaggcatagctcttggtccacttatgtaactcaagcacgtactgttgcgattcaggatctataaaagctactctcaaaccagccgtccgtcgtttcttcatcttttgtgcctctatggttcgtttttcatcttccgttaagaagcctgaattttccatatgcatggaagaaacttggagtcgtgactgtttgtcatcgagatcacacttgaagagagtcttctttggaatgattagttgtggatgatacccattcaatttattcatggatttcagcagtaactccggctgttgcatctctgcagaatctgacattaaatctagagcacagcaaaagagatagaatgatcgtgtttttttcttgcgtttcaagaaattatgtaaagagaagaaagatagaatgagagtgtgatgtatatatatactgtatgttctaactacacccatttagaaaacaatatttactttgaataaactttgaattaattacaggtttcttgacccttttctttatttaaacttgatctccattggaagtatctcaatgagatacccaacaaaaaaaaaataattaaaaaagaaaaagtatgagagaggtgagaaaaagtaggagagaaggagagttaagtttctcggaagagaaactttgagaaactattttcatccaatttggacaggtgtcatcatataattagttcaactattaaataataattaatatatctgttttgattaaaatattaatatattttttttttagaaactttccttatttttattgaggagatggtcttaacatttaaaaaaaaaaaaaaaaaaaaaaacgttttgtggtttcaatttatgggggagaaaacgatttcaattcatataatttgatgaagctttaataataacaatgttgcaaattaatatattttcggcaaaataaaaaacaaatgttgcaatttccttgaatg

SEQ ID NO: 30524 - DNA, 3000 bp, Unknown
  misc_feature (1)..( 3000): 2750-1469P.txt file - cDNA_ID_3032623; gDNA_ID_2214664; Annot_ID_188967
ttctctctctcgctctgtctgttcaaattccttggagattgtgtgttgctattagcgtgactagtatgtttcactagaactagcctatggagcttctgggtcggagactcgagtgtatacccggaaaaaaaggctaaagcaggaaccttttgagcctctggagaaatattccggcaaaggagtcaatacccacaaagtaagtttcctcaattgagcgtttagcattttgtagaactgggttctggagatttatctctcaagtgtgataatttctctaaagtgtgttcttacttggctcagattttgtcttatttgtccaaatgtcttgagttttaagttaatctgactcagccctatgggttgttagtgatcctagtgtttttaaatttgttcgccctgtgcttcagcaaatgagagaaaaccttgattagtgttgccatttgttccatgaccatatatgaccttgtgttagtattttactatttagagtcttatgtgttgcttaatgtaatgtcttccatcttttcatgtctaatgatgcatcagctgtgtggtttacccgatatagaagattttgcttacaaaaagactattggatctccttcatctagtaagtctccttttataaactcacaactttcacattcccaaccattcattaaacttaatatcaatcaccaggttgaaaaaatagccaaagaacctgactactttctaaactagttgcatgatatgttcttgtcacttgaatgtctcaacagatttaatctgaatagaagttggtaggaaaagttctatcatcaagaagattctttaaacggtcaagagatattaattatctagcttttgcaggcaggtcaacggaaactagcatcactgtgacttcagtcaaaacagcaggtatgttatcatgcaccgagtcccttaatgatagggttggtttggtttttactttacagatttcttcacacacagtaacttgttatgtttataatccaggatatccgcctgaaaactgggtcgaagtgctcgagggtattcgtcaaatgagatcttctgaagatgcaccagttgattctatgggatgtgataaagccggaagctttctacctcccacggtataattattttcctcaatttagtgtttaatttttgtgtggaagtatgccatgagatacactgagtttctgctcttttggcttgagcttttttgtttaccgtataaagcacatgtgtccttgagtttcgtataaaatttgatgtagttatagctagtgaatggcttacgaaaggattcttattgtctgctcaagaaagcacctttttctctttgttgttttctcattaaaacaagctatgcttgaaagcagagggatggattgttcttgttttaatattaatcagttttttgctatccctaggaaagaagatttgctgtcttgctaggagcacttctttcaagtcagacaaaagatcaagttaataacggtgagttttgtgctattaagaaacacttatttcacttttctagtttacactcaaatcatctgcatttacaagttcatgattgtacatggatacttactattcagacgctttcaacatgcagcggcaatacatcgtcttcatcaaaacggccttcttactcccgaagcggttgacaaagctgatgaatcaaccataaaagaattgatctatccggtatgttatccaagtgccgtcttacttcttcacgtcattgcctctaacatgagccccttgatgtgctaattttatgccattttctcataaaaaggccttattcttagtaaaatcttggtttaacagtttgcctttactttcaggttggattttatacaaggaaggctacctatatgaagaaaatagctagaatttgtctagtgaaatatgacggagacattccaagctctttggacgacctgctgtctcttccagggattggtcccaagatggcccatctggtaaaattcgactatattattacttatatcttgtgagttttagatgaaatgttttcaaaaagcttctcaaatttctcttctgttctctacatggcagattctgcatatagcatggaatgatgtccaaggcatatgtgtagacacacatgtgcatcgcatttgcaatcgacttggttgggtgtctcgtccaggaaccaaacaggtacctctaaattggcttcaatcagaaatggtattgtgacataccgagcagattgtctccgattctgtttgcctggtctttgtcacccatttgcaatctatgactttctagaaaactacatctccagaggaaacaagagtagctttgcaacaatggcttccaaaggaagaatgggttgccattaacccgcttttggttcgtcattctcgccaattcttctaccttaagacacacataagactatacaaatcccatgatagtattgagtaacatagctgccctccctgatcttcattcttgtcttgtctgacaatcatacacaggtggggtttggacaaatgatttgcacaccaataagaccacgctgcgaagcctgcagtgtcagtaagctttgtcctgctgcattcaaagaaacatcaagcccatcttccaagttgaagaaatctaaccgaagcaaagaaccatgatccgaagtccaagacttttgtattttgagtaaaacaaaaaaaaaaaccattttttgattagtttctctttgcatccaagaaaactgttagagcttcgaggcttgcaatgttgataatgaaaacttgtcgatgtatattaattaggaagcttgcaggtaattaattaattaattttctggtgttaaatcttaagtttttcaatgaaggatgtgaaacgtcagatttttttggttccagaaccacaaaaaaagactcttttttgtcaattgattcgattcaagagttctttcaacgtttggagtagagagagtttgacctatttgaaagtctctgagaccggtgtggcatg

SEQ ID NO: 30525 - DNA, 3003 bp, Unknown
  misc_feature (1)..( 3003): 2750-1469P.txt file - cDNA_ID_3032628; gDNA_ID_2214664; Annot_ID_188964
caattgaaatactcctaagaacagctaaaatcaccgcatttcaaacaagaggaacggagaacaaactcatgggatcaaccctttatatggttgtcactttattgagaacatatcagaacatagctatcgaaatgaaaccattaatcaaagtcaaacaccaagatccttatcaagaagcagagccagatatagcaatggacacactacatataactaatgtgcgacagattcaagtcaattacacaatgataatcaaaatccaatttctcaatggagtgaaattgaaactgcaaacaaaagatgggttcttatctgttgaagcaaaacacagtttctcactattaaactttcataacatttagttcttagctgcagattgttaactaaacaacatcgaataaacctcatgaggaaatacaaaaaactgaaaacacttgcctttaaagagaaggaacaaaaaaccactaattcgtgatactcttcttgctaccaccactcaacatctcgtcaggaattttcttaagctgcttcctctgcttcttagacatagaaattttcttcaaagtcttgggatttgtaatcttctgcaacttagtaccagttctcaaaacattctccttcttccgcttctctctctcttccttcttcttcctcttctcaaccttattactcctaatctcttccttcagctcattcaccctctccttatacgctttcttaatctccctttgcctcttcatctcctccagatctggtttcctgttcttcacaaacctccctgaagatctatgagttcgcggctgtttccagttccgtccggagactttcccggcgattacaccgtcgtaggttggtctctcgacagctagagcaataggtttgtctggattttcagaggaagcgacggcgctacgtttcgcggcaggaggagcaccatcgatgtccatggaagcttcatcggcgattgcttcggcggcggcttgttcttgagattcgcgtttgcgtttgtaggttttgccgccgaatccttcgtcaaggcaccggaaatctacggtgcaagccatttcttctcttctttgtgtggctgtgaggttttggcagaaatttagggtttctcgactatttatatgagtgaggatggagacagggttaaaattccggttttttagccgaccacataattataaccgaaccgaaccggaaattatgtgattcatcaattactctgttttagtgcaaacaccttctcttttaaattgtagaaaaccaaatcaaatcttttaggttgtgaatttggatagaattgggaataaatccatgttcgtgataaaatattgattcaagctattaacacaagttagtaccgcaacaataaatccaaagtaatcttttagaaaaaaattgttaataaatctacattattaccaagtcaatttaaaataaataaataaattcagaaaaataaggtcattggacaaacatccaacctctctagttgactcaagggagaaaatatccaatctctctacaaaaaaaaatcaataaaccataaaaaataatgaaaaacaaattcctaaagttacttgggtctcaagcaacattgtgacattatgaggaatgaccagagctgcttctaccacaacgggttggagaagagagagcaaagcaaagttttccacttccatctcgaaaggaccagatttcaatcacgtcattgactttgaagatttttttatcaatcacattgttccaaccatgacttaacacatatttccaaactgtattaccattccacttctttaaataaacgacatgcttatccgattcaggatccaccaaaaacactttcaaaccatcccttttagcctttaaaaagtcttcatctaagaatctggtttcgtcctctgtcaaaaaatctgacttctctaatttgctgagatgcattgagagacacccctggtttttacggagatcagtcgtacacagcaccctcctctttatgatcagctttggatcgtatccattctcttttctcatcactttcacgagccagtctggtatcgaagaattgcatgtttcgggactatcagcaggacataacgaaacgatgtcgcttttgttctgctgagaggggctcgggatgtcgaggatgattttcttttttcctttgagaactatttgagaaaattcttccaacatatccagcttccaaaacttacaaatatcataagcctccattgtgcggccagagaactacaagaaattaaggaagaggtttaataacaagcttaagagagagatagagaatattatataacagaatttttaattacgttcttactaaggatttgctcttgtttttttcccaatcttccttaaataagttatatatatatatatatatatatattctagtaataaattcttattttaataattttctagtgataaatttttattttagttctcactattttaatttttaattttaataattaggtgaaatccagttaattaacgttttttaatcaaatttttgttttatttcatttatttttcccctaacataaataggttttagtttccaaaagtaaaaaaaaattggattagtttatttgtttatcttgatgaattttatttttttgtgaaagattagtttctttatttcccaaagcaaaacatgtttatcttttgtcatccatgacccaagagaaaaaaagttttgtgtacaaaaattaaaattaggagataatggaatggtctagtggaaaccgaaacattaaactgccattagtattttcatggttattaatgattgttaattactattttgatgaactaccgttcaaagtctttgactttcctaaaaatttcaggaatctcattctcatccgtatattatcatcacctattttagctttgaatttaactataaataaaatgtttgaaacacaacaacggaaacaaaattaattaagaaagaccttctttgttcacaatatg

SEQ ID NO: 30526 - DNA, 3003 bp, Unknown; identical to SEQ ID NO: 25254
  misc_feature (1)..( 3003): 2750-1469P.txt file - cDNA_ID_3032632; gDNA_ID_2214664; Annot_ID_188959

SEQ ID NO: 30527 - DNA, 3000 bp, Unknown; identical to SEQ ID NO: 13885
  misc_feature (1)..( 3000): 2750-1469P.txt file - cDNA_ID_3032638; gDNA_ID_2214664; Annot_ID_188956

SEQ ID NO: 30528 - DNA, 3003 bp, Unknown
  misc_feature (1)..( 3003): 2750-1469P.txt file - cDNA_ID_3032705; gDNA_ID_1972175; Annot_ID_179979
agaaagttacatcggtaagctaatggcctgaggctcatatcaatcatcattttcttctcagaaaatattttgatatattaacttctttgatgcggatttgattcaggggaagttgcctgactcattccatctaatccaacacacggaggcccaacgttttgttggtaaatgcttggaaactgtgtcaagaagattgcctgcaaaggagctcttagcggacccattccttgccgcaactgatgagagagatttggcgcctctttttagattgccgcaacaattggcaatccagaatttggctgcaaatggaacggtggtagagcatctgccgtcaacgactgatccaactagaacaacagatatgtcaataacaggaaagatgaactcagaagaccacaccatcttccttcaagtacagattctagatggcgatggtaagttaaagttctacttactacaaatgtcttgcctggtttgattggaacatgaaatttgttgcgttgctagaaacttgctcagctgaaccgggctacaggatttgtagcacctttagtattagctattcatcataagatagaaatggacgattgtaaccttagcttctgatttttgtaaaactttgttagaagaatcaccaatggaaaatgtttttatgaatctgtttggctgtggcacaggtcacatgaggaacattcagttcccgttcaacattttaagtgacacacctctagaagtagctttggagatggtgaaggagcttgagatcactgattgggatcctttggagatcgctgcaatgatagaaaatgagatatctttgctcgtccccaactggagggccaatgactcttctatccggcacgaaagctttggtcatgaagatgatgaggacaatggcgacacagagggaagaacgcgccttttctcctctgcttcttcctctcacgactctcctgtagcagttagagagaacaatgacgattctagtaacgatgtgatcccagatatggatgatggcaatagaagctctaacaggttgctgaattcttcaacataccactactcacctgccattgatgatgatcaaaatcagcaacaacggagacgagtaaggctacaacagaaaatgagatcgctggtggacacgagaacacaggtgctacaccgatcgctcatggagttgatcaacaagcgtcgtgggcgtggctttgacccgaacacaaacgagctacaacctcaaccgtcgtccactgatttcattcgacgatgttgaaaatagtatgatgagagagcctatttgtgactctttcatgataaagacagatcttcatattggtactagcattttgatttgatgatactatatgaaataattgtttagagtgctttgtatatatgatattcttagggaagtgttacctttttagctctatctcgatttgaaagcgatgcaaaaccgctcgaattcgatttcaagtacgaaggtagcttcttccctgtgttaaagagacaatttagattacattttatgcattttccattacagtggtaacttaatattcaaataatcataggaattaaggatttttctaatcttgatacgaaagttgtttatcttctcgtatcaaacgtagaggcagttgaacaaatttacaaacgaaaatgttcttagattggtataaccattcgtcgaaaactataaagatttacttttatttaaccataagatgatatcatctatcaaaaagtgttaattatagttgatcatatataataagaacaaattataaaggctatatacaaaggaaatttgcgttaattaggttatctaaccgcatgcatccaaaacaaatcatgtatttaaaaacttgatcacaacttgagcaaaatatatggagagcaaagggccatcgccaatagttccacttgtgcttgtggtactcttcggatggttcctatgcggctcgtaccttgtctcactattagaagatgttgtattaccaatcttacaaaccggaacgttcattgtaggaatctttctcttgcttctccttttgcttctccatgtcttatcttcttcttggatctatccatggatcccttctcttcttcttttaccatctccggcttccacgacttctactgactcagacagctttggtcttggatcgtttcttttgttcacactttttctcatctctttctggttttttgggtcactctaatgtttattctacttgtgaattgtatattcctgattgatcatgcaaaatattgctatacactttatacatgcaaaatattgctatacatgttgtacatcatgcaagattccaacacaaaatgtttagcaagaatttgtttaaaattaatttattattaattactgcatcgctcttattccattttcaatgtaatacaacatatatcatccgtgaaaacaacataagagagacaacctagctactaggctactagctaggagcctaggagttgcataataatgagtcgaaagaagatgttatataataagtctccgtgcaaccacctttgacgaccaaccagcacgaagtacatgccacagacgaaagatcacatgcattgttttgggtttttacattataaatagggtcagattttgagtaatatgtgtgtttaaatgaggtaaaaatatataagaaaataaaattgcaagaaacttcttacttcattttattattttttccaaaacttttgtgaagatgtacaaaacatatccaagaaaataatttcaccaatttggtaaatattgcatgattggatatatgtgcaatgtgctatacaaatctttatcaatgcttaaacttcaaatagcttttaccaaactatgttataaaataactttaaaaaaaaaaaaaattaaaatgttttatatgtcatttgaacatttctttgatataaatgtccattattagtccattatatacttatgcaattttcacccaacaaaccgttggatatatg

SEQ ID NO: 30529 - DNA, 3000 bp, Unknown; identical to SEQ ID NO: 9729
  misc_feature (1)..( 3000): 2750-1469P.txt file - cDNA_ID_3032713; gDNA_ID_1972175; Annot_ID_179972

SEQ ID NO: 30530 - DNA, 3003 bp, Unknown
  misc_feature (1)..( 3003): 2750-1469P.txt file - cDNA_ID_3032742; gDNA_ID_1972176; Annot_ID_180014
aaccgaacaacaaaagttttaaaaactaataaaaatttaggtgaatataataataaggccaactatgaagaaaaggtctattttatactttttatataaccttttgtcacgggcactgtttcattcccttggaccccttcttcttcaagatctgtttcttccttctttctctctaaccagattttgttgtaccagagagagagagagagagatcccttaataattcttacacatttatctttcttgtctgaatcctaacaaagactttagttttggtcgatcttataattttctttttttattctatggatttctcttccgggtttcaataattgtcacttccgtagtgtaagtacgcgtgtattgtatactagtcagttacacaagtgtccttatgtgtttccttgtctttaattcatttctgaaactgaatttattcttctctcagattctgcaaaggttttggttttttctccgagtttttttgtccttcaaaaaaaactttggttgctctctctctgttcaagaagatccgagcttgattcctaatctgtgagttttatgcattccatttaaagctctgattttgtattcctgtatcaatgtttccccctaatgttatagattttggataaaagattaagtcttgatggatcttatgattaattgtaacaatttatatcatccttgggtcatgaatttacctctgtggttttgcatttgcagatcatttgagaagaagaaactaagaaatgggtaagagttggttttcagctgtgaagaaagcattaagcccagaaccaaaacaaaagaaagagcaggtctttatgctagattattcacattttttggttatctatatccataaagagaaatgcttctatatgtctttgatgtaattgaaaagctgatactgaaaatggtattgtttttgactccattagaagccacataagtccaagaaatggtttggtaaatccaagaagctagatgttactaattctggtgcagcatattctcctcgtactgtcaaagacgcgaaactaaaggagattgaggagcaacagagcagacatgcttactctgtggctattgcaactgctgcagctgcagaggcagccgttgcagctgctcaagctgctgctgaagttgttcgtctctctgcattatcacggttccccgggaaatcaatggaagagatcgccgctatcaagattcagacagcatttagaggatatatggtaacgtttttgttttttaacattttcaagtctagtaactataaaggtggttttgctaactaatggaacaaagttcatactttttggttaccctttattaggcaagaagagcattgcgtgcgttgagaggtcttgtgaggctaaaatctttagtccaggggaaatgtgtgagacgtcaagccacatctacattgcaaagcatgcaaacactagctagagtacaatatcagattcgtgagagaaggctccgattgtctgaggataaacaggctttaacacgacagctccaacaaaaacacaataaagactttgataaggtaagcaaatcaaatccttacaaagatgtttataattttagttacaaacttggctttttgttgatctcggatacatgagaaattcacaatgtgaaatagattatgtttcttgctacaaacttaaagattgtattacgttttgtgaaatagactggagaaaattggaatgatagtacattgtcgcgggagaaagttgaagcaaacatgttgaacaagcaagtagcaacaatgagaagagaaaaagcgcttgcatatgcattcagtcaccaggtattaaactagtttcctatcttactttagtgtgtctttacaccagaagaattatatatctcaaaatggtgaaacttgttaatatgcagaatacatggaaaaactcaactaaaatgggttctcaaacattcatggaccctaacaatccgcattggggttggagttggctagaacgttggatggctgctcgaccaaacgaaaaccactcactcacaccagataatgctgaaaaagactcttctgctaggagtgtagcaagccgtgccatgtctgagatgattccacgaggcaaaaacctttcaccaagaggaaagacaccaaacagtcgaagagggtcaagcccgagagtgaggcaagtcccaagtgaagactcaaacagcattgtgagtttccaatcagaacaaccttgcaatcgtaggcatagcacttgtggatcaattccatcaactagagacgatgaaagcttcaccagtagtttctctcagtcagttccaggctacatggcacctacacaagccgccaaagcaagagctcgattctcaaaccttagtcctctaagctcagagaagacagcgaaaaaacggctttccttctcgggatctcctaagactgtaagacggttttcaggtccaccaaagctggaaagcaatgttactaagaaagatactaatcttgcttaaacagagaatggatatatatatatagtttatatctgacattgttgattaggcaaaagtctggtgcagaggtgaattcagagaagattctgttatgtctttgtttgtttttttggtatttttttttactacaacaaacttaattatttgtttgacttttttaattggttgaacatatttgtattgatgaagagacatatataattttccacatgctatctgagttccttctttaacatatttgctaacgccaaagtaatctaaaacatagaaccagtattgaaacttaatgggggtgttttttaggtcaattaaataataaaggggttaaattagaaataaagagaagtaaaagggcctgtaagccttttagggattctagggctttccttcattggtcagatcagacgacgttttacatcttcttcttcttcctcttcgatattcgtcagtgtgtgtattttggggaaaactttgtgagcaaagagcgagaaaatg

SEQ ID NO: 30531 - DNA, 3003 bp, Unknown
  misc_feature (1)..( 3003): 2750-1469P.txt file - cDNA_ID_3032745; gDNA_ID_1972176; Annot_ID_180013
aaacgacatatacttccaaacgctatatacaagtcgaagagaaaattaaatgacaataacaaaagatatattttttgacaaataatcaccctgaattcaaataaatagtttgtatttttaatcaaaaaataaataaataatgttaccacaccataaacttcttaaaaccacatcatatatgcagcaagccagcaaatatagatatatcttttgacaaatattcaccttgaattcaaataaataatctgtatttttaattataaataacataaaaatgtaacaacaccgtaaacttcttaacaccacattatatatgcaacaacttttgataacatgcgtttttaccaaattttgtttattcgtgaatagcatattgttatttattttattattattaattattagttatagtaggcatgttaaaaagtcttgaatggtgacataattattagaccactgttaaattgtttagtccgcacgattcatacacggtcttaacttaatttcgatttcaaaatttgaatttcacagtgaactaatataatctcagtcccttgacgagaattgtacatggatactggaacaccgagttgctaacgatgttgtatctgttagagctttccatcgccatctttgtgattcgctaacatctcgtagagcttatcgtacgagaaacaagatgttcaaacttgttttaaattaatcagcggtttgacacaagcggttcttgtgtaggtggctagaatcatctatgatccaagcatcataagccatatctacatttccgggcctaaagattgaagatgctgtatctgatggatcattggcttgctcggtgatctcctttacttttttgctttattttgttttgaattcgtttactttgttgaatcttccaagagtctgccttaaacttgtgaagtacttcatgaatttaactggtttatatcattggatttgttttgtttgagcttttttttttaaactttgaaattagaaccttgaagtatttgatgaatctagttcatttgatcagtgtcagaatttggttttaaaaaagtcacatcaaaataattggggttgattggctctttcccctcatcaatacttgcttcttttttatacccaaaacaaacaaacaaaaaattgttaaaaggcttctttctgtttttttcttttactatttgacttttactttcgtcaaaaaaattaaaactttggcaaaaaaagaaaggggcattccgagaattgaactcgggacctctcgcaccctaagcgagaatcataccactagaccaaatgcccttttgttcaattgtttggttgacatagtatatttatcttcgacatattttgggacataacctaaactaaagtatgtttaagaatgttcttagaaccaactaagtaacaaaagaaaaatccccacaaatttcccacagaattcttaagaatagaaacataaatggcaatggtggtggacctgatgggtcaagagccatggaggagctggtggaccacatgtctatcttattggatgaaaaacgacaaatctttgtacaaagagcgttttgagaattgaaccccggcctctctcattcagaaaattaatacaaatgcaaaacatataatttgtttatcaactgcttatagatttcccaaaaagaaagtagaaggttcaacaatttcatgttactagctaccataaacattaaaactggaaattaaactagaaaaaaatgttcatttcatggatatgaattgcttctgtagcctaactgggtttagatatgtttctagttagtcctccaattaaacagatcaattcgattaaattttagaaactcaaaacagatgtctgtcacatcatccatcacaagaacttaaaaaaaaaaaacacatttctcatatgtcaatttaattagttttttttttccaaccaaattggttcatgtacttgattatgtatacactatacacactcatataaatggataaggtagttttatagtccaaccaccgacaaaacgtgcattccacttcttcttcttcaattgccatgccgtcgtcaatatctcaaacttgactaatataaaccaaagaagaagaagtatataacagaaccaaaaaatataaaaattcatgttcgttgtattaccaaatttaatttacacttaaataaacctaccaaccaatcactcaaaacaaataccagttcgttacacaatggacacttgaagttgaaagcaaccgaacaacaaaagttttaaaaactaataaaaatttaggtgaatataataataaggccaactatgaagaaaaggtctattttatactttttatataaccttttgtcacgggcactgtttcattcccttggaccccttcttcttcaagatctgtttcttccttctttctctctaaccagattttgttgtaccagagagagagagagagagatcccttaataattcttacacatttatctttcttgtctgaatcctaacaaagactttagttttggtcgatcttataattttctttttttattctatggatttctcttccgggtttcaataattgtcacttccgtagtgtaagtacgcgtgtattgtatactagtcagttacacaagtgtccttatgtgtttccttgtctttaattcatttctgaaactgaatttattcttctctcagattctgcaaaggttttggttttttctccgagtttttttgtccttcaaaaaaaactttggttgctctctctctgttcaagaagatccgagcttgattcctaatctgtgagttttatgcattccatttaaagctctgattttgtattcctgtatcaatgtttccccctaatgttatagattttggataaaagattaagtcttgatggatcttatgattaattgtaacaatttatatcatccttgggtcatgaatttacctctgtggttttgcatttgcagatcatttgagaagaagaaactaagaaatg

SEQ ID NO: 30532 - DNA, 3000 bp, Unknown; identical to SEQ ID NO: 28228
  misc_feature (1)..( 3000): 2750-1469P.txt file - cDNA_ID_3032753; gDNA_ID_2213619; Annot_ID_180907

SEQ ID NO: 30533 - DNA, 3000 bp, Unknown; identical to SEQ ID NO: 28228
  misc_feature (1)..( 3000): 2750-1469P.txt file - cDNA_ID_3032753; gDNA_ID_1972176; Annot_ID_180003

SEQ ID NO: 30534 - DNA, 3000 bp, Unknown; identical to SEQ ID NO: 9740
  misc_feature (1)..( 3000): 2750-1469P.txt file - cDNA_ID_3032757; gDNA_ID_1972176; Annot_ID_180002

SEQ ID NO: 30535 - DNA, 3000 bp, Unknown
  misc_feature (1)..( 3000): 2750-1469P.txt file - cDNA_ID_3032761; gDNA_ID_1972177; Annot_ID_180041
ttgcatggcgagattttttatcccgaaagttcagtctaagaatgatgtaaaattcctctgttaagaaaaaaatgcctttaacaaaataaagaattcgatgttgaagaagaagaatatatatattttggtgctaatttgcagcacaagatataaaaattagaaagtataagccaaaaaatcaaatcatgattcgacaaggttgtttttaattctttcgtgattcttgatgttatacccctaatataacttaccgataacattgaattagtgaaaaatatttcgaattatgatcaccagtctctatattatatttgatgattttatggttacgaatgtgaggggtacgtaagattagtaaagacggacatgttgtaggaaggtgtcccagtccgcgatttctaaaagaaagatttgtggtccaaacgtaaaatttaatcagaccttctttttaatggacctcactatgtcgacacacaacatcaaacatatccctaactatatagttcataatcaagatgttttttaccagaaaaatataacatcaaacatgtctctctctaatcattatatttataagtttttcgtatcagactaagaaagtatatatcaacctgagacaaaatgatccggtaagaagaacttcaatttagatgacaaaacttccaattaatttgaattacttagaaagggatgaagttgagacacaaagaaagaatataatagatatattgccttagcttgtaattcacagtttagttgtttcaaagagcaatatcattggaatttcgtagtaaccaatatatattgtggttatatatttgtggggagtgtgtatatgtatttgatatgttgatatttttcttcaaaagacagatgatagagctaaaacgattttttgtcgatatgttgcgcttcgaagtagctgaacctgagtgataatgtcttcatctattggacaagtagggaagaagctagctcgccgtatgcaaatacataaagttccatgtttcacttcttctaggggtgaatagacgaggacacacgatacagtttgtcatgttaatctttcaagctcaaaaaatataaaaattgtatgaaaatctgatacggtaaatctatatattcttttgcatgtttttaaaggagcacttatctttatttgttatagaaatttattatttaaaagaaattcgtctttatagaaatgtgcatgtgttttttttattagtaacacattttcatgcaacaggaatcttcgcttatctgtagtgtacatctcatgagcccatattcatagttgtaaagcaacaccttctctgcagctttttctttcctattgttttttgtatccatagttcacatctacacactatataaggctattacaaacaatgatacaatatatgttctcatataatttgatcttaattttcaagatatttaaggtgggaaaatatcgagatagtatacaatggaaatcgttaccacgtgcatgccaatctttagtagaagaagattcctagattccaacaagaacatgcgcattttttcacgaaaggctggaaagtttaatatataatggtcgaaaaaataggcataatctatttaagtactagcttaagtgttttacgctagatctggtgttgacacttgtacacctggttttaaagttgcagagaaaactagattaatgctcaaattgtagtaagtagattggataatttacactcggaaaaaacaagttttttcagaagaattagactgttgctcacttgagaaaaatctagctagctttgttaattgaggatagttagttatagtatttgaatgacattaaggtgtttgaatatcgcatgaattgtcgccttggtatttgggcaattaccggtcattattttgatctttgtgatgtcaactaatcgatcccaaccatatatatcataaactactgtctcttaattgatccattgtgtttttaattttatcattactttttttaactagttgagagaatgattatctaacccctttcatattcagaaaacttaggttttgagtttttgctttatttgctgctctcttgaattaatagagctctcgtatgcgattgactttgggtgatttttttttgttggaaaagcaaatttcattgaccaatataactaaactaacacactacttccatgtggttaagggccgggatcatttattatttgcatcttttatacgacaatgacaaggattcgttctcattactccatcccattttgtggtatgtaaaatcctaacttttttactgcattgatacaacattttattttagcattagatcaatacgatggacatatgtcatcaagtgagggggtagaagtttgcaactaatgtttttgtgctcatgaatcaatctcttctaggtaacattatttcactcttttctatagcgaatactgcaatgcttttacgttttaactaaacatgactaaaccaaataccaaaaaaaaaacgagtaacactttggtggttcctatctaagttgaccggatcactcgatttgataaaaaaaattatagtaaaagtttttgtttttgaatacaaattatatatttgactaaaattcgaaacttaaccgaaactaaaaccttagcagataatctatagtatagtagattcataaaccgaaaaaacaaaaatctaaacctaaactgagtaattactaatggtggatccttaaaacaaagccataatttgcaattgcaacaaatgtttttgtttggagtaaaaaccaaaaaaaaaatgatggggagcaactaaaaatgtaaaatggtcccaatctaatcgcataagttgggaagatagttagtagttctcctactcccaactacatcctcttcaatgctcaatctcgtcttcttcttcctctctatttaatttcccttgtctctctatctctctcaatttcctcatctgggtcttcctcgtttgctccgcttaagcaccatg

SEQ ID NO: 30536 - DNA, 3000 bp, Unknown; identical to SEQ ID NO: 9751
  misc_feature (1)..( 3000): 2750-1469P.txt file - cDNA_ID_3032798; gDNA_ID_1972177; Annot_ID_180049

SEQ ID NO: 30537 - DNA, 3000 bp, Unknown; identical to SEQ ID NO: 9747
  misc_feature (1)..( 3000): 2750-1469P.txt file - cDNA_ID_3032802; gDNA_ID_1972177; Annot_ID_180060

SEQ ID NO: 30538 - DNA, 3003 bp, Unknown
  misc_feature (1)..( 3003): 2750-1469P.txt file - cDNA_ID_3032810; gDNA_ID_1972177; Annot_ID_180055
tccaaagttagagaaatagatggtactggccgaaattagtatttttctagacaaatatttagaaagtagatggtgaaaatataggttcataaccgtttgtgatctttttattattattgcaatgagatgagatctttaatccgattaactctgggatctattaataatacaatgtgagattaacttcaaattaaaatagcttattggaaaatgtccaaccacgtagaaattatatcagtcatacaatataaactaacaattaactggttcgttcttgaagcaacgatgatgaaataattaaacaacgtaatagagaatttgagttgacatcatatgcatgactttgtctttctagtgttcataaaataatttcgaagttctaccaaaaatatgaataatgtgcatatgtataaactctgccatggttgaacaaaagtttatattttcgacgcttttcaaattaatacattgatactttaggtatatacgccgtacacagcacgtctacgtagccaacttttgtcatgcatgatgcatttatacaaatcgagttatttgtaagtaatatcgtaaatttctatttaaatccagtgcaatatatttttatcattaaaaaatgcaaatcaaacatgaagcatatgaaaaaaatacaccagaaccatacattttatatttaaaaaattatctacaacaactatgcaataaaattatgaaaatgtaaataatcaatccattgggatagttttcataattaacaataatatgttggcaaatcgaagtgagtgaagcatgagatggaaattaaaaaagaggaaaacagttaggggcggtgacggtggaagagcattaacgacatttggtgatgacaaagcagatctatgcaccaaccagatcttgtatatctgccacatcatccacgccagcaaaaaatatacatacgtgttatgtttaattaatcaaagtttatagcttctcgtggttacagatttttctttctttttttagtagatatgataatgtgaaataactataaatcataagtcgtatctaatttagttaaaattaaagtgagatacatttgacataatagtgtatatatacgtgtaattagtgacgtgtattatattttttccaaatgcacatgaacgcatacgtaaccacttgcatgtgaatttattatctacctctactctctcccgacgatttctcgtcttttcatttatttcattctttatacaaaaacagttttcacttctagttatgtctatctattgttcttatgtattttattatgtgtatatagatgccaattctcaatttttcatctccaactaacaaaacaacttgacgatcgatatgctaaaacattgtaaggcatgtccgtgtgtattgaatggtatcacagtctacggaagttgcacattaatgtggaaaaatgtatgtcgaacaaatataaagtacataaatagatctgacccactgctccaagaggactagggtctagggcatgtacggcgtacgatcatgtatttgatcatctgacaatgaaaacatgatatatagcacaacccaaaagatccaatctgatatgatatatatatatatatatatatatatatatatgaatccaaatatatgtcaatgaaaacatgatatatagcacaacccaaaagatccaatctgatatgatatatatgaatccaactatatgtctttaaaatatcgattcatttcacatatattgagcaagtatagtactcctatagtctcctactgtatatgagttaattcacttattaagttgttactattgaactttgacatggtattagtgtatggttattaatccaagtaaagtttgttatctaatcctaaaatgatttataaaggaatctttgatttacataacacttgttctttgatttgatttgagaaacgtatctaggaacctttgttttgggaagaaaatgatgtgtgcgcttaattaatactaatacaaagcgctgaaatcatgaaataatgtcacaaacatgtacatgcgcagcaattccttaggcttggaatacaagtaagtatagatgctaattatgaactccaaatcaagcaatacatgaaatcatacaaaatgatttataaaggaacctcggattttagcttaaacatgatgactttttatgtttgtgcataaatgaatctttggtttatttaaattaaacatgatcctacatatatgctccatcgaaatttgaacactaatatcatggacaaccgatgagatatttgttaattagaattttcttaagaaatagctaagaaatcattctatagagaaagatgtaatcgaaaatgtaaaataagacagattttaagttcaagatatagtattgagtgttatatatatcatctctaattcacttttgacaaaactaaaattaaatctgacacatagtcacactgtttaacataaacagatttcacgagaggatttgtagcataaatttgataattataattttatcaagtaaaaataataaaatacctataattatgtcgcaccatattcactacaattgtttattctccaaaaacaaacaatctttttgctgtaaaaatgtttagatttttgttaattttcctttttttttgtttttggtttacagattttgtttgtatagacaaggtcgggctgacccggatattcggatccgtattgtcgtattgacaccgtgaacccaaccaaccaaaaccctaaacccttttttgacttgtctctacttgttacttcaccgccgcgttctcagtctctcaaattcctctgtgctttcgattcttaccagtgaatttttcttattttacttatcttatgctcgtatttggaggaactgagcaaaaccctagttgtttaattgggtcaaatttgtagattgagaatccaaatttatcgacctagttattgaatcccgagttgatacctagaaacccttttgcagtcgcagtaaaatg

SEQ ID NO: 30539 - DNA, 3000 bp, Unknown; identical to SEQ ID NO: 9744
  misc_feature (1)..( 3000): 2750-1469P.txt file - cDNA_ID_3032814; gDNA_ID_1972177; Annot_ID_180053

SEQ ID NO: 30540 - DNA, 3003 bp, Unknown
  misc_feature (1)..( 3003): 2750-1469P.txt file - cDNA_ID_3032821; gDNA_ID_1972177; Annot_ID_180051
taaattcatgattttggtttttgacctctatcctacatttgtagttcgtcggagacaaggttgcctatgcacttgctcaaggtttgaaagtgattgcttgtgttggtgagactcttgaggagcgggaagctggatcgaccatggatgttgtggctgcccagaccaaggctattgccggtatgtatattgtcaaacatttaatctctttttgctatctcagttcgttctcgtttacagtgagacctgttttgatgatagtgatgcccgtttctacgcactatactcccttagtgtgtgattcaaaccccacagaaatatttgttggctaaaaaactctttttgttggtaatggcagatcgggtgacaaactggtcaaatgttgtcatagcctatgaaccagtgtgggccattggaaccggaaaggtcgctagcccagcccaagctcaagaagtaagtggttctcgatgcgcagttgcactgtaacgtgttgcatatggtcatgatttaataggaaaaccaatgctgttttccttacgagagcttgtttcgtttatgaacaggtacacgatgagctgaggaaatggctggccaagaacgtgagtgctgatgtcgctgctacaacccgcatcatttatggaggtagatagatgataacacgatctttaattaaacacccctatatagttttctatgttacttagcttgattatgcaaattattatcaggatccgtcaatggtggtaactgcaaggagctaggtggacaggccgatgttgatggtttcttggtcggtggtgcttctctaaaggtacatataatatggtttctcttgtaatgatatctttcgtttgtctctttcaaaaccatgactaatgttttcattcttggtctttttgcagcctgagtttatcgacatcattaaggccgcagaggtgaagaaaagtgcctaatgagctcattaagcaatttaaaagtcctttgcttttccagtcgcaactctgaaaaaatgaataagttggtattatgatatgatacattttgcttcagttgtatttggcaaaagtttctctcttactatattgttttgagaacgcaacaatcattttcttcgccatttatttagctgtggacttgcaatttgcaaatcccttccttttacagtcttctcaactcttcagagaatctgtgtttggagttcataacccctcgggccttttgatcaaacccctatttctaatgtcgtccgatcataaacctgtgtgttatataatatgttgtttgttccattttagactttggtattttgtcatgcttgatctctgaatcatgctgtcaaccactttgaaaatggctttacttgttaaataaatgacgagagaatacaggagaagtgggaaatgactttattttttcccttttatcgctttttgcctattggtctgtcatttttgacattttagcttttagaacattattattttcaactttattgtcatcatcttgaaaaatgtccaacattacgaaattattatgtagagagtaaaaaaggaaaagaaatttcatggagaaactcattgtattaggaatgtcaatgtttgtagaaaacaaaatgcttatgtaatttgagtaaaacggctcagtggaactaaagtgataatgtaaaagagacggttaagtccaaaataagagctcccgtatgtcagaattgttcaaaccatttattaaaaaattggactcagtatgatgaaaatgtgtatggattttgatccgaccacgaaaatccaactagtgccaataaaaactccacaatatgtgactcagctacaaatgtgataacgtattatctcccaagtcaacccacatttctggtgacttatattttatttatttctgagtaatatttaagaaagtagggattgaatttttatgagtattatattatatagttgaccttggacttatttgcgtaacgagcaaacaattgtgaccttagaaatggaggtttgactaagtcatcgatcatttcagcaatagagtaattttgggtccgtatgactcaaaacaagttttggtaaaaaatttctctgttttaaaaacttgtatttataaaacttatgtcccatcccatgatactaaatttaattacattatacgtatgtagtcaagcataattttttcctgaaaaatcttatttttcttacctacttgtaaactttaatttaattcctggttaagtagatatttttcttagttcttacaaatcttatattttcttacctacttttataaacatttttgagaccactattactaaacccgaatctgtttcatcattccacacccaaagcatataaatcgaaaatatctatgatcacatgaatatctatcattttcgacaaaatttgtccttttttttctttctttttgtatccaaccccaccacggcgaatttatttcaggcctattaaagattccaaaatctcatgaccatctgactcagatgtcatatctattaaaaacgttattttgaatcttaaacatatatcattagtgatctttttgcacgtttactcagatgcttaagatcatcaaaatcaatctatgaatttcaaaagttttaaaaatcatacaatagaaaagtcccactgatcattaaattgttattactaattttatttagaactcgtttattatcttttggtcaaaaatataacttttgtctgaattcgttttttttttgtttggacaagaaaaagacctttcttcttccttcggttgcctctaccatctcatcaacacacatcttctctttctcttctctcatcctctctcttcttcagtgtttactttttctctttctcttttttttttctctttattatttcgctttaatgagttttatctgatagaatctgctccacccaaaaacagcataagaagaaattcattgtcagagaaaagtgcaaaaaaaaaaaacgatcttcttcatcattctactaaatg

SEQ ID NO: 30541 - DNA, 3000 bp, Unknown; identical to SEQ ID NO: 9752
  misc_feature (1)..( 3000): 2750-1469P.txt file - cDNA_ID_3032825; gDNA_ID_1972177; Annot_ID_180045

SEQ ID NO: 30542 - DNA, 3000 bp, Unknown; identical to SEQ ID NO: 9759
  misc_feature (1)..( 3000): 2750-1469P.txt file - cDNA_ID_3032855; gDNA_ID_1972178; Annot_ID_180108

SEQ ID NO: 30543 - DNA, 3003 bp, Unknown
  misc_feature (1)..( 3003): 2750-1469P.txt file - cDNA_ID_3032859; gDNA_ID_1972178; Annot_ID_180112
tgcacttcattgggtctataaatgttgaagattgaaatttaagacttttaccaattacaatacatttgaaaaaaaaaaaaaaaacgtttgcgtttctcacaccatcaaccttacatatggctgttatatgagcctcgagagacttggctttcttcaaacacaataaatagatctgaacgaaaaaaaaaaagatgtgaacgagttaactttattgattcaaaataatattcagagtcggctaaaaggctttagataatgacaacttcttcttctaccacattcttctagctaggtattaataatattattccaataataagtgagaagttttgttggtgaaaaaaagagaagagtaaaataaaaagaaactttgaagggaaactttgatttggtcaaaagccaacgacatgcattggctctatatatatgtgtctttaagaactcatttattactcttcacttcaatcaaagacaagaagaaagttagccagaaaaaaaaacagataagaaaatgtctatctttctttgtttcctcttacttcttccactctctttaatcttcttgaaaaagctcttaccgtcgaaagggaagcttcctccgggacctaagggtcttccgatcatcggtaacttgcaccagtttggaagatttcttcacaaatctcttcacaaaatctcccaagaatatggaccggtgatgcttctccatttcggggtggtccctgtgataattgtctcttccaaagaaggagctgaggaagtgctcaagactcacgatcttgagacttgtagccgacctaagacggtggggagcgggttgtttacttacaactttaaagatattggttttgctccgtatggtgagaattggcgagagatgaggaaaattgcggtttccgagctctttagccagaagaagctcaaatctttcaggtatattagagaggacgagagccaattgttggtccggaaggtatcaaaatctgctcttgagacaccaacttcatcagttaatttgaggaaggtcatttttaccttcgcggcaagtatcatttgtagactttcttttggacaaaatttttgcgattttgtcgatatggagacagtggaagagttggtgcttgaatcggagaccaacctcggctccctggcgtttgctgacttcttacctgcagggtggatcatagatcggatctccggtcagcattccacggtgatgaaagccttttccaaactcaccaatttctttgaacttgtgattgatgatcatttgaagagtgggaaaatcgaagatcactcagacatcatcagtgtcatgttggatatgatcaacaaacccaccgaagttggttcttataaagtcaccgatgatcatctcaaaggacttatgtcggtgagtataaataatacctttagtaaaatcttcaaagttctacattagaggtaacttgagggacaatattatagcttggaaagcaagttaacttataagtataggcaaatataccgttttgttcttatttttctgacttggttcataatgctccctagatttatattgatgtcctattttaaaaccaaaatcatgaattattttccatgtcattggatcaggatgtgtttttggctggagtgaacgcgggttccatcacaatgatatggacgatgacagagttaagtagacatccgagagtgatgagaaaacttcaagaagagattcgagcagcgctcggacccaacaaagagaaaatcacagaagaagacctcgagaaagttgagtacttgaagatggtgatcgaggaagcattcagattacacccaccggctcctctcttactcccaagactaacaatgtccgacatcaatattcaaggctacagcattccaaagaacaccatgatccaaatcaacacgtacacaattggacgtgaccccaaaaactggacaaaacccgacgagttcatccccgagaggtttgtcgataaccctatcgaatacaagggtcaacattttgagctattgccgtttggagccggacgtagggtctgtcccgggatggccacggggatcaccatcgtcgagcttgggcttcttagccttctttacttcttcgattggagtttgcccaatggaatgaccactaaagatattgacatggaagaagacggagcttttgtcatcgccaagaaagtctctcttgagctcgtaccaactcttcatcgctggtgaagcatgcaactataactatgttaaataatgacaagaattctatatttatgtccactttactaccggtttggattttgctttgttcatgtaatccgcatgtttcatgttatctttcaagttctgtttttatgttattgtcaaaaaaaaaaaaaaaaaaaactgtttttaagttgacaaaagaaaaaaaaaaaaggttgacattacattacattaaagtatttgactcccgaagatccagggtttgttatgataaataattggttttcaaaagtatgaaggctactttaagttacttgtagaagaccaatactacgtagtcaaaactgctctaatgcttttcattcaatgattgaaccgtgttattaattagttaattagatgtatccaaaacagtttaattgaaaaaacatataatagtaaaactttaaaatttggagttcttttcttctaaaacatatagttattggagtaaacatccaaaatattatgacttttcatattctgttattagtaaattttgttttataattattcttttagaacttggagacataatataaataaacaaacctgacatttcgttgataatttttttttttttttaaaccctagttgaagataaacgacgtcagtaatcctctgcgttttactctgtttttgagcttgtctttgttccagttctctgtttcgatgttcttttatctttatttatcatcatcagctaaagaagttctcaagactcatgacctagagacatgcactcgacctaagatg

SEQ ID NO: 30544 - DNA, 3003 bp, Unknown
  misc_feature (1)..( 3003): 2750-1469P.txt file - cDNA_ID_3032866; gDNA_ID_1972178; Annot_ID_180106
ccgggaagtaattgtgtgggcatgatcttcttaagtggatacctcaattctgaaaatgatctacagaagtataacaaatggatgaaagatgtcgacgaactaaattgctttgattttggattattttttgttttctgcataaaatattttttttataaattaataatttcgaaaccgtgaaattctattaatttatcgataaataaatatatattatcagtttgttattgtaaaactaaattagtacaaagaaatgattatttttaagaacatctataacaagctaagcattcaaaccttcaaatttgaaggtttttttaactccaacaaactctcaaacccttattttttgaggatgtgaataatgaagtttcaaatttcagggtgcatactattcacacattcaaaatctcttctaaattttattttagtccttatacttaatatatcttacaaataattctattacatttaattatgacaaatatatgcatataaattcaaatatattaaaatattaaaaaaataaattaataaatttatacaacaataatattacattgagcatatatgaaagcattatagacataattacattgaatatttttgtaattttacatgtaattttataaatcattttaatgttttatgttatgtttcttttctaatttatatttaattttatataaaaaattaaaatattatttaacataattattttgataatatatgttttatatttatttatgaaacttttatcattatcagtgattattgttactattaaagactataatgtaaataaagaaataaaaaataaatttgagggagtatcatcggtggagatcaccctcaaaccttaattttaagggtttattaccttcgtagataacgtttttttattttgtttttttcatctattgccttgttggtatgaaaggacctggtttaattgatgtcaagaaaagaacccggtttaatttaatttcggtcagattcaccaatctcgaatccattctctcgccgtctttcaattctccgccatcgaacgaaacacagaatcttcaggatgtgacaacactggattcctccgccgtcttctccttcggtggagaagcgattcgaattggaagaatcggttggcttgacattgattcaacgatgaggctccttcaagctagtcccggtaatgaaaaagtccttattgctgcatttgcataataaattgttgcctgatatttcttggagatttggttacttgctttagctttttgatgcaatgatctatagtagttagtgggaatttggtgaaagaatgtatctttcttttacttgcttggttagttcaggggatacatacaactaatcttgaagtagctattgtagtactttaaggaagaagctttactggtaatccaaagcatggcgaaaactaactgtaaagtactaattttaactacacctaatttccatactttctgtttatgaactcactcttatgagtgttaaataccattcattcatcacatgtgcacacctcaagtcttatcaaaaacatatatatacttaggattacatcacaaaagcagaaaacataggcttaatatccgcttcatcacatcacagtctttacatatactgatatacacacatatacacgtcttaggagctcctttgtcccaagtcatatcttttttctcgtgttgctgattctaacctgttccatcttctccaccaccaccacctcctcctccgtttgcaccccaattgtcaaagttttgtcttggaatgttatggtggttgtctactcctcttgttgatggaatggcggatctgtccttctgaacatggtgaagcctctgatcttttgtgtatatccctctccctcctccctccacagttaaagagctcataaccaccattattaccagcaccactaccaccacgacatgccttgtctgaatttgcatttttgttttgtcttgtttcatgcaatagctttcctttttatagaattgagaagtaaggtttaggtatgggaaatcttgcaactgttttctgtgtgttccactaggaaaagacaaaacaaaagattgattgattagcctttaattgatgtgtttgtttgttattgttgtgacttgtgacgatgatacaaaaatcaaaagaaataataatcactcatccaaataggaaagttccaccgttaaagtggtgaagacgacataagaatcaatgagaagaattggttagttgcccgaataggaaatttccaccatttctagtggatcacctttcttttaatcatagacttttatatttgtttgtgtaattaaaagtcaatgggatggtaacaacttacataaagtaaaatttcaagcaatttacataattttcattcaatgatttcattcttctttctaatagcatgcgttgatagccgaacaagttgatgacaagtgtcttttaatctaacccacaaagctaccatctgaattatctatggttaaatgatcagttacaaataattcacttcgctaattacatcaaaagatttggtagagacaaatcattcagagaaagtaaccatcatgatcatgcattgggtctttgttgggctgcttaaagctcgtaatgaagctctgtcaattgctcttggggcttaattttattttggaaacggcttagtattatagtgaagaaaatttatatggaatgtaatgtatttttcaactccttaatatgaggataaccatgtgagtttcttcgtctatctgaacactttttaagcatagtttgcagagtttttaatgtttatgtttatatttaaattgatacccattgattaattacaggtcatctatttctactgctgtgacactcttttgacttcatcttcgtcttagcacattgcatcacatgccttgatgtctaaactataaaatgactttgaatcatcattacatttgatatttgcacttaatgtcttcctcgaagttaatg

SEQ ID NO: 30545 - DNA, 3003 bp, Unknown
  misc_feature (1)..( 3003): 2750-1469P.txt file - cDNA_ID_3032872; gDNA_ID_1972178; Annot_ID_180100
tattaaaaaatggtatgtctacatacccttttgttttcttctacttttggctttaactttattctttttcttttgtctaacttctttttaccccactattttcataattaacctcaaaaagtcaaaatggagctaatttagggtgtttgatttggtacaggaataacaatctggggatgtggactactactggatcggaaggtactagcggtttagattcttataatgactataccgatgaaatgtctggcgctggttcaaccaaccggttatctttttcagttcttgttttcttgctaagttcgatatcatatttggtcgtgttcacttcttcaacccaaatgtttatgttgtaacatgaattgaatttacctattttatcaaggaacaagcaaaaagttgtttccatactcattcttgtgcattcttttcttctatgatctttatgtagttttaatggacctcataatttgtagttttacaaaatgttatagttcttaataataataccacgtgtgtgtttattgtatacgtatatgcaatcgtgacgttgtaatagtcctatcctatctttaattaattacataactaatagtctaatagagattagatattaatctttagcattatattatcttcttccttgtcttttctaatatacaagagggcgttccatacatgcatctacacttcattcggatcataccaatataatctactttaggatattgtaatttagtatattgaacattaaatacttttcccttgaaaaaataaaatataaaacatttttaacaaatcatttggcacaaaagtacactaaaacaattaaaattaattcatattaaaggtgaagcccatcaaccaataatgttaacataaaaaaacttataatttttcatcattggagcatggacttctcatgtttttgttgctgtatataacaagactatacacatcaatgctatatttttacttaatttgttattatggatatgtacctttatttttattttattttattttgtttaggaaattgtttattgtgtgaagattaacaactttatctttgaccttgactaaacttgcgattcaaatttcatattgataaccgattcaaattgagttcaaattttacatatttgtgtacattaaggttgaatattggaacacttgttactttaatatagcactttcgaattcaattatccatcagttaaaaagtaaataaaccaactttagaattatgaccatagagaacatgaaaactcctcaaagtccctagtctcttgaaaccaccaagtaccaatgttaatattgttctcactgcagctattgctgctgtgatcttctgaaagatttgcttcactctggtcagtagaaatctctgatatccaatccgaaatccgattttcatacggtgatttcataacaccgaagctttctcttccaccaacaccaccgttggcttctttaccactttccatgctcacaacttcaacaaaaccatgttcttgagacgtcgtctttgtcctagtgatctctgtttccttatacttgtgcaacaattcttctcctgtatttcctctccactcaaagagctttcctgcagaaaaacacatcatttttttcaatgaatgcttatctaaaactaacatacatatgcaacaatgaaagaatatctaccatagttttgagcttcctgtttctttctataatgagttctccaatagttctttatctcgttatcagtcctaccgggtaatcttctcgcaatcttcgaccacctattgatatacaatatttgattaatcaaaccgcaaaaaacaatcatgtaagtacaagattcaagggttttttttgtctctcacttgttaccccatagagcatggagctgaaagatgattctctcttcttcttgactcatcggtccacgcttcagagtcggattcagatagttcatccaccttagcctgcaactcttaccactcctcttcaaacctatacgtatgaacacaacaaacatatatttcggacatgtaaatttctatttttggaaagtgacacaaaataaggtttcaaagtgtaccggaaactattgctaaagaatcccaacgacgttctcccaaaagactaatgaccttcactagccgttcgtcttcttcttcgagccatggccctctacgaagtgtttcttccttcttaaaatccatttttctttcttttactctgtttctttgtgttattatacttaattaaatcctttctaaaattgtgctttgaacttgtaagcatgctttggctttgcttaaatagtaaagtcatgagtttacccaaattgggaaaaatgtccaaaaagctgacgaacacaaatagtttagtggataataacatcatgcatcagttagttaggttcttgtttttccttgatctaggtcatcttttaagttatagattatagatttggattaggttccaagtatctttccttttgaatcatcatcaacttgtgattttttattatcattgtcttcagggattatggctttcatcatcttaaaatttaattaactaatctaagtatccaatcgggtttggattttggaatttcaatatcttagggacttaaaaaagaagatagaaagagatgaaaccagatcttttttccactcacttaaaagtttaagccaacgaagcactcttaagtatgattagttaagtaaatcccagtgttaagcctaatctcatttttgcaacaaagagagtttaaaatcgacgcatctaattgagccggttaatgaaatctatcaatgttgaaaatggctttggttaaaatcggtttagactattcacatttcacgtgagactcagacaacctgcacatgacagtcttatctctgtttttgtcgttttcaagaaagtcgccacaagagatcattcgaactaaaaaaagcaaaacagatctctcctgccgtctttggttacttccggcggagaacgatg

SEQ ID NO: 30546 - DNA, 3003 bp, Unknown
  misc_feature (1)..( 3003): 2750-1469P.txt file - cDNA_ID_3032876; gDNA_ID_1972178; Annot_ID_180098
ctcattcaccgatactaatcctttgagcatctctatgatgattgttggatcatttggttttattgtggactttgtgtcacatgaagggtcgtatttgcaaaatacttgacataaagatgtggttcagaaaattaataaactaaatttcatatttcgagacgcatgctcatgctggagtactatttgtatttcttactttttcgtcccatgctttcaaaagcctcaagaatatacagagtattttcaataatacggagtagttcttaatcatttacatttgtctatgaattgaatttgactactaatactcggaaacaaaaaaatgattgtagtattaggagcgcaaataccctttaaccattgttctttccatgttcttagtccggctattgttatctaggtaggtgcctgatccctttttttcaaatctttcttattcattactttgactaattaacctatttaatcatatttaatctccctttaatctgcaaactaaagcacatgtttttttttatgaaagaaaaggttagtatgacattcttttggtaaatctcatcatattatttatttaattttaagaaattggagtttaaagtgtaattaagttatgctacctagctaatttccttaaaatatgaacgataagtatagaaattaaagtaaagattaggtttatacggtacgcttattatgctcaaacaagtggacgaacaaaatccatctccatgtgactatggaagagaacttattaataagtccaaatttttttcttgcaaactttatgatttcattcacactagacaaattaattgttcgtaagaaggtatacgtacaacataatgagcttttactgcttccctttgcaaacgaatcagctaaaactttacagatttatatgttcaagggaaactataactaagatttgaaggaaaaatctaacctttctactacaacaataaaagtcaatgcaaggtcctttgaaaagaatcttgttgtcgcatgcatgtacgtaattttgtagtcaaatgtacgaatgatagatatatggggtcaaaacgttaaaatccagcctaagaaagacagagatttactctaaatcttccaaaccaacgttatcaattttgttgttaacattcaattgactttgctgttaattttggattgtagaatcgaattaaaatgaaaatacaaggtgaaaacgagacaatagcgtgaaactgctttgcgtatatatcaagtatcaacagttttgtttcgtttttgttggtttgcgttgggataagaaaccggcattttgtacatggttcaattttgtaatacctaaaccaatttccggtttaagtggtttattaatatgataaaataaaataaatattttttacaaaaatacatagataggaccatgggtccatgacgctttgacaagagccaataaaggatttactgtaaaatcagtaactttattgacaaacaaaaaatgcagctataagttgtccccaccgtatattacaaagattcgaatactttaataatacaagctaaagaataaagagcaagagcctttgactatttccacttataagttttcctccgagaccgagagagatcagagatggagcagattatttcaccacgctccggtcaaatatatatttcttctgttttaggcctcagcaaaaaccacctccatagttgttatgttggatactacgacaatttagtgaagaagtggtctcaatctaaattatcattctggataatgacaaattgataaaagatgcatactattacaaaagttgagaaaagaagattactttacgtaatgtaggcgttttaatgaactccttaatttcatcgttcgtggaaaataataacacaagcaaagcaatgacttttatggacactatgattggttacaatgatcttattgaacatgtgaggaggcaaagtgtatatccttatatctataatgtttttttttctttcttctccaaagatgtcgcctaacatcacgttatttaacactacatttagcttacattagtaatctaaaaacaactttaataataatccaacaatcacgccttatttaaccaatcctaatttatgaaaacatactcatgtatgattgtttgtgcgcatgtgtatatgagtatatggacacagtaggtttctttccttggttggatagatatggttacaaacttgcaatagtggcaggtagttagacctgcggttcctaaactccgaataaatacgtgcggttcaactgcaatgcagttctaataataacgaatatatatatatatatagataattttgttactattggaacatgtggttaggttacaatttcaaaccctaattattgattttggtaatttggatgtattcatattcctgttggttttggtctactcaaaatgttagtaaatctcttatgggatgtatcgaattaacttaaaactcttttttctggtccagaaacccattaatactagcattcatattgtatagcactatagctcgtggggttattataacgtcacatcacttttttgtaataaaagttgaaaaacctgacaagaattcaaatattaaagcctatccttagttaaaatctgttaaggcttatgaatatccttatcttatgtgagtaattaggttaattagatattagtacaataaaagaaaaaaggaaaaattgaagaccgtttcctcgagacaagcagattctcaatcctcgagactgtcagtggaaaacaacttcactctctctcttcaaaaagaaaaacaaaaatacaaaagccaaggaaagccattattacaaaagcaataacacactgtaaaaaagccactcacgaacactcctcagtaaccagagagagaagaagaagaacaacaagccatgtcttaactcttaactaatctcttcttctccctccatttcaccaaccaaaaaccctaaaatccttaaaatcacaagtttcttcagcaatg

SEQ ID NO: 30547 - DNA, 3003 bp, Unknown
  misc_feature (1)..( 3003): 2750-1469P.txt file - cDNA_ID_3032880; gDNA_ID_1972178; Annot_ID_180092
aagttttgattaacaaaacgtagtcgttttatgcatcgtcgtccttatccacgcgtaacggttcgcgtttctacacagagtcaaatatttctgcacggaagcttcgaaaagaggtcatcaatggagtcttcactcttttctccatcttcctcttcttactcttctctcttcactgcaaaacctacgcgtcttttatcaccaaaacccaaattcacattctccatcagatcctccattgagaaacccaaacccaaactcgagaccaattcatcgaaatcccaatcatgggtcagtcccgattggctcacaacactcactcgtaccctttcctcaggaaaaaacgacgagtcaggtataccaatcgcgaacgcgaagctcgacgatgtcgctgatctcctcggaggtgctctcttcttacctctctacaaatggatgaatgagtacggacccatttaccgtctcgctgctggtcctcgtaatttcgtaattgtgagcgacccagcgatagctaaacatgttttgaggaattatccaaagtacgctaaaggcttagtcgctgaagtctctgaatttctatttggttcgggtttcgctatcgctgaaggacctctttggacagtaatttcatctcctcctatctcaattttgaagtttttggaattgtggaagtaatgtgtgactgtcttgtatgataagtaactctaattttagggtttagattccaatcttctctattgggcttagctgaagtctgattttttacataggcgaggcgtagagcggtggttccatcgcttcacaggaggtatttgtctgtgattgtggagagagtattctgcaaatgtgcagagaggcttgttgagaagttgcagccttatgcagaagacggaagtgctgtgaatatggaagcgaagttctctcagatgacacttgatgtcattgggttgtctctttttaactacaatttcgattctttgactactgatagtcctgtcattgaagctgtttacactgctcttaaagaagctgagcttcgttctactgatcttctgccatattggaaggcaagtttcctgtgttttttctgtggtttgttgattgtgtggaacaattggattcttgttaattgagagggtttggttgtttttttcagatcgatgcattgtgtaagatagtcccgagacaggtgaaagctgaaaaggctgtaactttgataagggaaactgttgaagaccttattgctaagtgtaaagaaattgtcgaaagagaaggcgaaagaatcaatgatgaggagtatgtaaatgatgctgacccaagtatcctgcgtttcttgcttgcaagcagagaagaggtttaaacttttttccttaagtttataagcaaatttggcctttcattatcgcataatcgaagctgatgttgcattgtgagggttttcaggtatcaagtgtgcagttacgggatgatcttctctcaatgctcgtagcgggtcatgaaaccactggatctgtcctcacttggacactttatctcctaagtaaggtaccttaatgtatcttctactttgctatgctagagaatttacttggatgggagcttctctgttctcatttacctcttcaaattctctatgttcatagaactcatctgcattaaggaaagcacaagaagaagtagacagagtgttagaaggaagaaacccggctttcgaggatataaaggagttgaagtacatcactcgttgtataaacgagtcaatgcgtctctatcctcatcctcctgtaagcaatcaagctcatctctctaattattcatgaactaaattttctgattgatttgtttcctggtaggtcttgataagaagagctcaagttcctgacattcttcctgggaactataaggtcaataccggacaagacattatgatttcagtctataacatccatcgttcttccgaggtacagttctcttccttctctcgtccatagtataacataggggagcctaatccttctcttcaatgatctttgtgtggttcggatatctaaccggagtggacattcctagtattacattcatgcccacatttcttatgtgtttgttgtttgttattccaaaggtatgggaaaaagctgaggaatttctgcctgaacgattcgacatagatggcgcaatccctaacgaaacaaacactgatttcaagtaaactcagtagaacacatcttttgacacaaactactgaatcaagattagtggttttgattagggaatttaaaagatgattttcttttttcaccagattcatcccattcagtggagggcctagaaaatgtgtaggcgatcagtttgcattgatggaggcaattgtggcactcgcggtgtttcttcagcggttaaacgttgagctggttcctgatcagaccattagcatgaccacaggagcaaccatacacaccaccaatgtatgccaatgttctcacactcgagagattaatgagagtgtctgttttgtttagaatgattccaatttctctaatgctgatattttcaatttcagggattgtatatgaaggtgagccaaaggtaaaaaccagaatttatgttttcatgataattgattggtgtgaatggacttgtttcatagtactcttgagaaataaccacaaaaaaatgaattatggaaaatagttgtaccatcggaaatgtgaattttgaacagtgagatgctagtaccattaaagtttggtaattgtgttatcatttcaaatcaaactttcatacagcttgtgtttgttctccatttttcagtaattacgaaaatcaaaattttatttttttttgaatttctaaataatagactaaggtctaaaaccatcccattccatatggaccacacgtaacattaaccttaaaaaccatataaaaccatataaaaccaatactagtgggttctatagcgatgtgtagtttcactttcacgtacgaggaagattaaaaaaaatg

SEQ ID NO: 30548 - DNA, 3003 bp, Unknown
  misc_feature (1)..( 3003): 2750-1469P.txt file - cDNA_ID_3032884; gDNA_ID_1972178; Annot_ID_180089
acttaagcttagaaatgtatgtttgatattctgtttggtaattttgttttcttacttttgtgctttttcatcttctgcaggtctcttgtgatacctctctttgggctgctattggaggacaagatgtagaaagacttccatctgcttctacgtgctacaatactcttaaggtgaagtttcaatagtccaattatctttgtagtctacatgtgaatattcctatatcttttttgttcagtctttctttttggatttcttcagcttccaacgtataaacgagcaagcactatgagggaaaaactattgtatgcgattacttcaaatgcaggatttgaactctcgtagagacctctaaccaggtattcatcttgttatgcacctagaccttttatcctttattctattcaatgtatatggcttctgtcaagttaaactagtaaggctggtgtaaacagtgtgtttggtttatcttaagattatgggaacttgtttcttcttggtagttgtatatgaatatatgataatcaactaagctgaaaaaatcttcttaagctttaccaaaattcttgctgtaatcaaccttagaaatgttaaagaggtagattcggaacaaaaataaaataccaaagattgtgatcttctcaaacaaatcttggacctatagacccatcaggccatcacacagtgacacagaccagattggtagtttctacattcagtcacacacacgcacacacaatctgtctcttatttgtgagttacatatatagagagagaaagagaaagagagaagagagagagatagagagagagagacaaactttggtagctatttgtaggtatacagtttgaattcaatccaactggaatgaagctcaattcaattgattagagaaatcccttgacccagtagttgaccagccaacagctcgtttacagcctctgtgggatgaaatccatcccaaaacacatatcctgtggcatttacacacgttccgaaggatagagaattgcaaaggaacgatgtttctattgtccctgttccgcagcatgccctttttgtttcaaagaatcctagaatacatgtagtttagacatttaataagatgttaatggtatcttgttagttgctaactagattaaatatctgagttcttcttcctgtgaatagctcactctatcatggtctaaagttgaatgaggatttagattttgcaggtgtgtaccattgtcagttgggttggtgatgatgtccaggaaaggttggtagacattaaaggcgacgagtctgaggcctgagtgtctattcatcagtaaccgggttgtgttctcaagtttagtattgaacatgatagcatcattgttcagtctctcaacacaacttttgtttcctgcaccgaaaagagtgatagctgcaggcaggcaacccatcggcggtagcgatatcactccgattctccttgctcctagttcatacagattctgttacaagtgacagtatgattcttgttcacacaaaaaagggtaaataactgatacgatttttttgtgtttcttgtaaatttgcacattcatatggttgccttattatgaatatcgagttctacaagttcgttactaaacttagaagtacctggatgaattctgagaaggatctcaggagaatgtcagcgaactgatcaggtgtatttaggatgttgagtagaggattgatgtaataattctgaagaaagtcgctagatcccgcactcaaaatgtggatacctctagagaacagtatgcgcgcgttccccctcccgatcattctcgttactctattttgatacgccctgtaatagctcagctgtcgtgttaaggagatcgagccctgcaaaaggaagagtaaaaccttatggatcatttcttgggtatgtgtgtaatgatgtttgactgtgttgtctcctttacaaatggaacagatgtggcatcatagtatcctgaagaagctgatgcaaagttggcaccgatcaggatattctcgttgcttgcttcccggcttaggaatgcaggtgggtatgaagagaaaccaaggtactcggctagacacaagtaggcagattaaaaaaccaattagattaggaagagagaaaaagtatttgaaggtaatacttgatggagagatagatatatgtggttttgtgagaaagactttacctgagaaatctacagcgagttttccgttgcagaatcttccggtgggtctttggtcgatgaagtctctaccgtaaggaagaaagttggatttgacaatgctgagtaagttattgttgttgccaacgtcaacaatggagtcgccaaacatgatgagtgcaggaacaacagctcctttggatttgcagaagaaacaagaaaccaagagaagaactctaaaccccgaaactctcatcttttgcattccttttcgttcctgtctaatgcaatcaggtcgttaggacaaatagagaagagagagaagcagagagaaagaaatagagagtagtggtgagaaaatggagacttaagaagatgatgcatgttatacaaaatataatcattctccccatgcttatgtttaagataaagaaaacgcatttgctagtgcaatagagtaggtggaaattgtttatgaggtcagtctctttggtcattgatcatgggaccatgatcagtaatatctttgcatcctcgaacataaacttccgtcatatcgcgaaatttcaattcgggccacgcgtggaggctttggtttgaagggtagctctatcaataaaaatatgggtattggggaaatcatctaatcttgattgattgattgctcaatacttcaataatctaattttggtttctgttgaaccgttggaggcatgaatataaaattctgataggatacagttttcttgataagagatgatatgtttgaggaaatcaaagtgtgagctccaccaacttttagttgttgttcttgtaataatgtattgggtaatg

SEQ ID NO: 30549 - DNA, 3000 bp, Unknown; identical to SEQ ID NO: 10233
  misc_feature (1)..( 3000): 2750-1469P.txt file - cDNA_ID_3032937; gDNA_ID_2213638; Annot_ID_181112

SEQ ID NO: 30550 - DNA, 3000 bp, Unknown; identical to SEQ ID NO: 10235
  misc_feature (1)..( 3000): 2750-1469P.txt file - cDNA_ID_3032939; gDNA_ID_2213638; Annot_ID_181108

SEQ ID NO: 30551 - DNA, 3000 bp, Unknown; identical to SEQ ID NO: 10232
  misc_feature (1)..( 3000): 2750-1469P.txt file - cDNA_ID_3032961; gDNA_ID_2213638; Annot_ID_181090

SEQ ID NO: 30552 - DNA, 3003 bp, Unknown
  misc_feature (1)..( 3003): 2750-1469P.txt file - cDNA_ID_3032992; gDNA_ID_1972181; Annot_ID_180152
atctttcacgtcattcgatattacaacactttctaaccaacggtctttttcttacatcattttaccgacgttaaatacgatattaaacaacgtgattagccatctttttgtagtgaatttcttacttcaattttctctttgacccatcttatttgatttatgcaatgcctagagtttacagtttttaattccaatattaactagtccctaccttcaaacatgctcctcttgctattaccatgcattgctatatctacccgtacttgcgccgaaactacttgcagaacttaaaaacgaagtttacggttttgaagtgtcatacttaataggcatttcaaaactatttagagagaaaatacagtgattggtttgcttatactttaaattttggcttcaatcaaaagaaatgaatttgtatttatagagtataccacgtcaagatcagataccggatcctaggctaacccgacgtaagttattgattggtttacctgttctcctcccatcgagagttgggttgttgttggagagaggttgtacgtacgtgagtcgtgacggtgagcttgttagtcattttccctttattctgccaacgtgtacataattcagttttggtatatagtaaattttatgcgaaacaaaagctgaaaattaacatgtttattatcaaaaaaatgtggctgaattctgaaatatcattattagttaggtgcgttttaggaaatcagtaatgaataatgatcgtgcacaacaataaactggacaaaatagcatttgttctttttttctgtcacgaataatttcatttaagaaaaaaatatagaaagtcatttatatgccaacgagagacaggacattgctaaatccagctcaggacattagaaagttattctcacaatctctataaaataatccatgtcaacaaaaaaaaaacctctattaaacattaatcgaatttctaattcattatgaaatataatcagaagagtcctcatcttattgatcaatcgtaatacacaagaaaccatgactttagaggagcagaagaaagtcataatgcccgaggccgtcgcatcggagccatcaccaccatccaaggaggagaagtccgacgattcgaaagctattgttctcgtcgtcgctgcaagtaacaaatcttttaaatttcactgaacaagaattacatatttaaattgcaaaaactacttcaactatttcatattgttcgttttctctaattttcttcttcttcttcacaatatagtttataacacttgttggtataattattgtttatatatctaatatattttggccatgtaaacaaaatgtttttttttcttttggctaaattaatactgttatattttcggcaaagaactgtaaccttttcaatttttgttgttgttgcagaagaacctacggaagacaagaaagtaggttcagttcaccgaggtaatcaacgttatagttagatcatgattgatacataaccaggaaaacaaaatattttaactttttatttgatttttttacctgataataatagttaatatcagtgaagtttatccaatatctaacttttagccaaaaatttcacctgcggaagaaaaaatattaattaagtttatctaatttcagtaatttacatgataatattagttcatttttctctagattttttttttctgataattcatggtgtgtgtgtatgaagatgctgttttggttagactcgagcaagataagaggatatctctaatcaaagcttgggaagaggctgagaaatccaaagtggagaacaagtgagtcctaaagaagtttatataatccattgttttgatgaatttccaaatttttagttccatgatatttttttttgtgttccctatatatttgtatgtaatctcatttattaactttatgaaacagagctcagaagaagatttcttcagttggagcttgggaaaacagcaagaaagcttctgtggaagctgagctaaaaaagatcgaggtaaaagtgtaattctttattctttcaattttgttgttttatttttaacttttacatgaaatgctttccacttttcacattattctaatttatccgctggaaatatgaatgataacaggagcaactaaataagaagaaagcacactacacagagcaaatgaagaacaagatagctcaaatccacaaggaagctgaggagaagagagcgatgaccgaagctaaacgcggagaagatgttctcaaagccgaagaaatggctgcaaagtaccgtgccaccggaactgctccaaccaagctatttggattcttctgatcggagaaatggtctttgatgttgcattgtggtttcatttgttattaacttgagaaagaagagattattggtagttgaagtggttggtgtgggtttcatttggcaacataaaaagttacatggccataatgtaacgtcttattatgtttggagtaatgtgttttactcatgtgtaatttgtacagcttaaccttgagagacttcttttgaactttctaaacttaaactcccaattatttcgtttcaagttttcttcttcaatctcatggtccaagtaaaaatacaccaataccaaaatattgttacatttaagtttagtaaaaacaattaagaaaaataaccaaaattttgcactatttaagattagatttttaatatatatttaaataatattattgttccaaaaacaaaaagtaaaacaaaacacacccttaccaaaattatgtcaagtcaaagcatcctcgttttagggattttctatacttgggcctaaatactaaggcccgtaattaaaggcccaataacgtttgtggtattgtacaattttcatgtagaaaatgtcttatataaagaggtcttgcaaattagggttttcatttcagtaatcgctgccgcactatcgtctcctacctcctttgcctacaagctttcacgcgggagctcaacatcagccatg

SEQ ID NO: 30553 - DNA, 3003 bp, Unknown
  misc_feature (1)..( 3003): 2750-1469P.txt file - cDNA_ID_3032999; gDNA_ID_1972181; Annot_ID_180145
gtttacgctaaaatattcggttcaatgagaaacatcaacaaaggtattcagagctacatcattgaaaaatgtatgattacaagattggttatggtacgaatgttgataccttcccctcagtgatgttgctattgtcatctgctaaagatgaattggaatcttcttcgaatataagtggaaaccttattgcgtcaactggagttgctgcttcaacaacttgttcctccaaggtttctggttctttaagaatctacaccgttccaagagatttattaatatcgaacagaatagaaataatatcaaaactgagagtcatgtctctgcaatttgtaggtctgatatatcagaccatgtataggtataccaaacaccagaaagaaattatcaattaccttggcagctttagcgcctcttctctttgccggctctttttctttgtttccaagaacaggttcgggagaaggaatgcgctcaacaaaacgggcagcaaccaatttctgaagagaatctctgattgcttcagaacctatcgtatttcctgaatctgatcatgtatgaagaaaacatatataacagcatggaatccattccgctcgaagcattactgtaatcaaaacgagatacacaaaggccaaaagccaatgcctacgatgacgagtgtaaactgtggtaacataacataagaggtacatatgatatcacgactcacctctatctctttcaataaactgtcccaaggtaagcctaccgttactaagtaaaccatcaagaactgcaccgcactaaacatataaatcaaacaaaagtataagattagcattagagtcttgaagcataaaccaactaatcaaaacactgaacagagagaagaagaagcacgattaaaccttggagtcaagttcttcgtttacaatcctcgaaaacttgttatacctcacacgatgcagaatgttgttaaacaacacaatatactgtacaatagctttgctctcagaaccatctacaaagtaaaaaaaaaaaacatacaaaattactttcattgagttctctatttctgtgtgttgctactaatcaaacaatatagagactaaccaggaggttcaatggagaaagcttgaacacaattgtgctgaatcaagagatagagaatatctttaactttgttatggttgatatctgattcagctaaacgagagatgtctcgtgaggaaagaggtcctttacgtagaagacattcacaaactttctgcaaccaaaaccaaattcgttatacagagattataaattcaacacaagtctcagaagggtttctcaatttaccgagacgacggagccgaattggacggtgatgatatggatggcgtagacaatgccaaactcagacatagacatgagaatcaatcaccaggaagtctctcaatactgatgaagcagcctctgcagagcttgacggagttatggccgatatagagatgtttgccaatcgattgtagcctactactactaaaaagcgaagcaatcgtaatctagcgaccctaaagtttaatttttccagcgatccacacgttcgaatccaaaatttcgataatctaacatgaacccaccaatataagtataagaaaacaccaacccagggctagggcttttgttttttataaggactcgggccggccttaaatatttagcccattttaacatccctaattgtaggttattaattgttggcctagagaagtttgggcctatcaggccctaataaattgaatgtatggtttgacccaagaaaaaaaattagtgatggaacgaaatgtacttgagaattttcaatgattgggccagatgacaatgctctacttaagaagaacaaacacaaaccaaattcttctattgtatttgtatgtgacggcttacatgaagaccatgtttttacttagttaggagaatggaaaatgactttttcagcttcatgaatatgacttatattttaaaacactgtcgttttcatctatacgagatttttgtatttctattcataatcatatacataattttaatctttaacaaataacaaggtaaactaaatctttgattagtaaattctactctgactctcttctaagctacgcatgtttagtggtttaaattagtttcattgttgaataattatccaaatccactattgtttagttagatagtgtgcatgtatcaaaccaaataaaataatataataatttgtatgtatagacaaaacaaaattgattacttcaaaaagatatatgtctcattatatttagtcttctactttttttctataaataatatatttattcttatcattcaaagtcatttttaccatttcttattttaattttacatttttaccttggtcaatttaatttattaacaatcaaaataaggacgttatcttctatttataatataaagtataaacaacgtcaagcatcttcgaaacgtgataatcctagtcaaagacacatgtgcaaaggccctaaaagtgattaaacactcataggctatttttttaatgaaactattcttttgtttgataatacatacacaaactatttcaaattcctatgaaataattcataaaccgtaaattactatcgcatgcttgccgaaaaaaaatattttcaaaagttaattaactagccgtttcggttcagtgtttgtaccggaatcgaaattaaaaaaaccacctcttcaaaaaccgaaacgtcggtctaatcgtaaggatatatatcagcgactcccaccgttaacaaaataattaaaaatgaaaacattatgaccacacgatcaatagaaaatccgctacgatgataacacgtggcatcatcttttagccattttttgcttccacagatactgtagtaattgaatataaatttataaatatcgcatttgctctcttctctgctttcacattctctccttcctcatcatcgttactctcgtgtttatctctccgacgtaaccatg

SEQ ID NO: 30554 - DNA, 3003 bp, Unknown
  misc_feature (1)..( 3003): 2750-1469P.txt file - cDNA_ID_3033006; gDNA_ID_1972181; Annot_ID_180142
ataaaataaaaatattatataattagatataatttacaaagttttatatatattaattttaaaaaatgaattgtctccgcggtgtacatctgaaactcatcaacattttctataacagacttgctttcgtctatcctaaaactatgcaacttttgtcttaagtaaaacctcttatgattccaaaacatttgagaaaaccaataagagatgttatttcttctcttaactgcttatgctctattcctcttgttctaccttttattttctttaaattatctttagaatctcttcctcatactgtaaccaagatccagcatcctatcgataggtaaagttgagttttacacttgccaattgccaaacattagaataaaaaagttcaataggttactcggattcgaacacgaggttacatgaatttgaagggctggcctgagtagccaactcgttaagcatctcacgtctctttcccaacttctcgagctcttcagatccgatgggttttgtggagagagttgctttcttcaagcatcttgcattcttaaggatgtatgtagccactgctttctcatcttctcgttgccactcatatcttgtccacacaaatgtctcaagatgaaacaacaaacattcaggaacacatttgggtcgactccattcccagcccaccgaacaatcttctttaggaaactgatatggctgagaacaatgcaattaaaatatttgaaagtagagctcactggaagaaaaacaaaatttagttgactaatgaaatggcttacatcgacgagcttaagaatttgtaatttgggagaactatcgagcatgaaccaaagtagattccaccactcatagctatatgcacgaagctccagcgataaaagctggtagaagattttaccagtaggatactttatctgtgcatgaggcaacacagaacattaatgttagcccaattacagataaaccccgtgaaaatcttaaatcttaagtttaccttgaaaggtgctaagtgtaaggaaagacatttggctgaagttagagagtccataatgttctcattggctatttcaaaaacggcactaattttagcctccactagctctggcgccttctcaatcaaacaaaactcaagaccattaaacccgtcgatgttcaagtatttcaaagaaggagcatttatcacatagcctccaacaccttctccatagtaatcatcatatatggttagtctctgtaatgatggcaccgcaatagtataactctccacatcggtcgtgctatgtctatgcacgaccaaatcttcaagactagggcagccacataaaaggttgcaaacggattcttcgtcgttaaatctcacatggtagagatacagctttctaagagacttcaaacaaaccagagaaggaaaatctaaaagaatgcaatacttgagttccaagatttcaagtgtatcattacaactacaccaagcactcggaaatcttacaaagctttcctccagcaatgtaattttcagtacaaatttacgcatatggcgggaaaatgcaattccaatcaatatcccaacatccaaagcatcatccttatcttcaactttcaaatgcaaactatctagaacaggagctttatgtgaaatcaaagacctgaaaacattatctgaaaacgtataatgataatgatacttagaatcaaacttgagatttggcaccaacttccaaagagatttccattgtttagacaaaacactagtggcaatcacagtttctgttggaagtgacgacaatatgagcagaagcaacgcttcaggcaactcactgatcctgtcctcctcattcactaaacctcgatttctcaaaccttcaccaccgattttgctgtgaaaaaaaaagtcagaagaaaacaatgaaagggattccgagaaaaaacatagacgaaacaaagaaacataccatttttgttccattttcgtttaacagagacatcaattttgctaaaaatccttgagattactaacacttcaacctcaaatgcaaacgcagccgaacacacagaatccagctagagcttagatatgataatggtgacgagattcatcttcaaaattatatccacttgtgtttgattagtaaaagaatcacctaggctagatacaaaaccctaacagaataaaaacagtgatcaaatccgagccggatcgtttttttccaatgaaaccaaaatccaaacccaagacatttacaagcccaaagaataaaaattgattttttttttttcggcccaccggcccaataacgaatagttaaactgagtttaggtcttcactatttaaagctcgtaaaccctagacttggatatacttcagtctagagccgcgcaagaagacgattctctctgtgagttttcgctcctctctacttgtcgtctctctgattatcttcgttgctactgtctcgttttgtgtataagtagggttcttgcttgttttctctcatcgtgtgttctgctgctagctcctgtagatttttctaagttccttgttttgttcatttcgagttttattgatctgatataaatcgtccgttgatttgttattttgttatgctttattgattttgcagaaagtatcgtccttggaatgagtaatattacactttcagtgatgaaacttttcgtttatttgattggttttgataacatccttactgtattacgactgttaatgtaatgtgcatacaaactctcgaaactttgattctttaagagtttgagattgtcacaagtctcacctttagtatagatttaataagagtgatctttgaaatacttcaagattcgtatctgttttactctatttatgttctctatatctttgagatggtcttttgtttttgaagtttgaggttttatcatttgatttccttgagctgtttaaagtttcatcatttgatttaaagtgtgtctgattgatgttttttggcagcttgagttgaagaaatg

SEQ ID NO: 30555 - DNA, 3000 bp, Unknown; identical to SEQ ID NO: 9778
  misc_feature (1)..( 3000): 2750-1469P.txt file - cDNA_ID_3033013; gDNA_ID_1972181; Annot_ID_180137

SEQ ID NO: 30556 - DNA, 3003 bp, Unknown
  misc_feature (1)..( 3003): 2750-1469P.txt file - cDNA_ID_3033017; gDNA_ID_1972181; Annot_ID_180133
tatactaaatgttttagacccaagaaaaaattattagtatagtcaacattattgttccagaatatgcatttacaagtggaattctaattggtctaatatgtatacccaataaattcaaacaatggaaaccaaaccaagcttattattgaaaataaaacaaacacatatttatacaacacaaaagaaacacaaccataaatgtattaatcttcgtcatattgaggattcgaaacagacaaaaaaaaacgcacattgtcacataagaaaaccgcttatttccacacaacataaaagattaaacggagaaactaaaaaaagaacttgcatagtcgtatagttctgatcaaaagagatgtattgttaaggaattaagaaacaacgtgatgtttcatcaactcaggatgtgtgaaaatgtcagtctctttgtagaaaacttctacgaccctcgagaggtttaggaatcacatgacgatagggaaaggaaaaggaaaagagtgatctctcgtcattagttctttgattaattaagactcttccttgaatcaaatgccatgattttgatctcttcttaagctttttccccatgaaataccatattgcttcatataacaatcaatggatgttcctacgtgctttctcttatgttcaaaatgtataagatagataccagatttaatattatattttgcactaacgttgtgacacaaaatgtatttgtatgtagggtgtcaactaaagcttaagttctaaggtctgatattattctcgaatcgtattgtatcgccccaaccgcccctaccagtgggtcccacaattcttacatttctaaatatacttaatttattttgtggaagtccccaaatcttgcgtgcatagtaacccatgacctcttcttgtgagtgtgtgtacatgacagtcatgaatgcgagttttgatggtactttggctggaatacggagaatcagcgagtgatttccattgcttgcaaactagtttggaagtggtgatgattctttgcggtaatctcgatatgatatttgctgatagatcatcggttaagaaaatcatctcgtttttcttctctgtctccatcataattgaccaggtgtttttctcttttcaaagactatctttagtcttcttactaatcaagctataaggagttggccaactttcaaaatccaagttaaaaaggttagcttttgggtttaggctaatccaaaagtgattaatcgatcaaagtgtaaaaaaaagtcgtaagctttagaacgaatcttgacaaccctaccatctcaaaatatcaaacaaaaatggatcaaaatcttgataccaagacaaacggaaaacaaatcttgagacttattgcttccttcctcttcctttcttggcaggctgtgtctccatctgttctttcccggtgacttctgagagatcgactgcattatacaaccaacataaataaacaaagtaagctataatacacccaatgttacacagcacaaaaggagctttccttttaaaggttgtgagatgatgcacattcaagttccattctttcaagattggtaggagaaaagcgatgttttgagaaaataatagccggtgacgatgtgatacattgtctcataatagaaataacctcatagctcaataaaacaaaggaggtttttttctcaaacactaagagatagatgatgcatgttctttctttaagttagatatgcagaaaatgaaatttttaccatcaggtcctctggccatgagggtgaaaaatatgttattcagtttctccatcttcttcgcttcttgtgcttggtctgtcttgaacttgagacactaagttaaaggaaaagtagaaataaatctatcatatatatacttcacataataagaatggacaagaatgaaaacaagaagactacaacaaggacatctagttaaccacagaagttgatacaatgatttacatcaaaactcagcccagcttaaagagttctaaagtatcacacttcaacctccaccaagaactattgctctgaagagaggactagatctgcttatctaacacatcgccatgcaagacatgttaaattcatcaagacgtacgaaaacataacctattagcaatcacattgaccaagccaaaacaaaagtaaccacataactacgacaaggtacgatgaaaactcaactaaaaaccaatatctctagtaatcaatcatcatggaaccctaaattacattctccaaaccaagcatcataccatcaaacctcgacgaatcagatatcaacttcaatagcaaatattgaattccatactattatataagataaactcaaaagaagcagtgatcatagagaaactagacacagtcaaattacctctttgttatcagtaaccttaagaaccaacttgccgtcacagtgtctatacttcatcacataccgagtctgcaccacaacaattgaaacattagattgcgaccaacacgacttgattcaaatcaattatcaaggttaccaaaattcccagtacaaaaatcgaggaactatgttcaattaccataaatcaatccaaatatctcaaaatcaaccgtaaatagtgaaatcgaaagaggagagcaaaaaaatagttaacctacagattccggatcagctcgaaaaagctgaacagatcgatcaacgaattcgtcccacgatgcgatataaaccatcttgattcaactagattagcgattcgatttgaggcgattggattctatgaaatctccgggagactcgacggagaaacagagaagcaaaaagacggctttttatttgtgttttcagaagaaagaaaaaaaatttgagtgatgatcaaaccggaataaaccgactaaaaccgaaccggttccttagtgttaagatttctaaaaagaaaaaccctaaccgttcttcttcgaacttctgcaactttgtttctcccaaatctgtgaatctcaagtgttcgtcttcaccatcatg

SEQ ID NO: 30557 - DNA, 3000 bp, Unknown; identical to SEQ ID NO: 9768
  misc_feature (1)..( 3000): 2750-1469P.txt file - cDNA_ID_3033021; gDNA_ID_1972181; Annot_ID_180130

SEQ ID NO: 30558 - DNA, 2016 bp, Unknown; identical to SEQ ID NO: 10825
  misc_feature (1)..( 2016): 2750-1469P.txt file - cDNA_ID_3033043; gDNA_ID_2214450; Annot_ID_182452

SEQ ID NO: 30559 - DNA, 3003 bp, Unknown; identical to SEQ ID NO: 26497
  misc_feature (1)..( 3003): 2750-1469P.txt file - cDNA_ID_3033047; gDNA_ID_2214450; Annot_ID_182451

SEQ ID NO: 30560 - DNA, 3000 bp, Unknown; identical to SEQ ID NO: 10808
  misc_feature (1)..( 3000): 2750-1469P.txt file - cDNA_ID_3033063; gDNA_ID_2214450; Annot_ID_182445

SEQ ID NO: 30561 - DNA, 3003 bp, Unknown; identical to SEQ ID NO: 26505
  misc_feature (1)..( 3003): 2750-1469P.txt file - cDNA_ID_3033067; gDNA_ID_2214450; Annot_ID_182440

SEQ ID NO: 30562 - DNA, 3000 bp, Unknown; identical to SEQ ID NO: 10811
  misc_feature (1)..( 3000): 2750-1469P.txt file - cDNA_ID_3033071; gDNA_ID_2214450; Annot_ID_182438

SEQ ID NO: 30563 - DNA, 3003 bp, Unknown
  misc_feature (1)..( 3003): 2750-1469P.txt file - cDNA_ID_3033075; gDNA_ID_2214450; Annot_ID_182437
cagtctcaccaaagttatgttcctaatgtgattcattacaacattgtgttaagagctttagggagagcggggaaatgggatgaattgaggctttgttggattgagatggctcataatggtgttttgcctactaacaatacttatggtatgcttgttgatgtttatggtaaagctggtcttgttaaggaagctcttctttggattaagcatatgggacagagaatgcatttccctgatgaagtcactatggctactgttgttagagttttcaagaactccggtgagtttgatcgtgctgataggttctttaaaggttggtgcgctggaaaagttgatcttgatttggattctattgatgattttcctaagaatggttcagctcaatctcctgtgaacttgaagcagttcttgtcgatggagctttttaaggttggtgcaaggaatcctattgagaaaagtctgcattttgcatctggttcagactcttctccgaggaagccaaggttaacttccaccttcaacactctgattgatttgtatggaaaggcaggtcgtttaaacgatgctgctaatctcttctcggagatgttgaaatctggagtacctatagatactgtaacgtttaacacgatgatacatacttgtggaactcatgggcatttgtcagaggctgaatccttgttgaagaagatggaagagaaagggatatcccctgatactaagacatataatatccttttgtctcttcatgctgatgctggggacattgaggcagctcttgagtactataggaaaattaggaaagtaggactttttcctgatactgtaactcatcgagctgttcttcatatcttgtgtcagcggaaaatggttgcagaagttgaagctgtgatagctgagatggacagaaatagcattcgcattgatgagcactctgttcctgttattatgcagatgtatgtcaatgaaggtttagtcgtacaggcaaaagctctgtttgagaggttccagttggattgtgtgctttcgtcaacgacacttgcagcagttattgatgtctatgctgaaaagggactgtgggttgaagcggagactgtgttctatgggaaaagaaacatgtcaggccagaggaatgatgttttggagtacaatgtcatgatcaaggcttatggtaaggccaaacttcatgagaaagcactttctctcttcaaagggatgaagaaccaagggacttggcctgatgagtgcacttacaattccctattccagatgcttgctggggttgatttagtggacgaagcccagcggatcttggctgaaatgctggattcgggctgtaaacctggatgcaagacctatgctgctatgatagctagctatgtgcggcttggcctgttgtctgatgcagttgacctgtacgaggcaatggaaaaaacaggggtgaaaccgaatgaagttgtttatggttccttaattaatgggtttgctgagagtggaatggtcgaagaagcgattcaatactttagaatgatggaagaacatggcgttcagtccaatcatatcgttctgacttcccttatcaaggcttatagcaaagtggggtgtcttgaagaagctaggagagtgtatgacaaaatgaaggattcagaaggtggcccagatgttgctgcatcaaacagcatgctaagtctgtgtgcagatcttggcatagtttctgaagcagaatccattttcaatgctctcagagaaaaaggcacatgtgatgttatttcgtttgcaacaatgatgtacttgtacaagggcatgggcatgctcgacgaggctattgaagtggctgaagaaatgagagagtctggtctactaagtgactgcacttcatttaatcaggttatggcttgctacgctgctgatgggcagttaagtgaatgctgtgaactgtttcatgagatgttagttgaaagaaagctcttgctggattggggaacatttaaaacgctcttcacgctcttgaagaaaggtggggtgccaagtgaagctgtgtcgcagctacaaaccgcatacaatgaagctaaaccactggcaacaccagcaatcactgcaactctgttctcagccatgggtttgtatgcatatgcgctggaatcatgccaagagctcacaagtggtgaaattcctcgcgagcattttgcatacaacgcagtgatatacacttatagtgcatcaggagacattgacatggccctaaaggcatacatgagaatgcaggaaaaaggtctagaaccagatattgtcacgcaagcctaccttgttgggatatacgggaaagcgggaatggtggaaggtgtgaagagggtacatagccggctgacgtttggggagcttgaaccaagccaatcgttgtttaaagcagttagagatgcttatgtgagtgcaaacagacaggacttggctgatgtggtgaagaaagagatgagcattgcttttgaagctgaaagggagtgtagttcaagatctggagaagaagaagaagacgatgaagaggaaaattctgaagaagacgaggcattttgaagtgtagccacagatgtatgtaagaaatattgtagaatataggatttagtggaaatggactgtacagtttcacagaagccaaaggaaatatgcatacttaagcctcagattgatctctggtaaagaaatgtgtatcttaaaactgttatagaaagaaaaaaaaaggttccacagggtcaaatctataaaagcgagcacctttggctatggttttggtagaggaattagcatacgctccttacaacaatagattgatttgcatcatcgggttggtcttctgttggttttggtctctggattgaacatctttctcctgtcttgcttgctcttattttcaattgtatagcatcaaagcccatgaaaagagccagatgttctggaattgattccaatttggaatcttgtcagttactggtgatgaatatcaacatg

SEQ ID NO: 30564 - DNA, 3000 bp, Unknown
  misc_feature (1)..( 3000): 2750-1469P.txt file - cDNA_ID_3033086; gDNA_ID_2214450; Annot_ID_182430
gatcatatttaaccatgcgatttgaaagcgaaaaaaaaataatctagacaacacataatggatggtggttatgagtttcgacttataaagatgtgtagatagacaatgagaccatatattttttcacgtatcattttatgtataagtgggttcttaaagaaaaaaaattataagtggattcttaaaaaaggataaccacctcgacgcattcaacaaaataatgccatacttaattcctaaactagcgtgcatagatatagaaacttaaactaattaaaacacattagcaagatttttttcaatgatttaacgaaggaggagtatgagatagaggagaaaagtgataggtggggaagtggtcccagcaccaaaaaaaatgtgtggctgtcaccaattggaatgcaccaaattctttttacgacataaaaacaaaaactgaaagattgttttttttgttttgctttctgataggataactatgacgtggcatgcgtcactagacgcattatcattcgcgcgtccatttcacgtggtacagtcaaattagtcaaacctcccgggagaaacgaatgttcttttacggttttaacttttaacttttaatcttgctgctttggcctattaaactcttcttttctgagcaaaatcacacacgctatgttttatggttacgtaaacgcttttttttattggcttaaaccaaacataacgtgtagtaaatagaaactctccattcacttcttctttttttgtttgtttaaatgttactaagatttataccaaatcaaaaatattttcttatgttttcggacaaaactcaagccccatttacttttttttttttttttgtatgttttaatgttactataagatttattccaaatcaaaaatcttttcttatgttttcggacaaatctcaagccgcccaaaattgaattgttagccaactacccttgagcacttaaaacctccaatcgttttccttttttcttgttttattttatggaatacagatcctttatactataaaatagatttttgagaagtgtcatagttggaaaagtagataacatatttaagtcgaatggggggggggatgaatatgaaaaccacggtaatagtatatttttgttttttaccgtatttatcattccagtatataaaaattaaaatgtaaagtttaatttttaaaaaaaattacgtataaattatttcaacaaataatcatcttctatggtggaaaacaatttccaagacacataaagagttaccttaattaatgatacattaaaaaaaaattacctgatggtttctgaacctcacaatcgtgtggacactatagagttgatcactggaaaaatcataaatattcgtgttggtcaactattggctcatagctcacaccatttaataagttcaaagaagatacaatgattacctattacataaatcatacatgcatacgtgtggttgtccatattttgacattaatcatatactataataaactcatatattttgtgcatatatgacatacatagctatctctattgtaagttgtaagtcgtaaccactatataaactaattaattacatatgtatatagtgatagatatgttgaatgatcgaagagataacggtgtctcttcacgaaaatagagtttcatcaaaagcaagataacggagtactaattatctaactcgttaattaattgagctctatcttagtaagattcaccggacactgcaatatacaattaaccacgtgcttttcaagtgaatattcagttaaattctcatttgtcttttctttagaattgacaccttaagctatttctagtcattctcaaaatataaaaagttaatggtccttaattgccgtgacaattgctattcttcttttattcccaaaagagatacaagtataaaagatcgaaacgctatactatttattaaaaaaaataaaaatacagttttaattatatgaccaaaaagacttttgatatatttgatcgaaaaatgaaaattgatttagaacttgattggttctcctactaccatatgcaaatgttgagtttgcggttgctagcgtttaaaatgaatcaaagaaattgctttaaaccactttggatagtttttttattgttctaatgcaaaattttaaagaaaacattcccgtaagtatttttatttatatattagtgaattaaggacaaaaaatgtatctcacagttttctcagaattttcttttttgacatagtaatgaataaattgatgtagattctatgctgtttatagaaacaaaaagtaaccgttttaaatgcctcaattgacgttaagtctgtcttggtgcaatttaattatgtttcgtcatcatcttttcaagttcacgcactaagcttagtgaaaaagatacgccttttttcttgttctgttttgttttgcatgtcacagtaagtaactctcctcctcaattatcaaaaatgcaaactttaattttcttctagagaagagccactctctccacttctttctttgtccaactttttagacagagaaagtggcgtcagagatagatagagagatacatattcaagttggttgaaggaggagaattagcggttcatatcagtacggagaaaattgtcagtcatatgctttttttctttaaattctgcatttgagtgggtgtgtgcttttaaccattttggtgatttatcaaaaaaaaaaaaaaaattctgtgtgttttgagctcaagctctctacaaattttgctgtctcaagtttttgccttttgaagtccaataaagttgaaatctttgttctttttgattggtcttcgtgaattccggtgaaagtttcaaacttttgatttaaattccggggaggaattagggtttatgaaagtaaaagaagaaactttgaagaatttgggagatggagtggttttaagacctgttgatcattgttctagcatttggagtatgaagatgaacatg

SEQ ID NO: 30565 - DNA, 3000 bp, Unknown; identical to SEQ ID NO: 9964
  misc_feature (1)..( 3000): 2750-1469P.txt file - cDNA_ID_3033127; gDNA_ID_2096296; Annot_ID_195551

SEQ ID NO: 30566 - DNA, 3003 bp, Unknown
  misc_feature (1)..( 3003): 2750-1469P.txt file - cDNA_ID_3033131; gDNA_ID_2213359; Annot_ID_180741
tgcagttggggtaaactgcaaaacaaagccctaacttctgttacaagcttttattgttactgagcattctacaaacttgttggtttgatctttcttaggttgtcgtcgacggggtattgcacaaagagaaagaagccgaagatcgaactggtctgcgataactctgggagtcaagtggcttctgattgatggaatcgattatttttctaattctggttgtttaggggtctctatgtgtcttcttgtttctggctgttcttttgctttatttcatctcaagtagagttttcttaatgtttaggtggaacatttttccataatcaagaagggatttgatcaatcaataacattagattttcttagttaaagacttaaagttgcccacacaccacaccatatgtgattatgatgaatttacattttataaacaggttttcagtgatttcaagaaacataagcgtgcattcattttttttttgctttaactagaacccaaatcttcaatagttttcatgaatcgactttgaaaatacataaatccacaacattaatatgattaagcattcttgaaatcctaagttaggtgaacagagagttaagagtaaatgctcctagacatggtttagtcgattgcagataattcgggtcagcaaagaaatgtgatcactaagcaaatctgggttgcgtaaactcgttgacaataaacggaagcgtcttaccccttttttccggcccacttctttacttgggccaaataattttattttgggctttttttaaaaggatgatcttaattgtgtgtgggcatttaagggcaccgacaattcaaaggtagccgacggcttacagaaatatggctgctcagatcatcagagaccccatacaataaatatttatgtttcgagaaataaatcaccagatggttgacaagttgcggcagtaagtacatgttacttttcttgtcagaaagtacaacaacagtactttttttatagtcgacactaaaattaagactcgtatttagtaatgcagaaaaatctttacaaaaatatactatatactcctgagaaaaagcagctgatttgactgaaataaagaaaatgttagtagtctagtaatgatttgtgaactacaaacgttgtttaaggcgtttacagtaatattaacattacggaatacaaaagggtgatgactagtcgacaaataaaaatggtaatgagtctaaatgacgaaataattaaagaaatgtgtgaaaggaagagaataataagcacaagtcccggacctgaaaacggaaagatcagaagagccacgtgtgcaggagcttgaagagaaggttccaaatgagaaagagatccaccaccgtcatcaacacacacacacacactttgtttgttctcacggagtccccaacaaaagtcaaatcaccgttcattgagccccacttttatttacttacatgtttaatagacccgtttgtattacgagacacttctagtcgcatgtctccaccgtccgatcacggatcctagctgtaatcaagggggcagatttaatgaagtgggcctcttagtaactgccttctccacgtatcctgacaatttattgttttcttgttagtattttgccatttttggtttattataggatgattaatgatcttataactcttccataaactaatttagatagatacgcattgcatagtttgtttttaggtcgatgaaagctaatttatactatacctttgctttgtttggttttgtgtgtcagcgttacattaacttgtctttgttttttcacattgttaacaataaactccaaaatccaaccatagcattttcgaggttatatatacttgtaatattcattaaatttcagaaattactcataaactattaagaggatgttgcttataattcaacccccatttcagtagtactcaacattcaactgcattcaactgaatcttttggcttcaattactatttccattacaattgtccaaatgtaaaacgatttttacacaaaaatcaggaaaatgatattccataatgataaaccatgatattggtaaccaataaagactagtacatgtaatcgagcttcataaatcagaatacgtaatgaaacttaaccagtcaatgtaatttttttcatacaggaaaagtagactgagaacggtcaaactttgttttctaaaaaagaaaattaggcacatccttgaaccacgtttgacaaaatctctggtttaattacacattaacacacaagtactcactctctctttaaaaggctctatacactgaatttaataaggaaggttctcacttctcatcaatatgaatttatcatttcttatatactttgcactttgcgcaataaacatgtgatcgtattcataactaaagtaaaggcaacatactaaccctctttatttaccctttttagagcttaaaatgaaaacaatctccaattattttctgtaaaatgttaactactgtaaattttgtgaatatctcagtttattttacatttatctataaatacatttgtttttatcttaatagtaaacttagattcagttacatctctagatagattggatcttttaaattcacttttaaattctcttattctgtgaaagttaaataataacttcctctttattttgatttttctcataaatttttgaagttaaattaaaaattcgacatcatggggtcgttaattaacatccccttgatttaatatccacccacattttttgtcgtccccaaaaaaataatctgacccggaaaacccgacccggctttccttttcgttgttatcataacaataaatcaaaacagaacaaataattttgatgcaaaaaaaaacaaaattcgagaagaaagccaaaaagaaaaagaagagagaatgctctcagtctcagcctctcctcaccaccactaaccccagaagaatcctcacagacagagagagagagagagaatcagaatg

SEQ ID NO: 30567 - DNA, 3000 bp, Unknown; identical to SEQ ID NO: 10001
  misc_feature (1)..( 3000): 2750-1469P.txt file - cDNA_ID_3033147; gDNA_ID_2213359; Annot_ID_180736

SEQ ID NO: 30568 - DNA, 3000 bp, Unknown; identical to SEQ ID NO: 10005
  misc_feature (1)..( 3000): 2750-1469P.txt file - cDNA_ID_3033154; gDNA_ID_2213359; Annot_ID_180725

SEQ ID NO: 30569 - DNA, 3003 bp, Unknown; identical to SEQ ID NO: 26523
  misc_feature (1)..( 3003): 2750-1469P.txt file - cDNA_ID_3033158; gDNA_ID_2213359; Annot_ID_180724

SEQ ID NO: 30570 - DNA, 3003 bp, Unknown; identical to SEQ ID NO: 26524
  misc_feature (1)..( 3003): 2750-1469P.txt file - cDNA_ID_3033162; gDNA_ID_2213359; Annot_ID_180723

SEQ ID NO: 30571 - DNA, 3000 bp, Unknown; identical to SEQ ID NO: 10007
  misc_feature (1)..( 3000): 2750-1469P.txt file - cDNA_ID_3033177; gDNA_ID_2213359; Annot_ID_180719

SEQ ID NO: 30572 - DNA, 3003 bp, Unknown
  misc_feature (1)..( 3003): 2750-1469P.txt file - cDNA_ID_3033181; gDNA_ID_1972187; Annot_ID_180176
cttttttatggtgtggtcattagcaacatacaagtagaaatcaagctccttgttaatgaatgtggtgttgtgaatgatgtcaggaaacgtttttctgaagcacggatctgaactaagattgatcccgcgtgatagagttggagctgtgtttgtgatggatccatagatgatgtgtaagcaatgattaaaaactcagttccaaaaaaaacataataatatactgaaatgcttatgtacaacttcgttgaataaatatgtaatcgtcacaattgaagtgagttgaatttggtcaagttatatgtctgttataattcatatttagataacgtatgtgcactaaaaaagagtatggatctctctgtatatgctaactcttgtcaatataaatatttatcttgtaatatagtttttttattaaaatatatttttaacttttattttattttaaagttaaaactgtaaggttttttatattttttaaataatattttggataaactatttttttgaagtgttttaagttttatattttgtgtagactttggatacaacatccaaaactaagcggtgttttagatttaatatgctttacatataaagtttttaaaattcgaaccaaaaacttgaatattaaatttacataataataggaaaaacaaattgaatgtttgggaatcgctaacgactgactaaatgatggattcaaatccggttagatttcataccattatgtaaatttagtatacacagaaacaaaaaaaatttaaaaaacatacacaacgaaaaaagcttttaaaaattcgaaacgaaacataatcaaagttttaaaaactatttttaaaaatccgaattaaaaacttgaacattaaatctacataataataggaaaaacaagttgaatatttggaatcgctaacgactaatgccggatccaaaaaccgattagatttcatatcattatgtaaaattgacattcaaataaataaaaattgaaattaataatatatataaaaatttagtatatgattagggtttaagttttagggtttatatatattaaaagctattaaaaaattatgaagggatagaaattgacctgtttcttaatgggtaggtgaatgggctttttgttgggctgaatatgagaatccaatccaatctcctccaccatcgtgtctgtcaccatacctcctaaaccagagcattgaagattcgacgtcttttgatgtcaaacaaaacctcctacgacgaggaagagtgagagaagatatcaagagacgaagggagaataagaattagaagcatatcttcttccaccacgccacgaagtttgaagatgaaatagaagcacgaatcgagaaagaaaattttaaaatcatcgtttgacgtttttggttggatacttaagaattttaagaagtcatatttactaaaagtcaaacgccgaatgtaggaagtaaaatatacgatgtataaatcatacgatagtggttaaaatatacgatatacgataatgattgttattaacccagagaaaaatgcgctcctctacggaacctaaacgctttaaaactccacgattgcaaaggataggatgatagtgatgagtatttaacaacctaattttataatcgatttttaaaaattttaaaattccgtaattttgtaaaacgcagacacaattatgagtatgtcacaaaacaaagctgaaacagtgaaacgaaaacagagagctttgattttctttataaaaaaattcacctaaatgaaatctacttgctgccagaaacagtatttacataagaaaacgaaacagtcatgaacaaataaaattaaaattttatacacacagtctcggctataaaacagaacaggggcaaaacagagagatcatttgtggaaacaaagcgtagcttatctagacaaaagcatcaatacgtgaaagtagctaatctagatacggagcgtgtgtcaagtattaacaatattctatatagcaagcaagataagtaactaaactctaaaatgtacgaattcgtctattcgaaagaaactaatataattaggaagagatcaatcactaacgaaaacatgaagattataacggaacaaaaagagatgggaacggatcttacggagttcggttttaaaatcagagttggatcgtcgtgtttctgaaacagtatcttcagtcctccggggaaaataactgcaaaagagacaaaagcgattcatcactagctcgaactaagaaaccttaaagatcaagagaaaggatctgctatttcagtggagtttacctgaatgattgttcgagcagagcatgatcctgactgactcatgagtaggagtgaaggaagaaagagagaaacttgaccgagagatggtgacgacggtgatgtctctctctcattatcttttctatgagcagaagaatagttgaaatttgtaaagagaaggaagaaatgtgttgttggtaatgagattgatagcgtttaagggagtatttataggaatcttcaccaacggctatcttcttacgaaaagcttcaccaacggctataataagttacaacgttcgactgtcttctcattgatttgacaaaattagccgttgcattagtattactgatttgtaattttgtaaaccaagccaagaaaagagcagtactatgtgatgggccaattagcccaaaaacgcacatagcgaaggcccaatggaccttaaatctggtatcggattgaattctaagaaagaaggagaagcggcaataaggagttcgaatctcaaacaaatttctgggttttttctttcctccaaaatttttaaacaatttctgtgtctgtggatttctacttggacggcgatggcgagaattggggctaaacccagaaattgaggatttgaattctgctgctgcggcgtctctgtggtggtttggtttctcgtttctgaaaatctacggtgtagtaagtcggagatgcagttgagatttagcaatg

SEQ ID NO: 30573 - DNA, 3003 bp, Unknown
  misc_feature (1)..( 3003): 2750-1469P.txt file - cDNA_ID_3033187; gDNA_ID_1972187; Annot_ID_180172
cgaaaaaggggaagataatggctaagaaccatatgggtacaaccacgggtaatctagccatggctcttttgaacatgctcttcgtctcatgcacacctatcaatttctcccacacaaaatataacggtgtagacgcgaatccgaacgttataaattgatgaatgagcatgaggatcactgcggtatctctaaaaccagtcttagggagaagagagagcgcattggaatgagttagtagcttatcgccaaacgcccaataaaccgcagacgcggatggtagcgttagcgttagtacatatatggtcgctagtagatatatcgccttgaacttttgcggtttccacatagcgtgcattatctccctattatattttttcaaatttccaatacataattagttaagccattaattaagccattttatttttccaaacaaaaaaaaaatacttacactgtgacggcgtggccaccaaaggtgtagagaatgttggtggctccggtgaagtaaagcaccattgtggttggaccagagtgtttcacatcctcagccttttttatatgaaaaataaatatattaaacaacaataaccaggactatatgtctatatcttataataatcaaaacaagatttgtgttaattataatgacctggccatgaaggagtgaagcaatggtgagataccaagaagtgtaagtggtcatagcgagtccgaggaatgaccaaattctataattgtggaaggaaggaataaaaacagttgttgcacagcacgccccaaatatgtatgtccatgtcctcttgtccaatttgtcattaatataatatatattgctgcaaatcattttttatattaattaattttcaatatgaaaaaaccatataataaagaaaatgaacattgattattaatttacctagcacaagcaatgagctgaataacagatccaaagagaagaaaagtgcagttaaagatcaatccaaggttcctccaatgtttccccaacaatccatctaacacctcaaaccacttttttacacaaacaaaaaaaaacaaaaagttaaaattcaataataccaccaaaaaaataaaaaattataacgagtcacaagaattagaggtggaataaaacctgaataacgtggttacggaaatcgaatttttctcgttctttacgagttcgatattcaacgtaaagaacactaatgagataagcagtccaacttcccattaatccataaaagagttgaaacaaaattcccgacatcatcccaagttgtgagaacgagtatggtaatgtcaacagaacttgtgccacctgccatttttataacaatttagctatagaagacgatacatacacatctatatataagactaaatctgtgggaagtacatacctgatttgaagcacaactaaaccaagcatcgtagacagaaccaccatgccagaagaaattagagagttttgttttagttgaagatttcttgttaccacttatgttttcttcttccctctccatttctaagtaattccctgcgaccactgtctctattttctctgccgccatttttctcttcttctctcagtttctttagcttctttacttccactctttaaatagactagtgaaaagctttttcatttatttatttgttttatgggttttgtttcctttcttttgctctgtgtgcaattattgagtaacgagtgtcgggggacgaagtctttagtcacagctcacgagttgtcatggggatatcggtttatgattggttggtgactgagttatgtcacctacttgtgactgttactgttttcggcgagcgtggcgttgtttttttaatgggcttgatttgattgttgggcttatgggccatatttctggagcattacacgaacgggtaggcccggtttgagattgttaattatatattgaccccgataatatgcaaaaaaagagggttagctaattatagattttaaagtttaaagtagtgagagtagactaattgtaaattgaaaatagaagtgatgacaatgatgttttttttttttgaaagaaaggctaaactattattatcattaacaattatttgaatcatgatgattgtaacaactagaaacaatgaataaaacatattggtcctttcctccttcttgtgatgaggatgataacgatctttatgtagaataatcaattatatttctaagtttttatgttttgtccgattatattacatagctgttacctggaactcgaaattacataaatttatgcctttgtctaccatatggcatcgcacatccaaacgcttgatttagaagtagaaaaacttggttaaaagagaggaagaaatagtgatttgtgaggtaatcgaggattggagatggatccaatggaaagaatgattgctaatcaggtgggattagtggtaaacataattaccacacgtgtctagctgtctaagctttatttaactcactaatttcttagaaatgtctcctttttagccccatacttttacaatggatcgaattattaatgagaaggtatcatcattttagatctttatagctttttaacccggccaaaatggatggcagcggaaagaagactcatcgccaattgacattaaaatatgcattttcaaatgtttttttttttttttttttttttgtgattcaaccttatttaggctattgagatatctccaaaagatataatattgtcgtccctaaatagagcagatattcagatatcattggtaataatactgaaaaaatggcgagtcattgtagttaaataatttgacatcttgaaaccaggaactcgattctactggatggttacagatggttcccataacgacaaagattgtgagatttgttttgattttcatcaatttatcttcgtcagaaaatctgtttaaccaaaaaaaggatcatgactatacaaatttattaatggtgtaatattcaaaaagcagaatataagaatg

SEQ ID NO: 30574 - DNA, 3003 bp, Unknown
  misc_feature (1)..( 3003): 2750-1469P.txt file - cDNA_ID_3033212; gDNA_ID_1972187; Annot_ID_180191
cgtccgcttccgttctgcagatctcccacatgttcgaatccccatattataggccttcgcgttatcaacactcgtgtgcggtggatttccctccgtcggccatcccgtctccgccaccatcaccaccacgtttgcggcgttgatcttctccaacgccgcattgaatccgtcaaccatcgcctcaaacatattgttgtaatacaaatcaccgtctatcactaccggtgtattggatttgaaactagcgtaatcgagtgagatgtgatatggatctgacgcgtatgcgaagtacgggtagatattcgtcatgagaggcgaattcgtctctgagagtatcgatgtaatctccgtcatgatctcggttagatctgggaggaatgttgcagcggaaggtggatatgtattggtcaacgcggtcatagctaaaaccgtcgtgacagagattcctgtgacgccggaattcgttagcgcgacgttgacgttttttatcgcggcggcaacaaattgagcgatttctccggggaagacttcgttaccaattgtgatccatttaattgcaacgtcgttttggtaaggtgtaatccaggtggagacgaaatttgttgcggcggctggatcgtgagctagggattggatatcttcgtttcgtggaccaaacgcgactaagagacctgagccacgaagcgcttcgagcatgtctgcgaagggctcgtacatacggattgcgtcgatgttgttgcttttgtatagagcaactgtatctgccggcgttgggagattgttgccgttccggccgtaacaatctccggtgatgtcccctgcaacacctagaaggacacaaaatatagtaatcaaaccgtactcggttattgtttggtttaaaatatttaatcgtttccaaaaaacggagttagactgaaccagattacatccaaagaaaatcaaaccatgagataatgctttttattaatttaaacatagattgattaaataaagttgagtttttgttgttgttattattgtgaggttaattgtgatgaaaacaaaataaatcaataaatcagtttttacccgctgtgcaaaagatttggatggacaggagcataatcacaacagcgaaacggattagtttggaatccattgatgtatggtgcgtgtaaatgaactatttaggagagaattgatacgagattattctattgtgtttgtgtatgtttgaagatcttaatattggtgaatgtggaatgtatttaagggtggtttttttttttaggaagcatgcgtaattactactctaataataataggctctcaagcatgaattatttatccattaaatgaaatttaagtgtacctagttttgcaactgataaactatacaaattcgtgctacagctttgtcattaatggatgatcaaccattttttttttgtttaccaaaacatcatattattatgccacttgggttgggttaaacgttttctcttttggtggtttgcgaaaactctttagatcataggacttactcactatttttacattgtgtgcataaatacgtaattacctctgaagaaaagttacaggtgaagttcatcccctataaaaatgaagaactgtttggtaaaaacgttttaattaatcaccttcaaatacattctatcaatcggcgatatattaagaaagttaacaagttattaatttgtttactagatcaagatttcaattgtttactaatttgtcgttttgtgcaagagttatgcttaggtattaaaaatcaagacaaaaatttcattctacaaattgatttccacaagttttgaggttccagcttcgtaaatcattaggtattaatgcggtagttttatcatttcacaaaaaaacatttgaaataacattatacattaatacatccataaataattcaaacatcatgatctccttaattatatcaattaatctagttttttttttttttgctactcgatagttttaaagccaaaacattgtaaacaacggattctagtttaattggtgggcacaaagagtcattttcataataatatagaacatgtacatcacatgtaattaatacatacattctctttctgccaatcaatcataatcaaagcaatatttttttaaaaactaatatagagcaaatctaacaataaaaaagagagagtggtatcatcatcataaacaataagaaggctccaaaaaacagaaagttaaaaactaaaataaaagaaaatctaatttggatctaaatgaacttctgaaaaaagtaatgacctaatctccaattactacaaaaaagaaggatcaataaataattaaagaatcgagaggtaaaaaaagcattatccgtacgaatgaattaacgtggtcgtatctcgtgagtcatccaacgagtaaaaataaaacacgtgtcgtaacaaaggaggtgcacgagtactagcctacgcctcacacctctctatcatattctcttgaataaaaaagctgaaaaaataattaaaaaaaaattctggcaaaaatgaaccgttcctctgttgcctgcaaataacgcgaaaatctctctgagaaaaaataaaaataaaataaaagaaaccgaaccagtcgtgggaaggatccgaaagaagatgaaccagagaaatttgaagaagaaaccctaatcttagcctcgcttttattctatcttcttcttcttcttctttcttcgttcttaatctgagaggcgccaagattggtacgggcggagctaggctagggttaggattttaggctcgggaaattagggttagggttttgattttattggctgtttctttctcctgtggtttgggaggtgaaattgaaaggcggagttgtattggaggatttgggattttagggttagggttaagtgttttctcgttttttcatgggaggtgtgggagtttatggtggtggtttgtgtcggttatgaacgttgaccaatgccagtggcggaagaagatgatg

SEQ ID NO: 30575 - DNA, 3000 bp, Unknown; identical to SEQ ID NO: 9782
  misc_feature (1)..( 3000): 2750-1469P.txt file - cDNA_ID_3033216; gDNA_ID_1972187; Annot_ID_180190

SEQ ID NO: 30576 - DNA, 3000 bp, Unknown; identical to SEQ ID NO: 10980
  misc_feature (1)..( 3000): 2750-1469P.txt file - cDNA_ID_3033256; gDNA_ID_2214469; Annot_ID_182959

SEQ ID NO: 30577 - DNA, 3003 bp, Unknown
  misc_feature (1)..( 3003): 2750-1469P.txt file - cDNA_ID_3033319; gDNA_ID_1972192; Annot_ID_180231
tacttttttttatccacttatatcaataattaaatatacgtatgttgttgtcactctactcttttattactggtctttacttctgtcttcatttattaataagattctttaattttccattatctactaattaacaaaaaaaatcgacaaaggaaaaatacgaatcatattcttgtcgttgattttcgatgatgatttgatgacgatgaaaattcaacgttacgagtttcagaccctcatgttcttgtcgattgccgtcactttccaggaaacatatcattatcccttacttcttacgcatttaaattaactactgttttttctttctaactatattatgtgattttctatgtatagttttaccaacaacaaaaaaagaagaaatttaaaggaagctcacctttccaaaatacttgaaagtgagaaagaaagaaaaagctacttttgaaaaaaaaaactttaaatttaggttgatgaactttataagcggctttatctatctactaaacaaataatcgagtttttaattcatgaccagaatttcttgtataaactaactactcgtcttatctcccacgtaatagaccaccagggtgctatgattataccattccaaagaaacccataatgcactttggtgggttgtgtagatttatatatggtattaagttaatgatatgttttatgaaaaaaaagagagttaatgatatgttaattaagtgggttttgtttatatagttgttgtgtacatttatctcaaatattcaaacatacatatatgatgttttgtacaaaccttttttaaacgcatttatttaaagagcactaaaacatttgttaatacaacatttggcaaaccctgtagaatctcttaaacaaaattacaacttttgcttaatcaaatttgtagttctacacgaaccaattcataggacatgatttataaatcaacatcgcatataacatctatctatgttttcttatatgaaaatttagtagccgtttgtttatgcagcgcgtattctaacagtttgttgttatcgcaatatattttatatttgtatgtacctatatatagtaataaacaagtttgaatgcagtgaaatgcgatgcacatctcccaaaagagcttgtctcgaacactcgacaatcatcgtcatcgtaatagaatccacacggtgctccggagaacttatagctcatgttggattctatgtttcttctgcaacatgtaagctgtaacaagacaagtttgtctccatcgttaaagcaaaagataatggaaatttataactttccatttgtgtttagtcattctacactgaaattaatgtgtttgacaagtaaattagttcaacgattagtatggtcgaacctcgtaggatggagcatcgtgtcccactcctatcactatcaattaccaaacacaatgggaaagtagacactggtcaaagtatcatatgtcaaaaacatcatcatataactaccaacccaagagaagtgtgtgttcattgaatcttcttaaatggaataaaaattcgatttgatatcaaagatttggcttactcatctctactcaaagtcatgctttacataaatatggtgggtcgatctaggctatctaattaaagccaatttttagctttccttgggaagaccaaacaattgagagatggttaagttttgtagaaaaagacaaagatctccaattgttaggcttttgtttggttcttcttttaggcaaaccataagagtggttagctcgtcgggtaagaaacttatagtatctatcgtgctcgctacatatcgcttgctgatcaatctaacttgtgatcagttttcaagtacctagattagatgaacgcatgagtaattcgatttaacactcacagtacattcatttggaaatcaacaagggtgtcgaaattgatcacaatacaatcaatctgcacttaagttttagagaatcctacaaagagtttcgatagaactctaaattgaaacgtttatttgatctatgatagccataacaggcaaaagcaagcttcttttgtcttatcacttcattttctgctctgtaaagaggacatggcgattaactcgaggatcgtacttacggaactcgagcttctcaagaagtcccttggtactcttcctcttgacatagaagaatccagttccagctgctgaaactagacggatgaacatgaacgtcttcttcctcttgtctcccatttctttatcaagaatgacatcacattacattaccattcttttcattacagataactaaaatcctccgaactgatgaaacagaggtcacaaaacgtataaagtttccatttttttatagctataattcgaaaatgcacaaactttagaaatggatttgtttctaaatcatatgggacaatgacttttctttgaaatctatgaacctagagattcgaaaatcaagcggaaaacagatctaaaacctagaatccagcaaagaaatctcagttcgagaacaaactacaacaagacgaacacgatacaagcaaagaaatgaaaaattagcaagaaatgagtcaaaatccaagaagctagaatgattagcgtacctgaaaattcgaattcgacggagtccgaaaattgatttcgccgacgaagatgacgggtgataaaccctacaatgagaaatcgggttttgaatcaaaccaaatgggctattaagttgagcccaatatcagcccagcaaagcgacatcatcaaaacgcagcgtttaattgtcgagagccaatttgcttttgttgttgttcttcatcatcgcttttagttctctcagtggagaagaagactcgagtcatctgcagaaaaggtgagagataatgtttgcaaattttcatttagatttcgaaacttattttctcaaatttctgatggattcaattgatttttcagattcccgatcggattggatcatataagattttagggatttggaaaaaatcttgagctatg

SEQ ID NO: 30578 - DNA, 3000 bp, Unknown
  misc_feature (1)..( 3000): 2750-1469P.txt file - cDNA_ID_3033323; gDNA_ID_1972192; Annot_ID_180229
cttcttctccactgagagaactaaaagcgatgatgaagaacaacaacaaaagcaaattggctctcgacaattaaacgctgcgttttgatgatgtcgctttgctgggctgatattgggctcaacttaatagcccatttggtttgattcaaaacccgatttctcattgtagggtttatcacccgtcatcttcgtcggcgaaatcaattttcggactccgtcgaattcgaattttcaggtacgctaatcattctagcttcttggattttgactcatttcttgctaatttttcatttctttgcttgtatcgtgttcgtcttgttgtagtttgttctcgaactgagatttctttgctggattctaggttttagatctgttttccgcttgattttcgaatctctaggttcatagatttcaaagaaaagtcattgtcccatatgatttagaaacaaatccatttctaaagtttgtgcattttcgaattatagctataaaaaaatggaaactttatacgttttgtgacctctgtttcatcagttcggaggattttagttatctgtaatgaaaagaatggtaatgtaatgtgatgtcattcttgataaagaaatgggagacaagaggaagaagacgttcatgttcatccgtctagtttcagcagctggaactggattcttctatgtcaagaggaagagtaccaagggacttcttgagaagctcgagttccgtaagtacgatcctcgagttaatcgccatgtcctctttacagagcagaaaatgaagtgataagacaaaagaagcttgcttttgcctgttatggctatcatagatcaaataaacgtttcaatttagagttctatcgaaactctttgtaggattctctaaaacttaagtgcagattgattgtattgtgatcaatttcgacacccttgttgatttccaaatgaatgtactgtgagtgttaaatcgaattactcatgcgttcatctaatctaggtacttgaaaactgatcacaagttagattgatcagcaagcgatatgtagcgagcacgatagatactataagtttcttacccgacgagctaaccactcttatggtttgcctaaaagaagaaccaaacaaaagcctaacaattggagatctttgtctttttctacaaaacttaaccatctctcaattgtttggtcttcccaaggaaagctaaaaattggctttaattagatagcctagatcgacccaccatatttatgtaaagcatgactttgagtagagatgagtaagccaaatctttgatatcaaatcgaatttttattccatttaagaagattcaatgaacacacacttctcttgggttggtagttatatgatgatgtttttgacatatgatactttgaccagtgtctactttcccattgtgtttggtaattgatagtgataggagtgggacacgatgctccatcctacgaggttcgaccatactaatcgttgaactaatttacttgtcaaacacattaatttcagtgtagaatgactaaacacaaatggaaagttataaatttccattatcttttgctttaacgatggagacaaacttgtcttgttacagcttacatgttgcagaagaaacatagaatccaacatgagctataagttctccggagcaccgtgtggattctattacgatgacgatgattgtcgagtgttcgagacaagctcttttgggagatgtgcatcgcatttcactgcattcaaacttgtttattactatatataggtacatacaaatataaaatatattgcgataacaacaaactgttagaatacgcgctgcataaacaaacggctactaaattttcatataagaaaacatagatagatgttatatgcgatgttgatttataaatcatgtcctatgaattggttcgtgtagaactacaaatttgattaagcaaaagttgtaattttgtttaagagattctacagggtttgccaaatgttgtattaacaaatgttttagtgctctttaaataaatgcgtttaaaaaaggtttgtacaaaacatcatatatgtatgtttgaatatttgagataaatgtacacaacaactatataaacaaaacccacttaattaacatatcattaactctcttttttttcataaaacatatcattaacttaataccatatataaatctacacaacccaccaaagtgcattatgggtttctttggaatggtataatcatagcaccctggtggtctattacgtgggagataagacgagtagttagtttatacaagaaattctggtcatgaattaaaaactcgattatttgtttagtagatagataaagccgcttataaagttcatcaacctaaatttaaagttttttttttcaaaagtagctttttctttctttctcactttcaagtattttggaaaggtgagcttcctttaaatttcttctttttttgttgttggtaaaactatacatagaaaatcacataatatagttagaaagaaaaaacagtagttaatttaaatgcgtaagaagtaagggataatgatatgtttcctggaaagtgacggcaatcgacaagaacatgagggtctgaaactcgtaacgttgaattttcatcgtcatcaaatcatcatcgaaaatcaacgacaagaatatgattcgtatttttcctttgtcgattttttttgttaattagtagataatggaaaattaaagaatcttattaataaatgaagacagaagtaaagaccagtaataaaagagtagagtgacaacaacatacgtatatttaattattgatataagtggataaaaaaaagtaacaatgtcattgtcagtcgtggattcagcttaaatttaatgaatataaaccacaactatttcttcattactagatttatagatttgattctttctctctcagaatttttgtcgaccgaatttcatattcatatatagttttattaaataatctggttagatg

SEQ ID NO: 30579 - DNA, 3003 bp, Unknown
  misc_feature (1)..( 3003): 2750-1469P.txt file - cDNA_ID_3033331; gDNA_ID_1972192; Annot_ID_180226
ttgcccggtgtgattttttggtttgtggtgtgattttgtaaagccggtccgtttttcgttgtttgagtttgtggttttgttgaaaaattgtaactgtccatgtaaatagggactgatataggggtgacttgagtacacctagctcatatgcagacgttagcgtctgcgtttggagattcgagtttgcgttggtgggacgtgagcagattttttaatctaaagtttgtgtacactttcttgtacttcttatacaaaacaaagggacacgaatctttctaatgttcataatttattactgggttttgcaagaaacttgttgacaatatacaaataaactgataacttatatataaatataacttttgagaaatctaatcttatttttatgcttgcacgtatataaggacaaagtgagtgggtatcaatcaaccttatagtaacatatacaatctttcacgcataaaaccctataatgtgaaaacaagaaacgtcctttacatatttcttctcacctagatattattaattttaatattgagactttgaaaccccagaaataagataaagtgtgggacaagaaaagaaggcacctttttttgttgttgcttttagccgtgaggccagcatatgcagtaactcacatgcatgcgcctctaaccttgtggcattttaggaattatgcaataatgcactatacttaaatacgttaattcacaaagtaatacattcattcagttcataaacacgtctcaagattaagacaaaaataatcataaaaaactggtgttttacataaacttatgtcgaaattaattagtagtctacatataattactcaagtgttatttgcatgtaaacagtacaaatttttggaacgtttgattttgatactactataaactgcagtatactgtaaagcatgcatatgacgtcactttaatttgaaacgtaatttcaactttttcaaaaggttctttagcttagcgataaaaaaaaaaaaaaaagttagtgtatagtaaacgaacaaatgaaatgaaaagaagagaaaagtataagtcctcaaagtgtattgaatcacttaacggtaaattagtttttatttttatttttatccagagttcttaagttaattatgcatcaattatgtggttctgacgtaatatattacttgcgtttttcatctaaaccaatctaaaactgtaacaaaatgttaagtggagaacaataaaaaatacaaatagtaaaaaaaaattgaaaatcaaactaaatctaattttattcgttatttttaggggacaaataaactcatgaaaataatgacgtacgtggtctaaaatatatgaatgacctatatagctgaaacggcaagaagccggagcgagaaacaatagacggcggcgaagacaaagtagatgaaaactccgggagcttgagaagacagagaagcaagagatgaagccggaggagaagccgatggagcgaaggcgggatcaggatctgcggaaacgtcgtcgttttctggttcaggaagtgttgaagaagaagggatggtttgagtggaggagacggcgggtgaagggaggagaggagcgatctccggtgagatcttttcttcagagggagagattgtttgcgaagatgggattgtatttgtcgtcggcgaagagagagaaagtgaggagagaaagatgaaggtgatgagtgttagcaatatagatgaagccatcttttttggttactgtaatgatgaacaaatcaaagctgagttgtttttttccttaactgatgagagcgcattttgtgttgtaataatgatactgtctctataaaagaaaacttttagctctaatagtaaaatattataaattgattttaaatggaatttgtctcacctttttccaaaaagattattatttatcaatttaaaggatgtgttcggtggaaaagaaaatatatttgctgaattcttgaagatgggcgtagatcgagttttcactttttagtagaagctcttatatattgcacatattttcgaataaacatgtgctttactttttgctgaaaaatattatgttaatgcaaattatacatattgctaagtacgagtaaaggcatctccatccatgagaaacctacaaagtttctaaaacaaaaaaaatattaatattatattataatttaattatttgattaaaaaagtaattttgttaaaaaattgaatcaatagtgagatgagaattgtcatgatgggttgtagagaatatctcaaaatttttcaagtgagaaactttctacattttctctccttcattttcattatttttatttttttaattgtgaaaaactcttatgaaataccttcaatggagatggtctaattacgtttgttgttgcctcgttggatgttcaaataaaaagcacattttatattgggttgttcctaaacaaatattttgttgtcttttgtactaaagtttattggcgagttaagaaaagctttgtggtgtgtgggaattattattattatttattatttattgttctttagtttgctatgcaattcgagcccactaaagaggcttcctatgggcccaaaaaacgcagcccactattgtagtgcaaaacgtgctgagttttctacattgcatgcccaacaatggccaccagtgtagttaaagactcaagaacttgctgacctctatttgtttgactttcttttttgtgtgaacaaaatcacatattgttgatgtcatttgttctgctataattcttaacttcagattacagataacgaattttctcttgatgatttaaacaaacatatataattgtcaatatcagaaaatgaaaaggagatataaataatttttttttgcgcctaatcgaaacttcacctaccattttttagcgtataaaaacgttaaaaataccaaaatttagaaatccaataaaagttgtgaaaaaaagccgcaaagggtcgttgttgtttgtcgcctctcaatg

SEQ ID NO: 30580 - DNA, 633 bp, Unknown; identical to SEQ ID NO: 110
  misc_feature (1)..( 633): 2750-1469P.txt file - cDNA_ID_3033331; gDNA_ID_2720; Annot_ID_145895

SEQ ID NO: 30581 - DNA, 3000 bp, Unknown; identical to SEQ ID NO: 9794
  misc_feature (1)..( 3000): 2750-1469P.txt file - cDNA_ID_3033335; gDNA_ID_1972192; Annot_ID_180222

SEQ ID NO: 30582 - DNA, 3000 bp, Unknown; identical to SEQ ID NO: 9800
  misc_feature (1)..( 3000): 2750-1469P.txt file - cDNA_ID_3033343; gDNA_ID_1972192; Annot_ID_180220

SEQ ID NO: 30583 - DNA, 3000 bp, Unknown
  misc_feature (1)..( 3000): 2750-1469P.txt file - cDNA_ID_3033347; gDNA_ID_1972192; Annot_ID_180219
cttgtacggctctgtttgcactcttaacttttgcttttccgggcacttttaatatttaccgtataatgactgtgtagcctgctgtactcatattgtcctcatatatgcagaataatctccatgaactgtgggctcttctaaattttcttctgcctgagatttttagttcagcagagacttttgatgaatggtttcaaatttctggtgagaatgaccagcaagaagttgtgcaacaactgcacaaggtatggatgcacccattccttgcattgagtttattctgttctgtgtgagtcgtaggttaattgctttcatgtatctttttaggttcttcgaccatttcttcttcgaagactaaagtcagatgttgagaaaggtttgccaccgaagaaggagaccatacttaaagttggtatgtctcagatgcaaaagcaatactacaaggctttactgcagaaggatcttgaagcggttaatgctggtggagaacgcaaacgtctgctaaacattgcaatgcaactgcgtaaatgctgcaatcacccctatctcttccagggtgcagaacctggtcccccatataccacaggagatcaccttataacaaatgctggtaaggctagaaataaactagatccttcagatttctgtggaagttttttatgaagcatctctatattgttattttaggtaagatggttctcttggataaattgcttcctaagttgaaagaacgtgattcaagggtgctgatattttctcaggtaaacgctaatacagaacagctggatataatggtttcttacagttcatcttctctttttcctttgtctatgtaaagtctgagccttattcttttctttccacatgtcagatgacaagacttttggatattcttgaggactatttaatgtatcgtggttacttgtattgccgtattgatggaaacactggtggtgacgaacgagatgcctccatagaagcctacaacaagccaggaagtgagaaatttgttttcttgttatctactagagctggagggcttggtatcaatcttgctactgcagatgttgtgatcctttacgatagtgattggtaagtctctcatcattgtccactgtagtttatgaactttctcttcacgtttgacgagtctggcatattctggcaggaacccacaagtcgacttgcaagctcaggatcgtgcccataggattggtcaaaaaaaagaagttcaagtgtttcgattctgcactgaggttggtctcctctccgtgaatttcaagttaaaacagccatgagaggtttaaaattaattatgtgttgtttgtttacagtctgctattgaggagaaagtgattgaaagagcttacaagaagttagcacttgatgctctggttattcaacaagggagattggcagaacagaaaagtaagtgcgttatacagtgattgctttatgcattggttcatctctgacagaattggtatttatcttaactatgcagctgtcaataaggatgagttgcttcaaatggtaagatatggtgctgagatggtgttcagttctaaagatagcacaatcacagacgaggatattgatagaatcattgccaaaggagaagaggcaacagctgaacttgatgctaagatgaagaaattcacagaagatgctatacagtttaaaatggatgacagtaagggtgtcacttacctactatttcccctattaggttgtgtgaatattgtaatgttttgataatctgttgttttatttgttgtaggtgctgacttctatgattttgatgatgacaataaggtaacttgtatatttctttgcatagtcttaactttcatgtcatatccctagctttgctctgcattactgatgataaaatttactaatatatttgtaaatttgttcataggatgaaaacaagctcgattttaaaaagattgtaagcgacaattggaatgatccccccaagcgggagagaaagcgcaagtaatgattacttctgtcttatacattgtgcagtcctattttgccagtcttcatatctaaaagaaacatcccttttgttttatctactgtatcttcagctactctgaatctgagtactttaagcaaacattgcggcaaggtgctccagctaaacctaaagagcctagaattccgcgcatgccccagttgtgagtacctcaacaacctccatctcattgttgaatgccttttccctgttttgatgattttcttacactagaaatctaatttattgtccctctttcaggcacgatttccagttctttaacattcagagattgaccgagttgtatgaaaaggaagtacgttatctcatggtaggcctctctcaaaacgaaacacttgattcctttgatgtgcttaagagcgagtttttttgccttataaaagcaacttgcttctttttgtgctttttggtttcagcaaacacatcagaaaaatcagttgaaagacacaattgatgttgaagaaccagaaggtcaagcttgtacccactttgttaacatgtacccactttgttaacatgtttttcagcaaacctattactgattaagaatttttttgttagaaggtggggatcccttaactactgaagaagtagaagaaaaggagggattattggaggaggcaagtgaatatgtttgatgttagagtggtcttagacatttgatttggtaggctttaattaattttttgtaattgtcaatctccagggtttctcaacatggagcagaagagattttaatactttcctcagggcttgtgagaagtatggccgcaacgacataaaaagcattgcctctgagatggaagggaaaacagaggaagaagttgaaagatatgccaaagtatttaaagagcggtacaaggagctgaacggtaagtaacacctttcaatgctaagttatgcagtgtttttacatgtttctaagtaattcctacctccaaaaagagcttatg

SEQ ID NO: 30584 - DNA, 3003 bp, Unknown
  misc_feature (1)..( 3003): 2750-1469P.txt file - cDNA_ID_3033351; gDNA_ID_1972192; Annot_ID_180217
caccaagtcccccagctcgtcttcaagctctccaactcgtcttcaagctcttcagctcgccttaagctcttcagctcgcctttaagctcttcaaactctttagctcgcccttcttacaaaaacaaaaaaggatatcaattatgtagatcaaaacaaaaacaaaaaaggacttacaaggacgtagatatcaattatgtagatcaaagaataagcagtccaaattccagcgttgatgaaacgaactaacgatagccaaaacggcatgtacttgaaggtcttagtctccggcggcattttgtcctaattgtttcacgcattaaaaacttatcaaaaccagtttaatagtttacttatctatatattcatcaataagtgagagccagagagagagagagagcttactatggtaaataaaagatagatgataacaatgttgtaaacgttgcaaacaacaccaatgaatgtatgcttgccggccggataaactcccaaatccccagatagtcatacaatagactgttgccacaaaactaaactccaacggaagcaatagataaaagagtaatatctgcacatcaacatcgacatcatcaaaatcaatatacaatatttttctggatttgttttttttttctttgggatatttctatagaatttagtcaagattgtgtttgtttgttaccaccttttgtgcaccagtcaccaatccttatttttattattaaatctatttttgatactataattcgtgattttccttttagttttatatatatatatacttacagagatgcgagcttcatattattatttttatctttttgaacaccaaaaaaatagcctcgtattatttttaaatgatcaattatgtgatcatatttaaaaatacgatccggtttttaagggatttgaacggatcaaatgtgtttccggttcggttatataaaccggtattttaccatatccaaccgaaatgagtatcgacgggaattatccgtaaacagagtgacagtgaggtgtgaaggaagaagacgatggcgtcaatgtctctctccttttcttcttcgctatgttcatccagaatccccgaaggtaagcgtaggtttcgtcacagagatgtgggcatcgttagatgcgttttggctgcttcgaaatcttctccgggaagtgttacgaagaagaggctttggaaagacggcgaattccccggaatcacggagccggttaatcagagaagaactccgataaagaatgtgaagaagaaacttgacaggagaagcaaagctaacggatgggttaacaccgtcactgaaactttgtccgatctcatcgccaaaaagcagtggttacaagctctcgaggtatttcgattttctctcttctcgttcatgtttgattgaatttgaactcaattttgaatcacgagtataatttagctgaaagatgattttgattgaattgggtattttgttgatgatcttaggtttttgatatgttgagggaacaaacattttatcaaccaaaggaaggaacttacatgaagctgcttgttcttctcggtaaatctggtcaacccaatcgtgcacagaagctgttcgacgaaatgcttgaagaaggacttgaaccaactgttgaactctacactgctcttctcgctgcttacactcgcagcaatctcatcgacgatgctttttcaattcttgataaaatgaaaagctttcctcaatgccaacctgatgttttcacgtacagcactctgctcaaggcttgtgtggatgcttctcagtttgacttggtggattcgttatacaaggaaatggacgagcgtttgataactccaaacactgtgacccagaacatagttttaagtgggtacggtagggtcggaaggtttgatcagatggagaaagttttgtctgatatgttggtgagtactgcttgcaaacccgatgtgtggactatgaatatcatccttagtgtgtttggaaacatgggtaagatagacatgatggagagctggtacgaaaagttcaggaactttgggattgagccagagactcggactttcaatattttgattggttcttatgggaagaagagaatgtatgataagatgtcgtctgtcatggaatacatgcgaaagctagagtttccgtggacaacatcaacctacaacaatatcatcgaggcgtttgcggatgttggtgatgcaaagaacatggagttgacatttgatcagatgcgtagcgaaggtatgaaagcagacacaaagaccttttgctgtctcataaacggatatgccaatgccggtcttttccacaaggtgataagtagtgttcagttggctgctaagtttgagatacccgagaatactgccttttacaacgcggtgatatcagcgtgtgctaaagcagatgatctgatagagatggaaagagtgtacataagaatgaaggagagacaatgcgtatgcgattcaagaacgtttgagatcatggtcgaggcgtatgaaaaagaaggtatgaatgataagatctattacttggaacaagagaggcaaaagcttatggatcgcactgttgctacaaaagagatggagaatcttccggcaggatgattgcggtttgtgtgtgaatctctctctctctctctctgcaaggagagatcgatgtctcacttgaaagagtagaataaaagagtttgtaatacacttgattgttcttgcagctatgcgtgttatatattttgatgggcccaaaattatgaatagaggcccatagataaactgtgacgtgcacaagaaatcggacaagtccaaaaagtggataagtgcgtgtcgtctttctataaataatctcttttctctcatcttttaccgtttcttctcgaacaatcaaaaacgaactaaccaaacataaaattgaacacatcctcttcctctgctctctgcaaacaaaaaaacaccgattcggtcaggaatcattcgtcgtgaaatctgtaatg

SEQ ID NO: 30585 - DNA, 3000 bp, Unknown; identical to SEQ ID NO: 9802
  misc_feature (1)..( 3000): 2750-1469P.txt file - cDNA_ID_3033354; gDNA_ID_1972192; Annot_ID_180213

SEQ ID NO: 30586 - DNA, 3003 bp, Unknown
  misc_feature (1)..( 3003): 2750-1469P.txt file - cDNA_ID_3033361; gDNA_ID_1972192; Annot_ID_180208
gactaaaaagccgaaaagcaaggtcttggagatttggtgctggtaaggaaccttgatatttattcaaacagtgaatcaaaaaccaaaaaaatctgtctaaaagtcatttacttctccaagcaagaacctcaggaacatcggtatccttgtcattgcagaatggttacgtgggtttatagcagattatggtgttccagtaatggtggtagtgtggacttgtatatcatacataccttggaaaagtgttcctcaagggataccaagacgtcttgttagtcctaatccatggtctcctggtgcatatcagaattggactgtcattaaggcactaatcacttcctctacacttattattctctttactattaatgcttcatgttgatattcatgaaagtgcatgatgaataaactgcaggagatggtggatgtacctgtgctttacattcttttagcggttgttccagcgtcaatgattgcggttctttactactttgaccatagtgtagcctcgcagctcgcacagcaggaagatttcaatctgagaaagcctcctgcttaccattatgatctgtttcttctaggtttcttggtaagagatgaagtgtatgtttttcttgactgatttattgacttgaccagttacgaaatatgaaaggttggaactcttcttttgtagacaatcctttgcggtctcatcggaattcctccatccaatggtgtcatccctcagtctccaatgcacacaaaaagcttggcaacactgaatcaccaggtttgattacatattgtagtgtgttttatgtaggccttcaattgtatttctcaaaaggcatttaaaaactggttgatgtgcagttacttcgaaacaaactcgtggcagctgcgcgtaaatgcatcagaaacaatgcaacaattggagaagtctatggaagcatggaagaagcttaccaacaaatgcagagccctctgatacaccaagagccttctcgggtatgttggtatcatctatatattagtttataatttgacctttttaactcatccctgatcaagcacggtgcaatatcagattcaaggactcaagcagtcacatattcaaaaggcttcaaacgccgatgcactggtcgatgaaacagtgttcgatatagagacggaagtggagaatattctgccagtagaagtaaaagaacaaagagtaagcaactttcttcaagctatgatggtggctggatgtgttgcagcaatgcctttgatcaaaagaatcccaagctcggttctttggggttacttcgcttacatggcaatcgaaagcctcccagggaatcaattctgggaaaggatcgtgcttctcttcactgccccaagtagaagattcaagtaaaaaacaaacctttcttcatcaatctgaaaatcttgttgttggtgtattctcatggtctctgtgaactttggtctctttttttgtgcagagttcttgaggataatcatgctgtgtttattgaaacggttccgtttaagacaatggcgatgtttactctgtttcaaaccgcttacttactggtctgctttggcatcacgtgggttccggtggccggagttttgttcccgttgatgataatgtttcttgttccagttaggcaatatgtgttgcctaatttcttcaaaggagctcatcttcaagacttggatgctgcagagtatgaagaagcacctgctatcttatcattcaatctcaaaccggtaattaattctcttcttcttctcttcaaaagcttaaggctttatcgagaacataccggtaatatactggtttcttcgtggttgtgtgcaggaaggggaagtgagccgtgcgacgtcgtttgcggatagtggagaagtgatggacggaatgtttacgagaagcagaggagagataaggaaagtgagcagcttgaagctaggcggtggaggaagtggatcgacggtaggttcgccggcgggaggaggagtggagttgatgagaagagtggtgagttttcagaatccaagggtgtcggagaaagtgtacattcggagcttaagtgatttcagaggaggtggagagattagtccacgatcgtccgctggaagagctccgttcagtccacgatccgccacgggtggtggaggaggagaacagagactttctaatttaggaaagtctgtttagtaaacagtatagtgtagtctctctctctattcatatttgttctaaccaaccaatcctatatagccaagttattccatttgcctgtcattatgagatttaagaaatgaaaagaagattatctctcggagaatttgtttatttcaggaaaatttgaaatgattttgatctccaagtacaaaaaaatggacaaaaaaaattattagagtcctagttagtagtccaagagtacaaaacaaagcaatacaaaaaagttaaaacgacatcgttttcattgtaaataactgacatcgtttcgttgttatataaaacaacgtcgtttcctatagcaacaagatgctctctgcttcagctggccttcgtcgtctctgcctgggctctgaaactgcatttggctgatcttggatcttcatgaattatgtacttgaaagatcatcgaaattcaatataaaacgggtaaagcttctcaattttacaataaacacaacttttcagctattgaaacagtgactaagctgtttttcttttgagctatatttctttgttagtgctaagtaatagtaaacaacaatttactatgatcttgcttctgggtctccttatatccattaaagactgatcctttctgcaccaattcagtttaatctttcttcttttagcttaaatgtctctggttagttatgtctgaagtatacaacaccggttccaaagttcgttgaccattgtttgagttcttcttttattaggattgtgagaataagaatcggattatgctaactctaattcgtaatctgcgttttactttaggttactcaatg

SEQ ID NO: 30587 - DNA, 3003 bp, Unknown
  misc_feature (1)..( 3003): 2750-1469P.txt file - cDNA_ID_3033365; gDNA_ID_1972192; Annot_ID_180207
taataagaggaagtttaggcttggtgactgaaaattgtcgttttttcaaataaggctataggtttttaaaacatttgggcttagaacccatttcggtagggacttaaccaaagataactgaaacatttgaactcctaggccttgtcatctaacacacatttcttatttacataatggcttgtatgatttgaactacaagccaaaaaacttcaaaagggtgtaatctttttgaagatggatgttggtcttcatttcttggccagtaatttcttcgggagcttatcgaggggcgttgatttaagtaaaaatagcctcgcagctcgctctcgcaatgtccctctgcatttcagaccgcgtgactgaagctcagtcttcaatctctccatccccaaaacctccatatctgtggctgctttgaactcagcaaagttaagcggttcaacaggtttgcaacacactctttctttcgcagttcctcctctctttacgacaaaatcatcgtttccacttgatttctccaccttttcaagttgatccattgcatcagcaacagcaaaatcatccatcttctcttcgttaattctttgaacaaccgtgatctctcccttaactacatctgaactttggtgcactacaaagtcgttctcaccatcatgggatccatccaaaacagagcctgagctttcatcagtatccttatgatctgaatcaacttgaccaccaacaacagatttctcatcttcctcgtcactgctatcatcactgtcactatcttcaacagctctctttccattccatattttgattcgtttcgatttttcagattctgcagtacccatcttcttcccttttctcttattcccattcttgaaagtttcgttcaaagccaaatgcacagccaaaatacacttatcagatccccccttatacttgttgacattcttctgcgtagctccatctccaacaccttgtttagcattattggattgctccttcagatactcaagagcctttttctcaaaattcctcccttattcaccatccttccactcctgaagcctgttctcggcgtttacatctccgttcactcatatccctacacgaatcgaaattgtttgtcttcttctgtccagctttcataaccacattacgaagtaacgatccgagtccacctttgcctccacggagggacaggacaagattcatggtggtgtcagactgagaaatcgcggatgcgccggggatttggaatcctccgcttatcaatctctgtagatgcgtcggaatcttcgtttgctcgaagatccgctgcttgatctgctcgccacacgctatcggagaggaaaaggttagggttactgattttccgtcgagtagtctcacgaaaaactgcaacggcttacaactttgatccgccatcgattttcgattctaaagcttggacgaagaagaagaacaaagttcgattcgatttctggagagaaattgggggaaagttgaaaaacggatccctaaggtagtctgagtctctctctctctctgcttgttgggctaagaataagatttctttttggtaatgtgttgggctaagaataagattgatatctcttctgatgcggtttcttcttgttgggcttcatagttgggcttttcgttttgaaaagtcttaggttttatgttttgctttggctagtttgttgtctatgacctttttagcttgatgtatgtgtttcgtatcttaataaaatacaaaagagtgtattacaaaagaaaaaaaaaaagatgtttgtagagtgaattaaaattatagtataaattatgcgagaaaaatgaatactataaaaaatggttagcaaactagtattttctaatcagtgagtgctggaaatcaccgcccattagtactgtagattaggatgccactagctagtaaatagaagatatttattaggaaaattcgtccaaagaatttgtaaaaaactaaaaacccattaaatcaagtaaatcgtcattgtcagaaaatgtgacatgtttttggaaaaagattccaattcatcaatccgagaaaaatgtatgactcaaaaatctaaaaatgtcttagtttggaagagatgagaatgagataaatgaaccaacttgactcttaacttaatctcatttatagaaaaattggtaaaagagtgataagagacatttaaacgccgtgttaggcggaagaagtgtacaaaaccaatcacgagcattgtctgaaaccggagtcaaagagacacagagacagacatctctctcctctcatcagatctcaacacatcacactctcttcccttttttaaaatccaattttactgttgtttttttctcctccagcagtagtttttaactgataaaaaatctcccacggctcttgtatagagactagagaggtcaagcctagaaaacgaaagctattttctctcagtcttctaaagttgtgttcctttagtcattttgagctgatttgtctctggtaagtgtttttctttctttctctctcagtcattcttgaatccaagctcagagatcccatgacttttttacttctcgccagcttttgatttttctatgagctttccgtactaaatgtgttgtaaagttctcacctttttgtttgccaaatcacccattatcaaatctacataactccttttaaagacatcctccgcaattaacgcttttgaagacatttctttgggtttcttttaaggttcctgcaaatatttgtattcggatctgagtttcttagtaattaaaagggtattaagatttattcgttactctttgtttattttggttacactattggaatttttttcaatctaaatcattctagttgtatcagatttcctatcttggttactacatgctttatcttaatcatgcatcataatcctgggttttgagttttaacagaactgagtgttgttttgtaggacactgaaaacttgaacacaccaaatctacatg

SEQ ID NO: 30588 - DNA, 3000 bp, Unknown; identical to SEQ ID NO: 9790
  misc_feature (1)..( 3000): 2750-1469P.txt file - cDNA_ID_3033369; gDNA_ID_1972192; Annot_ID_180206

SEQ ID NO: 30589 - DNA, 3003 bp, Unknown
  misc_feature (1)..( 3003): 2750-1469P.txt file - cDNA_ID_3033385; gDNA_ID_1972193; Annot_ID_180273
cttactttgtctttcatcactctcaccgttctctcagccatcttcaccgcagcttcagcggccgatgctacaccaagccaagtagtcctagacatagctggacatccggttcagtccaatgtccaatactacatcataccggccaagatcggaaccggaggtggtcttatcccttcaaaccgaaatttaagcacacaagacttgtgtctgaatcttgacattgtccaatcatcatctcctttcgtctcaggccttcccgtaacattctccccactaaacaccaaagtcaagcatgttcagctctcagctagtctcaacctcgagtttgattccacggtttggttatgccctgactccaaagtgtggagaatcgaccactctgtacaactaagaaagagctttgtaagcattggtggtcagaaaggtaagggtaatagttggtttcagattcaagaagatggagatgcttacaagcttatgtattgtcctattagctccattgttgcgtgtattaatgtgagtttggagattgatgatcatggagttcgacgtttggttcttagcactgatcagtctttcgttgttaagtttcagaaggcttatgattcaaactccaactgtaatcttaagtctaactcgagaatgttcctttttctctaagtgttaaattttggtaaattgttatgcttgagagttgagacaatgccaagtttgtgatgtaaccaacggtttctatgaaataaaacgtagttattgtgtgttttataatctaatgaattatcttaacacttaagtaacaactaacaatgtactatactactatgaataacctagaaaataattctttgtgggttaattaatattttataaaatgttggggtaatttagagaaaacatggaaatatatactatttattgataactccaaaactatgctatatttcactttggtgcccctcgtttgtgagagtatgtttggtccgtcgatgcacatggaagcagcagagatagtccattcggcggcgcgttttgaagctgagaaaatgggcaaggaggatgaggcggtggaggagatacgacgtatgagtggttacggcggagatgtgatagtagtaggtgggtttccggcgtcggagtcggaatctgaatctgaatccgatttggcggcggcggagattatggttatatgggctattcaagggccaacttcttttgctccaaacacactcgttgctcaatcttctcttgagctgcgtctcgacgcttgtggccactcactctctattctccagtcgccatgttcattggtaactccttagcttctctgtttcagtgtcaaatttctcgcttttagggtttattgcaatcaagtttgcgtctttcggatccttaacgagtttgtgtatatgtgtcttgcggctatcatcaaacctacattgggatgttgttagaacatgtttactgatacattcagcttttgttaagtggatttagcttaacattgaagaaagtgataaactttgattcttcttgggttgaacatgaagcgtgttagaactatctgatggttgtttgtttttgtactgtgaagaacacgcctggagtaaccgggtcagtgatgtgggacagtggagtggtgctagggaagttcttagaacattctgttgactctaaggttctttctcttgaaggcaagaaaatcgtcgagttgggttctggctgtggcttagttgggtgagcaaaaaccgctgatatttctcttctgagaattactattaacgtgtaaaacatttagttagtttcttctttcagttgtatagcagcacttttgggaggcaatgctgtcctcactgatcttccagatagactgaggctactcaaaaagaacatccaaaccaatttgcaccgtgggaacacgcgtggatctgctattgtgcaggaacttgtttggggagatgaccctgatccagatttgatcgaaccattccctgattacggtaatcatctcggtttcattttttctccttttgccttgtacataccattctcacaccttttatttgctatgtacttgtagtattaggctcagatgttatatacagcgaagaagctgttcaccatttggtaaaaacgcttttgcaactttgcagcgatcaaactacaatcttcctatcaggagaactacgaaatggttaatcattttctttttgtggttttcaatcatcttatataacaagaacacaatgtctaattttgcttgctcgttctttctgtcagatgctgttcttgagtacttcttagaaaccgcactgaaagattttgcgatcgggcgtgtggaacaaacacaatggcatccagattatcgcagccatcgagtagtgctttacgttcttgaaaagaagtcgaagagatgcctcgctgatgaatcttcgcttaatcaatcttgttagccattgaggtattgtttgtttacacttgacaactgaagtagatggccctaagcgggaagtatagttctggcctgatccttccttgcatatttgcatacatctagcttatagagtgttacagatatactaatttttattttaaccttgttttaaagtgatcttgaagaatatctaagaaacaaatgtactcttcttctttacgtttaacttttttttgctgttgtaaaaaatggattcagatcattgaagatatctggtctgcgttttaagtcagacacaattatagagcaaaattaaaattttatgtattgtttctcactaaaatgtttaaattaaaatataggaataattgtctttttatgatcgcgtgaagtgaggacgattgtttagtaattttatacaaggttgcgacattttaatattttgatccattaaaaaaatataccaaaaccgaaagataagagagttttgatagacgacttttttgtgtataaaagatgcagtaattgttgtccttaatgacattgctaatcagaaactgaaataggaaatg

SEQ ID NO: 30590 - DNA, 3003 bp, Unknown
  misc_feature (1)..( 3003): 2750-1469P.txt file - cDNA_ID_3033406; gDNA_ID_1972193; Annot_ID_180267
acgaaacagaaaagtaaagatggtcaagaacaacatgatgtaaaggtcggagaaagagaggtaagagaaggcttgcttgcagctgacgcatcagagagagtgaagaaagttttagaatcttcggaagagaaacagaagctagagaagatgaagattgcgtatggacaacaacatagccaaggagcttcgccggttcgaaacttgttttggtcagtcgttgtttgtctctatatctgctacattttgaagcagaggttctttggtgctaactcggctcaagagtattaaaaagtttgaccttggatcgaggaaaagtgaaaaactgtaaaatatgtaatgactaatgaatgaaactaccatcgatgtaaaattaactaataaaatcaaattggtcaagatttttttttttttttaatttggctttgtgaattaatattggcttaccaaattgtccaactgtatataattacacacgtgtatgtactatgtgcatgtattaattatgaaaattggttgaacatatatttgaattaatatcttaagataataaataaagtaatgaatcggtccatatgataattaaatttagggatagctatatggagcaaacgaaggcagagactgtatgtgaattggttcactttattcaaggtcccaaaataaatgtggtaagatgagaaatttatatcaaggctttaaggactctatttaattgcttcttcttttcagactgatgtcaatattttttaggaataaaataatgcacacatgaatggtaaattaaagaccaaagttgataataataagaaacaatataaataacttttgttcctaaatgattatctcatcaataacaaagaattggtgaatgatacacaaattcattacactatctttagttcataaatagttttatatttacttcgcattatagcattcataatctctaatgaaatccatgatacgtttctatatcatccaataatgaaaacataacaccaaatagaaaatttgcaaatcagtttaattatgagatttcatatttgttttaataatcaggttagtagtatcatacagtatgttgtatcatattttcagctaacacttaatgtcgtcgttgttgaggaaacaaaattagaaatcgcatgcaatcccttttgtcaacgaaagtttgtataataaattcacattgttgtcaagttttcaagtttcaaccatatttctttcttccacaggtttctaatttcaatgtatagtaaaaacagtttgactttttttgatatacacttcgaagtgaatagagttaagaccgcgtgagtaggaaacagccaacacatcgagacgacccaaaaatgcaaaaatacaacaactaaaaataaaaataaagctattttgattacagtatttaaacagatataaaaatagctaattatatcatattaaagttatgttatttaaacagtcttaaaaggaattgaataacgtgcgatgttcctaaatatgaatgtatgattaaatcaggtaaaacatagtactaataatcttatatagaaaaaattataaattagtggaacgttccatgcattcattgtattcagtaaataatctttactattggcaattttgtcgaacttatgacccgctcgctttaatagaagactacagtgcagataagttgtttgtccatgtgtaaacgttttaatagttttaaccgtgggtaagaaatgtttgttttatcacgagttaaaacaataattactactattaaaatacaataattattattaaatatccttaaactagtaatgttttgagaaaagtaaatatctataagaaaatccattttaattatagatctttgttcactaaacaaaacaagtggtgttttaagaaaagtaagaatctagtacaaagtaattaaaattgcctttacacagattttctcatttttcattttgaagaaatattatgtattatagtaataaatctttatttgtttttagtacatctaaattaggcaaaaattagagaaagtacaattaaattataacagagtaagaaaacttgggaaatgagaaagagaaataaataaaaaatccaaagaagaagaagaaaatgagatcagcaaaatccccaataaaagttaatttttgtcattatacgaaggtgagaaaatcgccggagaaagtggataaagtcctctcctttttttatccaaccaccgtcaatttaaccctctccggcaacataaaaatccaccggaacttaaaaaagagagttagttgtatagaaagagaaacaaaagaagaaggttggttcggtcctctctctctctctttccccgagtatggtgagagtactagttagcagtaatggagagagcaagagactttaaaaccctctttctctttctctctcttttctattttttcttctgtcaatttaaaaacccatcagttacgccaatttctaaagagagagttttcttttagcgaatctgtaatgaatgttgaagaagcaacaaaaggggtttgggagcactaatggcggctttagcttaggtgagaaagtctttacaaggaagagatcatatactatctcactttctctttctagggtggctctgtagagaactaagaagagacattattacggctaaaataaaaaacctatctcttttggatttgtaaaaattccttttttttttcttttgttttcgtaatcaatttcttgcctaaagcgaaaccttttcacctcccgaaatcatcgcctttgcatcttctctttcagattctcttccgtttcgttttttttctttcttttaatctctcttcctcttctctaaaatttgaacctttttttttttttggtgtgttgctctgttgggtttgtgttaatggtgacagtggtgtaaatggtccattagtagtttgtggttgggtgaaaagtaaagagattaaagactgttttactgtcttttcgaaacattaattaaaaaaaatg

SEQ ID NO: 30591 - DNA, 3003 bp, Unknown
  misc_feature (1)..( 3003): 2750-1469P.txt file - cDNA_ID_3033410; gDNA_ID_1972193; Annot_ID_180266
accgtgatctatactcttatgaaaagtgagtttcagtttaaagctttgtcgagttttatctcttcttttgctatgatattttaagctcaatctttctatttatgccgaattataggatcatggagacagcaccaacgcttcctgattttgccttggcattgaaacccgatgagtaccaacttccttctgttgatgcgtcatggtctgaagccagtctacggactaaaaacacatcaaatcacatatagggcaaccaaagatagagcagtgaatagaatgcatatcaacaccttatagagttacaatgccaatggccgccatagaaacacaaatggtatagctctataactaccctagtgattctccaaatgtcaaataatatatgggtgtgaaaaaagtaccgaattggattagttttcaggtaaaaatatgggaagatgtcgtctgttttctctgtatgttgttgtaattttgtatgtttagtgcaataaaattcgattctttctgttccacattcattactattacttagacaacaacatctacaccaaacaatagcaaactggtaagtttctgctttttgctttgtttgacctactaatactacaaggtttggtctacagaagttacaaaattacagaataggtagaagtttgaactttaacacgactaatcgccagtgagagctcgagggctatggtcaatagtggaaagagacatgcccgactgagccacggctctgacaaacgccatgtttgcagtcaaggtaggagctccccatctatcacctgtcccaaacacagtcttgttcttcatcgctaacttcctcgttgttgggagactcatcacacgctctgagggattgtcatttaccaccctgtcaaaaatcacatcgaccatcaacaacaattgtaatgagtcaaagtattgaactttgagattctctgttgatacagagcataatgtgacttacattaggctcttcaataactgttcagctctgagtttctcattgggtccagcatacatggatactaactccttgaactctgagaaaacactcttgcatacaataccacgcttccctgataatacagttcccactttgacaaggcctggcttctcaatttcagatctcgcctgcatataaattgtcaatttcacaaaaaaaattgatagactagtgataggaggcaatggtgaacttttttctgtacctgagcaatcacaaaaacggtattgcccttaaacttttcttctaattcgatctcaggcatatccacgagtctctctgcacacccattactgattccggaaacgagagcaacaagagccgttgtgtcgaaattaatgagacagtcttcaccaagcaatctcatggaggagattacagtagaaaaagcatctttttgacttagctctgtgacctctgcttgaactaaaacctcagtttcaggagaagcaagtgaatcacattgatctatcagcttgatctcaatagaaactgcttctttatatgatctggttcgaacaacgttaacccattcgcaatcaaaatcatcgagcattgagatatccgaatccgaatcagaatcgaagccaaaatcgaaatacacagctccgaattcatctttcagtttctcgtaaactgaagaagggagaccatttgcgaagaacagaatcaccgaagaaggtttaagcgtggttgtggaattagcagcggcgagaatctgttcgattctagatcttaaacctttgcttccatggcgatcaccgttccaggagatgtacctagggtttctatcagagacgatgatccatacaggaacttttccgagagtacaaacgagatcaacatgaacgccaccaatcggaagaggaatcggtttgcaaacgcgcgaaacgccggtgatagacggaagctgtaaaatccgtaccactgattcaatgtggccaatgttgacactgattgcggaaaaaaaatcaaagtcagaatcagagctaatgagagggagagaagaaagagatgattaaaaatagagaacctgagaggtttcggagaaggatcagaagagagagacgagagaaaggagagctcggaggaagcgagcttaaggagtgtgcgacggcacgaagcagtgattgcagttgataaaggaagattctcgattgttcttataaccgattcgcatctctgtttcgctatctctatctctcctatctccatgaccaacaccgtcgtctgcttaccggaaactagaaacgcgtcgtttaagttcagagagctcctccgagacacaacaacgaaagagtctaaccggctcaaaaccggtttgagtagctagcatatcgatattcggtccgatatccggtatgtttctctggccgcttgttatattccggtacataatgaaaatctcaacaaaattagttcagtgtaaccatatgattaatcaagtgatgacttaatttcctagactataaattgatcaacttgaatcttttttccaattggtactaattaatggataattagtactgtataatgatataattattatcttgctataaagtaatttagtatcattgtccacagggaccacaatcttaagtaaagtatccatcaaagagggggaaaaggagcattctttttgcacccataccttttatgttattaacacatgaaccccaagaaaagcaaaaggtacacaaaatctgattttgcttcaaacaaaatgaaaatcacgcaatattctttttttgttaacttgcttgcacactttcttttccccacttttatttctaacgaataatcttctcccccatccttctccttctactcctgtgagtcctgtccccttcacagcatattattgtgtatctttatatataaaatgtggattaaaccatgtttcaacaaactacttcatatctcaatcattcaatattcttgaagagactttgaatcttcagttgtttctgtaaaaagaaaaaaaaaacatg

SEQ ID NO: 30592 - DNA, 3000 bp, Unknown
  misc_feature (1)..( 3000): 2750-1469P.txt file - cDNA_ID_3033414; gDNA_ID_1972193; Annot_ID_180265
cctggcctgtccttgctgcaacataaacagagcacagattttggttttatgagtttgaaatttcagtgtatatgttgatgcaaaaaaacgaacaagacgaaccttcctgcgatttcttgatatgtgctggtaatgatgaagtcagtaacattcattgcgattaaatcagctgtgaactgacatgagaaatggtatttcggatctaattccttccactttgcatctgaatcttcatactttgtcttctccaacgcatgagcgatcgttccctgagtgacaccaagtttggtggccattagagatgcaaccaagtttccatctgtgtagtttccaatgatgaggtctggcttgcaatcaaggcgttgaagaatcttgctcgttgcgtcctgtaaacaagaatggtttaacaaggaggatttattttgattttttcattgagaaagtatgaaaacattctaaaggaaagatgattagcttacctgagtaaatctctcgaggtaagggtagatatcgaatcgggaaacccattgacgaaggactcctttatttgtaacaaaaggaaccctgagaatatgagaatgcttggttccttcaatggcttctagttcttgatcacactttgttcctcttgcttccggtattaaccgtgtcaccacaagaatctgaggcttgaatccgagaccttgttggttaattcgaataagaagctcttcctccaaagctcttacttgatccagaatgtaaacaacctgtatgatcattataaaccaaaaagtttcttcttgtaagttagatatcaaattttgcaggtaatataaaactgaagagttgtataagtaaatgacctggcctccggtatcgggtaatccgagtacgtcttgctgaccaaaatagccgtggacagagaatatcacaacgttgaacactgtgggaagtctgctaaagagcaaatctaacttcccattgtctggtgcttcaagaacttctgaaaggataatcattgtttctttcactctctctgctgtatctccccaacctttctcgaatcccatctccttcaacctaagaaagtaacttttcaatcagatccttgttccggttcctcaaggaacttgatcagttgtttttctttacctttgtgcaaaagtttcataaggtgtgtgttttgagtaagtcgagacaacaatcacagcaagcatgagagatttctggagctttgcaaccgtgttgagatcgtcattgatcatgagattctgcaagagacaaagcatttttaatgagttataagactttcaagaaggtggatgaaaatggaaacaagaaatgattcaatcatgacctctccgtgatggttaaggcgaagcagatagttcaacaaaggttctagtttatcggatttgcctccaagcttagaagatataaacttagagatgtaatcagctccttttccaatcgaagaagaaagactaagacgaggagatgtgaaatcaatcgctccaaagtctatctccagtgcattttcatctttagacctacataacatttcaaaaaaaggttacaccagatgatgaatatagctcaggttattgccaaaacgccgtatgtaagattgtttactaaccatgactcatcgaaaacagattccttgagctttaagtaatcagtggctgtgatttcatcaactgttaaatctccagagttgaccttaacatattcccagaaaccaggatttggccttgcggctagtgcaacaaacggtggaaccactgctgcttcctgataagtagttaaaacagagaaaaataaaccgtgatttcgcatgaacacgcaactaaaccgtttttaattgcaaatggtaatgaagatatattatattacctgagtacaagtgagaatgtaaccaaacagcccctcaaggatcttactgcgttcacggctatcttctatacatttctctatctcattcatcaaatgctcacgcttcatcagcttctttcctcctccaacaaagctacaacatttttttacgcacaaacatttaactaactaaggaatccaaatagcatcaaaatgtagccaaaaaaaaaaaaaaaactaatcctaagagttaaaagaacctggcaaaacatctcttcatgtggtaccggctttgtttcaatgcatcaggcattttctcagcgatggaatccgacttttgaagcatagcttgagatgaagatgacatgttttttttttctttttacagaaacaactgaagattcaaagtctcttcaagaatattgaatgattgagatatgaagtagtttgttgaaacatggtttaatccacattttatatataaagatacacaataatatgctgtgaaggggacaggactcacaggagtagaaggagaaggatgggggagaagattattcgttagaaataaaagtggggaaaagaaagtgtgcaagcaagttaacaaaaaaagaatattgcgtgattttcattttgtttgaagcaaaatcagattttgtgtaccttttgcttttcttggggttcatgtgttaataacataaaaggtatgggtgcaaaaagaatgctccttttccccctctttgatggatactttacttaagattgtggtccctgtggacaatgatactaaattactttatagcaagataataattatatcattatacagtactaattatccattaattagtaccaattggaaaaaagattcaagttgatcaatttatagtctaggaaattaagtcatcacttgattaatcatatggttacactgaactaattttgttgagattttcattatgtaccggaatataacaagcggccagagaaacataccggatatcggaccgaatatcgatatgctagctactcaaaccggttttgagccggttagactctttcgttgttgtgtctcggaggagctctctgaacttaaacgacgcgtttctagtttccggtaagcagacgacggtgttggtcatg

SEQ ID NO: 30593 - DNA, 3003 bp, Unknown
  misc_feature (1)..( 3003): 2750-1469P.txt file - cDNA_ID_3033417; gDNA_ID_1972193; Annot_ID_180264
acaagtggccgttagcgtagttatgacttttgagactctcgttgtgaatcattgcattttctatggttttggttttaatgcatttctcattattttttcacaatttttttcagaaaccaaattaaaaggagggatacaattgggggattggtttttaagtagattgtatgcacattcactcttcaatctccgagcgaattaaggagaatcataataataaaatcagaacatagaaaaagaatccaaaccaataaattagaaaacttaaaacttaacttagagaattcaaaatgtaaagaaatatcacaatttctttgttcttgttcccaaattaaagtaccgttcctacaatttttatttttatttttttatcacatgatatcttaatatatagttggatatacataggatcgatattggacaaccaaataaaaacaatgaccatgattaagtttgaaatttacttacgactgcaattaacatggcagatataatggatttcttcctaactattaaaaggagagaataaaagcaaaccaaaactaacgaaagagacttcacaaaaaaaaaaaaaactaacgaaagagttgcatcatactaattcatgctagatacagttttattttgattagtaccttttctaagcaaaattagaaaaccctaaaccaaaaatttgcattcaacgtgtcgatttacttgtaacgatcggattactttactgggtcttttagttggttacatgaaaataaaacataatttaagtcagtttctataaaaggaaaccaagtcgtagacgaaacgaagacacaaaagtagctttaagccttttaagttttaacctgtgggtaacatcgaaccaatagtaagcaacggaatgatagtagacacgtgtcgtcacaaaccgcccttataaattttgctacagaccgttggggcggtgagacagtcgtgatctactaaccgaaatcgattcatgaatgtagacacgtgtcttcccttaactggattctacaaatatcttctttcgtcattacgttgcccagaagaacatagcaacgtcactttgattgacatttccgccacgtggactgcatgtgtcatcactaatattaccaaaaaaagaaattaaaatgttttttttttgttgataaatgatttttgagcaaatagtggacgtgggatgcttatgcataggccggtgacttttgtttggtgactcataattttgtgtgattgactgattgtaaccaaaaagatctaaagattcaatgatattttagaaagggacggtcgttttgatgtcatataacacatatttattcggtctaaggcgaatgtacttagtataaatactacaacttgatatttttgtaacatgtagaaacaatacattacacacatacacatgttttaaaaaacaaaccttaacgtacgaggcactttactatacaacaattgttacatattttaaattgaaaataaagcttctgtatgattcagagagaggatggtgccattgccaatgagcttccgattttttataatttagaattgtggaaaccaaccatatccatgcgtatgcatgttgtgtgataagtattgataatggtgtgtccaccatcgacatcctccatacacatttattttatagttatatataatcttcttatgtaccttgaatatataggtagtttgtcttttttggttcgtacatactcttaaattgaaaatcatggcttgctttttgtaattaagtttttttctaatacaaaattttcatggattttaattttatttttaatgataatattttatattttaaaaaactatgtcactagtgtgaatataatttgaggaaaaaacatttagccgtgatattattttaaataaatactacctataataaaaagttttggttttaggtaactataaaagtcgaaagagcattaattttggtttttataataaaaagttgaaatttgtgcccttttcaagtctttcttcatcatcttcattctcattctcatttccatcctctgcttgctctcttctcacagccccatcctctttaattaccatctccaatcccctgaaccaggatttataccattgcgattccgcaatccaacactactatctctctagtttcctttcttcattaggaaagagcaaaagcattcttttatggtaaagtttcgatttttcaaattcatacactgtcggattcatacccttttcgctccgggtctggaatttgggtttttgaggtttctacggagtcaattcgagtctgcggaaactcaatttgatagactcgtttcaaaatgttgcttaagggttttcttttgttcatggattgaagttttgcttaaaccagttacgaggtttcttggttcttccatgtatccgtgcgttatctttgatgacccttcactcaaagtcttcgttttttcatgtcaagttgcttcctagacttagaaaattctcgtttttaatggatttttgttcatagaacaaacatttaacgtttcatgctttttctgtgagtcacatgtttttttttcttgagctgattaagtctctttttttgtttgcagccatcaattgaattatatgtcttttagccaataattctgataaacgtcaagaggtaggtgagaaaatcaaaactcttgccttgttatcggttttcgataaccacatctatcaaacgatgtcatttgcttgtttgtttctgcttggacattagtttccaaattattagagagttttagtcacgtagaattatgaagtttgtagtatggcagatggctcgtgagcttgtttaactttatcttatgaatttagtggacgagaaagaagttgggttgtttttggttggacatttattaattttcgtctctttgtgccatgttccatgaagtatcatttcatcatctctagcttaatctctgtttctgctttcatctgttgggattgtagtttcgttaagctttagaaatg

SEQ ID NO: 30594 - DNA, 3000 bp, Unknown
  misc_feature (1)..( 3000): 2750-1469P.txt file - cDNA_ID_3033430; gDNA_ID_1972193; Annot_ID_180260
gccaagattacagaaacgtagatgagtattggtggcttgaagtagcgggtgtaggttagaacttagaaacaacaaaccttaaattaatactatacgaagagacgttgagaggctaacgaaatcctgcccacaccaagcaatctctagtctatgctcttattttctacgatattatatattctataattattataactaaataaaatcctagttgtaaaataaaggaaagaaaaaggtagattacgtagaagggggtgttttgttggttagggaagacgttggcatcagtcgccggtagagaggtccgtccaaaccctcccgactctctaacggattttgttttattttattttaattttcatcatataaaatgtatatatatatatatatatatatattttcttttggtaaagacataaaatgtatattagacgaaaaaaaagaagaagacataaaatgtatattatatatatactcgcaataatatagactatgtatatatatacgtgcaggtgctcttcagctttcttcttgttcccacatacccatcttccccaaccttttcccaagaaaaaaaaaacttagggttttaatttcttatatatgtacataaaatacatgaacacaacaaattttttgcgtgcgttattgatatagaatctgtgtgtttttctttttctttgttcttgtattggtttggatcggtatacttagttaattacgtaattaaatagatcggcgtgaagaagaaaaatgatcatgtgcagccgaggccattggagaccagctgaagacgagaagctcaaggatcttgtcgaacaatacggtcctcacaattggaacgccattgctctcaagcttcctggtcgctctggtaattgatatcttctagggtttgtccatatatacaaaactagctagggttaattttgatactttgatatatatatacatatgaattaattgtattggtgtatatatgcaggtaagagttgtagattgagatggtttaatcaattggatccaaggatcaaccgaaaccctttcacggaagaagaagaagaaagacttttagcggctcatcggatccatgggaacagatggtccatcatcgcaaggcttttccctggaagaactgataacgccgtcaagaaccattggcacgtcatcatggctcgtcgcacacgccaaacctctaagcctcgtcttcttccctcgacgacttcgtcttcttctttaatggcgagtgaacaaatcatgatgagttctggtggttataatcataattatagttccgatgatcggaagaaaatatttccagcagactttataaatttcccttacaaattctctcatatcaatcatcttcacttcctaaaggagtttttcaccggaaagatcgctttaaatcacaaaggtaaactcaaaatgatggagaaggatccattttctatagatgtgtttgcatgtatatgagtcttgcacggattattgatgaaaaaggtatatatgttccaaaattttgaaatgaagtttagccgaatttttttacttttcaaagagtttagccgactttttcatttgcataatcatttttctaatgaacttcaaaattatgtgacaaaattagttgcatgttttttcttgtactcatcatcatatattgtttccgtcattacatgaagtcatctctatatatttaacatagttgcaatccacatagcttataatttcgtccttcttttatcgtttggatcgcagcaaatcagagtaaaaagcctatggagttctacaattttctacaagtaaacacagattcaaacaagagcgagattatagatcaagattcaggtcaaagcaaacgcagtgactcggacaccaaacatgaaagtcatgttccattcttcgactttttatccgttggaaactctgcctcctaggattagtttttttgcagtaactcctaaatttctagattaactatttagtccgtatacgtacgagattatctaggtcgttagcatgtatgcttgatgtgtataatcactaactagtgagctattacctgcgaaaattgtaagaaaaatacataatgttgatgtatcacacattctcaatgtctgtaaaatttccatcgagttgttaactatcaaagttatccgtttgaatgtatttgtttaatttgtcttgaatgagatgaataacatgtttaaatgtttaattctgttaccaacaatttaattatatatatataacgattaattgctagtttgtttcttattaaatttgtatcatatttattcaacgttcaaacaaatcaccgttcaattgtttatgcataacccgatcatgaactcgacctcgagaggccacaatattatcaaaatttgaaagtatatatgtacagttgaaatcttatatcgttgagattataacatgaaaaaaatccaatgtttgatgaagaagcaaaaggtgttggaaaactctttttacttcttactttccttaatcgttttcttacaacaacacaaccattatgtagttcttgtacttaatctaattagaaatttgttaataaccaagacccacccttaattgggccttgttcacctctgggcccaatggcctttttctctcttttccttcactcttcttcttcttcttcttcttcttcttcttcttcttcttcttcttcttcctcgtgcataccttgctgtagttccctcttttccttcacttgctccctcatagttcgaacccgtgcataccttttaatttctgttgaatttctcattgtctttggtatggtcctaatctcaatacgtctctgtttctcatccatctctccagggatctgaaatttcttcctctgcatgtgctctcgtggtttcttccttgataattccttgctcattccctgcatgtgactcccgatcatcgtcttcctcttccaagttacgaatcaaaatcatagccgagattcagatttcatagacaatg

SEQ ID NO: 30595 - DNA, 3000 bp, Unknown
  misc_feature (1)..( 3000): 2750-1469P.txt file - cDNA_ID_3033436; gDNA_ID_1972193; Annot_ID_180258
gtccgtacttcctctggttatatcttatataatgactttgattcttttgactccttttagctactttacaagagttcgctttagaagaatacatattattttgtatccaagaactcatacatcttggtctctctacattcgatctatctacggtcaaaaagtgtagatcatatgcttatataagactagctatcaagttcttttttggttacctgcttgcttcatggatgaatggtataaatacggacaaacaaaaacatgtaccacgcatttgaattcttaaaatcaattcttgtttcacctctgtcaagacataaaaatcaattggaattcttaaaatcaattcttgtttcgtctaataacgtagaattttaaaggaagcaattggaatccgaatctttagattttagcaatatgattaaaaaaaattcagtagaacacaatttatgcattatatacatacacacttatcatataatggaaagaggacagcgacataagaatattgaaaagaaaacacatcccaactctggagaaacaaatccctaattagctaacaatggcgaggggagaatcggagggagagagctcaggaagtgaacgagagagttcgagctcgagttccggcaacgaatcggagccaacaaaggggacgatctcgaaatatgagaagcagaggttgtcaaggatcgctgagaacaaagcgagattggatgcactcggcatctctaaagccgccaaggctcttctgtcaccatctccagtttcgaaaaaacgtagagttaagcggaattccggtgaagaagacgatgattatacacccgtaatcgccgacggtgatggtgatgaggacgatgacgaagtagaagaaatagacgaagacgaggagtttctgtgtaaaagaaagaacaagtcctctgcatccaagagaaaagtctcatctaggaagattttgaatacatcagtttcccttggtgaggatgatgatgacttagacaaggcaatagcgctttctctacagggctctgttgcaggaagcgataaagaggctgcaactatgaagaagaaaagaccggaattgatgagcaagacgcagatgacacaggatgaattggtcatgtacttctgtcagtttgatgaaggtggaaaagggttcattactctgagagatgtggcgaaaatggcaactgtgcatgacttcacatggacagaagaggaattacaagacatgattcgttgctttgacatggacaaggacggaaagctaagcttggatgagttcaggaagattgtgtcgcgatgtcgcatgttgaaaggttcttgatttaatctgtaagttaggctgtgattttgggtgactacttgttttttttttgtttttttgtcgtcacctttgcattacttaaaaacattcaacttacatcagtccaggatattacataagtcatcttcttagaccttgctatttttgctagcttatcagctacattgttaagagtacgaggaattttacagaactgagaagaaatataagtcttagcaaggttcttgatatcctgaatatatgatgctagatcattgtttgtggtggttccttttggcagactctcattggactccaatgcggcgatattgtgatataagtttgatgcatcaccacagaacagtacatttgtatagcctaggcgtccaacttgaaagagtgctgatctgagtgcctctgcttcagcttcttctggtgtgctggttggtggtatggatgccattcctttaagaataatgttttcctgtttatcatagagtacccaacctattcctgcacagtcagtcattgaaagccatgaagcatctacacagcagcaatactcctattttttttggatttgttatcttcttccatgccacccatggaattttatgtctatccttagtgctagaccaccaaaatcttctcatagcactagtaatttgattaagtaaccgggatggcaacaagaaacaagacatgctgtaggagggaaaggcagttaccaccgctttaaggaggacctctctacctgcaggtgaaaggaatgcattgtaccaattatccattttttgatttattcgctgagcaagataagaaaacgcattagttctgtttcgcccaataaactcaggaagtcccaagtatcttccaaaaccacccactttgtggattccgagaatgtgtccaagttttttttgctcctcttcactaactcctttaccataagtgatagcggacttttgaaagttgatggactgacctgaagcttgttcatactgttggagaatagtgagtagagatgaacattcctcttcagatgttctacataacagcaaagaatcatctgcaaataatagatgagaaatgggaggtccatttctgcttgctttaaaaccatgaagctttcctgtttttatagaggtttgtataagagctgagggtgactacttgtttaatgatgactcttgttttctctaaaaaaaaaaaaaatatatattgaaaagaaagaaccctaatttttaaatttaggaatttttattttaattgaccagtgaatatgttcgaaatcattaccatccattgaaacctcaacgtgcgtgtcttcttcttcgtttgacctgtaattttaaagcgcattttcttcttcgcatagcagaagttttatttctccttggatccacttccacgtctttttttctccggatcttcagctctgaggatttttaaagcttttaagcgcttattggagttcgtatgagcaaacgtgagtcttgtctgcctgaaaaatcttctcttggcttggttctgaaatgtgactgaaagtattggttttaggcagattttgattcttcaattttttttcgttaagagggtttcgtgtatcagacaacatctgaacagagaaaagtatttatcttttctgttggttactacagaattggtgggattttattgcaaaaggtcaataaatg

SEQ ID NO: 30596 - DNA, 3000 bp, Unknown
  misc_feature (1)..( 3000): 2750-1469P.txt file - cDNA_ID_3033440; gDNA_ID_1972193; Annot_ID_180257
atgtcaacaagcatgatcctgctgacaaataccatcttctacggttgtatgattacttttactaccgggtaagtgattacatcccttttgcaaaatttggttttgctactgtatatcaaaagtgaccaattgtgtctttctcttcaacaattttagcacaagtgtgaaccatatgccttttatttaatacctttgcaatatttctctttgtggattgtttggtgtaacggattccctgaatgttctttgcaggagcacttgctaattgtatgtgaacttcttaaggccaatctatacgagttccacaaatttaacagagaatcaggtggtgaagtttatttcacgatgccaaggttgcaggtttgtccactttatcattaccatacatcatagatatgtatatgtatccgattcctgatctctttgggaccgttctgtacagtcaatcactatccagtgtctcgaatcacttcagtttctacatggccttggacttatacactgtgatttgaagcctgagaatatattggtgaaaagctatagcagatgtgaaataaaagtcattgaccttggaagtagctgtttcgagacagaccacctatgctcctatgtccagtcaaggtcatatcgagcaccagaagtcattttgggacttccttatgataaaaagatagatgtgtggtctcttgggtgcattttagctgaactatgtacaggcaacgtaagtcctgcatttccattgacttggtgcatttctgatttttgcttcatcatgtattattttttctcatgcaaaatacgtttcgaagagatagaaaatttccatatccgcataaatttgttttcttacatgggaacttgattctcgggctattaagtaaacagaaatttaccagaaacttgtgtcatttatactaacacttgatggagttaaaggtaactgcatcattgatgttctggagtgtcagctggttattcatattgtctgggttggttgttgatttttgaggacaagaaggtgaatccgtgtttaaatatcgagttacttttgcaggttctcttccagaatgattcgccggccagtttgctagcaagggttatgggaatcgtaggatctttcgataatgaaatgcttaccaagggacgtgattcccacaaatacttcacaaaaaaccgaatgctctatgagcggaaccaggttagtgtttccagagaccttaaaggaacattccctgaactccaaaaactctgcaactcttaagttgaatggaagaaacatatgctaataaagaacattctctctggaaaaattgtttgttcaggaaagcaacagattggagtacctgataccaaaaagaacatcgttgagacatcggctgccaatgggagaccaaggattcacagactttgtggctcatcttcttgagataaacccaaagaagcgtccttctgcagcagaggctctgaagcacccttggctttcatacccatacgagccaatctctgcttaaacaactggtgtctttacttaagctactaaaagccgcaaaacctcagattaatggaaacctcatatgtgcaaaggttcaagcccctttggtgggtgacccttaatacaagttgtggctgtctccttcagtcaaaatgtgagctgaaaagaagaaaacttttgtgaaatttgattagagtgtaacactgtgttgtcaaacttgtgattattatcctcctagaacagactaagtagtagaactcttttttgtatcatctgctgatccttagtagtttagtcatttgattatgatttataaatgtcatttatgtaatttatatatatacagggtactgatcattttaggtgtcatatatagaagtaaatttcagagagtgctgtgcgggagaatctcctttggtggtcattgtaaggtggtgaatggtattatcaatgggacataaaaaaaaattggttctcgggttcttagtgttgtaggttcgagagagtccattgttctcttttgtggtttatctttgtctctgttctgtttctaacatctcccaattcagtaccaataattagtggaacaaaaaaaaaatacttttatagtccacactctaaaacatgactaaagagattcggaagcgactttaggtcacaaacttttggaaggattacaatatttttgaattgattgatagttttaaatgtataacaaatgaaaatttgcggaataaaaatttataaggaaaaaattgcattatgaaataacgaattaccttttttatattgaaaataactatctttggattgtaaacaaaatttcgtgtaaaattttctaaagaaagcaattggaatcataataatctatgaaatttagcaatatggtatcattttaaaaaattcagtacaagacaattttgtaatattggaagaaagaaccctaattttaaatttaggaatttttttaagtttaccagtgaatgtccgaaatgattacatccattgaaacctcaacgtgcgtgtcttctccttgcttcttcttcctcgtttgatctgtaaacgcatttcctccttcgccgtgcctgaagaagtttcatctctcgttggatccactcttgttcctccttgtcttcttaaatttttatttttatttttctggttctccggatctccagactcttcgatggcgcgtttggagcatgatttctaaggatttttagggtttttatgctcttattgaagttcgcatctgctgcatcgttccgtatgagcaaacgtgagtctggtttgccggaaaaaacttgtttctgaaatgtgactgaaagtattggttttgggcagattttgattcttctaatgtcttttggtagaaagattcttcaaattgttttcgttagagggttctgggtatcagacaacatctgaacagagaaaagttttcatctttgttgggtacaggattggtggagttttattgccagtgcttctcctgtatattgtaaatg

SEQ ID NO: 30597 - DNA, 3000 bp, Unknown
  misc_feature (1)..( 3000): 2750-1469P.txt file - cDNA_ID_3033444; gDNA_ID_1972193; Annot_ID_180255
ggggtttttccaggcatgtgggaaaattctgaagtctcagaggcagagggaagcttagaactcgggctcagtaaatggaaagttgaactacttgccgcactacaagtgggtgctacagaggtccaatctatgattctgaaggtagtcttgttttaaggtgtttcactttttaaaataatatctttgttctcaagcttgtgtttttgtttcttcaattttcttgcagggtggtggcatgatcacattcgccaaagtttatcagttggtatgaaatcgataacagtttgtgtgtttaaacttcttcttctctgaggcgatacaaataactggtatattctggccctatatagttggctaagaaactatctggaaaagtattccttgaagctgccaactaccagattaggaaagagatgctaaaaaaggtttgcatctgtatttatttcatcatgctgcataagaatttttcatcatcactcagggatttgcgatgcactatatcatgaagttcctgagaagcattacatgtcaatgatgtaactgattgatatgttgatacgttaacctctttttacagggtgggcagtttgctgccattaacttggaatctcgagcagctctgttagcagcgaagcatgtatttactttttccatctctcgttttttttcttttcttttctatctctctattgcctttgagctatcttcattacacaaactacatttcgcctaacaatgtgattacagtgaccttaaattgatcacagggatttgcaggggctgcatccagatacattggcttaaaaacagcgatgcaattacttggccccatgtaatagccactcccctaatccgatctaacacagcatttacattacatatgcacatgaatctgcatctaattcttcttaaattgtttatgtccggacaataattgtggaatcttcaggatgtgggggacattactggctgacttagtgattcagatgctcgagactgactacgctagaatcctaagagcaatttacgcatttgcacaggtacttctctttttgcaccaaagtctgcatttgttttgtagtaagatctcattgactagatttaatgagtttaaaaggattgttttgttttgcagattcggatcaccaggacatacaggctaccttgtaaatgaagtaacagtttgttttctcaatctcagtgtccctacgaactatgtcggtaaacaatgtttttcacactcgtataattcgcttgtggttgaaatcaaattagacgttactcgagtagatagagagtggtccagagaattgagcgttttgcgaaacaatattttggagccatggaaacatgttttacagattttaaaaaaatctgattccttagtggtaacgagcggataagcgacgtgtggggttcactgtgacacgtgtggggttcgcgaaacaaggtaaagatattagtcctctgagtgcttaccacgtgtgtggtccgcgaatcctcgaaagcaacggctcttgtttctttcacgacgataagccgccgcgtttcttcacgtgcctttttgtcggaatttcagactattctagacaacaactcaacaagtcattataaaactaattatgctatagtcgcgaaaataatgcgttactaggtgaattattactagattagtagtacacttttatttcttattgtgaagacttatttagattttatcgagttgtcctatatagccgacttggtataaatgatcctcgattatgtcttaaaatctctattagtgtggagtgaacatacatggtgtatcagtatatggggttaccaaaatccggagtgatcaagtcatttttgtttttgtggttattatttcaaaacatgtggttaatttatttgtggccctcgttgagaacaagactttttattgttttagaaagatgaataaaattcaaattgaaatttgatatcacgaaacctctattatataatcgtccaaaaaatgatgacgtgacgtaggagacaaggttaaaaataactaacatatggttagataatatccaatactttttttggataaaaatattatccaatacttgtggcatttttttttaattcttttcttattttaatagctaaaatttataccaccaatatataaataagtagactttcttaatcttacacatgtaatacaaatttgttaataactttgattatgtgattttcttattaattttgttgggtaaattttctagggtatttattctataaactataaaatgtacattaaacaaaatgtataaaattaaggaatacataaaggtggtgattagaaaattcataattgttggagctttttatagataggatcatatgataggacggtcttttagggtaaaaaatacttcaaaaattagtgtagaaacaatagtgaccttacacgtgtaaactctggaacaatctactcgtctcttctcttacatacctcaacccaaagctacgaagacaactcttccaagttccaaacaaatatcacaaaaagtaataaactaatcaaacacaaattctacaaatacagtgaatttgttgtttatttaatttgttcaacgattatcctctcaaatcctttcactatcatcttttccttattcttcttcttcttcttcctcttcatcggccattataaagctctgttttttattaccctgttttataaacagaggaagccctaaatttggattctctattctaaagttttctcatttcgctaattttggagaaaaacgattgttttttttaatcgtttcttcatttctgattcatttttcttggtttatgatctgttcaagtaaaggaacaatcttaatcgctagaggtaaaaattcaaatacaatccctagattacccctaaaagggtcatccacaaattacgcgaatcgaattcaaattcgaaacccaatcagtgtcaaaactttccggcgatcatcttcatcgtcaatg

SEQ ID NO: 30598 - DNA, 3003 bp, Unknown
  misc_feature (1)..( 3003): 2750-1469P.txt file - cDNA_ID_3033458; gDNA_ID_1972193; Annot_ID_180251
aaacgttaaaccgaatagcaaatccaacaaattcaattttgatatggagtaggtaaatgcataccactagtcgcagcttcaggcaacgcagcaggcgaagaagcttcattaagaaaacaaacatcaatatcagaacgcgtatataatctatgcaattaatacaatagtcacacattttgattaaagctaataagagataaaaagaactcacgattagtcttgttgcagactgacggatcatgattaataccacatgagtcgaggattttaatagcgttctctttggtgagagcaaggaacctgagcaagtctggatgtttgaaggcggtgcatagacacgacacatccttctcggcgatctgtttcatcggattacaacacaatggcggcggaggaatcgacaagtgaatgtacggttgacatggcattagttttgctacgcatctcattgcctgttgaacgtctccgaaaaattgtgctgtgacttgcacggagtagagaatgacgacggtggtgactacaccgagaattcttgtgatattcattttctttttgttatgcagtgtttgttttgctgagtgtattttatctcatataaagagaaaatattggaaggttttttcttttaacttagctaggaaatattggtggatacaactattggacagggcaggtcaaacatagaggtaaagttttgtttcttagtatagtagttttttgtaggttactgaatttgttattatacaattgaatgtattgataagaccaagatatgaccaaggctacaaaatccaaaatgtctgaatttggatttccaaaaattgactaaatactaattaccagtatatacatgtgacaagtttaccatttccttataatcttgtgataccttactgttataagttagtctccactggataaagataaaatatcaggtatctaatgttgggacagtgaaaatgtatcagcattaattagtatatataaatatgttaattaaaatattactaattggtaactttgactgtgaacagcctggctctaaatatatgtgctggaggtggtatagccatggtccattcattttttacttttctttttgaatgaaatctattaaaattaggattgtaccatttttgttttctaaaaaacatgggacaaatgatacatttttttccagcgcaaggacctcaaatttattgtgtcgggcctaactttaaatcttatatttttcttatgtataagattaaatttacatggcaatgtccatcatttttagaaacatgaatcaatttacttattgttgaattcgttttgagttggataggaagtgaggtttgaaaataaatattgaactagtttttagtaccaaacctcattagttaattctttttcttcatttttttttgttgtgtatgtttttggttattgtcgatgcaattacatgtttcatgtttgtatagtttctagctttaacctgaatttggtttttacaacataaacgctggcaatcgaatgtctcatacatatcccagtggttaataatttcggtgtcagtcaggtagacactttggaactatcgtcattctgatatgaatggtggtgattttggggttggccaaaacttatgttctttaaaaataccttttcatatcaagactgaggataaacttcgaaattgtatataaaagattaaaacaaaaatacttaaacacattctgatgaccgaattacacagtcatcacacatataattataaattaaaaaatgacataatcagaagaagatcattgccacaaaagcagacagaaagctaaatcgattgaagctgatagttgaagcggaagaggttcctgctcattaaaaagccccatgtcaattaatttgataaaatattaatagagtttgtgtattttatggggggtttttcaacaaaatgtataacaacaacaaaattgaaaataaacacgaattagtgctaaccattggttgatcccggcgacgcaataggcgaaggagcttcatttacaatagagaaaaaacattaaaataacgtcgtgtatacttatcaaagatatttgattaagttatatatctatgggatcttataaatagaagaataatcatcactcactggctattttggagcagagtgaaacgtcaggattaactccacatgccttgggaagtaggagagcgttctctttggtgaggtttagggctttgagcacctccggattgttaaaagcgatgcataaacacggtgcgtctttctctacgatctctttcatcggcccgcaacacgatggcggaggaggcggattcagcgaatgtatgtacggctgacacggcagcagtttctgcagacaagccgtcaactgagggtttcctccttgtgccgtcgcttcgacggagtagaggaccacgacggctacgactacggccagaaatttgttaatctccatttttgtttgttatttgtcttttgttgtttacaatgttcatataaataggtggagatcaatcatgcatagaaataatcttgtttgttaattatgcaagatttattatgaatttcatggtttatatttacctgttttgtctgatttgttgtgatatatgtggcatgtatgtaagattcaaaactaaatttggatgattgcatgataaaatctttaatttacatttcatttctatggaaattttgtaaagaacaatattcataaaatctcagtaaatgctgatgaaaatttgaaaattaaggattactccaagagagcccatttcaaaccttagccagtgcaacacttgtaaaaaaaattaacaacataatgataagtttagtggctaatctacatgtttacgtggcggatgattattgtatgagtgataataatcaacgtggcaatataagggagtgtgataaaattacgtcattaccctcatccattgtttcgtcttcttccctgagaaacactgagaaactggagaaaagaaagaatg

SEQ ID NO: 30599 - DNA, 3000 bp, Unknown
  misc_feature (1)..( 3000): 2750-1469P.txt file - cDNA_ID_3033473; gDNA_ID_1972193; Annot_ID_180247
ccgccgccattgtgttgtaatccgatgaaacagatcgccgagaaggatgtgtcgtgtctatgcaccgccttcaaacatccagacttgctcaggttccttgctctcaccaaagagaacgctattaaaatcctcgactcatgtggtattaatcatgatccgtcagtctgcaacaagactaatcgtgagttctttttatctcttattagctttaatcaaaatgtgtgactattgtattaattgcatagattatatacgcgttctgatattgatgtttgttttcttaatgaagcttcttcgcctgctgcgttgcctgaagctgcgactagtggtatgcatttacctactccatatcaaaattgaatttgttggatttgctattcggtttaacgttttattaattgtttagtaattaaaataaaatgatgaaaattgtgaaattatataatttttgtgaactgtgattattttgatgtgactttcttattgaaacagggaattctttcagcaccaagaaaaacacagctctagccatcacttttttcggattttcttttgtatttcttgggatgatcatttgatttttttctttgtaattctcagagacatatatatatatatatttttttttgaattagctgacatctgaaaaaaaagattccagtattaccgtctgctaaatatgctaagcaccaatcaacttagaaagacctaagaaaatgagaagagcacacaacaatttctcaatgattgaaagatttatcaggttctaggatttttctactgtgacctcaatgatggttagactattataaatgattgaacgaaaacattaaggaaaaaattatatttttttctaacgattttagactgaacgaatatctttcatctatcaattccccccccccccccccccccacccccacccccattatgtttgtgatattgtagctcctaacgaatggtgagaattgagaaacacgaatctctctttttggcatgagcaaaaaaatagcaaaaatctgtctaaaaattagatttcctaatttcttttaaaagtcattgctaaaaaacactgtttggtaaaagcagaaataaatcttaaaattagattccttaattccttataaaagtcatttgctaaaaatactccgtaaataccgtgttggcatgaacacgtgttcatgttgtgtgtgtaatagaataatgggtccctagaatatcagaaacagacaagcaaacgagtcacccacttgcttgctactccacgcgcctttaaccgcgtctgccttccactctcttcttcttatcccgcgttctttggaacttggacttgggttcgttgacatcaaactttgaattttatttgctaaaaatgtgatctagaagataaagaattaagtattttgagattagtactaacctagtcctaacttcttatctgaatttgttaaaaatcggaggatttctcacgtgaacttatctgaaaacgataaagactgaagccagaaggttataattaaccgaaaaaaccgaagtagtcaattcaatacccgaaacaaaagaccggaatctcgatcacttaaccgaactaattgaccacaaaaataaactacttttaaaatagatgaacgaagaagcgcgtgagattttccatataaagacgctcgcaaacccaatcctctttcacaaatcacaaatcacatctcttcatcttcctcggtttatccaaatcctcattcagacttcatcaaatcgtttcttgcttccgatccgaaatttgcggcgggaaaagaagataacatcaacaaaaaaatgatttctctattcatctcaaacttttcaaacttatcaaacttatctccgacctttgataacatgaacatgaacatcccatcgaagaagatcgtaccggtaccgacaccgagtgagaaagttgtctctttggtatctcgaaccggacgagatctccaacgttacaacaccgcagggtatcgtcaagtcgtcgggtacgttcaattttaccaaaccctaattttaaaattctaggttatgaatttgggggaattttggaatctgattagaaattcgaaatttattgcagatgtgtaccatatagatacaagaaacacggaggaggagaaattgaagtgcttttgataagtgcacagaagaaagggaaaggaatgttattaccaaaaggaggttgggagattgatgaatcaatagaagaagctgctttaagagagacaattgaagaagctggtgttacgggtcagcttgaagaatcacttgggaaatggcaatacaaaagcaaaagacatactatgattcatgatggtcatatgtttcctttgcttgttagtcagcagtttgagatatggcctgaatctgaattcagacaacgcaaatgggtttctttgtctgaagcgattgagttgtgtcagaattcgtggatgagagaagctttggaagctttcattaaccggaaatgccagacccaataaggataatgtagcatctctgggaacaaagagctcttcatttggaagcagatgcatataattgaagagcaggtcctcaagtttagtgttctgatttgattcattcatttgttaatgatgttagtagactaattgataataactgattgttctgaatgattgtcttcacaacatgtaatgtgtacatatataaaatggatcaatctcatagatgtaataacgacttggtcttcacttttgatttcttatgattttcaatttgttggtgttattttttgaaaaaaatgcagattaggcggtgatgaataattattgacgagaccaaggaaaacaaagtaagattataacaaacaaacaaaaaaaaaacaatttgaatgtttcgttcattgactaaattttcaaccgtggaaagaagaaagtaccaattctaccctcaattaataagtttaaggggataggggtccggaagttggggaagaagaagaagacggaaacaatg

SEQ ID NO: 30600 - DNA, 3000 bp, Unknown
  misc_feature (1)..( 3000): 2750-1469P.txt file - cDNA_ID_3033475; gDNA_ID_1972193; Annot_ID_180246
cgggtcagcttgaagaatcacttgggaaatggcaatacaaaagcaaaagacatactatgattcatgatggtcatatgtttcctttgcttgttagtcagcagtttgagatatggcctgaatctgaattcagacaacgcaaatgggtttctttgtctgaagcgattgagttgtgtcagaattcgtggatgagagaagctttggaagctttcattaaccggaaatgccagacccaataaggataatgtagcatctctgggaacaaagagctcttcatttggaagcagatgcatataattgaagagcaggtcctcaagtttagtgttctgatttgattcattcatttgttaatgatgttagtagactaattgataataactgattgttctgaatgattgtcttcacaacatgtaatgtgtacatatataaaatggatcaatctcatagatgtaataacgacttggtcttcacttttgatttcttatgattttcaatttgttggtgttattttttgaaaaaaatgcagattaggcggtgatgaataattattgacgagaccaaggaaaacaaagtaagattataacaaacaaacaaaaaaaaaacaatttgaatgtttcgttcattgactaaattttcaaccgtggaaagaagaaagtaccaattctaccctcaattaataagtttaaggggataggggtccggaagttggggaagaagaagaagacggaaacaatggcaattagcttaggtagagtcgtcgttccgtcgtgtaccatttctggagatcggctcttcatacctaacttctcggccatctgcagcgtctcttgtggacgaatcaatgtcggaaccggcgtaatttctgctcgtcgacgccgtgacattggcggggttttaatatctagctgtctctctacggattcatcttcttctccaccgtcttcttcttctgggccgaagacgaaactctatgtcagtggtaagttagttcccttccttgtttctgtttccaattcttcatcttgcatatatcccagttggtgaatgatgttactgtattttggaactttttggttatacaactgtgattcttcactatttcttcgagtattatgtatgacattagatgtagttttttttttaccgtggatacgttgagagctacatgtcattgtgttactataagcttaggatatctccaaaatattcggagcaaacacatttgtggtcaccaatttatgtagttaacaatgttagatgttagaacttgcggtatagttttaaatgttagagagaatggaatgataaatttgtttgtggggttctagagccttgtggaatagcttcactcggttagggaatgtctctgtttggttactttcagaactggtgagattattgggtatttgttacaccgctgtaatggtacctaagacattgccggatttgttgtaaaggtagataatgattttggttggtgtatagtgttgtgtgtgagctctgatatactggggagatagatatctttctgctgttaattgtggttaattttaattcattactagcaacacactgttataagcttgttttctaagtaaaagggattggtgcaagttgaatagtggggaattagagccttagacatggccataagcaaaagcagtgttaatgctcttctatggtttcctttttttgtttcacttttcagctttctgcaacctttttgatgcctcatcgtctcttctttcactcagacactcattatatgagacttgaactctaatgaaatggattgagggtttgattggtattgacttgactttgatggtttatcacagggctttctttccgcacaactgaagataccttacgggatacatttgaacagtttgggaaccttatacacagtaagcataaacctctccttttgttccaacttctatccaaattctacaactgtaactcatgttcttgattgtgtccccatgtagtgaacatggtgatggataaagtagctaatagaccaaaaggttttgctttcctacggtatgaaacagaggaggaggctatgaaagctattcaagggatgcacggaaaggtactcacctcaacattacactcttgtcttcattcttaaaccgtttatctggtgattgagaacaatacagcaaatttctgatttggtgtttatacagtttttggatggaagggtaatattcgtggaggaagctaaaaccagatcagatatgtccagagcaaaacccagacgagacttccccaaacctcaatccaaacctcgcacctttcgtacctggtagctcttttgattttgtcttcatactgtgtaatgaattgtataattttaaatgtagttttcagaatatacaatggagtcattggtgaactcattccaagtttaaaccagagtaacattattttaaataacgtaagtcatgtcaaaatggataatatagcttttaaaagaagaaggtaaaatcaatttccctttacttaggattagtgttaataattgaatcatagttttgttactcaaaaaaaaaatcacatgaaaattagggtttacctattcttttaggatatctaccgatttggtccaaagaaatagagttatgattatatgaaagatttaataatttaggttataatttagtctcaaaaattatttaaaaagaagttaacgtatttatcttttttttttttttggtttaatgttaaactacgtatttatctatttacacaaacaactgctatatctttgaggagattatgtagggttataaaagaagtttcttttttttttttccttatctgagaaaccaatttccatttttttaggttttctattccttttacgagacttatcactcttgtctctatatatataaactaaagaccgcatacgctttaagtgtcaaaagccagattaagagttaagaaacttcatagtctctcgattctcaattcgatacaaaacgaaacatg

SEQ ID NO: 30601 - DNA, 3003 bp, Unknown
  misc_feature (1)..( 3003): 2750-1469P.txt file - cDNA_ID_3033503; gDNA_ID_1974073; Annot_ID_180294
taacttcggccaaagatgtgaccagcataaggaacaatccttcaggtgaaggaacgagctctgcaggagacattgtctggtccacttccaaaccatgaagtatcatccagctatcctacgtcgatgagaaaacatgtcgctgctgttcccccatgccgctgcactctttaattatatcgtaaagagttaaagttgtaggcctgaactactcactggaacatctaggatgggaagctaattctctggggctgttcttgactgaattgttttgcttcagatctttgcatcaagggcctaaaataggcgtgtggtctgatggggacgacacctttcactgctgaccctgcacaattaaagatctgccttgactgaatacacaccatcacattgttaaattcctttcctggatccttagccgtctccacagcttatcacattgttaaggtaaccaggtgccggtccaacgttttcaagggccctactcgagattcatttttttctccttttaaattactacttaaaatcacacataattaataccaagtgttttgagaactataagagttagagatagactaaatgactcaaaatcaatctccacatatgaagaacaatatactaaccttaacaaacacatcctgcacatacctttaacgttacctcttttatttaatcacttattcctcacgaatcacaaaaaaataagtctctcgtagagtaattaaaagtgactctgcactaaactaaagaattataaagagttgatggttttataaagccataataataataataaaaacataatacaccatcagtcgattccactcttttttctttcttgccgtcttacaacgaccttgtgattcctaggaacatgaaggacattgagtaactacgaggcagtgaagacttatgggaagtagccaagctgcacaaccgtgaaacctctttgcctgaggtaaaatctcatcttacctctcttataaactctccattcatttgattgctgaatttgtgtgacataatacaaatgctctgttcttctttgccgccagcatatggattcaaataaaatggttttcattgttagtccagaacatgatataactttaaaatgtaaattactgataaagtgatttgatagatgatcgtgagagatgaattcaaatagatttttgtgttgttgtttcaggaattgtacgtgtcaaggtacttgaaggggatggagttgagaaaatggggcgaactcaacacaaaacgaagagagtttctagacgcaattccacggtcacttcttgaactcgttgatagatgtttgacagttaaaccaacgcaaatctaatattgaatttcaagaggatgctctcaagcacgacttcttccaaccagtacatgaaagccttagaaaccaaaggctccttaaactgcagcaaatgcaatcgcagccttcagtggttgctgacgcagtcggccaaactctaaagtactactgtacaatgtttgaacaagtaattttgggtccgtaatatagcccaaatcacgaaaatgcccgaaaaagtacttaaaggtcaaaatttggggtcgacaaaaagtcaatggaaaagttccattgtcctgcttctttcgtcggagggctctctttgggctttccgaaaaggtatcacatgccaagtttggcctcacggtctaaaagttatggagtcataaagttttaaccaaaaaaaaaaaaattaaaaaaaaagagggatgcaacacgaggacttcccgggaggtcacccatcctagtactctcgcccaagcacgcttaactgcggagttctgatgggatccggtgcattagtgctggtatgatcgcatccgttagtatatgcaatgcaatcgtatatattcttttttgaagacttgatgaaccattcgccgtgggtcccacccgctatgtagggataccccatctagtcttaacgagctttgatgcatgaaaaaattcgaaaacaatgcttgaacaagtaattttgggtccgtaatatagcccaaatcacgaaaatgcccgaaaaaatatttaaaggtcaaaatttggggtcgacaaaagaaaacattacatgaaaatattctctccactgtccacaccacacagctctagaaaactagatagtttgttgtcagtgttttcactgtattattagttgaattataatcctcataatcgatatacttattattctcctaatttccatgcatgtatgtacagtatgaataggaaaaccagacttttgatattagtgaaccttaacattgttaaaataaattgaaatcttgtttctgtcttgaaccactgacagccacaaaattttgggtcttcaaaaatatatgtggagaggaaaagtagctctcgaggaagtttctgtctattttgcctagaaattatcttgaaatcttgtagaatggctacgtctcatcatcatacataaattcagtgacgactgatagccacaaaattgacttatcgttatagagtagaagctttccaaggaaaggaaggggacgtttctgtatcacacaattatggtcttatcttgttagggatttgatttttcaaccactaaaaaaatatcttgtacagtaagtcttctatgcaagtcttctaagaaaggaagaccaagtttacgtattatttgccccaattgtcttgtaatgggatttgattttaaccactaaaacaatatcttgtatagtaagtcttctatacaagtcttcgaggaaaggaagaccaagtttctcctctctgttactgtgttgtattattgatatacttcaaagagttttcctttgagaaatttcgtctcttctctctcatcctctgccatggcgtcttcttgcttcaaatagatatacaatgttctcagatggatatataatgttttcgcgagcttcagtggagaaaatttcggcaaattgtttcgtggccatcttgtcaaggagctcgagctcgaccgtgaattgatg

SEQ ID NO: 30602 - DNA, 3003 bp, Unknown
  misc_feature (1)..( 3003): 2750-1469P.txt file - cDNA_ID_3033507; gDNA_ID_1974073; Annot_ID_180293
atcttatggaagttgcacggtcaatgatgtttcacacaagtgttccgaagaggttttggggtgatgcggttctaaccgcgtgctaccttatcaatcggacaccaactaaagtcttgaatgacttatctccctttgaggaactaaacaacaccaaaccgtctattaaccacttacgtgtctttggttgtgtatgttttgttttagtacccggagaacaaaggaacaagttagatgcgaagagcactaagtgcatgttccttggctattcaacgactcaaaaaggatataagtgctttgatccaaccaagaatcgcacattcatatcccgagacgtcaaatttcttgaagatcaagagtatgataacaagaaggattgggaggacttaaaagatctagctcattcaacctcggatcgcgttgcaactctaaggtttctattggatcatttgggtaatgaaacaacaccaacgaccgagaatacgcaagaaacacattcaccaaatcaagaagacttgcatcaagggagtgatagtaatgaggaagagtatttacaacatcaagaagaccttctcaatatacaagaagatcatgaatccgtccaagagactcaacatgactcaagtgactcaagtgatgatgaaaaacaagaacaagtcctagttcttccaactccatcacttagaagaagcacaagaatccgtcgcaaaaaggaattctttaatgctcttgcggtagctcatccattccaagcaacatgttctcttgcccttgtacctaaagatcatcaagccttcctctccaagatttctgaacatcgaattcctcaaacgtatgaggaggcaatggagatacaagaatggcgggatgcggtggccgaggaggtgaatgcaatgaagcgaaatcacacttgggatgaagatgagttaccaacgggaaagaaaacggtgagctctcgatggatattcacaatcaaatacaagagtaatggagatatagagagatacaaagctcgcttagtagctcgggggtttacacaaacctatggatccgactacaaagaaacctttgctccggtggccaagcttcatactgtccgggtagtcctcgccttagccacgaatttatcatggggattatggcaaatggatgtcaagaatgcatttcttcaaggcgaactcgaagatgatgtgtacatgactcccccacccggcctagaagacacaattcaatgtggaaaagtgttgcggcttcgcaaagccatatatggtctcaaacaatctccacgggcgtggtaccacaaactaagtcggacactcaaagatcatagcttcaagaaatccgaatccgatcacactttgttcacactacaaagtccccaaggtattgtggttgttctcatttatgttgatgatcttatcatcacgggggacaacaaagacggtatacaaaccacaaagacctttcttaaatcatgttttgatattaaagatctaggtgaactaaaatattttctcgggatagaagtgtgccgctcgaatgcgggtctttttttatcacaaagaaaatatactcttgacttgttgaatgagacaggttttatgaattctaaaccggcgagcactccacttgaagatggctacaaggtcaatcgaaagggggagaaagaagatgagaaatttggcgatgcacctctttaccgcaagcttgtaggtaagttgatttacttaacaaatacaagacctgatatttgttttgctgtgaatcaggttagccaacatatgcaaatcccgatggtgtaccattggaacatggtggaaagaattctaaggtatctcaaaggcagctccggacaaggcatatggatgggaaagaactcaagtaccgagatagtaggatattgtgatgcggactatgcgggtgatagaggagatagaagatccacaaccggttattgcactttcatcggaggcaaccttgcaacttggaagacaaagaaacaaaaagtggtctcatgttcaagtgctgaatcggagtatagggcaatgagaaagcttaccaacgaactcacttggctcaaagcgcttctcaaagatcttggcattgaacaacacacacccattaccatgcattgtgacaacaaggccgcaatatacatagcctcaaactcggtgtttcatgagagaaccaagcatattgaagtcgattgtcataaagtccgagagaagattgtcgaaggggttacgctaccgtgttatacaagaagtgaagatcaattggcggatatcttcaccaaggccgcaagtctcaaagtttgcaacttcatacatggcaaactaggacttgtggatctatctcactcttgatctcaagttcccctaaccatgaacatcacactctttttcccttagtaaagttttctcccatgtggttttctctactacggtttttaatgaggtgatggatcatgtgttccaagcttagacttgcgtgagtcttacgcttgagggggagtattgagcaagacctaataaaaagcatccatccgtacaaataaagaaaagaggccgagtgttgtgtgtaagctacaaggtgttgggccgaacacattgagaagcctatagggagcttctagaatgagtgaaggcacacaaatatctcttgtagccgttgaagagaactcacgagtggtcttagcttcatggtcaaccaaggacctgtcactctcaccattaagaccaaggaatctcttctctcatgtctctttcattcgcatgttatgtgtaaacggctatgttccctttgtgtgtccttaaaatacaatgtaaacacacaaaggtaactaaccaattctagtaatatgttttggtcattctcactcataacaatgctctcttgttcctcatgattctcttacccttactcttactctttccaaactacaattccgcatattctttcaagaagtccctcatacgtattacaccgggtggatatatagagatg

SEQ ID NO: 30603 - DNA, 3003 bp, Unknown
  misc_feature (1)..( 3003): 2750-1469P.txt file - cDNA_ID_3033511; gDNA_ID_1974073; Annot_ID_180291
agtgaaaactagatatctaactattgattcattttcaggatcaactgcaaaatagaccataggaatttaataaatttgattttattatgcagattacggtaagaacatatgaagatccttccaacttactctgaggtaaaacagtagcaaacacaagcttgacggctccaaatttggaactttccttagggcagggtaaagtttccgcccagatgtcttcttctacaagtatgatactattgttatcagtttcttcaagcaaatttcatggcgatggaacatcgttgtataattccctttctccttctgaacatagatgcggtggctgactgctaggaacccttcgcgtgcggcaaaagaaaaaaaccctagtcgcctctcctgtcgccattttctcggctgacgtagcctaaaagttatgagttctttcagggcgatttaattttaaccactagaagtacaataagtcttctatgcaaggcgaagtttctttgttattaatttattattgtgtctgtcatcatactctcttgttaggagatttgattttaacgtatataccactacaaaaatataacttgtacagtaagtcttctatgcaagcctgcaaggaaaggaaggaagtttctgtgttaatttgttaaaacttgattgtgtctctcactatacgctcttgttaggggatttgattttaaccagtaaaataaatatcttgtatagcaagtcttctatgtgagtcttcgacgaaagaaagacgaagtttctgtcttattaagttattattatgtcttaatacatcatactttgttaggaaaattgatatcaattaaccactaaaaaaatatatcttgtacaaagtcttctatgcaaatcttcaaggaaaggaaggcgaagtttctgtgttaaattgttattatatattataaattgttgatagatgtttgacagataacccgaggcgaccaatcagcatagaggatgctctcaagcacgacttcttcttctgatgtagcattttattcaattgtttatcgaaccacaatttgcaattaatcaactcaccaagaatatacacaattgcttaatctaagctaacaagttgattttgagtattctaaatcttagtaacaatgcattatcaagcaaacagtgcaaaacaaggtaaaagaaagcaagaaacaaaagactaacaagtttcaaaagtaaacaaagcgggagattaacaaattattgagtgataactaaagacgaattctcgggttaaggcaatcgattagaaatgataaagagatttggattatgtagcatcaaacaacttctaataagcaatgatccttaggccatagaacactaagcaagactaacacatttcgatgacattaatccctttattaatcaaccaatcaacaacaatttcaaaggcaatcaaatgatcaataagcataaataacaagtctatctagccactaatcaccctaatcaataattttcaaaggtaaggtatgaaaagcacttaaagattttggttcgggaaattcatcgaacaccttccaggcatgaaattccaagtgtctaaatcaacatgatcaaggttgatctagccttaatagcaactaataagtaagaatcttaagtaatctaaccctaaactccataacccaacatctaaactatcctaatgtaccctaaccaaagatttctaaaagactactcactcataatcatgatcatacaaaggaattggtttgatctttgtaaagccataatcattagagaatatatgagaaatttagaagaagtacttgatatagaaactttagaacccacgattcatacaaaaacttaagataaagaaccttaagagaagtttttgtctctcaaacaaaaaactctcttctcaaaaactaggttaagagtatttctatagtaatgaggaaataaaccggatcaaccaggaacaaaccaggttttgacccggtttaggaaagcaatcgaccaagcaatagatcacttggtagattcgaatatcatccgcaacattaatgattaatccttgaccaatcgaccacgcaatcgactattttggtagattcaaatttcctctatagctttggtccttgaccaatcgaccactttggtagattcaaatttcctctgtagctctgatccttgaccaattgaccaggctatcgaccacttggtctattgtcctgcacttctcctctttggtcactttgcattctctgaactccttttttttcttcatttgcttccaaaactctaacctccactcatgtactatcgattcttgaccttgttgataaatgtttgaccgttaacctgaggcgacgaatcagtgccgaggatgctctcaagcacgacttcttccatctagtacatgaaacccttaaaaaccaaatgctccttaaacagcagcccacaatggttgctgacgcagtaagccaaactctaaactaatattacaattgtaaaagtaaataagaaaaatatatctaacaatcttcactccactgtccacaccactgaattctggaaaactaaaagagtatttaagcaaattagatagtttgagtcttcaaaatatcttttgtagaggaaacaaaattgaagtttttgtctatttgcctcgaaattatgataaattataatcttatttctttcttttacaatgacttagtagtaattcagtgacaattgacaaccacaaaatcaatcttttaaagtatctttgtatagtaaaacctctgtatcatattagtttagtacgtctcaattgtcttgttaggtggtttgattttagtcacttaaaaaaatatttgtatagtaagtcttctatcaagtggaagaccaagtcttcgaggaaaggaagaccaagtttctcctctctttctctcttactctcttactcataatatgtattgctaatttacttctcttacaaatcttcgtctcttctctgagttctctctatcgtctcccatg

SEQ ID NO: 30604 - DNA, 3000 bp, Unknown
  misc_feature (1)..( 3000): 2750-1469P.txt file - cDNA_ID_3033540; gDNA_ID_1974074; Annot_ID_180336
agtttcaaaggagttggtgaaatatggagcggtggtgattgatgaccaaagctttgaaacacaacgaaacctcacgacagacttcgcaggcagccttgagaatatctccgaggttagatcgagaggtaaggatgatgatgaagattttcctctgcttctttttctctggatattttcggtcttctcttctctttgctccatcttggagaaaaccctaagtcggtacttcctttccacgatttatgcttatatgtctcaactttttccttttccactaaattggaaaaggaaaaaatgcttataggtgttaaacttccatttcctaaacatctagaccgagataaaaaaaaataggctctatctgacgtgatgtcaatacttcttggagggaaatcgactgttttcccactaaatttaatcgtaaaagatgtacaaagaaagacttaaaataccaagactcttaaccagagttgataacaaaactatacataaagcactaaaccaactaaactaatctagtgatatttaataatatacaaaatttatactggtgtgagaaataaatagatttttttaataatatttgaattgtaatagtaatctacattttttctttcatttaatataaagaatttttgaacaaaaattcaaatttaacacattctattttgcaatataatttaactattcatttcatgataataaactggatattaattttatacacgtcattaatgaataataacaaaacattttagttatacacacgctctatcttattgtgtctagttttacttttgatatttaatttttaaataataacccacacactttcaatcttaaatgttctaactcttatctctaaatattcttaaatcactttttttttttaatttaggaaagataaaaaaagaggaatgattgtcgtagattcatttatcttaatcttcatgagtatcttatccactaaccgcgagtaagttatctcctctattgatgatgtcctaaacgatataccatacaaaccaactatttttgaatttcattgatatgcatctccggtttttgaataatatccatcataatcaaaatatatgtttattggaaggttgctcattctcctgaaaagaaaatattagttgttatttcaaaaatatcagttgtaccatatatactacttcaaacagttatatcagattcataaatggagagtgaggaggtcctaaaattatcgttcttccaaatcaaaaattattatttattagagtaaaaagttgcgctaaaggaatttcttatcttgattcttttacataaagtatgctctgttagaaaaaaaaagaattcaaagacgtcagaaatcaaaatattcccaaaaaataatggttttagatctctccaatcaactaattgaaccaacatcaaaattttaaaatacgcgaatagtatatcaatgctgtgtatcaaaatctcataatccaaaatactctatccaaactcgaagagaatacacccatataaccatatcaatagagaataatacaaaaactgatttaaaagcgttttgtagcgaaacacaattttaaccatcccaaaagcctttttggtactgttaccagagtaagagacgataaaatacaaacaaaaacaaaacatgcaaccaaaaaaaataaaaaagaagagacaaaggggagagagagaaaagaagagcgaacaaattccttctttttcccctctttctctctctctcccactctctcatcttcttcttcttatgattttcaacttattacaacaacaacaacaacaaaataatcttgcaaagtttcagtctcaggtggttcacagttaatgctacttgcaatgatgaatccatcccaatttcgtaagttaatcttctcttctgaaaattgaatttggtgtatcaattcttacattatcttgaagattcatctctgaatttctcaaatttatgggggttttttgtttgtcggaattgccggagaaattggaaaaaacgagatctttgagtaaagggtttgtttaatctttagtctttattgctttccttaagctaattttggcagatctggaacataaaccctagaacaagaccaaatcagtgtctccttactcttagggattttagtctctgtgataccttaaatgtgtttataaattgactgtgcttaatgggtcacatttgatttgcaataaaagtttcacaattcttccattttcagtaatgtaagctccagttttcaagatttactattttggggaactagttaggtttgtaggtttattagatcttagaaacactaatgtaatgctgtttgtttggtactctttaatattcactattcatcttaatgtggaatcaaatttgctttttttggtcagactcaattagttggaatgagttgttgaaccattgacttgtctcctaagctcttacttaatctatctgtatcatcttctcctgtctatttctctttatttaatacataactcgttcatgattgcatctgacatggtagcaactctttgtgaacaagacttgattttataacactgtaacatgaccacactttttccttttgatctctgtatatttggggaagtaaggatttggtttaacaatgatacaaaatcacagtttagatgactcagtcttgtcttttatcattaagatggaaaaaatgagaccaatcttgtcttgctttattctaagatgcatgctctattatattttatgcttttgtatatataactgattgaagccggccaatggagattggtgctgactttttaaatgagctgttgttgtatttcagccaactagcataagataaaataaaataggaaaatttttcatttcagtctcttaagttcaatgaaaacataatgtggcacagaggtctttgcttttgtacctttcagaatcttttattgattgatgatgtttacatacaggataacctctactgaggcatccaaatg

SEQ ID NO: 30605 - DNA, 3003 bp, Unknown
  misc_feature (1)..( 3003): 2750-1469P.txt file - cDNA_ID_3033563; gDNA_ID_1974074; Annot_ID_180315
tggaatctcatgtcttgtgcatattgtaagtttgttgatgtttgtgtgtttaaggtaaatgatggagtgggaacattagctggagcaaggtattgggatgaggatgtgatggtcggtgtgattcttggcactgggaccaatgcttgttatgtagaacagaaacatgcaattcctaaactccgaagcaaatcttcttctggaacaacggtattattgatatttatatatgtagataggtatgtcaatttttcatgcttaaaactgtttacatttggaatcagatcataaacactgagtggggagggttctctaagattcttccgcaaaccatttttgacctagagatggatgagacaagcctgaatcctggtgaacatgtagtaaaattttatcctttctttagtaacattatgttttttgcctggtgtcacatgttttacaattgtttactgtttgtgtgtggatgaagttatatgagaagatgatctcagggatgtaccttggtgaaattgtaaggagggttttgctccatatgtgtgaaactagtgacttgtttggacacttcgctcctgccaaactctccactcctttggcactcaggtatctttatccaagtccatattttggttgttgttttatgagtagtagatttagttaggatgtgtagtttggtttatggtttggtttcggctcagtattaaaactcgatttcgttcagtttgatggaattacggtttgaaaatttctcttggtaatgaaaatatcaaacattgatcattggtgtatttcagtttgtttggttcaggttaaaaaattacacaagatcattttgttagttaagtttcaattttggttcagttacaatttcggtttgttcgattttaaaccaggaaataccaatatgctcaaacatttcggttcagctttggttcggtgcggtctatatatgctcacccctagattcaataccttaataacttgattagctaggaaagtgttgtaaattctgattgacagttttattcattatttttttttttgtaaattttgtaaaggaccgagcatctatgcaaaatgcaagaggacaatacagatgatcttcgggatgttggatcaatcctatacgactttttagatgtaagttgttaatgtataaggctaatcacatccatagatttgataactgtaccaacctgatcgagctattgaaaataggtagaggcgaatatgaatgcaaggaggagagtggtggaagtgtgtgacacagtagtgaaacgcggagggcgtctagcaggagctggtatagtggcaattctggagaagattgaaaaagataccaaaagaatgggttcaggtaaaagaaccgttgtggctatggacggtgcactgtatgagaagtacccacaatatcgacagtatatgcaagacgcactagtcgagcttcttggccataagcttgcaagtcacgttgcgatcaaacataccaaagacgtgtctgggctcggtgctgctcttttggcggccactaactccatttactagtacttggacctctacttcatgagtataggaggacttttggtccatttgtttgtgtacatttatataagatatcatatcaatatcaataagattgtaaagaggagcaacgaactagcagaagattatgtcttggaccacttcgtacaacactagaaaatccttttacttccaaagtgaaaattttgatacgatttataattttggatataaatctatccctatttggtttgtgaaacactctaaatgaagtagaagttatgaattatgtctaatcaatgagttagatttgtaactttgtttaaacaaaccgataagttatgtttagtaacaaacggctgactagtaccattgctttgtataaatcaataaattaaatatagataatagttttaaagattcttttctagagtaatatatattattttttttgaaaacttttaatatcattttaactaacaaataaattttaaccaccaaacgtttagtttttagagttggcaatcgtccattttttctctcttttaatcactttttccaaccgctcatatgattggtaatctccaaagctgtttgttttgttttgtttgcaaacaaatctattggatcttactaatcaaacccaatgtcataattaaatatagggcaaggcaaaatatttgtagtactcttatttgatttgctatatcatctttgatcccattaaaaatatgcagatatttgtaagtaaatttaatatatgttagagggaaagttaattacaaatattaaaatttgcaatatggatatccaaaatggataatacaatttattagcattcaaaaaggttttgcagtactggatagtcctaatatttcacgtataaaggaagatcaaccgtttcacaaatggattgacaaattacatgcgttttcattgtttctagattttcatgcatttgatgttctcccgaatactttgatttcgatatttagggatgataagtctgaactatcgtgtcacgacatgttcgattaaggtttttcttctgattttcaccaaaaaaaaaagaaagccttataacaaaaaaaaattaataaaacttttatcatattttttgaactttcataaaatatccaattaaaatttaaaaattaacagatttgtaactagttttgagaggatacgaatatgaaacacataatatttcattgagttggaaaaaaaaagttgtagttaaatcaaatttttaaaacaaaaattctatttcacaaatcttttctagctccaagcttatttttctatttcctcctaaatcaatttttttcttaaaaactccatctttttgactggatagtttggctgctttacgaacctgttttcaacaaaggtcgtgaaaattcaaagtgagatctgaaagaagaaaattcctctgatcgctcacgatttctcctgaattctccattagattttgcagagaaaatg

SEQ ID NO: 30606 - DNA, 3003 bp, Unknown
  misc_feature (1)..( 3003): 2750-1469P.txt file - cDNA_ID_3033596; gDNA_ID_1974075; Annot_ID_180372
acagatgcaggcttttacaactgtcatgtgatttgttgtaagagttccagttttgtcactacaaatagttgttgcagatcccattgtctcacaagcagcaagattgcgcactagcgctttgtcattcatcatctttttcatggcaaaagcaagacttaatgtcacagccaacggcagaccctccggaactgcaaccacaacaattgttacagcaacagcaaaatattctagcatcgccatcaattcatcagcagtccagatccagtgagaattatctaggcgcttctgattagccaatccttgaaccaaaacagcaaacgtaatgacagcaaaaaatagacctattttaccaatgatggttgccacaccattaagttttacttgcaacggtgtctcatcatcaccgccttcacttagtgtagccatcagtttaccccattgagtcctcattccaactgtagtcaccaacattttgcaagatccatcctgaaccttggtaccagagagaagaaacgggtgttccacactgacactaaccggttcactttctccagtcaagctcgattcatttatcagaacagaaaaccctgagataaaaagcccatctgctggaatctggtctccaatgccaagatgaacaacatctccagggagtagatcatatattgagattttttgcctcagtttgtctctcgtaacctgaaccacaatctttttcttctctgcatccaggtccttgaattgcagggattgcctataatcactagtggcagtgacaaacacaacaagcagaatactcgccactataccaagtccgtcatgggcaccaataggccacccttccatcagtattccaactataagtgaaacaaacgcacatgcagctagaatcataagtgttgtatcctgaagggcttcccaaacaaataaccaaaagccacggctggggctttctgtgaattggttgattccataaatttcttttcttacactcagcaggtcttcagatgtactaattccactagcaatagacgtggaaagtttttcagtgaggccctcagttccaccatgaattttcaactttttcaaatcatgaccttctacaattgatcccaactcatcaggacaaatctcaaaccctgcttttcttacttcttcaggtagtgtatactcactggacaactttaaacctgtaagcacgcaataccttctcgttaaggaaatcaaatacatattgaataacacaagggagtagtctattctcactattaatgaactgaagtgcagcttgtgaaactaagaccgccactcgaaatttttcctgcattcataaggttgacaaaggaaaatggtattagaacaaagcaccaatagcagtaagaatttattctcaaaggaaaaatgaacagaacgctttgatcgctctaattaacgcctccttcaatacaaactacaagaaacacaaggcttgaaatgggttgtttgctactaatgagtcatatttgcttgaacattcttactagcaaacaccacgaagaacctaaaaatctacatcttaaattagaaacagaacctaatgtaatcatgtctagtgataacaatccctaacctgaggataggtaactagaaaaatactaaaaacgagctcacttagatcccatccagtaagtacagtgagtcaaccaaacaaaaaactcggaatgcagaaagatcacttattagatctccaacagtatacaagcagaaatagaaagaaatgtttcagtaatcaaagtgagaagaaagaagcacctgattggaacgccgaatcgcctcggcctcggaacgcttagacagattagcagtgaatctaaatctccttttaggattcttgacgatccagcagagcttcctccaacgctgcaacgcctcatcggacgagttcttcggcttcacatcgccgaagttttcgttcaagtagctctccatttcttcagcttactactctcgaacaacgagtgaattcgtaactatacttcagatgagataagattagagaaagagagaatcaaggatctcgtaaatcgagaacgaagaagatatgatatataacaagaagtcctctcactggtaatgggtgcttttaacttattgttatttacctttatatgggtcaagatgaagacgatgctttgacgcgtcgtctcgcactaagtgagcttcgtcgaagtttcgtctgcctgttctgaaatttcctcatggccatggttttttttttttttttggaacactcatttattcggacatgactcggagctggtcaagaaagtcaaagctatttactgacttggactttatttcaacaaagtttttagtatattctaagttttgtgacttttgtccattagaaatttcacacaaataaattagaataatttactaagtatattttctaaagaaatttttacaaaagtagacgaaaaaagatttgctctcattgtttgtcaaagtgagaactggttttcacgttttgtcttttcattcaatttcggaccaaattaccctgggaaaacttaataatggcataaaccaaaccgtgcagcagttcgtatcggttaagttgacggcgtaaaccaaaccctacagcagttggtttcggtttagttgatgcggttcagttttgaaaaagacaaaaaacaaaaaaactgaaacgaagaaaccgagaaaacgaaaaagagaataacggagagattgagagagaatcagaaagcgaaacgaaattcagtatccattgcttcaaaattcgacataacttcgaattgttgggtagttgaattgtgccactgaactcccacatccggtgaagtgaaagttactgtttttcccggcgaagccaagagaaagttactgtttttcccggcgaagccaagagaaagttactgtttttcccggcgaagccaagagaaagttactgttttttccggcgaaatttgaacctccggcgagatcgcatctttagctatg

SEQ ID NO: 30607 - DNA, 3003 bp, Unknown
  misc_feature (1)..( 3003): 2750-1469P.txt file - cDNA_ID_3033600; gDNA_ID_1974075; Annot_ID_180370
tctatgcaggatggatatctatggaagatgagcaacttcaatatttgtccatgatcatgttgcattcggcagacactttctctatgaaggagtcaccgcttcttctaactgatggtagaaacgccgaagagcttatggatgaaaatgctgtagttatgcaatccaagatcagtcaaataaaagacatattccctgagtatgggaacggtttcttagctgcgtgtcttgaagcctataaccagaatccagaagaagttatacagaggattcttgaaggaacactccatgaggatttgcagcgattggacacttcactggagacgatgccacaacctaaatctgctccaactcttagaagcaaagacaaagggaaaggaaagctcattgaatctgacactagtagctctgctagtgccatctatacagagaaaccgatcacacggccctcccttccagcttcatcagcctcatcagcaacagttggcagatttgtcagaaagccaaaggatgatactccaagttacaaaattctcgatgctagaaaagaatccgacagagagaggaacgcagccctacttgcacaatacgaatatgatgatgaatacgatgattcttttgatgatctgggcttgagtattgcggaatcaggtactgaagaaagcggagcgtttggtaacagagctggatccgagccctctgatgctccaaagtggggtagcagaaagaatcctcaattctatgtgaaggatggtaagaactacagttacaaagtggccggcgcagttgctgtggcaaacgccaacgaagcttcactggtaaatgaagcagagggagataagatacttgggttgggacgtggaggaaacattcctctaggagcggttagaaagttgacagagtatcaggcacagagagatgagaaaggtcagtctaatgtgaatgtgaacccaagcgatggaagagagaatgggagaaactggagaggagtaaggggaagaggaagaggagtggtgaacagagagcaaccgcaggagaagagtaatgagagtagtaataacaactcagaggttaatacagaggcggagaacggaggaggacggggtcgaggaaggggacgaagaggaggaggtggagggagaaatcataatcataaagatagagctatgaagaaacatattgctagtgtttctggcttctagaggtttaaaaagtaacaaaaagcacaatacgtttttgtgggtctgttttttcggatacaggggagaaacttaattacaaatcgatacttcatttgattgtaatgcttgtttctggtaattaaaagaagaaaactagcatattattattccctttggttttggttaaacaagtttcttttgtaacaggttggtatgaatctaataaaaaaatgaactttttgtgaaaaaaaaaaaattcttttgatatatatgcaaaggtaacaacaacttataaccattccaaatctccaattgaactcacattgtctaagttctatctttttatctttattcttcttcccgtaaaagaaagagtagttattacttcgagtgacagaagttgtaaaaatttgtaagcatgtaagccgcaataatataaaaagagaagaaacatttataaatgtgtgttatatataaagaattgtattttatttgaggtagataatgaatgatctacaatcaacaactacacggtttgtgattatatgtatccacgtgatttaatatacaaatagatttgttttctctgcaaaaaatacaaaaataaatacataaaagaaaagccaaatcctaaacgtaactggaaaataatatacgtatgagctaatttcaatttggattagacaaagaaaagaagaagagagagacgtaattatacaaaagcttacgagaagtttgttccatcatcacttgagagaaagatgatcaaatcatacaagagaaacacgaaccgttcaacgggagggaacgcggcagcactatcattcgctttggttcgtcgtgcagaatatttaggtacatacatatgttttataaattttatcatctttttgaatgcatcataatttacaatatttcgattacgagaaaactagatgaagagaaccttaaacatcctttttaacataaaaaagaacactaaactaacacaagttctacacattagtataatttcttagctgataaaaaacacaccattagtatttttccctttttggtaacgttttttttaagataatctaaaccataatactgaatcacaaagctcataaaaaaggaaatcgaaattataatcacgtcggcaagtaaagagccaacggtgagggatgagccacgtgtgaaaggatattccttagatgtgaatgggatctaattcttgtccgattaaaccgagaagagtcttggtacgcctctctatatataaaagtcatcactttcctcctcacgtttcttcctttggcatcgacgaaagtctgaaaactcttttctctccacctctttctctcttaccccaaacacaaaatctcctctttaatggatatatcgcctctccgatctcattcttcctcgtttttatctgccaaactcttattgctcttcttcttttgtagttttcgtgcttcttcgatttcttcttcttcagttgtttcccatcgtcgtaatccttctagctttcggtttctttgataattccctttgaattcgtttttcttcttctttcaatttccgcaaataatcagccgccgataagataatcatggggaggagtaagatttctcttcttcaatttttattctttaattgattcaatttgcaactggatttgtttgttttagggttttaattgattactaatttactatgaaatctcttatataaccaatttctgttttcgttaacgcttttataaatttggatgctttgattaacttttgctggaattgtttttttttgtgcagaatctcagcgtaagaacgcgacaatg

SEQ ID NO: 30608 - DNA, 3003 bp, Unknown
  misc_feature (1)..( 3003): 2750-1469P.txt file - cDNA_ID_3033624; gDNA_ID_1974075; Annot_ID_180361
ttaggtgaataagtccaattcctgaaaaaaaagaatacaaaataaactcattagatgaacaattgatcatagaattattggggacaatttgaataaagaagtattataataatgtagaagaatggttggaaagagttggcgaggagagagtgagggcaggtgaagctgcactgcacagcaacgaccgggccaatataatgcacggttgggcgacgtacaccgccggacgaaactgacacgtgtaccctttgttctttcttcttttttgtacccctcaattactacattcattgtaatgttttcgaaataatagagtatatatgtattttgtctctaaatagtagagtatgagtgactagattcactatatgataactggagagtgcaaaactaatcatgacaaaaagtaagggtatgaatgattttggttattcgtttcgattctaaggtgatttgtgagttagatttggtactaattacagtttagctcttttcatcatattcttacatgttatatatttcaaaggaattatctagacgcaaacaagctttgacaagaaaaatgaaaacaagcaaaatcgagaatacatcttaagtaaggcaggggatgcggcccgattcaaaattctatgttctaaaaaattatttattatatatggagaaattaattcagacaatttgtgggttctttggatgacgatctccatctcttcttgacactgggagaagaattctaattcttactcgttaatttatatgcatttgatgatattatttttctcacatttgtctaattagtgttagtattaatttaatttggtatgctagacgggctcaattgggtgagtttttttaattagttccaatgaaagttgatgtgaaaaaagtattgtgagccaattagattggtaattagtaaaatttagaaaagtcaaatgtatggaaacactatattaaaacatctattacttaatattgttaatgctatagcattttattaatttataagaaattgttagaaactcctttttaattctatttgtttatgcagttcattctttttatacattcttttattttaatgactgttttactcatatttgaaaatattttagattaacaaaatgaaataataattttttccgtcaaaaatatttcgaaaataagtttctcgtaaaacaaatccgacaaaaaaaaaatctaccaaaaaattttcccaaaaaactttttcttgtcaaatttttttttccaaaaaattcatttcccccaaataaaatatttttgccaaaaaatagatttacttgggtttacttctttttttctgttttctagctaaaaccaattgacaaaccgataccataaatctaagataatagataaatattgttatgaccgaccataattgtaaatttgtttggtgaaaatgggtttctcggagctgaatcttctctaactgtggagagatgtggagaaaatatagacattgcagagctcacagacttcctttgtgctgcttcgatggttagagaatttagtgagtttcacactgaccctgaagatcgaaagcttagatatgacgttaagaaaaaaagttagaattgaaatatgagccaatgtcagttgttgatgacgagccggtttgcctaccaatgataaaatttggggtttcaaaagagacatgactcatcacacatagatcacttccggagttagtcacaaagcaactttttttctactatgagaatgtctttctcacacctaaaagcgtttgaaaaactatctcaggatacttgtttgatatcccacctaagttttttgactcgaaatatttatgtatttcagcacaaatcagcacaaagagaggtaacatccacaatcttccaatccataatagaatccatcaactgccaccgaaatacacaattcgtgatgcatttccatttactaagagatggtggccaacagactaggataaaaaagcccaagctaaactgcattttgatttgtacaaggagtgcccaattaactaacatgatccgtttagcccttgaaccttacaatggagaactaaaaccgcataatctttttctgacgaaataatttaatgaaactatagatgagcaatactattgtatctaatgaaaattgatgttaaaaaatattgtgaaccagttagattggtgattagtaaaaatttagagaactcaagatgttcaataatggaaatccgaaaaactattattactagagttttttcttttttctttctgttttctagccaaaaacaattgacttaaccaatgccacaaatctaaagacaatagacaaatattcaacttatgctttccaagaaaatatcatcaggaccatattgagtgatactgtagtttgttttgctctttctgccattttggatctgatttgtaaaaatgtaaaatcatcttagaattctgcataatttttactaatcataaaatgtaacggattagtaattccaatcatttagtaattagtaaggaccaaaatcacatgaaagatatcttataagaaccaaatttggttattccaataaaacccttgaatgatattttgccgttttcaaaacccttaaaagaagaaaaacaatcagagggttggcggtgttcccgtcagaagatcacgaggatcatcacattaaactctgttttgttgatctctctttctgttccgtttctctttccactgccaaaagttaaagctctctctctcactcaatcacacactcatttctcactatttcacaacttccttgtggacaaaattagtcgacttctctgttctctccaacactgtttcgttttcactacccaaaattcgaatctgggttattgaaaaagttccaatttttttatctgggtttttcgaaagctgatatctttttagaatctgatctatctcttctacttcatttcccttgcatttttttaataagttgtagaatctgtcttgttctggaaaaatatg

SEQ ID NO: 30609 - DNA, 3000 bp, Unknown; identical to SEQ ID NO: 9821
  misc_feature (1)..( 3000): 2750-1469P.txt file - cDNA_ID_3033629; gDNA_ID_1974075; Annot_ID_180359

SEQ ID NO: 30610 - DNA, 3003 bp, Unknown; identical to SEQ ID NO: 17493
  misc_feature (1)..( 3003): 2750-1469P.txt file - cDNA_ID_3033633; gDNA_ID_1974075; Annot_ID_180352

SEQ ID NO: 30611 - DNA, 3000 bp, Unknown; identical to SEQ ID NO: 26528
  misc_feature (1)..( 3000): 2750-1469P.txt file - cDNA_ID_3033676; gDNA_ID_2213624; Annot_ID_195773

SEQ ID NO: 30612 - DNA, 3003 bp, Unknown; identical to SEQ ID NO: 28009
  misc_feature (1)..( 3003): 2750-1469P.txt file - cDNA_ID_3033680; gDNA_ID_2213624; Annot_ID_195769

SEQ ID NO: 30613 - DNA, 3000 bp, Unknown; identical to SEQ ID NO: 9828
  misc_feature (1)..( 3000): 2750-1469P.txt file - cDNA_ID_3033719; gDNA_ID_1974077; Annot_ID_180436

SEQ ID NO: 30614 - DNA, 3000 bp, Unknown; identical to SEQ ID NO: 9826
  misc_feature (1)..( 3000): 2750-1469P.txt file - cDNA_ID_3033733; gDNA_ID_1974077; Annot_ID_180428

SEQ ID NO: 30615 - DNA, 3003 bp, Unknown
  misc_feature (1)..( 3003): 2750-1469P.txt file - cDNA_ID_3033750; gDNA_ID_1974077; Annot_ID_180421
tgaaagaatctaacagatttaagaaagtttggaaaactcaattcagcggttacgattcttttgctctatcagcggttacgaagaccatttttctttcagacgattataggacatgtgtgaggataaatacatcttgtgaatagtccttcttttatttgggagtagtacttatcaagtcttataaatagggagcgttacttatgtgatttatgacctttaatcttaaataaaaacaagtttaggaaaatcttgatttttaagaatttaatggatttaagaagatttggtaaacatgcattcggtcacttcagtataatcctcgtacgagttgtagattggtctgactatcagcggttacgaaactattttccttttcgacgactatatgacacgtcttgtgaattaagatatgatgaacatattgtaaaccgttcatatattataaaaccagaaaatttagaagaaaaaaagagagactcatgcatgttattaaaagggtttagatcagtacgatgttcaaaatttctttaattagtagctaagcttttgcaaaagacctaagaaatttacatggttttttttttcttttcagtctaaagaataaaggatatataaagattaagaagacatcagaaactttacaacatcattgacaatcaaagaaaagatttcaaaaactaaaccgatggatgataagatattttcggaccgtaaacccaaaagaccgatatgaatataatacataaccaataacaaaaagagataaagccgaaacaaacaagagaaatgaaactatagaaccataatctagcacaaaacaacatgcgtactaccaaaccaaatgaaggataagcttgtcaaagtagcgtacggaaagggaagaaaaaccacgagaacggagagcaactcttctactaacaaatgaatcctacctctctaagaaagaacgaggtattagtaccaacaagaaaaaatctagggcggaataactagaaccaatcacaatttctaaaaccggcgaaaatgaagaatacgaaaaaacaacgatcttttaactcttaataagaaataaatgataacttgaaatcttgatcaagaaaacgtcacaatttccaacaacggtgttagtcggaaatggcatatccgacaaagttctgacaaagtcaaatttgtcggaattttttggtctaaagatcggagcaatcggtaaggaaaactacgtttgaaatatcacttccaatcatacacttcatcaggtgcgcatagcgtagatcaggttgtattaacaaatttatttgaaagtgttgagattgatattttatgggtatatgtgacatttaagattttttgtaagagggggattaagcaacctccggttaacccagcttaaaccaaaaatggatcgaaaaaccagtaaactcagcccaaagatgtaagtctgatcagatcgacaccaacctacaagataaaggaaaagatagaggcaatctaggaagctaagttataatacaaaaagaaagaaaaagatagattttcgatagagaaataaggaaatcaaacatgtatatgttaaactaactatcactttcttataaatagagaagcacccctttgaaagggaaatatgtggactcatacacaagatcaaccaaaacacctagaaaaaacccttataacataaattatgaatgacttgatcccttatgatggatatataaacaacctacataaggtgcaactattatatatataaaatctcaatttgtcatcctacttttgttgttaaacttgaaccttgttgaaatcctccttaaaaccgacttgatttatcaccttgtttaccacaggtgatatctcaaatctacagatatcaacacggtttgtcaatatcgtataagtgatgactaccacatttgattaactccggagaaatagcttttttgtgctcgagtgtcaagtacatgtacctacaagagaccaaccatgtaggatcatagattacttcaaaataaagcgttgaatacataattttaatatagttgaaaatgtagtaagtctaaaatatttttttggtgggcaacatctaaattatttgttttaaagttttttcaacattatatatatatatatatatatatatatatatatattagaatggataaaaatatagattccattcattctcttgccaaaacagttgtagcagcagaatttcttttaagtttattcacatttttataatgactgaaaatttagaaaattactttggtcaatcaaatttattttattataaccactgacacttcacacaatggacagaaaaatatcaattttgttttgacgttttcatctgtaccattcgagcaaagaatgattctttgcgtgacaacttcgacaagtttatagaaagtactaaaatccattgcaaaagcaaaaagtttatttttctttgctcttctctttggacgttttcgccatattcgttgttattattctagcaaagactgattctcttgcgatacaacctgtgaaacctttcttaaatattataaaggttttaaaatactttaaaaccatgattgttataaacaacatgtcacatatggatgaacagtccgctggagatattaataaattgtatctatggatcttctttgattagttctcgaaattagctggactatgaaactaaaatctatccatcaaaatatatataccacataattactttaattcaggggataaataagtaatcataagaaaatcaaattcaagcacatatttttgttgaagagttaaccctctcaaagttgttaaataggtaaaatttagaattttctctattataacagatgatggtattaattcatgtattcttttaaccactcaaaactccaaagagattcaagttttatccaaaaatatttgtggagcctatattgctaaaaaggttagaacaatcggtgaataaatatggcagagaaggtggaggtgaccacgatg

SEQ ID NO: 30616 - DNA, 3003 bp, Unknown
  misc_feature (1)..( 3003): 2750-1469P.txt file - cDNA_ID_3033754; gDNA_ID_1974077; Annot_ID_180417
tccgatctaaatgttagtgtcttgaagttgtaactctccttagtttctcaatgttatgatcgataatggtgatgaagcaaggttgcagggacgaagacgacgttatatacacatgtatatacacacttcatgattaggttttgttgttaggtttttgttgggcctataatgggcttagtgagaaattgagtctcacattgaaaccttatattacagataaaatcttagaattaatggatttgggtagataataatatggggcgctatactataggtaaaatcatataattaacaatcaaaatataaatatacaatcttaaacactaaatagaattatttttttaaagaaacacatctcaattcttttataagaagtttatacattataaacgtaaaatggtctctattttcccacgagaacgatcgtatctagccagataaagcccgatctttgacctttgtctgtatacacatgaaacggaagttaaatgcttatttccccaccaattgaaagttcgagagcttaatgtccatgaatcctggtttcgtcggtttagtgcgtaaacccgagacgaaacaatgtttcggtcgtaacttaaccaaaaaaaaaaaacagattacaacctattgtcgttgtcttcataaaaatcaaaatcccaaaacccccaaattcaaattaagaaccctaaaaagctgaattcttaattttgtaattgaaaaccggatttccagtttaggatgagcaacctttcatcgagttcgacgggatcaacgggaccacgtggaagaggaagagtggtcgaagtgccatcaagatgatggtgcgaggaactaaattggtagtcaacataaaattgaggatttaaatcaccaagtacatagttcatgctttaaaccaacgaaaatggtaaactaatgatttaaatgacatttttcccaatgtatatatataataactacccaacactatgaatcatgatagttccttttttctttgataatattaaggacatcaaggcactaacaaacatggcaaccttatgaaagtataaaacaatttacataacaaaaaggttaagaccaattagtttaactaaaaatgaatgttatcgaatttacaaaattatacgtgatttgaagtattccattatatacattttttttgggacaaattccattacatacatgtttttttttgggacaaattccattacatacatgttttttggggacaaattccataaacaaaaaatacttcactttttttctctctctcgggcaactttctaaatctagtttttttttcttctttttttttatttctttttaatcttcacttgaggtttacgacttcaacggtgaatcaagggggagcaagcttccttctccaacaacggtgatgtgtgttattcgtcatgtgacgcatctatggctctttcatggcggtttgagaagctatgatatcgttcgctctgattcgaggacggaggtttcatagacgagtgtctcacggctcatccgccctattggccgctgcgactagcggtggaagttatccgacgacttttttcgtgctatgtttgtcaatctcccaaaatatttctgtatctagattattcttttttggttcattataaataaatatatttaattttaaacgttcatagtgtattttaaatttggaaccaataaaatgggagagaaataacacatgtcaaataaagagatgacatatgtcacaactttagaacatatgttttgtgaaaaacttattttattatataagatatgttggttgtaacaaaaaataaaataaaaaattctacttcacgggttctctcctagtttctttaatgagttatccgaaccaaataaaaacttgattcgaatccggattttattcaatcgaactgaactaatcaaaatttcatcaaaaagtaataaatcttcttaatatatttatatcattgaaacatattaaaagtctataaaataattaggtttttaataaagaaatccagccccaatccaaaagaaaagaccaactaattcctcgccttttgcaatttcgtataattatttcccaatttttgtgtttgttaattaaatctctaaatgttcgctgacttcataaatttggattacgtaaaaaacgactttcattagtaaaaagctgaagaagagtggtgaacatattgtaccacgacccctcttgttctacacatctatcgaaaagcttagagactaacaatattttatgtaagaaagttgtttttttttattctagactttcacatgataacaaaaaatataacatatatctagctagatatttacataatgattccatagtagaatcatatttttgtttgtgtgaaatgattgtaatgttttcctcatcttgaagattcaaatcctttttttcagaagttgtacaaaccacaaccaaatatctttatcttccacctcaaccattgtttaaagaattagctacaaacatttacggttatcttccacctcaaccattgttaacagttagacttttatgaagtcaacaaattcttaaagacaattggcaaacgcaaaatttagtcattttatccaaaattctaaactgaaacggagccaaaataaaattcagttttatttggtgcctaatttataaaatccaataatacgtaacccacaaatctcgaaccaaactataccaaagaatacccaaaattaatatcagatttgaggcacgtgagatacgcctgctaagatacacacagctcgaaatctgagtccttctcttctttttcgccatcggaaagttcttaccttcgatttcaatttcttgctttcttctcagttcgtcacgatcggagctttttgtccgatctcaaatgcccaaactcctccatttagttatcttcccggtagcatctaagtagcttgaaatccctaatatcggagttgctctctcccagaaaatctcgagaggttcaagtaacgaaaatg

SEQ ID NO: 30617 - DNA, 3003 bp, Unknown
  misc_feature (1)..( 3003): 2750-1469P.txt file - cDNA_ID_3033798; gDNA_ID_2213627; Annot_ID_195925
tcttcttctctgctttctgtttctttgtattcaacatgctttccgctgcgtatagcttcacgttctgcctccccgtctctgatttctccttcgtctttcctgcctcttcctcctcctcccctcccattgactcatcatcatcactctcatgctcagcctcctcttccgtctgcgtcttagactcatcctgttttttttttttgtgatacatcatcataaacaaagattaaatccagaccgagtcatttacaagcaaatggaatcacgagagaagttaccaacctcgatcatagtttcatcgaaattgagaggaccatttgaaggaataataacagggttgaattcgttaaccgtcttcaagctcccaatgaaagaggattcaccactgtaaacctcatcgatgttgaaatccttggccagctcagtcacaatctttgactctgcatgtccaccctggtccctctttggcggcattgtatagtatgggattttacctgcataaccattcatattagagacaatgatgagttaagaaactggttttcaaaaatgcttttacgcttcaagtttacgaggaacaaaaaaagatccgcaccttcattccagtcatgcaaaacaattctggcagcagcatcaatatccacaagaccaccctttttaagtttaccccttacagtggcgactttgtaaaggaaatcatcaactgcctcgaagctcgggattttgtagagagtcaccagcatatctttaggacaaagcttgagaatttccttcactatttttttcacaaagcagaagatttccaagttaggtcactcagattataacctttaaaagacaaagcacaaaaataagtgtgattctatcttgagcttatatccaattacctggactaactgggtcatccaacttctcgattcttttacaatttcggagagctatggaagcatcatttcctgatgatttcaacatcacaactccaggacaatccagcaacttcacgtttttgtccaagtgaacctcttgcagagatctagtcagtccaggagtggcaccaacattgacaacatgcgctctcttcagactgttaataagactactcttgccgacattaggcagtccaataataccaactgtgatagatttttttaactgccaaagaacaacaaaggaagatttaattgaaactgaatgatataacttgatgctaaggtaggatgattaaagtttaaactatggaaccaacctcatgacttcttgagtagttcttcaacaatttgataagagtgtctgctccaagacaatcactcgtctgcaacatattgcttggttttgatgccttagatgatttccaacccaagtttgatctctgttcctgggtgctacacttgaaggcaacagctggaaattcttccctaaggtacataagccatttctcagcagcctctcggggaacaagatctggagagagtgaatcagttacaaaaattaattacaccacccagagtaaacaaacaacttattacgtccacgagtaaagactgaatatatgaacttaccaatcttgttcagcagcaacacaagatgcttattgggaccggcttgcatcaccatcctctccatgtcagtacaacgagtgccaagaggatcacgggcatcaagaacctccaaaatgacatcagacaattcaatgactttaactagctccttgtagaaagccctctccgagttatctgtgaaacaaaagacattagtgcatgtaaaggcagagagaaagcacataaacgcgtgaagaaggtatccaaaacaactcacctcgaacattgacaactttaggtaagtcctctatggtctctccttctgtcttggtatcctcatcatcaaccaaaccaagtttcctctttttggcctgaatagatttattaggagagatcagaacacaagcaccactccaaaatacgagtaaatcaaacagcaagacatgaaaaatgcaatcttttatcaatcaatcaaaactcagaacacaaaggaaatagctttaagaatttcgacctgaacttaaagttatatgattactaaatatctgaacatgtatcatagctgtgagttacaatgttaaaagaatgagattaccctttctttgcgagcttctttcttctgttcaatctcctcaagagcacgggcacgtcgaacttcaagggctttaagctcttgttccttgaaaggccagtcattgggtatacctgggtctttctctactcttggcttacggtgaaggccaagctttttagcatcctttgccttcttcttgtggtgctccttcacctttttcaggaccttatgcttctgcttcaaggtcaccctcttactcttactctctgcaaaaaaccatcaaaccaatcaataaaaccccagtaggaatcctgaactgaatgatatgattcaaattcattcaataagacagatccagaatatcaatatgattgaaggatgtatcttacttttactccgtttcaccatctttctcgccctgggatgagagcgacgcaaacagaaaaactgagtaggttaaaagaaaagggtttatggagaaggaagatggacatatcggcgccaaattagggttttgctattagatgtacttggatcattacccgacccgttatagttgacccgaatcaacttaaaaatattgaaaaaataattggggtgagagaggctcgaactctcgacctcaggattactcagatagctatgagacctacgcgctagccaactgcgccaccaccccgatgttagtaatctttactgattatgtaattaacttcaattgacattcgttatccaaagtcataataaccttgacttggaccagtcacctgaaagtcttgagtttttttcccttaagatcccgccgggctccggtgctggcggttaaacccttccaaaacctgaaattcgtttagcttaggacaaacaagtgaagcccaccatacagaaatg

SEQ ID NO: 30618 - DNA, 3000 bp, Unknown
  misc_feature (1)..( 3000): 2750-1469P.txt file - cDNA_ID_3033825; gDNA_ID_2213627; Annot_ID_195912
ggagtctggagaggttatatatatatgctccgtattaatatatatggaagctagttaactaattataatgtagttctcttcatttaacaaatatatgatatattttttaattttattttttcaattggtaaagatcttacgcgaagcttagagatcgtcggttcgagtgacgtttgagatgaaaataatattatatgctacggtttcggggattacgagtttcggctcaaaaactcttggtattgaaaagaaaaatgatatattttttataggtagttgagtggtttcccttccttagagaagtaatgatggcctgggcacacattaaaagtaggagtttcttgtacgttgatgtactttgggatttggttcttgttccttgacttgagctaggaccagcttaggtatcaatctaagccaacgcatacatttggcgaggaatcgaaagtagctatattagtagaatatatcaaagttatctattactctacactgtacgtattgtctaaaattagatcatatgattatttcatgctgagaattttatacaatggctgctattacgtaccccaatatcatgcttgtgcttgggttggtaataccaacttggtatggtatctcatgaactagttcaactatctgattttagatagttttgtggttacatgcactggatgcacacatgcatgacatgtaaacaaaagatgcaacattctgacgaaatttaattcatctctaagattatagtcttatatatagacctaacatggatagatctttttttggacagaagaattcggacctgaaattgtttttattgaaattaagctaagttataagaaaacttaggtatgtaagtaaactaaaattttaaaattaatttaaaagatgaattttgaagctaaaattaccctcagggacgtgaacaattttttttttttttttctctcatcatataagcgaagaggaatgtaaagtaaaaggcctatgagttaggacatgttccgaaaaggtaaaaaaaaaaaaacaaaggtgagaagcttcggagaaggtaagaatttagaaaggtaacaaagtgactaagcctatatatagaatgttgatacttaaccaccaagcagtgctttcaagctgtcttaaagtttgggacacaaaatactaaaaaaaaaagagagaggcatatgttttagtgaaacaaatatcttctttcttcttgattataagcatatatatcgagctctgactgattctttcattgcttttgtatcgattcgtgcctagtaaagcttcttctttctaacatatattcgtttttcttttccaaaagctttgtataaagatagtgagttttggtttcgattatttggagcatatcgccctataataataagaacgtacatgactgattatttggcaaacttatgattagacacctcctcaactttctctagtgaagtaataaattatccaaaaggattcatagtaaatgtaattagttcataacaacaacatgaacgagagtaattgatatagacaacagaaaaatcatatcccatgtttgggtttaacctggagaacaatcttctcgccttccaagacacttttatttgaagaaaacgattatccttatctaaatatatacacacttttggtttaagatttgaccaatcatatgcggactaattcttctacgatacttatacaggcatcacaatcaatcttctcataaggaactttatgcaagcccatgtgaaaattatacttactaaatttttttttaaggagtaagcttcttcccttttttctgtggagactcattgattatgcatttctttgtttgagattcattttggaataaggtgaagtaatgtaaaaccataattatttaactttttacaagaaatatccactgtttttgtgtttctttgatatataacacaaaccaacgattgatttatcattgtcgtatgcattaataaggtacgtagagaaaaacacacataatattcaactcgatagacttgaccaatgaggattatatttattgaaatcacatagaaaacacgtactacagagacgaaaccggaaaaaacaaacaaattttcttccaaactactacgtactccaagagctgaagagaagaataagaaggtgatggaatcagtcacgagtctcgtggaaccttttgatgaaatcagtggatctccggttaatagctggttcaacgaggtaccaattatagaagttggcttcactatcttcaccatacatctcatcgtccgttcctgcctggttcgatctctgtctccgtcgccaccacgctttgaaactgccgaagaagctaaagaagaaacgccacgaacctcccattatgatgttttagagagagggatgtattttgcgtgtgtatatatatctaaagatacagaagcatgtgaaggaaggtgtgtctgatggtttagggttcaaaactcaaggtccttttatatataagcctgaccaagttggaatcctagaggaaccatgcacgaaacaccccctaccaaccattaaaaaagaacttttctcttctaaacatttgtatattattcacaaagaataaagattaaaaaagcatcgagatattatgtgtcgctagctgcggttattttaatcattacatagacactggtaattccatagcaaacattgaattttaagcttttgaggcaaatgaattgatatgaatttctaaagttcctagtttctttgttcctactcttttattcaaaccgaataattcaatccataaccggaataaatcgattcttttaaccgttagacgccttctttgttctttaagccggtttaattaaacgggaagcattcttcttatgaaaaccaaaaacggcaaggtgtttatcgaacaaatccagagtaagagtgtgtttggtcatctccaggtcagctgggtgtagaaatcgagcgacggcggcggagacgacggagatgaacagaatg

SEQ ID NO: 30619 - DNA, 3000 bp, Unknown
  misc_feature (1)..( 3000): 2750-1469P.txt file - cDNA_ID_3033833; gDNA_ID_2213627; Annot_ID_195910
gatgttacagaactagtgatggaaatgggaatttttgggatattttggtttctttcgactattgaatagctaatttgttttcctctgattgaaaattttatgtatgagtgagccttgagccttcaggtttggaagcacgggtcttttttatgatctttttggtgctgttactaagagtttcattaatcccacaggctctgtgatgaccgcagcatttggtgaaaattcaatcagatcaaaatttgaaaatgattctgagggtgttggagggttctctcttcattttccatctgtaaattccggattcatggctgatgccttagggcgggcatcactcacagctcaatatggaaacttccagaaattcttctttgatctcacccgtttccatgctagattagactttccgcatggtttgaggtttcttaccggtgccactagcgtcgcacaagatcttttaaattctcggcagcctagtttagaagcatttcagaaaatctgccctgaagtattagtttctctacagcaacaggtaaaataaacgatattctactatgagcaaacagtctaccagacacagaaattctcaaattcatagtttcagctacttgattcataacaatcttctacgggttttgcagattgttggaccgtttagtttcaaagtggagtctggaattgagatcgatctgaggaacggagctaaccctgtgactgtagataagacagtatttgctattgaatatgctcttcaagtgcttctttctgccaaggctgttgtttcgtactccccaaaacagaatgagttcatggttgagcttcgtttctttgagacatagtatcaggattttccactcaaaatgtcaagcttgatcctgtgaagattgtagtcttgcagagaagtaaatactaaatagacaatgttctaattgttcagtttcttatgtcaaacagaagaatgtttcaatagaagggaagtttacattttgttatagtgtgatgtctaccagaactagtaacaggacaatccaatggaagctttagatgatcttccttatacttaacagacacaagacaaagaccatgaggcgacgcaggcaaactagtatactttgcaagcaccctcctgtctttggtttcgagaatcattgggacaatgtctgaatccagtgcttcttttccaatctgaatcagcaaagctacctgcatatgtaaagaactttagactaaaaaaacattatatcgccatgtcaagcatgtaaaagagagtgtagaactaaccatgtttctgacttgtctgtacaaaaagccagaaccttcaacttcaagctgtagaagagatccctaaacaccaaaacaccaacaaggtcaaagtctgatccttaccctaacttctccagaactaagatctttcttctttaccatttgaatgacatcgaagcgagatatagttttcaaaggatcaggtactccatcttcccgagtagcgttagcaaatgcagagaaatcatgctttccaacaaaaagatttgcagcttcccgcattttagaagcattcagtttataagcacagtggtaagcccaatgacgctggaacgggtccatgaaagtgtcgttgtatatctggtagcgataaaccttgctagaggcagaaaaccgagcatgaaactcaggaaccgctgcactcagctctctgacacggatatctttaggaagaagaccgttcaaagcagcgtgaaagctatccaaactagtatagttgaaaggagtgacaaaatgagctacctgaagaataacggatgatttagtttgtgttgagaagttgagaaagagagagttgtgactttagtcaaacctgaccccaagcgtgaactcctgcatcggtcctgccagctccaataagctgaagctcttttctaccgagctctgtaatctgaattaaggctttttctaacattgattggatagttggtggtgactcctgatactgccaacctgagaaaccaaatgcgcggatataaggaaacaagattttgatagatgcatcaaaaacttaagaacacaagttttgtgagaagacgaacctgcaaaacgggtgccatcgtaggctatcacaaggcgccatttataagcaccagaatcactaacctttaccgaactgttcaagttggtcatctgcaaaaataaaacaaaagttcagattacatcaccaacaaaactttcttggcatttccaaggaagtagagaagaagaaattgcttttgtggcgcttacggagatattctgaggagacgaaagatacccattagtaaagagtgaaggaggaagtgctggtgtaacgcaactcatcctcttcttcttcttcttcttcttcttcttcttcttctttgtttgctgccctgtctctctgtgtaatctcaagattctgattagggaaagactttaaaacggtgcgtatacggttagttagggagcggtaaattggtcagaccggaccattggttattagattgatttggtttaatgctactctaattcttaggttctttctaaacgcatcgttttgatatcacccttttctctctgaggccgtacgtggaagtttcaaactctcaccatctcctctctctctctcggtctgcagaagaaaaaaagctcggcaattttatattttcccatcgaagagattcccaattcttgagctttctcaatcaggctggcgtaataaacggtactccaatgtcttctttctgaccctagatttaacctggttcagttcgatagtagggtttgtttcccccttccgatcctcatttctgatgtcagaattgtgatctagtattcaatttcagattcttttttggaaattagggttcataacttaatagaagtttttaaatttcgtacagtggccatggcgttggctgattttgataaaattgtgtacattgaggtgtgatatagagcctgatttggttttataggtatcgtttggtcatg

SEQ ID NO: 30620 - DNA, 3000 bp, Unknown; identical to SEQ ID NO: 10151
  misc_feature (1)..( 3000): 2750-1469P.txt file - cDNA_ID_3033837; gDNA_ID_2213627; Annot_ID_195909

SEQ ID NO: 30621 - DNA, 3003 bp, Unknown
  misc_feature (1)..( 3003): 2750-1469P.txt file - cDNA_ID_3033841; gDNA_ID_2213627; Annot_ID_195908
ccttattatgctggcatcactcggctttcagttgcagaatctcctttgctgtcctagcccggaaatatggcatttgttcctgtggaaatcatacaaacagtttcaattataagcagtcttacgtctttcaaaatgacactcacctactaaagacaatggcaggtttagtatctttctgctatttacctgagtgaaacaaagatccagacctctgctatagaagtcgatgtatttcaccataaacattccacaatcgaatctacaaaaatcggagacaaagttattatgaatgtatgaactagtagtagctgacatcttttttaggaagacagtacccatttctctgcattggaaggtcctggacaaattcttgtctccatcgacttacatcaaggtctacttcactcttatccctcacttcatcgacaaagtatctagcctgacaaatgaaaaactacagaatcaggatatatatgttatgacacaaaacatggtttccttactcatatattaccagtgcatcgaggattttaggctcccttcctttgaaagagtcaagatactggaatttctggtcctttatattaattacagccaaagtccagtggatgttcatatggatagggataaatatctgaaaacaaacaaggtctcttagatggtaaaatgaaaaaaaaatgtttgattatctcaaaaaggagtttaatacagagagtggtcgcagaagaagcacacaacaagtttaccttgtcacagtctttgagatggtagcccaacctcttcattgaagtccatcttctcactgcaccatagttgtatccagtcgccgaattaactaactgaggtgtgatttaaggtaatgtcttcttgttaatattcatgagcatatataggggctaaaatttaaatttcattagccatagaaatgggtataaccttagtgaagaaaaatgtattgaaaaaatgacatttaagaaacttctttggttctctagcttccctttctttcagcaataccatataaagattaatgacctacatagaacaaagtccaaggtttttaccaaatcatagaggtcctaattagacaagaaaattatattcaatctctaagaagaaatcacgtgagatttagatgcgtcgactaacctcatcgttcaaccatttgcctggtttaaggcacctcaagattttcccggtaatatcaatatttgagttcttatgagtaaccaagatgtttctgcagcgagagacgttcatacaattacatcacaaaaacaaaaatgaaatctcagagcaagtaaacaagagagcaagaatcaaaatcatacgaatcattagctgagaatgcacgcctgactgctgtctcctcctctctagaaagaggtacaaatgcctcacgttgtacaacctgaaaatcaattatagaacaatgaggcaccccgatttcacaaaatctaaagaaaccgaccgattcatatcacaaagcatacacgcttaaactttagccacacctctactggttcttcatcttgtctccaaaaggaagacaagcttcgtagtaaagcacgacctctctctttaaaaaaatcaacaaagcctctgtctttcagtttagaagtccggttcacagcactctcaagaacctttctgtatgcttcaaaacttgtgacatcagtcacagggcgattcacaacgagtgaactactattagctttagaacattcacccaccctcaagctcccatttttcagactggcaacctcagaaaacaatccatttcccatctccgccttctcttccacctcgtccacctccatagccacgttttcgacaccctccctacttgtatcatcagatatcatttcaacatctccaagctcatcatcaacatcaattacttctctatccgttctatagcgtaaagacgaatcaagtgcatttcttttccacatgtcattgttccttgtgagaaaggttcccaacacattaccagaaccttgtcgtgtgctacgatctcgaccgctattgagtatccgcacaggcgcatgaacttgtctccgcaacgaagatttcacttctgggtaacggtaaattcctggagccatgggtcttgatgaatgtgagaaaccggagtgtttacaagggtttaaaccggcgctccgtttgtggtaaccatccatatccattggtctgaaacagtaggaaccataaccctcgaaattcaaaatttgatcccacaaaactgaaaggtcaaaatcccccaattcagagttcaaaaccctagattggtttttcatgaaataactctcgggaagcaagcaagtttcaacttttcattaaactcactggcgtttccgatacacagattcggacccggacatgagacccgggcgggttttgttttggaagagataggtcaaactcaaatatgttgacttatctcataccctctagccgaaagggaggtttctgggtcatgttgtttcttactcggctaaacctatgttttttcttctcgttaaaccctctctgctctctgttctcctgaaagctgggcttttcacttcagaatttccttaaaaataaaagctttgatctttttagttattatcttcttcgatcgtgttaaattttgagacaaatcggtgatttggaacaggaaaatcaggaagatgcggatgctattaagaccaggtaatctgtgtatgcgcatttcagtttctgaaaattttcagtgtttaatctgctcgattttgagctgaattctggtcgtttcttcatagtattgtagcctggaggttgataactcccatatgaactattctatggtgggattcgctagaacaaaatgttttttttttttttgtttatccgctcattagtttgatcctgatttgcgttatttttgtcttatcactgcaggaattatattccatacagatacaaaatcatctcgtgttgtcacagtttgtaagaacttatcatctttatctgataatg

SEQ ID NO: 30622 - DNA, 3000 bp, Unknown; identical to SEQ ID NO: 10147
  misc_feature (1)..( 3000): 2750-1469P.txt file - cDNA_ID_3033845; gDNA_ID_2213627; Annot_ID_195904

SEQ ID NO: 30623 - DNA, 3003 bp, Unknown; identical to SEQ ID NO: 25272
  misc_feature (1)..( 3003): 2750-1469P.txt file - cDNA_ID_3033892; gDNA_ID_2213619; Annot_ID_180909

SEQ ID NO: 30624 - DNA, 3000 bp, Unknown; identical to SEQ ID NO: 9740
  misc_feature (1)..( 3000): 2750-1469P.txt file - cDNA_ID_3033896; gDNA_ID_2213619; Annot_ID_180906

SEQ ID NO: 30625 - DNA, 3003 bp, Unknown; identical to SEQ ID NO: 25275
  misc_feature (1)..( 3003): 2750-1469P.txt file - cDNA_ID_3033900; gDNA_ID_2213619; Annot_ID_180903

SEQ ID NO: 30626 - DNA, 3003 bp, Unknown
  misc_feature (1)..( 3003): 2750-1469P.txt file - cDNA_ID_3033918; gDNA_ID_2213619; Annot_ID_180896
caggaagcatcgcgtcgtctcctcttgcgttgtatcgtttcagaaggaacggttcatcggagaggatctcgatgaagctttgttgatgatgatcggagaagaggtggttgtggatgtaagagaaggaatggagagggatacagtgttgtgagattaaagcgaaatagagattgttaggatcgtcgaggattgcgtttgctagtaatcgtcgttcggcggagattaacgtcggagaagctcgtgcggttcttctcgccgggatgaacttagcgttgattgatgaagaatcgagaagaggagagacggaggaggttggatctgcgtggatgtaaacgttgtagagatcttggtgaccttggaagaagctttcccagagaggtaagaaggttagatcggagtttgttaggaagaggaaagcgatctttgggggtggatttggagagagggagatgagacgacggttgttgttggtggaggaagagacgacggcgcggtggaagagagagaggtcgtctaggtcatcggcggtggaaatgagggtagaggaagagagaaggatgtgtggtgagaggatgaagaggaagaagagaagagaaagagagaggaagagagatagagaataaacgagtgtagaagatgagaacatctctctgtatacaacaacacagaatttctctgaggaagaagaagaagaagaagaagaagattgattgaaatgaatgagttagaaaaaattctgatgtgacaataaaaaggaaaaaggggaataatgacgtcagcaaaatggggacacgtgaaattatttttaaaattatttgggacaatcgacacagttgctctatcgctatttgtttacgtggggctgttctctctctatttatataataatgagatacggttttttcagcaaccagattttaaagttatctgattaaatctaataataggatagagatagagtcacagagacatgttgttgactttatgacattattttattctttgcttatccactcagtcatcatttatctcaccagtcagacataatgtgttgttgttgtgaatttgtagatgcttccgactatacctgattacctggccattcagaatcggtttggatcaaaaaatttgggttttcggtttagaaatcgaaacaaaccgaattagttgaaacgaaccgaatagaaattcggccaatttggttttgcattggcgtgtaccttgtgactacatgtgtgtgtgttagatgagatctatccacccatttttcaaatcatttttgtcgttaagctatcaagattctgatattttcctgctcacttttgattcccaaaacaaaaaactttcttcaattattctattcatcttctcatggcggctctctccaccaccttctactaccacccactctgcactaaccaccgtacaaagagacaagcctcaagcagacacggagttagatctatgagagtgatgtcttgtcggaagcagaaattaccagaagagaatgaaggagtgatccagagaacattgagaaggatgatttcagaggctgggaagattgggaagaatctgaagccagagaagaagaaaggagacgtcaaggacctgatgcttatgagtctctcttttgctgtttatgtttatatctctcaactattggtttgtgcttacttctcctggcaacatctcagcttccccaaatcttcatggtagtagctaagctagctcctccttgtaaattctgcacaaatcagtaataagataagaaattcaattccgacataggagaattgagagttgtgatctttcactttggtcttatataattgaattgttaagcttctcatacctctttatctgctttaactccggcagaaaaggcaaaccaaccattgcgataacactatcaaccagttaaggctctttgttttagagccgaaaggagatgcaagagcctcgggcagagtcgctgagtatgccttgaaaaccaaaactttgaccgtaattgttagaaagaaagagagattcctaaccatttcgtattggcctcctccaatttatcctccttaaacagagagccccatccattttccttctgtgtgctgcaccaaacctttcctccatagtcatatcactgcgagcttttccctgtacaatccaacctctaagtcagctataagcaaagagcttgggataaaagcttggttgtggagtgttcaggtaaggaaacaagaatcagcaaatgatcttaaagaaaaaacgttcctcctttgtttcatcaaatccaacaacttcagcgtcatctaacaattccgctatagatggaacattgggaaaaagaagagtttccatctctcctatatgctaaattcccagcaaacatgcaagagcgcacgttcaccagacttgatgctggaaacaccaatagctaaaccggccattacttgtatctctgttcatagaggacatttcactccttagtttttaatcttgtttaaagctctgtatactaacataaacatgcatgaatcagctttaaagcaacaaaagaaagaaaggaaaactcaatttctttcctcccaaatattctttttcattaggttcacatgaaacgcaagatttaagacctcagctttactatcaactttaggtaggtaagactacctaccattttgagaaggctcacaatgcaaaaatggaactcaccatccttgactgattcggtttcagctccagcaaaccaaagtgtttctaataaacttggccgtgcattgaaccacggagttccaaaatcaatgtctgtttaaatcattggccccagaatttgaactacacacagagtcacagacattcattacgatggttgaatgaaatggtcttgactaagaagtaagaacaactatgcacaattgagaaactattagctcgatttccagaaactatcactatcgtaatataaaagtcccaggatcgaccaaatcggacgagaaagactcaatg

SEQ ID NO: 30627 - DNA, 3003 bp, Unknown; identical to SEQ ID NO: 26543
  misc_feature (1)..( 3003): 2750-1469P.txt file - cDNA_ID_3033924; gDNA_ID_2213619; Annot_ID_180892

SEQ ID NO: 30628 - DNA, 3003 bp, Unknown; identical to SEQ ID NO: 26544
  misc_feature (1)..( 3003): 2750-1469P.txt file - cDNA_ID_3033930; gDNA_ID_2213619; Annot_ID_180890

SEQ ID NO: 30629 - DNA, 3000 bp, Unknown; identical to SEQ ID NO: 10017
  misc_feature (1)..( 3000): 2750-1469P.txt file - cDNA_ID_3033943; gDNA_ID_2213619; Annot_ID_180883

SEQ ID NO: 30630 - DNA, 3000 bp, Unknown; identical to SEQ ID NO: 10037
  misc_feature (1)..( 3000): 2750-1469P.txt file - cDNA_ID_3033947; gDNA_ID_2213619; Annot_ID_180882

SEQ ID NO: 30631 - DNA, 12 bp, Unknown
  misc_feature (1)..( 12): 2750-1469P.txt file - cDNA_ID_3033969; gDNA_ID_1974083; Annot_ID_180484
agacggaagatg

SEQ ID NO: 30632 - DNA, 3000 bp, Unknown; identical to SEQ ID NO: 9835
  misc_feature (1)..( 3000): 2750-1469P.txt file - cDNA_ID_3033973; gDNA_ID_1974083; Annot_ID_180481

SEQ ID NO: 30633 - DNA, 898 bp, Unknown; identical to SEQ ID NO: 9833
  misc_feature (1)..( 898): 2750-1469P.txt file - cDNA_ID_3033995; gDNA_ID_1974083; Annot_ID_180461

SEQ ID NO: 30634 - DNA, 3003 bp, Unknown
  misc_feature (1)..( 3003): 2750-1469P.txt file - cDNA_ID_3034033; gDNA_ID_1974085; Annot_ID_180531
catgaataacctttggataactattatgtatcaaattatttaggccgtggtcaacgaagattccaacgaggatgtcctggaattacgccgtcaaatccgacttttaaaggcgtgtaacattttaaactgccgttaggtgctcgttatgtgaagctgtaataacgctaagacaattttttgtgtctgcggaacaggaagagctttccctcctcaagcgccagaacatatccagggcgttgtcatttggatcagcaacagccaacttcgcagaatcacaagtcgattcgccatcaagtgtaatgcatgagacaggacaacagcaggctggtaacttgcttgtgtatgaatctggaggctgtgtaaggatgtctagaaagcaggtatatcaacttgagaaagtatgttaggctttactgaggattcatatgcctctgtcttgggattccactaaaaatctgtatatgtttatatatcagttgaaatctttggagataacacttgctggctcattaagacgagaacatgtggctgatgcttcaattaagaagcttgaagcggagatagagcatctaaaccgtttggtaattctttttcacctacactgttcccattcccacttatgtttcagatatcgcctgaatccatttatgatcatttaactttaggttcgacaaagggaggaagatactaggagcacaaaaatgatgctcaggtttcgagaagacaagatacagaggctagaatcacttcttggcaaccatatatctgcagattcttttttgctggaagagaataacgtgttgtcagaagagattcagctgcttcaagctaaaattgataaaaatcctgaactgactcgctttgccctggaaaacataaggctactggatcaacttagaaggtgataaatcttcaaaaacatgtgatgccgacgttaaagataatgtgtgcttttttatatataaaaagttttgttattatggtacttgcagatttcaagagttttatgaggaaggtgagagagaaattctactgggcgaagtctcaaatctgcgaaaccaggtacctctagttagcacaacatcctggtatcgattcattcttcttttcgattgcaataccatccttaaccttagctattgctcatgcagctcttccagtttcttgatgaaaactctgactggcaaaaacatgttgatgatggaatagagccacaggttacatctatttacctctttctatatgttaatatctcttaatatccagcaggattgtgcttcattggttgcttgtcaataatatcttgttgtatttcgtatggcacagggtgcatcacgtatgagcaaagaaaattgttctctacaggaggaggtcgagtcactttctttctcttgtttcttgtgcatcacgtattttcaatttcattttcttaacgtcttttccattgcagttaaaaaagacctgttacgagcttgagaaatgcagaagtaaccttggttcttgcctggaagagaatgcaaagcttagtaggttagcaaatctgatttgatgattcttgggtttttcctggtatatggccaaatgagttctcattttccccataccctgatgagtcttctcgccattctcctgcagagaaatcaatgatctacaagctatggtcagcgatatcagagcttgcacacctgatgaacatagcagtgtgaacaaacaaaaggtttgaacaataagtacaatgtgatttactaatctgcccaaccatctgttttgttgtttctgcaggttaaccttgagcgtttcacttaacagttgaattttgtaaaaaaattgtaggcgctgttggggactcaaaattttgagccgcacgaaacacttgcttgtgagcaggccaattatgtcgaagaaatcatcaaactgcagcttgatctggacgtacaaaaaattatacttgatgaggaaagaacactacgtggtgatacagaggcacaagcagttcgcttaaaatttgatattgaagtgttgaaggaccaactacttttgataagcaagcagcaaaaaaatgtttatagcgagctgggggagacaaagtctgcagttgcagctctcgaatcgcagaacattatattgatccaagaagcagtggagttgaggagaataaaggagaactattttgagcttttaaaaaagcaagagcttgatatcccagcaatgaagtccaaacagtgcgatgagttcaaagataatcctgcagaggacagtgaaattgatacaaagtttaagaagatgcaagcatctcttgaaaaagctaagagattgaacatgctgtacaagagtgatatcgcttctaaggcatgtggagatgaagaaatggatgaagtttgcaagcaagctgaagctgcaactgctgaggtgattgtctgtttgcagaatgagcttgaagttcttcagaaggaggtcaatgatttccagtcaaaagaaaacgtgactgaaaagcaggtagagattttagaaactcagatggaggagctgcaggataaattacgagacacgaccatggataatgagcagttgcaagaacagctcagaggcaaagacatggaattactgatcatatcaaatgaaatggaacttctcacatctgagcttgaagaaattctgctgaatgggaatgaaggccttacagatgcgtgttaccaggctgatcttatttcgggttccttaccagataaaaggatatggatatctgaacaggttggaggattaataagaacactttctgagagggaattaatgattgaagatcttgaaagctgtttggaggatgccaataaaaagcgatgtgatatagaatccatgttgaagtctcttaaaggggcagcaatagtaatgaatgaagcgcaccagagagagttcgaggaaaaggagacagatgttctcctcctgaaatcgcagttgtgcacaaaaacagagacaatattaaggcttcaagagaagctgaagatg

SEQ ID NO: 30635 - DNA, 3000 bp, Unknown
  misc_feature (1)..( 3000): 2750-1469P.txt file - cDNA_ID_3034041; gDNA_ID_1974085; Annot_ID_180525
aagtgtgccggtggaggtggcggtggttcaaacccatcaccaaaaccaacaccaacaccaaaggcaccggagcctaagaaagaaataaacccaccaaacttagaagagccatctaagccaaaaccagaagaatctcccaaaccacaacagcctagtccaaagcctgagacaccatcacatgagccttctaacccaaaggaacctaagccagagtcaccaaaacaggaatctccaaaaacggaacagccaaaacctaagcctgagtcaccaaaacaagagtcgcctaagcaagaggcaccaaaaccagaacagccaaaacctaagcctgagtcaccaaaacaagagtcgtctaagcaagagccaccaaaaccagaagaatctcctaaaccggaacctccaaaaccagaggagtcacctaagcctcaaccaccaaagcaagagacaccaaaaccagaggagtcacctaagcctcaaccaccaaagcaagagacaccaaaaccagaggagtcacctaagcctcaaccaccaaagcaagagaccccaaaaccagaggagtcacctaagcctcaaccaccaaagcaagaacaaccaccaaagacagaggcaccaaaaatggggtcgcctccattggaatcaccggtaccaaatgatccttacgatgcatctccgattaaaaaacgtcgtcctcaaccaccatcaccctcgacagaagagacaaagacaacgtcgccacaatctcctccagtacactctccaccaccaccaccaccggttcattccccaccgccgcctgtattttcacctcctcctccgatgcattctcctccaccaccggtttactcaccaccacctccagtacactctcctccaccaccaccagtccactctcctccaccaccagtacattcaccaccaccaccagtccattctcctcctccaccggtccattcaccaccaccaccagtccactctcctcctccaccagtccactctcctcctccaccggtccagtcacctccaccaccaccagttttctctccaccaccgcctgcaccaatctactcacctcctcctccaccagtccactccccgcctccaccggtccactctccaccaccgccaccagtccactcaccacctcctcctgttcactcaccgcctcctccagttcactccccgccgcctccagtccattctccaccaccaccagtccactctccaccacctccgtcacctatctactctcctcctcctccagttttctcaccgccaccgaaacctgtaacgcctctaccaccagcaacatcgccaatggcaaacgctccaacaccttcatcatcagaatcaggagaaatctcaacaccggttcaagctccgaccccagactctgaggacatcgaagcaccatcagattcaaatcattcaccagtgttcaaatcaagtccagctccatcaccagattccgagccagaagttgaagcaccagtaccatcaagcgaaccagaagttgaagcaccaaaacaatcagaagccaccccttcgtcatcaccgccatcttcaaatccatcaccagatgtaactgcaccaccatcggaagacaacgacgacggcgataatttcatcctcccaccaaacattggacaccaatatgcatcgccaccaccaccgatgttcccaggctactgaaccatacatttttaatattttacattttggtccaacatttttccggttaacgcaatttgtaacaaacaaaaaaaaagatacatttataatttgaccatttgtaatctgtaagtagatgatttttagaagtgaatattttcaaaattaaccattaacatatctgtaattctaagttttatacttttatagtgtaaattcatcacattctttgtgtctacttctctcaaaaattgtcttttacaaaaataaaaaaaaaattgttcaatgttcaaagtataaatatccattcatattttcgcactgtttttaatatcaacagaaattttcaactttattttgacatcttagaaaaatccttaattgagaattgaaatattttagtttatttagtggtcaacgtcaacgtgacttagatcgttgatttatttttcgttttccttaagcaaaaacctatacttttatttctggtctttattggcaactatcacattttcaactttcaatatttcgactcatcaatcaccatcttcgaatagatattttctttgcccgatgggctgatcggaacaatcctctgaaaaaggtaccaaaatgctactatgtagactaacatcaatacttagatgttggactactttaacctaagcttaaaatattttccgactagttaaccaaatcgtttgttcatatcatggtcaagtaaccaaatcgtttgttaatacttaatatcatggtcaaataggttaatatccaaaacgattccttagtttggaatagaagtacagtaataggtaatagctaaactccatctatgttcaagattaaaataagaatagtgttcagctaataaacaaatattgatgatttagttcaactttcaatattgatttagtttctatggtcttattcctaatacaaacttcgactgtaattttactatattttcaataggtgtttttttttttaataagagtgttaattacttcatgacccgaccccgacagatcctctgaccggcttaattattattactcgttttaaaaatcattcaacgaggaaaagtctcggtactttgagcggtcgtcgaagaaaacgttgtagttttagtatcttatatcattaacaaaaacatatgcatataaaaacaaaacaaaatcgatttatgtatcctaataatatattacttaaaaaaagtagtggtgtatataattagcacattttcgttgtagatatccatccaaagtccaaacacagcataaaagtagctctattgactttttttcttcctccaaactctttttacgtcaagcaatg

SEQ ID NO: 30636 - DNA, 3000 bp, Unknown; identical to SEQ ID NO: 9839
  misc_feature (1)..( 3000): 2750-1469P.txt file - cDNA_ID_3034045; gDNA_ID_1974085; Annot_ID_180524

SEQ ID NO: 30637 - DNA, 3003 bp, Unknown
  misc_feature (1)..( 3003): 2750-1469P.txt file - cDNA_ID_3034059; gDNA_ID_1974086; Annot_ID_180563
gataaaacaaaagggtagaattgaaaaggggcatcatgaaaacggcagtagaaagaatttttctaattgtaactggttcaagaaagatattttctataatgaaagaaatcttataatttttttaaaaaagttacctaattaagaaaatctctctataaattaataaatattaatttattgataaattaatacctctttaaattaataaaattttgcaatcccaacattattaatttatagaggttttactgtatatgcttctataaatttgttatgaattattattgcctgaagaaactacatagtacttatgtttggctttataataggttttaaacacaactcgaaaatcaaatgggactatcttcgaggtctgtggatcaaactggtctaattattggtcaacgactttttagttttttattacaacttacataaatatatttacatatatatatatatatatatatatataatacatctaattctttataaataagttatatatatatataattctacgtaaaatgtaaatatatcgtatattaaaaagcattccaaaaataatttatttttgttgccaaatccaagaaataaagttagttttcttataagaaattagaaacgatgatttgttctaaacagaacgggttttaaaacaataaaaaaaaattatctttcaacctggagaggttaaaagttaaaacaaaattttctaggtacattaaacatttaaaattcaacataattatatataaataaataaatatgctttaatctataataagcttacaattttaatttcaaataatttaatgatttatattatacaaataaagttgcaattagtcatttacaaaattaagcatatatatttgcagtttcaatttaaaaacttataatatatgagaattggttagtgatgaaatgtgataacacgtcatttcacccgttttacctattgtttttttttatgttttagggagaatttggtgccattttagagctaaggagatgataaacaagtattttgggagtcaagaaagttttaagagttttagagtaaaaaagacgaaaagacgaacaattcttgtttcaagacaatttatgtacttcagaattttgtcatttgttggagacctccacgtgcatcaaatttacatatcagtgtttatggaaatttagtagagtcaagatttacttctatttggaacgaataaatctataaaggtgttcggaataatacgacccggagaatgaagacatatgcgagactggctgtagtgcgaagcaaccgttctggagcctcaaggtcagctcggttatgaaggcccgtacccgggcagtccctcacacttcccacatgtcacttgaccttgccacaagtccagaactcggccaatcacttacccaatcaacgaaattgacgtttttacccctaaactgactccttggtgtgctttcttcttgtcttcatcacaagcgaacctagctgctgccgtgagcctcccagctgccgccacacctctccaagcctggaaagacaccaaatctctatttttctcttgttttgtctaaaatctactaaggtgaagtcttaccttttatattttacattcaaagaagtaatctctaaactctatttaagtcttattcatctctttcttatggtattatcaaagcaacctttgatgagttacttaaccatgctagagtaatcctctacttgggtttagagggctaatcaaagggggatcgatgatcgtttgtctctaatgcagattagagaaatcgccatagagaaaatatatggttcttcatgcttgacaaataatagtatagtagtatcagggtcggcttagagaaaagtggaatcctgtagccattttaaaaaatatatttatctcgtatactatatatactatatgtatagatttgggcattttcgtataatttcttataccctagtttcttaaagaaatctgactaaaaaatactggactatgtgcaaaaacaccctttgcacaccctctcagccggccgtaagtatgttgtattagatttctactattttttagtgtttaatcctcgaaaaataattttggatctattatattttattttttcatttttaatgggctttttgtatcagaattctgtttaaaacaaatggacttatgatccgcagacttctgctccaccaatttggactaggcctataactgtagcaaaattaatgttatagtatcatcccaccccaaggtttgattgaagctgatagaatttcaaaacaacggaaatattgattgactttgtcaaattttgaataaaatgatacgtcaaacagaagaaatgtaaatttgagaaggctgaaccacccacagatttaggatagcggtaagaaatcaaaaactttgaaagcaattaaacatgtaaagaaataaatatattttaaaatactgtagaatcctagttacgtaggtataacaacattaaataaatgaggtttcatcaaaggtgcaataatctcagattatctcaataatttttgtaattatcgtcaaagctaaatatgttgtatatatatgcatatttttaatagatttattacttcattaaacagctcaccataagagggaaatagtacttgagcaaaaataaaaaataagagagaaagagtatgtaacatatggtaaagcctctactagacagaaataaaaatatataatagtaacaaattataattaacgttacaaattacatattgaaccaataagcagaatcaagaagatcagcccacaggaacaagtccgtgggtttttaagtttcaaattatgagggcatggacttttctatcagcatgtcatatctctacactatatataccatatacgtattgattctcttttcttacacataacaaaaccaaaagaaaaaaaaattcatattgaatagtaccctgaagattttatatatagagagtagaaaggatcaactgaaatg

SEQ ID NO: 30638 - DNA, 3003 bp, Unknown
  misc_feature (1)..( 3003): 2750-1469P.txt file - cDNA_ID_3034070; gDNA_ID_1974086; Annot_ID_180558
accaaagatatggcccggttttggcctaattcatgaattcgaagcccatattatgaaatatatgtgggttgtggcgacgaggtaattttattgtggtatgcggtgaccctttttccgtgacaaacaaatgaaaacttacaaaacttaaggttctagattcggatggacccagcaaatagacaaacgttgccgtctttttctcgagacaactgtaccttgcaaatagattagtagctgttgatgaaagtcactaaattaaattattcatttttgcagattaataaaaaaatattttgttgtaactcttgtcttcgttttcgctttattttattcagtttatttggtcccttgaaaattacctttggtttaataaaatttattttaaataaactgactaattaaaaaaaaaagaaaaatgtcaatcctaacttttaaattatggctacatatataaaatattcacatgtgaagctgatttataaagatcataatttgaaaattgagatattaaataacattttctcaataaaaaatcatcataatacttgataatagtttttattgttttggatagaagtggatattcagttattcggttcaatttggttctgactattcaaattttttgttttcaataacaaaaattgatctatttgaaatataattttattttggtttgatcgatttgagttttgattcggttttttattaaaaaaaacttatagctaactagtttgagataagggaaaaaccccgaaaaaaccgttatctaattttttttggccgtttaatacgtgtagtattaaatttagaataaaaatactttatttaatttcgcttgtctttaaaaaccttcatttttaaaaaattggtaaaatcgtatctccgacttaacgattgttaactatgccaacggaaatattaactgcggttaaaacttaacccatgcggtttatgtttatatatacaatctattttcaaaattttacgattaaataaagtatttttttcaaatttaatagtaaacgtattaaacagcaaaaaaaatttagatggcagcttttttgggttttttccttttaagataatattaccgatttttagtcaatatcagttaaacagttcgcctttcaatatttgattaagactaggggtgtcaaaatgagtcaaaattcatgggtcaactcaactcaatccatgaaccctaatgagttgaaaattttgactgaaatgagttgatgggtcaaatgggttgatgagtcaattggtttgatgagtaaaatgagttgggttgtaatggttaatggtttcaatggtttacccaattaacccatcaaattttgtaaaattgaattaaaccaactaaaatctctaaatcaatgccaatttaagtttaaccaacacatctaaaccaatttaataaaattaatatttttccaaatttcttaaatatacaagcgatgaaattgagaaaaaataaactcgtaatttttccaccaaaaaacataaacccatgatttttccaccaaaaacgtaaacccgtgattttcccgccaaaaacgtatatccataattttcccgccaaaaacgtaaacccgtaatttttccaccaaaaacgtaaacccgtgattttcccgccaaaaacgtaaacccgtgattttcccgccaaaaacgtaaacccgtgatttttccgccaaaaacgtaaacccgtgattttcccgccaaaaacgtaaacccgtgattttcccgccaaaaacgtaaacccgtaattttcccgcgaaaaacgtaaatccataattttcccgccaaaaacgtaaacccgtgattttcccgccaaaaacgtaaacccgtgattttcccgccaaaaacgtaaacccgagattttcccgccaaaaacgtaaatccgttatttttcgccaaaaacgtaaacccgagatttttccgccaaaaagcttaaacccgaaattttccagccaaaaaatgtaaacccattattttccggccaaaaacgtaaaaacctataattttcccgccaaaaacgtaaatccgtgattttctataccaaaaacgtaaacctgtaaaaagtggaatccgtaaatattttaagtttgatgataatgaattaataatgataattatttattattgttttataataataattaattaaattattacttaatgggttaactcatttaacaactcaacccatcaaattaaatgagttatgggttgacccaacccattttgttaaatgggttgggtcaactcataactcatttaatcctaaactcatttgattatgagttgagttgagttgggttacccattttgacacccctaattaagaccatgtttagcttatttactgtaaaaatttatatactatttggattgttttaatatttattttagcttgggtaaaacaaaatcttctgttcagtttagtgacttctgttcaatttttaattttagtcatcagccaaaagtcactgcttcacataccataatattttctttatatatatatttttaattattgatgtaaatattgtctttaaatcagcagattttcctattattaatttatcatatcttcaaatattttaagcgtaacttgaccggctctaccttcaaatttagactaaaagtctaaacacaaattctgaaatatttatttgcgatacagctagattaatatatatacttttggtttgtccacaagattaatgtaacgtctgcttcttcaaactaaataaaaatagtaaatacatttcttgtcttggttgtaattatctacaaatgtacaaaacgtaaactaataaaacactgattaaaacgagtaacttttggctttaagtgcttctaagtcttaaaagttaactaaagccagttctgtgtctctcttctctttcctctctctcacacacatcttcgagaagtttccgccggcgggagagatcaaagacaactgctgatcagaaatcagagatcagagatatg

SEQ ID NO: 30639 - DNA, 3003 bp, Unknown
  misc_feature (1)..( 3003): 2750-1469P.txt file - cDNA_ID_3034093; gDNA_ID_1974087; Annot_ID_180576
aaccgagcggacaaaagccggaggccccaccgtcgtcagcagctacgaagagacaaaacaagtcgcaaaggaacataaacaataactctccgtcggcgaatgtggtggtcgcttcaccaacttctcaaactgttaaatgaaaaacagagacaaaaagaaacaatataaatattattatgtaccaaataagaaagagggcaaaaggaaaaaatggcagcgtacccgagtgtgccacttctcgtgcatgcatgggatcttgaagacaaatggagggtcatgattaaagctgtttggtcggggtccgggtttttactccattttttgctttttcttgtcgagtcggttcttttataactctttactctttttaccttcaggatattgtagagatgattaattctggaaatggtgtttgtgttatatttctggagagatgattatatagttcttttgttgttgtaattggttaatattacatatgtggctcatttcttgagtcgagcttacatatcgtttataatgtgaatgttttaagaagagttgaatgatacaatatttttacacaaacattgataatgataataaaaatgataattaatgtacaaaattatttgtaaatatggacatatggacaatttaagaaggaattgagataattaattttgtacattaattatcattatcaatgtacaaaattatttgtaaatatggacatatggacaatttaatgatagtaaaaatgataattaatgataattaatgtacaaaatgataattaatgtacatatggacatatgtacaaaattatccatatcattcacatattcacattgtaaatatttgtaaatagaatgtttacatatggacattttaagaagagttgttccttaccactttgattctatcattttcttgtttatctagttagcttgaaccctttgtattattgagtaacgaaaatctttggaggaaaaaaacaagtgaggtaggattataattttcctcatataagtgtgttgtttgtgatacatcattattctttcttatttttggttaaacccaaaaactggaccgcacctaaggaattgagatattcaaaaaaacaatgatctgacccgtgccaaatatccacaccacacctttctccattcaggccctactagaaagccgtgagacggttgacaacttgaaaacaaaagacttataatgagactatgagaaacaaaaaagaaagtggagttgatgaaataatctgatcttatgaaagtgaagttgattacaaaaggagcagcgtggtagttgaatagtttcagatgttgataaagacgtgacatacatagttgtctcagtaatctaatcaaggactcctcatgtttctaacttcttcttctataaagttgcatgagatttatatctggagaacatatattgctctaattatgtggtcttattatcatcaatatatgcctttttctacatatgaatatatgatcgacatgtatagatattttttgttgttcaaaaaaaaaaaatgtatagatatttttttcattttccaaaaggattgaatttcgaaatggtgtagccaccttagaggtatacaacaataaataattttcccgacttgtaacaaatgtttggaacaaaagtgtcaattagaatcaaagtaaccatcagatgccttttataaatttctttatctatgattattttttaaccaaattcagacacttctatattactaaaagccaaacttgatatctatttcaacaaaaaaatttttttttagtctgctgtgactcagtatatctaattgttttcacatcattcataaacttttactagtccattgtaaaatacagtatattagaaattgttttcctatctatatatgcttaggtttaagaaaacaacttttggccatgaatatttgagtttttaagtggttttggattatagattttgccaaaaggaaaaaatattgatttaaaattacaaaaagaaatctgcaaacaattatcaaaaactcattaaagtgggatttatttttcattttgtttacaaaaatgcgaactctaatcttgattggataattaaatgggtttttggaaaaccaataactatgctataaagtataaactactaccattcaagccttctatttttctatgccaaaaaatactacgcaaaaaaaattgagcgtgtttgatccaacaataaaacaaattactcaatcttgtttgatgtcaaaatccaaatccaaaatatgtttcggacacctgaccggtctactcgattgacacccctgaaatttcgaaatagacaatacacaaaaggacatagacaacataacttcatctcacttagatattcacatttcccatttttcaaaatattggctcttcattttctgtgtacttccaacaaattgtcttctagagaaaccaaaactatctaagatttctccaccttctccatcatccaccgttgattcactcatctcatgtctccaatgactcatctacggtcaagattcaaggagcatgaaacatcccatgaaccaaattacacaaaaacatttaccttgataaaaaaacatcattttattattttggcagaagaaaaagtcttaattcgaactttgagcgtgcttatagtttaatcaattaaagttataaagaaaagtaactttataaattcaggagtaatcagtagatttataccattcttgtccatcgctttaagccacacttgatcggacggtaagcaatcaatccggtttacactttctgattataaagattccaacttttggttatatcggacggttaataatcaatacggtttgagtttaaatcatagccgttgagatgtttgactaaagtgtttacaaagtagtcaacactctctttctgctacaaaggaccagtcttgaaactcaaagtccttacctttcccttctctaacctctctttctctttctctgtctctttgtgagaaatg

SEQ ID NO: 30640 - DNA, 3000 bp, Unknown; identical to SEQ ID NO: 10047
  misc_feature (1)..( 3000): 2750-1469P.txt file - cDNA_ID_3034125; gDNA_ID_2213621; Annot_ID_195720

SEQ ID NO: 30641 - DNA, 3000 bp, Unknown
  misc_feature (1)..( 3000): 2750-1469P.txt file - cDNA_ID_3034154; gDNA_ID_1974091; Annot_ID_180593
aaggcaattctcgtttccaaaatcaaacccgactacactcattgtcaggctgtgttattcaataatactgggggctcccaagtatttgatagcaaccttctcagatcaataaaagcaaaaaaaataagtatcagatgaacaaggatggaatatcaatgaaagcagactaggagaagactaattggtgttaacacaggtcagataactagtcttattactgaacctaaatcaaatcaacattttagattacaatcaccaatacgggagaacacgcgagccattcatacaaatagatcaaacctaaaaatcaaatctacgaaaaaatagaagaggagcttcagatctggaagatctgggaataaagattgggaaacatacctggatcgcgagaggggtttaaagttatggaagcttgaacccaaatctgggttttatcgtcgtagagagaaaacgaagagcaggagaggttgtcgtaaggaagagacaagagagcgagaggggtttattaagaagcccccagggttgcgttcctctctacttttccttttttcttttcacactttcttttcctttttttttttaattactacttttatgtccttttcttctaatactatatcttatgatatttatttttgcctctctttcataatttacgtaaacaaatcgagtctacaaataaaaattatcaaaaccaaattaatacatttgcgtaaagctcttccgtccaaaaccaaattatttataagttgaaagattatacaactaactttgtatgcgttaatgataaacaacaataataattctaaactatttgaaaaatattattagctagtaaatgatttctgagttggattttttcgagataatgtcactgtttactggcatttcaatcctactgttgcaaaccttattttgtgaaatattcttagtgtggacaaaaatcttggatcgtaatcatctagtacagtactttctaatcgtcaattagattgaagaactatattaaatgtttacatatatttttggtatcacttgcttctttatttgcatctttcctacctgatcttaagtttactcggtttaaaactactgtatatagcaaacttgcaatgacatgcaatatgctatgattgttttcttttgttataaatgttaatatcatatataaaatgaaagaaatgtattacaaaagagcattaacctaatcaccagattgcgaaaaccttttagatgtcttcttgaagatatggtattgcaaatttcacggtcaaaattcttgaaaatgatcgaagaaagcagtgactgtgaattatgtaagacattatttacttgttttcaaatgtggtaaactccaccgtgtgctgccatttttttgagagtggaaggaacatttggtgaacgagtttttgtccaagagagaagctcaaactatgtggaaggcatatgcgtgtgctgccagtttcttgagagtggtaggaacatttggtgaacgagtttttgtccaagagaaaagctcaaaccatgtggaaagcatattcgtgtgctgccagtttcttgagagtggtaagaacatttggtgaacaaaagctcaaactatgtggaaggcatatgatgcgagaaatgcttaaccgagaaaaaaattagcctccaaatctcacaagcaaaatctcaagttaataagcattttagcagtggtgtctatgtacaacaatatcataatatgaaagccagtaataaaatttaaatggtatgaaaaacgataatagctatataataacattttctttgtttttaatatctatattttgttttagttatatataatattaacatgtcaacaaagttttcaaataactgattatttaatataatcaaaacaagtaaaattatacgatatttggctagatttaaaacgactattttagtgaatcgaataaccaaatcataccaaactcattcaaaatcattattagctttcgttacagtagataaaaaagtattggtaaccatgctcttataaatttaattgaattagacagtttatgattaaatcgataataataacgaagattgatgtattttgcaagtagaacaatttatttctggtcgaaatataaatagttacaacaaaacagttttcttaaaatcattaaatatttgttttgtttaaatctctattttgttgtaactatttacaatctctagatcacattaaatctctagaacatataagagatttgttgcaatccctattacaatatctggatcacattaaatctctagagcatataatccctctttgatccatatccttttctctttttcctttctaatttataaaaaatgtgattttttttgggaaattcgttttcgttcaccataaaaactttgctattaataattactctaatttaatggaaaataaataactcgtaaaaatgtaaagagagaaatgaattgcgaaatattttaattgagaaggtaaagaaaagtgaataagcaagtaaagaagaaagaactcaccaatcagaaatcagaaattagaagagaagagaagcataaagaaaaaaaaactgcaacgccgtttgttgccgatctgcagcagcgcgatctctctgattatagagagctatcatcctaggtgagcttcttcttcgatttcctcttctacaatatcctttcaagttcgatttcatcttctttcaccaattattggttttgcttccttcccgtagtttcgtttgtttgttttctaaggttttgtgtcgatctcaaagtgagtccagggattcatatacctttagactagattagccgagatctattagtgttgatctccgtcatgtagaatccctaattaatttcagtggcctcagatccagcttttcatgttattgataattttgtatccttgaagctttttggatgttgtgagattataacagagcttttcctttcagcagaatagaatctctcagtttaaaggctccaaagatg

SEQ ID NO: 30642 - DNA, 3000 bp, Unknown
  misc_feature (1)..( 3000): 2750-1469P.txt file - cDNA_ID_3034169; gDNA_ID_1974091; Annot_ID_180586
tttactcgattcttattttttgacaggacattgctgtagaggcacaaaatgaatctaaatggaagcaacttggagaattagctatgtcaagtgggaaggtgaccattttttagctgcaatcagtgttctaggattcttacaaaggttaaagctaacatgtatttttcttttcattttccttcccatgcttggactacttagctggatatggctgaggaatgcatgaggcatgctatggatttgagtggtctgctgctgctttattcttcattgggagatgcagatggaatgatgaagctggcagcacttgcaaaagagcaaggaaagaacaatgtcgcttttctttgcttgttcatgttgggtcaagtagaagactgcctgcatctgttggtggaaaggtacattgtttactatttcttacatgtggaacatatattcccgcaactaattacgtctatgctgatattaatatggttacagtaatcgaatacctgaagccgctctgatggcgagatcgtaccttccaagcaaggtctccgaaatagtggcattgtggagaaacgatttgaccaaggttagtggtagacacatccgatgcaccttgtgattgaatttcaaaccttgcctgttgagatatccacaatttttcttcatcctctgtcaatctggatatagataagtccaaaggctgctgaatctctggctgatcccgaagagtatcccaatctctttgaggagtggcaagtcgccctgtcccttgaaaatagagctgcagagacgaggtatcttttcgtcgttgccgtcattagcttattcttaaaaacagtgcttatgaggaaacctttttaattgaattgtgggacttaagccatttagagtcatgtgtctgtattacatagcaaggtagccgtcatgtatttgcttataatttgaatttatacccgtataaacataagccgaatgtcgatttcattttttcaggatcctcataaacaaagtatttttgttgacttatcttgcaggggcgtccatcctcctgctggggattattgtagtcatgcagacagagatcatacaactttagtggatgcttttagaattatgcaaatagaggaagagggtcgacttgagcaaggggatgttctcgacgaggtatgcatgtttacattacatgcattgaagaggattgtcttttacccatgatatccaatccaatggtcttggccatggtggacaatggtaggatcattaattctactgtcgctgcttcatttgttgtgaacaggttggggaagagggggaagatggagaggaagaggaggaggaggatcgtcaggaagagagtagtgatgggagacagcagaatgtggaagaagaggctgttgtggtggacgctgactctacggatggtgctgtgctagttaatggtaacgagtctgaagaacagtggggtaagattagtgaaggaaccgcatcagccttatagcatttgtggttatcaattgattataagatgtcgctgcaccaaaatatccttttgccatctgcacatatatcataggatttgcgtttgcatctgtccatcaatgtttcctcatctgtctgcctcccatcttcgtcttactgatcatcttacttttgatgttgactgtcttttaaatagtgcttctctatgccattaacttttttatcaatccgtggactgattaaatatttgtttgttgtacagttctaacaccgccacaagagtagggttggtgaagagtgaagacatacacagatagatattttcttggctttgaaacttgatacattcagcagagaaatgaggcagcacagagagagattagtttccattgttaaaaaactgatctattgatagcttccgctttgtgcttttaatacagatacatattaaaaaaaaagggggttttgggactcttatgtagctttaacttatgagagatttcacctgtagaatatctgttttgaactgagatttcacccatataatatgttttgactttcgattcaataggttatgtagttgatatcttttttttttttgcaaaactcaatagcagtagcaaaaaacttaattggaaataatcaaagtgaagggataagttgggaaagagccagaggataacgcatggtgcattattattagtattgtggaggagacgcatctcgaaacatctctcaaagcaaacaaggacccaaaacaaagttccttgcattcttccactgtccgtaatcaccatcaccatatcattattcttctacccattttgtcttggaaatgattttaaattttcttgttgcttcttactgcaaactgtgtataggttcaactactccattgagttacacacttgcatgcacctatggaagttaattttccggttttgattgatattcaagttgttgaccaatggagttatatacccttgatttatatagaaaccacatgttttatttatattaacatggtcacttttgtcaggattaatagacaacaatagttgagagaaaaagtgataaggtagagctaatttgtattaaacttatcaattagtattgttggttaaaaaaaagttaataaagtagtcaagttggataattcccaaaaactgggaaaaaagaactcaagcgtcaaatgttgtaggtgcatcatcatcagtctacaagtagtaaaaaacccattcgatttgataagaagacccaacggaaagagtcttcccgtctacaaagtaaacccaatcaatcttaataatctttaagaggttttttcttattataattatctatctctctatctatctatctgcggatctctcatgaagaaacactgaggagattctctcgctctgatctcctggtatcgtcgtctctctccgtagagatatactagtttgtcccatatccgattgattgctctattcaatttattcctcttctaggttttcggtttggccctccgatttagagggattgatg

SEQ ID NO: 30643 - DNA, 3003 bp, Unknown
  misc_feature (1)..( 3003): 2750-1469P.txt file - cDNA_ID_3034190; gDNA_ID_1974091; Annot_ID_180616
ctcttccttctcccgtttgctgccatatccaatcttctttttttcacctagagcgtctgcgctaagctttggtatttataagcggtgctgtctgtgttgacatattcatgtgtattgtgtggttcagcattgccatctcacgtacgtgctcacgctatagcgacctagctctttacttactctttgttttacttttcacaacaatactaattaatgaagccactaattcacgtgctacattgcaactggatcctagcctttaatacaactcttctaaattggtatatctctctctgtattgagttcatgcatatatggggatatatacaaacaaaaacattatttattttttgtctgccgtcactaatcgatctcaactaaacttttgtcatttttttaatgaactgtaaacttggtgttcatttcgttctcattaatgtagtttccttagagattgcaaaaattagatacattttgtagcatgaaatctgaattatagaaggaaatcagataagcaagtgtgcaaatatacaaaaatgtgctattcgagctaaaagtgaagatacaaacaattacgtaccaaaagcaagccctcaagaattgtgtggaggtaagtaaaaggaactatatggatcgcagagacaacgatatataggtcacgtgtgtgggagttttgtctaaccacacatataagagaggaacaacatggactcgaggaagaccactcgtaatgaagttaaaagttgaaacttgtaaatattatcaatcccaacaaaaagaagaagaagaaaaaatatatattggttgttttaaactcacttttgcgataacttggaaagtgggaggacgctcacgtgcatgcatacatttcttgtctattatatgtagctgattcaacataactctatatatcttgttgtctatattgcattatagttacacttacattacatacgtagtgtgaaaacgatgcatagcattactatacatcaaatctgtgcatatatatacacgttacgtttcttgcagtgaaatactcgaaggtggatatgtgctcttgcaccacctaattaatctcgggttatgtaagaattacttcagagttcagagtatatatctatgtgattcttgcgcagtgtcaagtggattgggcatgagattgataaccgaatgggtgaggggtcaaatatcgttatttggatatagcgggattttaaactgaatgattgggccatgcattgcttgggaaaaaggctaaaattaaacaagattgagatacacattacccacttgtattttagtttccaaagaaaaaaaggaaaaaaggagcaacaaggcaacaagtatgtaatgatcaaggaagtaaaaaagggaagaggagtgtgagaaagagagcaaagaggagctgttggaagagggaaatggtcttcttcttcgtccttttggtaatttttctgcttgtgttgtggagagtggtagtactagtgtagagaaaggatatggaaatcagattgtgatgaagatctgatttgtaaagaaggggcctccccacaacgcccttgaatcttccgctccagccttgatctccgattgtgacgatcaccgcatcgggacgtggggagaaggagacccaacctcttttggagtagacgtggaactctgcatggcagaagttgagacatagagaatgtctttcgtcatagcctcttagcagcatccttatggcttcttcctttgattcgtttttaatattatgcctcttcacgtagcaaacccctaccccttccttttggcttcttcctcctgctcctagcttttctctcaccgccttccctatcctctctgcctcacccatcaactccctgcatcttcaaatcattacttactactttattttaaacaatatatattcctaatcaattactatatatagtaaattttgctgccttacctcaaatctgaataacaagccgtgtgatcatcagcattaatatctttattaaacacgaactcctccgtctcatcgtggaaaatggttttgtccatggcggctttcaccatagcctctggaacaccgtggttaacgagctgaaaacaaccgatggtggcgatggcatcaagcagagccgagagggagtccaaccggtggaaatcgaaggtgggagggttgagaaggaatgtgtgcttggggaagactttatcgggcaatacaagatttgggactcgaccacacttgtccaggaactccgagaggacgtcttcgttggccgtgaaggaggcacggcggctggatgctaccggggacggaggaggggctcggaagtcgggagaggaaactcccatttttgtttggggtcttactcgtgataatacttgtatatatgtagagcaaggatcgatcattggccaaagaaaaagtttttgttaaataaagcgagagcataatgatgagatgcaattctcttgtttgcttttattcattgcaacttttccttttccaaaaaccagagaggatgacactattcatcatattatggatggacccaagttgggccttaagcggccttttgtttacccaattgacgtggatcctcacaggatgggcatcgagtgtgacacaagtccaagttggaagagtccttttctgtcacataaataaaaaaataaatgtcaagtagagagggcaagtggtgaatctctctcataccaattccaaaccaactaaatctacttagtaccagtacattgatggtagttgcattttcgcttgaaattgtctgtccttttgctagtttgagtcacaattttcaattgaaaagaaataagagagagaggtcagagtcaacgaaaagttataatttagattttgtgggctaaaattgacaaaagcgtaccaatacagggaccggtgagcaatggcaaattggtaaataaagggagaagccaaggagtggagacgcaatttgggaagagatagaaaaggaagaagacacgtcaacaatg

SEQ ID NO: 30644 - DNA, 3003 bp, Unknown
  misc_feature (1)..( 3003): 2750-1469P.txt file - cDNA_ID_3034202; gDNA_ID_1974091; Annot_ID_180608
ccagctttcatgtctcagagcagaacagggccagttaagcaagtcacttgagaaagagaggcagagagcagcagaaaatagacaggagtatctggcagctaaggaggaagcagataccctagaaggtcgagcaaaccaacttgaagttgagataagggaacttcggagaaaacataagcaagagttgcaggaagtgctactccacaacgagcttattcaaaaggttctacattgctttatggacataacttaatctaataagagttagtcccatgaaaaatgccccatcagttacggaatttaaaggactgaagtacctagcgaattcaatcaaagtagtgctttcccaaactttttcatcctgagtagcttctattaacaaccgaactgttccagtttattactcttctttattgtccaagtagtttctcaatatggcctatttttttcaggacctagagagggagaaggcttcacgtttggatcttgaaagaacggcccgtatcaattcctcggcagtctctgaacagcttcctatagcaaggcaaaattctgcctttgagaatggtgatgcatctagatctatactactgcttaataagtcaggcattgcacatctgtaattcattaactattgcatcaggaagcttgcctagaaagctatcaagcgcaagcagccttggaagcatggaggagagctattttctgcaagcttctcttgattcttcagataaattttctgagaagcgaagcatgcctgaggcaactatgagtccgtactacatgaagagcatcacaccgagtgcttatgaagccacacttcgacagaaagagggtgaacttgcttcatacatgacccgcttggtaggtgtagaaaatatccaactgggacatttttgtgtaactctgttggtaggcttttggcaattggcttagtaatgggattgaggttgacatcagtccttacaatgggacactatgggtgtttggatcatgttgagaaattattggttagttgcacaccgtggttagccttcttttataagctggtttagaaggtttagctctactcgtcgaggtagtataggctggttgttagtatcatcgttatctgtagaatctaactgtaagagtctatttgcctttggacaggcatcaatggagtctatccgagattccctggctgaagaactagtcaaaatgacagcagaggtatgtatagcgctgagagtttagagttgatattatgctcagtgttatgatgatatttcgtctatatctggtaactgtggatgtagtgtgagaagctacggggggaggcagatagggtcccgggcataaaggcagagctggaagcactaaggcaaagacacgcggctgctctggaattgatgggtgaacgagatgaggaggtaagatatgtgaataaaatagtagtgtatccagcattaacaacagtagttggcattgagttaataaaaaagtgggtttgggtggtagttggaggaacttcgagcggatatagtggacttgaaggagatgtacagggagcaagtgaacatgctggtgaacaaggtaaggcaaacagacacaagtggagtcaaagtgttgacaaactcaggctaatgggtttgtgcaattttgggtttgcagatccaatgaggggcaagggaagatggtgttggcaagctcaggctcacgagtaggaccacctaatccttgtttccccaatattgtatagctctataagctaccaacctaagcccactatattcatttgtcgttttgtctctcaggtgttggttgaacttgaggctttttaaaacaaacttttgctgctcgaaagaagatttttcttacagtgaattcgatcgtaaattattattttggagacgagaataaacttttgtctgtgtgacttatctacgtatgtaacatgtattgtctgtgtagtagaaaaacggtggagagacccattaataatgggattcgttgatgtagcaatccatccatataggaaaactgtgtgactcgaatggacccgaatgagatatcaaaatcacagaaatgatagataaagaaaataaagaacaaaaaggcctccggccctcttgtaaatgttaataaaagcccaaaggcccaaaatagctctgcaatggcttctcctgtaatgaatagttgtaggctggtttcagcatcaatcaatagtcataaagcaggggagggatcctttcatcaaaagtcttgtactcttgtacatacagcattactgaattcatatataaatgtcattatttcattggtactagagtatagtttgctgagttccatgaaaagaacggtagaggcgagagcaggtgattaaaacccatcccctgtgaacggagtgagtgtaggtgtagccataaagttgtcgtcgctcctctgtaaaagtttcttctattcgacgattcctctcgacgttatcatatttcctctccaggttggtactatcatcatccttgttctctttgtttgcatccctccttccttccttgcttccttgtagatctgccattgccttttttaatccaaatcttatatttctgatttacattgcttccgtcagatccgacgatctcactttctcatcatctgtcgtcagcttttttgtttcttcttttatctctttttatttttaaaataaatatattgttgattctggaattttcctagtagctcacgtcacgttacgtcatgtgtgtgctttgaattttaaattgactcgcaaggctggttttgattatgtgtaagtgatcgctggacttcacacacactaacaagtagcacttgaatgaagctttcctttaatggattgattatttaataaattgcgactttgacgtctttgagcatccatccatgttgaagaatcccattattcgtatgcttttcttctatggccttgcatcagtcagcactcaacttgtttgaatgtgcaggagcgtgtttccagaggggatg

SEQ ID NO: 30645 - DNA, 3003 bp, Unknown
  misc_feature (1)..( 3003): 2750-1469P.txt file - cDNA_ID_3034206; gDNA_ID_1974091; Annot_ID_180606
cattgaccgatcgttactcattaatttcagcgaccttaaaaggaaatgaatgctctttatgggtttgcctccaacccctttccaattcctccaccctctctttattacttactttcctattcactatacgcatctccctctctctctatatccaccatatatacattttataatgccacctggacacatgtgtatgtgtatgttgttttaatatttgacaaaatttgaaattttgatcatcttattgtatcacgggcacgtcaagatttcaaacattgattcatattatcgtatgcatacaccatgacatattattgcaagatatatctcaacagttacattgttaacaatatagatatagtagcttaaaccgtccgtataatacgtacgtaaatggacgaagacgtatagtgaaggaaacttaggtctttaataagatatataatggtataactgtagcagatgatttatctacaattcaaaagctttatcagtttcttttgtttttttctttgttagtcgtcgtacggcctagggaattgttagttaggaaaggtagatacataatgtatagagagggaagcaaccataaacatttacattcaccacatgctcttaaataattaattaatgcctcctaacctctccttttgctctatctatctactttaattaattacttgaatatatgctgcctatagagattcctttttctttcttccattcattccttttggctactgactctctctctcttttttgctctcgattaatacttctacttaattagggttttgggtaaaaaaattcgcccttttcaccattaatctattacccgtgttggcaaacttccaagaccagtcttctttcttttttggcttttcttattgagggccaatgaaagcaactaattaatttttaaagtagggtctatcaaaattaattaagacaacccttaagttgattccaagatgcagaaactgaccatatatcttttcttttatctcaacaagtgacgacgatcccttttaattcacgtccttacaaataactatctagaaagagaactgacccaccaaaaatggaatatggtgatgatctcacgctaaaagcaaacgtgtttatacaaatgtgacatcgagtgtgcacacgtacgtgtgaagagggaatgatggcataggagattgcgccagataaagacagtgaggacaactaactccatatactaacttatatataattaatacaatgcattttgatattcactttttgtacaaaggaaatgataccatacgagtcgtacgttgctaatattcttggtacctccaagtccaaccgcaaaacaaaagatggatagttagttggagaggatcagctgatgaaaaccaaaagacacagttgtgagagagctactagctagtgagtaccacatatatacgtatattgggatatatatataccttgaatcttacacattttgcttacatctaaaatagaaaatgaaccagtaattagtttttgtttggatccataaatatcacatatattacttaattatttcatataatttatcactcaaattacatttctgtataccagttgtagtattttaatgaataactctactagtaaattgtaacattcaaacagaaataaaaatgaaaaatgtaaatgtaaagatataatcgtgatctgaaataggatggtttacaatacgtaagagaatacgaatgtacatcatgagtatcaaaacaaatcaagattcataccaaaaggaagagaaaaaacatatcaacatatgcataggttagcgtcttagcgagcgtgcggaaccgagggtgccttggtttgctggccccaaaatgggtgggcttttaggggcccaatattgttacttacagaggctaaaatggatcctactgttttccctttacaaaaacggagacaggccttgtatataaaaaattcagaccaaagccgcttagaatgaagtaaatgatatcaagacagaacgtttttctaatccgcgaaacgacgccgtttgtaccgccggtggccgagggaaaaaaaaggatttggattttgttggatctaaaaaaacataaaacacataggggtgggtctctctcctccggaattcgatcacgacggcaaggacgacgcatctccttctcgtaagccattgatgatcccaatagatagctctattctgctttatccaatcgcctcgtcttaataattgattcagtgatgtaattgggatctaaactcgattggttgattgttttccttggaagccacagggctggagatggatctggtccggtgatttctgagatttaagtcgatcgagtttccagatatatctctcaagtagagatggcttggttcagtggcaaagtttctctgggaggattcccagatctcactggcgctgtcaataaattccaggagagcgttaaaaacattgaaaagaatttcgacaacgcccttggcttcgacgacaagtccgattctgccgctgaaggtgttctcttcttctcactttttttccaatcaatacacataatattatcatccttcccaataatctgctgttagtcagctgggaatataggatttgattactcaaggcgcatttgttgataggacctgccatttttcttcttcttctttatgtaggatgtttagatcaataatctgctgttgcaataatacaatcttgcaagttatgggattctgtcttatttttcttagaactagcttagctagtgtgcttcagattctacccattgcattttattctgaatttgaaaaaaacactttgttttggatctttgcgtttacttggtgacagctttttctggctatgatttcaggggtattctgtgtttacctaactgtagcacaaatcattttcttctctagtttgtcttgagtttcttgtacctttcacaacaaaaatccttttgttctttctttttagatgcagcttcaagtatg

SEQ ID NO: 30646 - DNA, 1668 bp, Unknown; identical to SEQ ID NO: 9864
  misc_feature (1)..( 1668): 2750-1469P.txt file - cDNA_ID_3034260; gDNA_ID_1974092; Annot_ID_180657

SEQ ID NO: 30647 - DNA, 3003 bp, Unknown
  misc_feature (1)..( 3003): 2750-1469P.txt file - cDNA_ID_3034260; gDNA_ID_1972104; Annot_ID_178667
aataaagcccaatatacttcaggcccatataaagcccaaaatagtaaatctcaggccctttttgccataagaaaagcgacagtcacatttgcaggcattaatcatcatttgcatcatgatgatgtatcagtaataatgtgtatggtccgaacaaaaatgtaataatcacgccgctttgtgaaacaccttgttcaaaaaatgatgactaatcatagtccaatgctgaatcgtataaaatataaacattcgataatcatagtcgaatgccaaatcgtacagtagaaatataaatactaagttcttagctaactccaagaaattgaaataaaatttaacctcgtggaagaaaaagctgagcatgggacggctttagacagcatcattgctcgtacatcaaattgttgtatcctccttttgcttcaatattcctctttttcttcactttttcacattctttctctgtcttcttttagttaaaaagaaagtagactataatcgaacagattaaatgctagctatatccaattttcattatttatattcgttcacacagaaatggaaatggtgtagtggaatttatgatgaagattcggccatgttgaattatacatgcctagttttctggagtatgagaacgacaatatcatgttgcaaacactttatattttgatcagggaatttttgaatctgcattgattattggagttactcagtttgtttctctaaccttctgctcaaagctgaatcgtacgtatacatttacaaagttagagccaaacattacgtcaaaaactggtaagcataaaagctagtgtgaacagataattttgtactctcggattagtgatctactaatgcaaatatgtagtgattcatttttcagttagtggtcgcaataattctccctcatgagttatgattcagagattcatatataatagtagtataatacttgctcctatgagccaccaaagctattaccctttgatgccattctttttgttgacaggaatcaaattctcccgctttatagaagaccttttattcttacacattcttcattatttgaattaatttctttaacatttcttacattttctcattttgttcgatcatacgatggatattaaactaagatagaattgttatagaccacaatagctggtatatatggatcggattcttcatactttctatgctacaagtacgtctgtatgcgtctttatgtacgtattcatgtatacgtgcacgcatgcgtatggccccaaccattaaaccctttgggatcgatacataaattttgcatccgccaaataagctgtgtttagatatgaattcacaattcagataaagatggggaaaaactttatatcctttactactttgggttaaaaaacttaaagcgagttggatctaactgtattatccaaaataaacgagaattgtcttcttgaggttaattagctattatataacgtcatgttgtgccattgtgccaaactcagtcataattttatttttctctcaatcataagttctctctggtcaactctgcttcggtattgagtataattaatcaaaagccaaatagaaaacagtatggtacaagactcaaatctcaaaagagacaaaaatctatatgcatgccatagtgatttttgaaagaaatggaagagaaaaaaaaatgagaggggaaaagctagaggagagcgatgacccattaagattaaatggactaacaaacgaaacgatcatcaatgtgtaagtgtccctacgaggaccgcacccacttaattccccaaattcaatacctattgaccctcttttcttataatgacccacttataattattatcgtatattgttgtatattgtcgttacaagattgtgaaatgttttatattttctatacacgacgaataacctggtcaagctatatatcgagattcaagtaagtatatataatcgcatgcttggttaaatcagtcctccatttcgagagacaatatgattatactttaaaaaatagagactctcgaatgtcgacaatcaaatgtcacaactcgtactatgctattgtaatgtttttcaatcaataaacttggtttgttttccacaattttatatatagttttattaaatttatatcaccggttggtgttgagcctaacaaataatatgcattattaatagtctactactactagtttgtgatatattctttttccagcttggagagaagattaagcatattttggtctctgattaaagagattacgtaccgtaacctcaagacttctataattaaaagaaaaaaatcaccatatttgtttgttagaaactccaagagattccataacaaaaacatttcattattctacaagcaacattgtgaacatggaccataaatttaacttgtacagtactctacataaacggtaaaaaacaataaagcgcttggaaaaagagagtaacaccagaaagcaaagagctttgaagaaacccaaattcaaaggtactcaatttcatctgactagctctgaccccatttcttcaaaccaaagaatgatcacaccaaatccaaaatttcccctataaattacctatctcacataaatataaagtttacttctcttacctctctttcctctttttatcatttacttcataaactttctagatatctgcaaagcccttaatttgaattcatcactaacccacatgcccaaaactttagcaacacacaaccctaataaatttttgttggagggttcgatgagttaattcattctttattgtttttgatcttctgtgttttcccttaagaaagtgattatgtgtttaataggtttgttgggagatgtgtcagtgacatcaagaagacgaacaacaattcaaaaccgtattaaatgttgtctttttgatcactcaagaagaaaacaacaagacagcagatgttttcatcattcttcacaacaagtttcgttcaagtctgatccgatg

SEQ ID NO: 30648 - DNA, 3000 bp, Unknown
  misc_feature (1)..( 3000): 2750-1469P.txt file - cDNA_ID_3034267; gDNA_ID_1974092; Annot_ID_180655
gaacaaatgctgaagtttatgggagcaaacacacacttgtctgttcagcaggcaaaagaactcatcgaggtgcctacaataatttaaactaatgtcctacaggttttctctattttttatgtctatctttctcctgtcagcctatatctatgatttacgcgatctataaaaatgctgtttgattcttccaggacgagaaggctggatttgcatatctcagtctacgagaagctcggccatctttgtatgaaatctgagaaacatttatttgtgatatacaaatgcatacgacattttcctgttcttccataagcagtttggtggtaaagataacatctgatcgtattgacaaatttctttgacaaatttgcagatattcactaatcgaaatgagggagcatataaagaagcgccctcctctggcaacaacggagaaagttcagcaatttgtgagggtaagggatctatgaaatgtcaccgccttatatgctccacgcaaatagaatttaacaactcatgtgactaagacaagtttaagggggaaagatatcatagggcttgacagaaagtgaccgtatgcagacatttcatggactgtttttcaatgcaggcgacagggaaagaagccattgttgctgggttttaccatgaaggctacgaagagcctctcttaatgcttatgagacgaagaggtgtccattctggtttggtggttaaggttgagtctctctcttttaccatcaaatatatattaatgccctacgagctactacacacttgggacgtagacttagaacctgaattctgttggaagctctttccatatgaagttttgaacttttagtagagaaaatttcaggtctgattgtaagggaatttataaggcttcttttggtaatgcagggtgaggagggggccctttcaatgacaacacgggtgcgagctgcaagtgcatcaaaagggtttccagtcaactactgttccgggtttcgttcattgagttcggacacggctctagaagctgacggttagaatagctataataactttccttgtttcaaactagaatctactgcttgaatatatgaaccgagtccagacagggttgacacttaatttcacaggtgcaaattagtgttgtagtaaaccggattgtaggtggtaggagttcataggctaataaactattagctaatcttatatttggtcgatatggagtcatgatgtatcattttaccttggtgatggaagtcttttggtggattagcctaatctagagtgctatgaaatctaattcagattagattggtctttgtgctatctgatattaaacttatttgccttatgccttggtactagtatatgtcttgttgtacatcaatatagtttatgctcctaaaactcatggctaaactaacttctggaatcgtaggtgtatcgcgtcagagtttcaatcttgaggtggatgcgagaaactatgggtttgaaccaaccgagactccacgaactgatcgttcggtaaaacttccagaagccatttgtttcacaatgttgaggactgttagaaaaagaaaaaaaaagagaaaacttaagtcatacttttgtttaatgaacaggtgtcaaagaacatagagctggggctggcagcgcttcgtggtgagaaaggagcggcttatgatagaatcgtcctaaatgctgggattgtggaccatttgttgggaagtgaaggtgcagaggatgtagctgtggcaatggagagagcaaaggaagctattgacagtgggaaggctttaaagaaacttttgaattacatagaaatctcacgcaagataaaatagttcaaccaacctgaagagtctgaaaaatcatacacggaatagagaaaagcatacacctttctgattcttattgatttcgttttgtgtaatatgtttttgaaacttgaaagtgtttttttacagaattggacacacaacacaatgtggatgtctagtgaatcacgtgtacagagtctgagaacaaaacttggttatttctaatgtgtttaatgtttcttaatcattttgcacattcatgttacttaattagtttagtcccgtcaaagattctgatggagacattcgagccactctttctcttgaggataatgggaaacaaacaagcgagtcaatgtccggaaaatgacattgaagccgaaggcaagggacgtgggacgattttataggttgtgttgcagaaaaaacagagtccatatcaattctctcactcgttttttttaatccgttttgtagcaaaaagctagaaatgacttttggttataaaatctttctttttgccgattcaagtggctcagctgcttcgtctttttgtgttctccttatgccacatgatctgatcagacgagtgtccaaattcacgtcagacacacaattgtaatctaccgaagattttattttaatatcatataaaacgctattgcaataagcgcccacacaagtctttcttacttgccctgctctggaacgtgactttggaggtaacgaaactgtgtcgtgagttgatctaaggttggtataatttcttgtagttttgtccgatttcgaaaacccatttcaaaaggcgtcgcctttacttttatatcgtttgagactgttctgtagattttgagttgtggggttcactctctacgtgggttggtgatgatttttttttagctctgttcactgttgttttattggaataagttgatggtacgttctgtagttatagattcgataaaaaaccaatctttatgatcgactcaataagtcaaatcttgttgtgttaagtgaaatctatagtagtgaaagggtctccacttagctgtttggttagtcttgttataagctcgattatgtcctttcttgtgatcagtgtattaatacatctgcttattttggttgtagaggggaagtgaggaatcattttgcttttagctttgaaaagtaaatcctggaaatg

SEQ ID NO: 30649 - DNA, 3000 bp, Unknown
  misc_feature (1)..( 3000): 2750-1469P.txt file - cDNA_ID_3034271; gDNA_ID_1974092; Annot_ID_180653
actgagaagaagagcaaggatgatgactgatggattcaacagctgcaaaaacgtcgtctgtaatttcacagaaggtgctatgtattcattccctcaaataaagttgccgtcgaaagcaatccaagcagcaaaacaagccggaaaagtccctgacgttttctactgccttaagctcttagaagccacaggaatctccacagttccaggctctggatttggacaaaaagaagggtagaaaaaaaccctctgtgttttacagtttcatgttattcttgcagcaagctcatttttgtttgtctgtttgtttcagggtgtttcatttaaggacaacaattctgccagcagaagaagaaatgccagagattatggacagtttcaaaaagttcaatgatgagtttatgtctcagtacgctgataactttggttactccagaatgtgaaaaagaaaggacttagagtcagagtcagagatcacttcttcttctttcacgacattattattgtctattcacactcttaaaaagcaataagtactggtcctactctgtgtcaaactcttcttggtgctcttaaaacctttgtatctattgttaccaatttgtgtgactcacacacacacacacacaaatctctaatgttcaattatatggtaaatggtttatttaattattaggtggacaacattatcatattataaaacttaggaataaggaattaaggatcataagaatgatttattatatacgataatattttgcatccaatagaattccttcctttaatataaactttctccgccgtcaatatttacatttttttttaaagtaagaaatataattaaataaagtatagcacttatccaatcatgattaaataaaattgtagccgagtataaaaatttccaaacctcttttcttctttgactcctccttttggagtttcttcagcttcaatcacagagaataagagaaagccctaaactcaaatcttctcttctttttttcttttccgagaaaaagttttgggagtttttacttattacccgagaagaaacacaagaaaacaacctttcccgcctaaaagtttctttctttttttcctctttaagagaaaatttaacaatttcttatatatagaatcagttgaatattcaacaaccatcttcgtttaggtcttcttgttgaatttcttgaatcaaagtcatggattttcctgaaaagtcgcttaaagtgaggatcccggtgaaagctccggtgagttctaagccagagaaagaagaacaacaagaaaagaaagaggaagaagaagatagattcacaactccaaagggggaggaatttagaattccgccgctatttgagtgtcctctggcaccggagccacgcatcttcaagaaaaaaatcgaaaaacgtcgccaaaaagccgtcgggcaaaggaatatatcctttaacgttcaagatttagatactttcttcgcaagaacacaaaacgttgcagatgattcttgatacatatttaggtttatagttagttagttaattccttattaactgaataatttgcaggagtttttattcaatttttattttaactatcatcttaacataggatattatcttccctttttagtatagttttgggtagaattagtattaatatcgaccaatgatgaagaagaactaactcatattgttttgaatatttttctttgatagtttttttgatggatcatgtgtgatattattaaatttggttcttaacactttaaatcaaataaattcgtattggtaatttaataagtgatatatatatatatatatatgtatatcttttattcgtacaagatgtttgcaaaccagatttgggttaatgagtggatcaagcttgatacaggatatatatacttgcatcaaactatagagttactttaagattaaatcgtactatgaatgttcttgctaaatctatgattcataacaaaagtcaagaataaatttcataattagtgaatggacaaatcttagcttaagtcattttattcttcatactttggtcagctactggatagaaaacatttgaacccattctatgttttttttctccagtgaaacaagtcttagattgtgaccagattaacatttgtggaaaaatcaaacttggaaaagttgacccacacggccacacaacaaaccactgtccactgagtctaaatagagaggtcaatatcgtgtttggtaatggtaagaaaattgaataggccgcgtcaagctgaatggaatcctatgcaattacaaatttataacgtcaccagtttcatactcttgtttcacgggagatttatatctgttcttgactttttttttggagattttcaagtaatattttccagagaagtaatagtatcatacaagtaaaagagtcaaattctcaatttttgacaatatgaaactttagacaatcacattttctttaatagcaaaaacttcatatccaaattaattactcatagcaacaacaaaatagtgaaaaaacatcaccatcatccataattaacgacacaataggatctccgtcaccgccatctcagtacactgacaaaaaactcaggctatatgcattgtttactggtccatgatttttgtagactaatttccacatattatatgaaaatgatttttgtccaaatgattttaaataaggtacacagaagattgcaggcccagcccaaaaactaatattaatgcttcgtgtttattagcttggttcactcatcatcctatacaaaatttcttggcggtttaagtattccacgtgtcacagtgtagtctcgttgattaactgtctcatatcacatagccgtccgatcttcataaccacataactaaaaaacaaaaaggaaaaataaattactcggcacatacgcggaaaaaaaaaaaaaaagcgaatcgtttacttacccctctttgaaaccgacggtggtatttttcgccggagaagatg

SEQ ID NO: 30650 - DNA, 3003 bp, Unknown
  misc_feature (1)..( 3003): 2750-1469P.txt file - cDNA_ID_3034271; gDNA_ID_1972104; Annot_ID_178671
ctaacataagagagatactacggttctgttgtgatgagagattagttcttctcggagacgaagtgtatcagcaaaatatataccaagatgaacgtccctttatcagttccaagaaggtaacaacgatgtctttcattggtatctttaactccttagcttcaattatattagcctatgcatgtgctttgtgatcattggtctgcgtgatagtccttcattttatcatgaatgttgcaaaggttttgatggatatgggagcaccgatcagcaaggaagttcagctcatatctttccacaccgtttccaaaggatactggggcgaatgtgggcaacggggaggttactttgagatgacaaatatccctcccagggtttgtacctgaccgtctctttttcacccgtgattttggtaattgcaagagcctttttaatttctggtaatgcagaccgttgaggagatatacaaggtggcctctatagctctcagccccaacgtctctgcgcagatatttgtaagctagcccttcttagtttcttagcaagttctggttactgaatgatctcactgctgaaacctgattgtttttgtgtagatgggtttaatggttagcccaccaaagcctggagacatttcatatgaccaattcgttcgtgagaggtatatatagtcattctactctaaataaacacgctttgatgaatgaaggatcacgatcatcgaacttcactggaacattattaacagcaagggaatactagaatcactgagaagaagagcaaggatgatgactgatggattcaacagctgcaaaaacgtcgtctgtaatttcacagaaggtgctatgtattcattccctcaaataaagttgccgtcgaaagcaatccaagcagcaaaacaagccggaaaagtccctgacgttttctactgccttaagctcttagaagccacaggaatctccacagttccaggctctggatttggacaaaaagaagggtagaaaaaaaccctctgtgttttacagtttcatgttattcttgcagcaagctcatttttgtttgtctgtttgtttcagggtgtttcatttaaggacaacaattctgccagcagaagaagaaatgccagagattatggacagtttcaaaaagttcaatgatgagtttatgtctcagtacgctgataactttggttactccagaatgtgaaaaagaaaggacttagagtcagagtcagagatcacttcttcttctttcacgacattattattgtctattcacactcttaaaaagcaataagtactggtcctactctgtgtcaaactcttcttggtgctcttaaaacctttgtatctattgttaccaatttgtgtgactcacacacacacacacacaaatctctaatgttcaattatatggtaaatggtttatttaattattaggtggacaacattatcatattataaaacttaggaataaggaattaaggatcataagaatgatttattatatacgataatattttgcatccaatagaattccttcctttaatataaactttctccgccgtcaatatttacatttttttttaaagtaagaaatataattaaataaagtatagcacttatccaatcatgattaaataaaattgtagccgagtataaaaatttccaaacctcttttcttctttgactcctccttttggagtttcttcagcttcaatcacagagaataagagaaagccctaaactcaaatcttctcttctttttttcttttccgagaaaaagttttgggagtttttacttattacccgagaagaaacacaagaaaacaacctttcccgcctaaaagtttctttctttttttcctctttaagagaaaatttaacaatttcttatatatagaatcagttgaatattcaacaaccatcttcgtttaggtcttcttgttgaatttcttgaatcaaagtcatggattttcctgaaaagtcgcttaaagtgaggatcccggtgaaagctccggtgagttctaagccagagaaagaagaacaacaagaaaagaaagaggaagaagaagatagattcacaactccaaagggggaggaatttagaattccgccgctatttgagtgtcctctggcaccggagccacgcatcttcaagaaaaaaatcgaaaaacgtcgccaaaaagccgtcgggcaaaggaatatatcctttaacgttcaagatttagatactttcttcgcaagaacacaaaacgttgcagatgattcttgatacatatttaggtttatagttagttagttaattccttattaactgaataatttgcaggagtttttattcaatttttattttaactatcatcttaacataggatattatcttccctttttagtatagttttgggtagaattagtattaatatcgaccaatgatgaagaagaactaactcatattgttttgaatatttttctttgatagtttttttgatggatcatgtgtgatattattaaatttggttcttaacactttaaatcaaataaattcgtattggtaatttaataagtgatatatatatatatatatatgtatatcttttattcgtacaagatgtttgcaaaccagatttgggttaatgagtggatcaagcttgatacaggatatatatacttgcatcaaactatagagttactttaagattaaatcgtactatgaatgttcttgctaaatctatgattcataacaaaagtcaagaataaatttcataattagtgaatggacaaatcttagcttaagtcattttattcttcatactttggtcagctactggatagaaaacatttgaacccattctatgttttttttctccagtgaaacaagtcttagattgtgaccagattaacatttgtggaaaaatcaaacttggaaaagttgacccacacggccacacaacaaaccactgtccactgagtctaaatagagaggtcaatatcgtgtttggtaatg

SEQ ID NO: 30651 - DNA, 3000 bp, Unknown; identical to SEQ ID NO: 9863
  misc_feature (1)..( 3000): 2750-1469P.txt file - cDNA_ID_3034275; gDNA_ID_1974092; Annot_ID_180651

SEQ ID NO: 30652 - DNA, 3000 bp, Unknown; identical to SEQ ID NO: 9861
  misc_feature (1)..( 3000): 2750-1469P.txt file - cDNA_ID_3034283; gDNA_ID_1974092; Annot_ID_180648

SEQ ID NO: 30653 - DNA, 3000 bp, Unknown; identical to SEQ ID NO: 9865
  misc_feature (1)..( 3000): 2750-1469P.txt file - cDNA_ID_3034287; gDNA_ID_1974092; Annot_ID_180647

SEQ ID NO: 30654 - DNA, 3000 bp, Unknown; identical to SEQ ID NO: 9866
  misc_feature (1)..( 3000): 2750-1469P.txt file - cDNA_ID_3034289; gDNA_ID_1974092; Annot_ID_180645

SEQ ID NO: 30655 - DNA, 3000 bp, Unknown; identical to SEQ ID NO: 9859
  misc_feature (1)..( 3000): 2750-1469P.txt file - cDNA_ID_3034293; gDNA_ID_1974092; Annot_ID_180644

SEQ ID NO: 30656 - DNA, 3003 bp, Unknown
  misc_feature (1)..( 3003): 2750-1469P.txt file - cDNA_ID_3034296; gDNA_ID_1974092; Annot_ID_180643
attggttattcaacatataggattctgaatgaccgaaatatattttttctaatataattgtattggctgatagaaacttatacaaaccttttaaaagtttttaaattaacatcaatatatacaaaacatgattacacttacgacatcatgtgtgctgcataattacgtccacctttgttacaacattgctttgtttgtactgtaattcgaatcaaaattaccctcgttatttcttctgtctacagcatcatatatatacaacattttctattcttacaaaccattgataattatgaagtaatgaactaagcgcatcatgttcatgccttttgcggttgattattgaaatataaacaaaataaaatgatatggttgtttcgcactgcatgatgatcttacaagtcaatttcacccaaaaagctacaaacatagcaaaagtaggagtttcacgtcttcttgccatcacacagaatcaatatgttgaaacgtatcaaaagtttcttacattatatggtgcatacggaattaacatctggacctatatcatgcatgtttaatatgatgtcgtgttctaggaacgctagtggcaacgaatatatgatgatggttcatgcatatcaccgataaatgaacaaattatccattctgtattatattgatatatatagagtaagttgttatctgattgtggttggtccaaaaaatacatgaatgtttatttcgatcacactactacctctaccatcttggttttttccaattttttagcatgattttttatttacgattagatatatttctttaaaaaaacatgaacatgcatatgagtgaaagtaaattgacttgttagaatcgtcaatatttagttctaataattatatccattgctttaatcactttctatgttgatattattgtttgatcaaaaccatcagtataacctattatacaatagtttgatcaaaaccatcagtataacctattatacaatagttttgattcgttttgatctcttaggtttctttttagctattagaaacaaattcatagagactatagacattagacaatgataatgtagaacaacaattaatgttcctcaaatatcccataaaacctattgaatcaactggtccaaaaccaatacaacgagaacttattgtctacgtttatatgacccaaagacactaatcaatcggcctcaattagaggcggatttaaagacatcacggtatcatcatatccatgttactttttctgttctcttttttacttacccgtccatttctttcttttggcaaaataattttgctaaattacgtggcaaaataattttgctaaattacagcgaagaggatcacatgcatcagcactatttacaacaatcctttagggtatatgttagtcaaccccgtaacaccattcgtacccattaatcatgaacatttcgcaaagttttcccaccaaaaacggcgtcggataaggtttttggcattttgtgtttctttttttgtgtgcatagcataatttcattttaaccgtactattcgaagatttttaaattggataaagatgattcattcattacatagtcgctttgttgttactagtgataaattcatgttaatgattctatgattttcggccagctatctcattaattattaagacgtttaagtggagctattagcaatcgtgtatgacataatgattagcattttcatgtgccatgcccatgcatgaggcttttttttgtttaaaattttattctattatatccgaattttgttatatactaaatgaacatttgtctctgatttggtctactagttaattaacctttagcttcactaataaaaaatctcatgattttgatacttaaacccaaaacatattaaaaacaattagcagtcttttaaatcgataatgtgcttagatgattatacgttcgtaggaaactcttttgtttccaatgcatgttaagaactaagaactcgtatccttaagcaccaatgctttatgcttaatgcctcattagagatataaactgagattgactgtgttctgaatcatcataatataaggcacacaaagaacagaacaggaaatacttagcaatataataggtttccaataaaagtgaagaagaatacaataaacttttataaaaaaaaaagtatataataatttcacactcgaatcaaccaaatgtaagatgtcttgtccatttacacatcacatgagtaagtggattacagattgcaattgatgaaatctggatcttagctaaaaatttattacgttactatatacatcgagttttaagatgttcataatcacaaccacaaccacaagtttgaagaaataagaaacagagtaataatatatcaaataaaatttcatggctgatggaatcttttttctaattgtaggtccaaaaaagcctaaattaatggggaaacaaaaaccaaaattcaatagtaattttactaattatgtcttggttaaatagagtaaaaagaaaattaatcacaaacctccaaaaatcaactaattgagatcaaaacacgtgtcgcatgccaatagggcggtggatcacatggtaaaaaaattcactttaatttttgtctttcttcataattcatctcacagatttcaacttctcttttggattctctcaccgtacaccgtcggcgtaccactccccttccacaccgtcggcattaaaaatctcaaaccctaaaacccgtatccaataacccacccggtccaaccggttattcaaacccggtcaatccaaaattcgcctcggaatccaaacctccatacccaatctaacatggaaaaacctccaatcacaaacctccacgtggtgatcactcattggctcttattctggaatccaagaggacctttttagtataaagagccccttcgttggtcctatcaccttctctctctcacacactaacagaaagcacaaaaaacagagacaaaagaatg

SEQ ID NO: 30657 - DNA, 3003 bp, Unknown
  misc_feature (1)..( 3003): 2750-1469P.txt file - cDNA_ID_3034304; gDNA_ID_1974092; Annot_ID_180641
aaatccctaaatctctctctgttgttaccttcccatgggatggtcactaagaactctcataagagcaatctgggcatgacaaagtccatgaatttctttcagaacatcattaaacctttcaaacgcagctccaatcgaggtaagatccgtttgatttgttgattcttagtgtaagattaggtttttgtgaaatttgactaactttttcttcgttgacttaaaggtcttgaagatgatattgagcgaattgctgctatggagcaaaaagttttcccatttcaagttttagtttccgctaccaaagattttcacccgacccataaactcggtgaaggtggtttcggtcccgtcttcaaggtaaccctaattttgacatacccagagcttaaagtttccatttttagggttgtggttgtataattgtgtgtgtgtgttttcgtgggttttgttagtttggctgatgaggttgattggtgtgtaatagggaagattacctgacgggagagacatagcagtgaagaagctatctcaggtttcaaggcaaggcaaaaacgagtttgtgaacgaggctaagttgttggctaaagttcagcatcgcaatgttgttaatctttggggttattgtacacatggagatgataagctcttggtttatgagtatgtcgttaatgagagcctcgacaaggtcctcttcagtaagtttttcttctcaatgagattggtttgtatattaggataaatgatattgaaagaagatggttttaacatgtagtggttgcttcatttgaatgcagaatccaacagaaaatcggagatagattggaagcagaggtttgagatcataacaggcattgctcgaggactgctctatctacatgaagacgcgccaaactgcatcatccacagggatattaaggctggcaatattttgctggatgaaaaatgggttcctaagattgcagattttgggatggctagactctatcaggaagatgtaacacatgtcaacactcgtgttgcaggaaccaagtatgctctctctattgtttacccttaaaaagctcatttacatatcttcttgtgtcatttgaactctttttgtttgttggtgtttcatggtagaatgttatttaacgtccattgcttcttcttttcttatgcgcagtggttatatggcgccagagtacgtaatgcacggggttctatcggtaaaggcagacgtattcagctttggggttttggttctggagctcgtaagtggacagaagaactcgagttttagcatgagacaccctgaccagactcttcttgaatgggtaaagcctctagtctcatgctccattgtttatagggttgttgtgtgatggcctgacccagccaatattcttcagcgtaatataaccaatgctaaattctttctgaatgtgacacaggcatttaagttgtacaagaaaggccggaccatggagatactagaccaagatatagcagcttcagctgatccagatcaagtcaaactctgtgtacagatcggactactctgcgttcaaggcgatccgcatcaaagaccgagcatgagacgggtatctctacttctctctagaaaaccaggacatctagaagaaccggatcatcctggtgtcccgggatctagataccgtcggcgaacacaacgtccttcaggagcagcatcacttggaacattgtcgaccactggttccagcacagattctttcggttcaaacctgaacacaaacacgggaactggtgttagaggtacccccgcatcttctaaagcttcaactcggagtaatgccactagaagtgctggtcagagctctagctcagaccctcacgggaaacgacatatgagttattgaagtacataaaatctggtcataggtgattgtaaatagcgagctgcatatataatatttgtttcataatttatttaattttgcttttgaaaagtaaattaatttatttttttgactgcagtagtgatttagttttgtagtatgatttgttatattagcgggaaaaaattatgattcatttgttacatttgtatattagaataatcacttgtagtcccattatctaggtccccactattggcctcgtacgtataaaagcatattctcttgtacgtattaacggtaccttactttaaacaaaacataaaactaaaatgttttttatgcgttttaaattatttttcagttaaaatttataaaaagggtttttgtaaacaattattttgatagtaaaagaaatactaactgaaattagtggagaaaatacacaaacatatatttaactttctttaatttaaaatatacagattttgtttctttaattttttttttcaaattttagttttcatttatttttaaataaagtatgacatgtcataatgttgtattttgatttgtcattaaaaagggggtgaatcaaattggttcactctagaggtgaacttcgccaaagaatcacagaccgtcagtgttaatcatcagagacatcaacgtaatgttcctcttggttacttcttgctttaatgttcctcttggttacttcttgctttctacctgattcaggttcttcagttaaagtttctcttttcatttttggggtaatgcccggttgggcctcgttgttttatttaggttctagttctagggcctgcgtgtccttttaggcagttattgccatgtatgttctttgggccattcgtgcctctgtcggcttgttgggccttgtaatcgtttcggctctattggaaattaaaaataaaatatatatactaacccgttttgggtaaaaagttaggtccactaaaagacgaaaagagatcctaccaaaaaaaaaaacgaaaagagacgagccacacgcgtcaccttctcgtttagcctcttcatctcctttcctcagactcactgtgtaaaaaggcttttattttatcatcttcaggcttattcgattttcttcagatttgaaatg

SEQ ID NO: 30658 - DNA, 3003 bp, Unknown
  misc_feature (1)..( 3003): 2750-1469P.txt file - cDNA_ID_3034308; gDNA_ID_1974092; Annot_ID_180640
ataaactcgacccaaaaagttcaaagaagtctaaacatattgctgttcacgtgaaaaagacaacgacttaagaatatgacatttggtaaatgttacttgaagtcttgaagactactctttaatactttatcatcatcatattcgacaaataagcgtgtgcctgatttggtgtgatattgtatgtaccgtacgactctttcaaagtgtctccaacaagtatcattggatatactacgcggcaattaaacaaaataatgaaaaagctttaatttggttgaaatttttgccaaatgacgtaacctttctttattttacggcatagcaaaactataagtcgcaaatcgtacgtactatttcgattgtataaagattcaatgattctacaatttttctaaatcaaaaagttgttgaaagattcaatgattctaccatttttctaaatcaaaagttgttgtcgaacctccgtccgagtaaagattgagtttaatattattagttttatctaaatttctttttgtgaatttccaatagtcttcaccttaatttggacatctctctgatcatgctgactattaaattttttaacattccagcataaaaattgatcattttcagggattagtataactacaaccgttttttgtcaatcaattatataagatttattaaaccgaatacaaacgaaaacaaaacattgactctgatcgatatcacgcgttatggcggaataacgtttgtaatgcgattatgcagaaattttacttattagaaaaattttcatagtgtttagttgtttaccataacgtaaaaatatagaaattgcattttcgcctaaaaattataaataaatcattatgcaaataagtgaatatctatatagtagtttatatcattatgcagtattttattttgggatttattgcaaattttattgtgagacacatttgtattttattgtatacatttgtattttaaattttattgggatttattgcgaattttattgtgcgattatgcgacttatatcataatagaattatgtgatgttaccactcaaagtcattatcttatcacttatgaatataagttatgttatatatttatgtgaaatacatttgtacgtgaagttgttattagttatggttacgtatacattggtttgacacaggacagaaacatctaaaataaatgcagcgtaatttgcaagtactatttaatggtttcattgacatttgttgcaagtttctttcggtggatactgagtgatcaacaccctagaaagtaaaagacttcaaaagatttggtatttttattttgtttttttcattgacccatttatttatcactgtagagatataaacacgattgcaaaatatttatctaaatatacaataatgttttaatccgagtatataacaaattggcaagtgaatcagtgaattgattaaccgaatagtatgactcgtatctaaactaatacttaaaaagatcgatgttagagtatctccattgcaaatatttcatatggattatacaaaaataataaaaagtagaataataataaaacattttagctttctcaaatagtagtagaaacccacataaaaaaagtttctattttttctctataaaaaattttctttggattttttccgtactgaaaacttcttatattttattatttttaatatatatatttttattaactcatgtgagattttttcattttgcaatgaaaatgttcttattaaaagaaaaaaaaaattggaaaggtgaccaagcttgaccgatcgagctaagtcaaaagaacgcgtcttgcttgggtcatgttttggttgttccaagtggtatcgttttttttctccttttgaacgtcatcctcagtgatgtcatattttagttttaatttttgtttcaaatgatctcatatatatatatttttttgggcacacaaatgatctcatatagattgattttttttgtcacccatattagaaattagaaaacactacactaaatgcatgctccaaccacatagggttaaaagtctatgtcattgactacgaacgatgactccaagaaactaaatgaatatgatgcaaacaaaatctttattcgtcataagattgcgattatgtataaatactataaggtttaccggatatttcatttagtttgtcttaacctgataattgctctactagtggatctgccattgaaacaaaaaggctttccactcaaattctctgaggttgcacttgcacatgcatacaaacaaatattcttctaattgtttgcgcgtaagaaaaagaaaaaaaaaactatatccattattgagaaaagtagctgaaaaataaataaattaatagacaaaaatgttaatcaaaatttgcttttgagtaaaaattaaccagttgaatgaataaaatataacttctacagaaggtataagagtttacatgttctaatcctccattaaacaattataaaatacccacaaaatctaaaacttttaggtgaatattcattaatgaataattgaataccactaattaattatgttaaattcatcacaactttttcatgatacatcacacataaaccaccataatataataatgaaagaaatgtgaatttggttgaaaaaaacaaaagaaaaaagtaaaaaggttgaagcaagagactgacttttatccaaaaatgtgcttgaattttaattaaaaaacacgaattcttcttgactttcgtttcaaatctaaatccttcctcgcataaactcttccctgaatcaaaaacccattctaataaaaacaaagacgatctcaaacacgcttcttcttcttcctcattcctcaatcatccctaagacgtcacctcacttaaacccaatccaacgccgccgaaccaaaatcaacttcttcggttcttccccaattcaatactactttctgggtcgtcgttaaatccctaaatctctctctgttgttaccttcccatgggatg

SEQ ID NO: 30659 - DNA, 3003 bp, Unknown
  misc_feature (1)..( 3003): 2750-1469P.txt file - cDNA_ID_3034312; gDNA_ID_1974092; Annot_ID_180639
ctctcaattcaccatcatttctctcaccatttttactcattataaaaaataaaaaataaaatctcccataccattaccatttttctaacatgttattattatttagaaaactaataataacatactctaacaatcaaattctttctcaaaaataaaatgttattcctcaatttcaaattaagtgttaccactacttttttcatggaagtgactagcgagttattcttagttttcacatttttagaatcccaagtgagtttcgaaataattttcttcttttccgggattttggagagccattggtgtggaaagttaatcacatgttaaaggcttaacctaaaagcttagactgcaaaccccaccaccattttttttaatttttaaagtctctatattgattcggccgacgaatgttaatcattgaggtcgcttctcctttcttgttttcaatgataaaattaaaatcaaataagtacatagtataataaacatggtaatagaataataatacttcaatttttttgaattaatcgatttccatttactatatatttgcttaggagcgtttctcacgatcacctgtttaattctaaatcaacaaacgatcaagaaatgatgtgaaagttcaactgattgcatgcacctaccaatatttataccttagaaatcttaaaactacgatgaatatgtaaactccaaatcaaacaaaaattcggaaagattctatactataattaagtagtaaattattaggcaaaacagtgaggtgggagtgacctgtcattaaactttgtatgagccacggccaacaccacatggcccttttcattcacagaaattattttgttgctaaaacaaataatcgaaatcacaagtttccaatatctctctatggtatagtgatcgaatatttgatatggttaataccttcaataatattaattaattttctgacatagtataagtttaagtgggatatactggcccctttgaatattaattacttacatgtttaacatacatttggtgatgattatctcttcgcaaacacgcaaattataagttgacaaggccacgaggttcaaaaaacgacatatattgtaatgtgtcttcgaaaaagtcaatatttgtatgtccctatgatgtcaatgtgaaccattcggctaacgaagagaataataatattataacattcatacacaatgttgaaatgtcccgtcaatattttataaaaatggacacggtctaattaattaaaatgaattcggttttgatgtgaaatataaaaatgaagtggcacataatgttagactggtccattaactcttaaaaattttttaatcacaatttctttatttatttgctcatttcgaatatcgattaccttgtctacactacacacgttacatatgtaattgtttatgaatgatgcatagttagttgcatactttcaaaattggataccgccaacttttttatcaaccatgttttttagtagaagtgtttttaaacctcttttatttttaactgtggtctcctttattttggttgtaagctgtaacaaggtcttgtcctctctttatggttctccttacgggcctagttaaacttggtcaaaataatgaaagaagtaaagtggtgttcttaaataaaaggaaactaaaggaaattttgttacccaccttcttattaatcgattttcaattcattgtacgacagcataatgaatatgaatttttggggatttaaatgaaatatccttcacgaattggccaatttactttaaaaacccttagttaaattattaatagaaaaaccttttaaatataaaagttttaattataaaaaaagttagatattagtccatctatttaaaaactcctaactaaattactaatgagaaactctcgaatacaaaattctagtgaaaaaactctttcatataacttcatttaaatatattttgtttttaaacctcactaacattgatttaaaccgttattttacaccgttttaagtttctttccgctgaaaaatactatggtttccggttcaaaatgtgtgggcccttttacgcgcatgtgggtcagatgtatgggcccattctatttttttcctccaaagttaaaggcagagtggcggggtcatttaaaccacgtggcaagttttttttttttatcaactactgtttcttttgctgaaaaagctaaacaacataaataaaattcaacagtatgattgcgtcacgagcaatgcttaatcataaatcactcgcttgacgacaaaaaataaaatcattaatcagtagctttccgctacactaatccactctcctcttataaatttcaaaggattcatagtttttatgttaagtattgataattttttattttttaatatgttaaaactaatacataaaaaatatataactctgttaaatataatttgataaaatatgttattacttactatttatgaaaatacagacataaataataatctatatagactataacctaaaataggaaggtgtgttggcaaaaaacctaaatggaaggttaaaatctcaaaaaaaaaaaactgtaatcagataaaatcgaatccaaaacattgaataaaaatattaataactcggtcaaccagtataaacaataatctttttactagtacttaatttcttattttatataaactaaaacttaatatcaaacaactattgtttccattatatatacctacccgtaacctttaaataatttagtacatacataaatgtgttattatcctaacctttttttttctctgactcttagcttcatttccattttcatatatataatgttgtcaaattcaaattaaaataaaataaaaaagtgtcactaatggtcggtccgatttctccggctaacttacttaagctgacaagtctttctcctccttcctaacttcgtcccccacacaaatctctctatctctctcaagctttctttatcgtcgtctatg

SEQ ID NO: 30660 - DNA, 3003 bp, Unknown
  misc_feature (1)..( 3003): 2750-1469P.txt file - cDNA_ID_3034366; gDNA_ID_2214478; Annot_ID_133192
aaaatgttttttttgtgggacaagttaaaagtggtagaacatcaatttattagaaacaaagagagtgtatttttctttcttccccatcgggaaaccaaacccaatttatttatatattaaactcgtacaatataaaatcttttatatttaactaaaaattcagtaaatatccattcttcgtaaatatttaaactctattttttctttttaaaaagatcaatttacatcttaaattcaaaatataaaccataatatattatgtacatattaatactgcattctaaacaatttcccaatataaaaaataaaaatatatagaggtaaataacttatcataactactttattgatggcctttataattagtttctgctttggtagaattttttagttcagcctttatctcgttatctgcatgtctctaattgagctttgttgctaagttttagcttttttttttcttatgcgatcactttgctggttgttgtgttggttggttcggttccttgtacctttgatgtatcctctatttctctttttatctaggttaagcttttttattaatgaaatattaagtttgattggaaaaaagaggcacattaatagaaagttagctttgttgtttaggttttatttaatatatgtacgtgtgtcatatgtcataggtaacaatcttactatttgattattaagccggtttttgcgtgacggaactcttcttgtatttgccatcaagtgaaagaaagaggaacatctttgccatagtttagtttgcactctctattggtagcttgagttttcagctattcgaatgtggccttctacacctgcttcccttctatttgacatacttatcatgtggtaagctaacccatccgtcaacgaggaagtacaccacatatagtaagtatatatattagactatctagatattttgttaaagattttatgtaaataacttataaaatatattgttattgttttccaaaacaaataaactagttgacacatacttcttaagttcattgttaatttatataatacaacaacctaaacccatggtgatgattacctttagatcactaaaacttttatcaaaaattttgcctaattttcagtagattccatcagagaaacagcttttctacaaaaaaatttcaccaccaaatctcttttctttaaaacttatcaccacaaacacttgtttttctactaacttttttttaatattgtaaaatcttacaatattttaaaagttaaattttgcttatttcacgtcaatttatatgtctcttacaaaaataacaatatttctgcatcaacaatattttcgagtcattaatatatatgttttacaatattgtaaaagctaatgttttttaataaatcttaaattcattgtcaatatacaacaacttggacccctagagatgattacctttagatcaccaacacttttatcaaaatgttttcctaatttttagtagattccatcacggaaactgttattctgccaaaaacaattttacaccaaatctcctttctttaacatttatcactaagactttttcactaacttttctttcaatattatgaaaattaaataataaattttacaatattttaaaagttaatttttgcttattttccacgtcaataatatatgtctctttaaaaaacaacaatacttagcttaaaaagtattatatttctagatcaacaatatttccgggtcattaatatctatattttacaatattgtaaagctaaaaaaaaaaaaatctatcttgcgtgtcaataataaatgtctcttactaagaaaatatcaagattttgtctaattactaattagaaaggaagcactaatttttggggtgaaaaaatatgatttctggacaattagataaaaaacaaaaaaataattggactaaataaaaataaaagataaaagtgaaaatatttaaaaaaattggggataataatccaaataaaaagatttggtcactgggacagattccgcactatatatatattcttgtctaaagaaaataaaaaaccctaaaaaaaagaggcagacagagagatctcctctttgtctttttactttatctcctgaagtttcgcctcagtcatctcgtaagttttctctctctttctcattcaattcaatttttaatgtaatttcttgtttgatttttctattttcttcgagaaaacaaaattctcctgtaaaatttaatattataaaagtggtttctttttcatttatgtttatataattttcatctttaatcttaaattctggtaaccttaatgcgcgatccgcttttctaaagttttgtgagagagaagagatctaaaaaaatccacaattttgttcaaatcttggagttaaatgctgaattttaggccttgttgcttagatttatggcttaaagtttcaaacttttcattggatatggtacaaatcttgtagttaaacactgaattgtgtccctcgtgggcgttgttgctttgatttatggccaaaagtttcaaacttggatatggtacaatcttgtagttatacactgcattgtctctcttgggtgttgttgttgctttgatttatggcttaaagtttcaaactttttcttggagatggttcaatcttgttgttgaaagttgaaacactgaattgtctctcttgtgcgtgttgttgcttagatttatggctaaaagtttcaaactttcttcacttcagagcttcttgaatggaaactatggttttgtggttttggttaatcttctgctaacactttttgccctgttttggtttgggaaagtgagaagaaaatgtcaggatctgagacgggtttaatggcggcgaccagagaatcaatgcaatttacaatggctctccaccagcagcagcaacacagtcaagctcaacctcagcagtctcagaacaggccattgtcattcggtggagacgacggaactgctctttacaagcagccgatg

SEQ ID NO: 30661 - DNA, 3003 bp, Unknown
  misc_feature (1)..( 3003): 2750-1469P.txt file - cDNA_ID_3034366; gDNA_ID_2214478; Annot_ID_183227
tcatcaattaatcagccaaaacaataagaatttcttttggaaaatctttcaaaaacatgcattgaaaatataaaacgataactaatttaatacaaaatttaatttctaaaacataactaatttagaaaggagtgagtgatatttaaaaaaaataaagaaaaaacgaaaatgttttttttgtgggacaagttaaaagtggtagaacatcaatttattagaaacaaagagagtgtatttttctttcttccccatcgggaaaccaaacccaatttatttatatattaaactcgtacaatataaaatcttttatatttaactaaaaattcagtaaatatccattcttcgtaaatatttaaactctattttttctttttaaaaagatcaatttacatcttaaattcaaaatataaaccataatatattatgtacatattaatactgcattctaaacaatttcccaatataaaaaataaaaatatatagaggtaaataacttatcataactactttattgatggcctttataattagtttctgctttggtagaattttttagttcagcctttatctcgttatctgcatgtctctaattgagctttgttgctaagttttagcttttttttttcttatgcgatcactttgctggttgttgtgttggttggttcggttccttgtacctttgatgtatcctctatttctctttttatctaggttaagcttttttattaatgaaatattaagtttgattggaaaaaagaggcacattaatagaaagttagctttgttgtttaggttttatttaatatatgtacgtgtgtcatatgtcataggtaacaatcttactatttgattattaagccggtttttgcgtgacggaactcttcttgtatttgccatcaagtgaaagaaagaggaacatctttgccatagtttagtttgcactctctattggtagcttgagttttcagctattcgaatgtggccttctacacctgcttcccttctatttgacatacttatcatgtggtaagctaacccatccgtcaacgaggaagtacaccacatatagtaagtatatatattagactatctagatattttgttaaagattttatgtaaataacttataaaatatattgttattgttttccaaaacaaataaactagttgacacatacttcttaagttcattgttaatttatataatacaacaacctaaacccatggtgatgattacctttagatcactaaaacttttatcaaaaattttgcctaattttcagtagattccatcagagaaacagcttttctacaaaaaaatttcaccaccaaatctcttttctttaaaacttatcaccacaaacacttgtttttctactaacttttttttaatattgtaaaatcttacaatattttaaaagttaaattttgcttatttcacgtcaatttatatgtctcttacaaaaataacaatatttctgcatcaacaatattttcgagtcattaatatatatgttttacaatattgtaaaagctaatgttttttaataaatcttaaattcattgtcaatatacaacaacttggacccctagagatgattacctttagatcaccaacacttttatcaaaatgttttcctaatttttagtagattccatcacggaaactgttattctgccaaaaacaattttacaccaaatctcctttctttaacatttatcactaagactttttcactaacttttctttcaatattatgaaaattaaataataaattttacaatattttaaaagttaatttttgcttattttccacgtcaataatatatgtctctttaaaaaacaacaatacttagcttaaaaagtattatatttctagatcaacaatatttccgggtcattaatatctatattttacaatattgtaaagctaaaaaaaaaaaaatctatcttgcgtgtcaataataaatgtctcttactaagaaaatatcaagattttgtctaattactaattagaaaggaagcactaatttttggggtgaaaaaatatgatttctggacaattagataaaaaacaaaaaaataattggactaaataaaaataaaagataaaagtgaaaatatttaaaaaaattggggataataatccaaataaaaagatttggtcactgggacagattccgcactatatatatattcttgtctaaagaaaataaaaaaccctaaaaaaaagaggcagacagagagatctcctctttgtctttttactttatctcctgaagtttcgcctcagtcatctcgtaagttttctctctctttctcattcaattcaatttttaatgtaatttcttgtttgatttttctattttcttcgagaaaacaaaattctcctgtaaaatttaatattataaaagtggtttctttttcatttatgtttatataattttcatctttaatcttaaattctggtaaccttaatgcgcgatccgcttttctaaagttttgtgagagagaagagatctaaaaaaatccacaattttgttcaaatcttggagttaaatgctgaattttaggccttgttgcttagatttatggcttaaagtttcaaacttttcattggatatggtacaaatcttgtagttaaacactgaattgtgtccctcgtgggcgttgttgctttgatttatggccaaaagtttcaaacttggatatggtacaatcttgtagttatacactgcattgtctctcttgggtgttgttgttgctttgatttatggcttaaagtttcaaactttttcttggagatggttcaatcttgttgttgaaagttgaaacactgaattgtctctcttgtgcgtgttgttgcttagatttatggctaaaagtttcaaactttcttcacttcagagcttcttgaatggaaactatggttttgtggttttggttaatcttctgctaacactttttgccctgttttggtttgggaaagtgagaagaaaatg

SEQ ID NO: 30662 - DNA, 3003 bp, Unknown; identical to SEQ ID NO: 17000
  misc_feature (1)..( 3003): 2750-1469P.txt file - cDNA_ID_3034370; gDNA_ID_2214478; Annot_ID_183226

SEQ ID NO: 30663 - DNA, 3000 bp, Unknown; identical to SEQ ID NO: 11082
  misc_feature (1)..( 3000): 2750-1469P.txt file - cDNA_ID_3034373; gDNA_ID_2214478; Annot_ID_183223

SEQ ID NO: 30664 - DNA, 3003 bp, Unknown
  misc_feature (1)..( 3003): 2750-1469P.txt file - cDNA_ID_3034376; gDNA_ID_2214478; Annot_ID_183221
tgctctgcctccaagcatgagccaactaccaaactctggtcttgacttgtctgactctggttgattccctgatgtggtgtctgaaactgcatctgcgtagatagcaaaaggtgtcttggatgatctgcaaaagacaaagttgcttaccatagtgagttgcagaataatttaaaggtatgagttgatagaaaatgcagataatgaaaacaacgagaaatatagaaccaatcaaactacttactgatttggctttagctttttggcttgtgggttagaacttcctaacgcctgccttcttgcatctacagaaaacattttcatgtaagatagcttaccaaaacatttcagtggtttccaagttaagttaatgtgactcactattatctcccctggacaataaagtgccaaagcttcttgacggtaagtcattattctcctttggttcctgctggtaggtagaacattaattatgattaggaaaaaccttagtccataatgaatagatataaagtgttacaaagagacaaaactttttacttcatcagctgtgttggaccttctcatcgttctcaccataaacttcttgtacgcgtcattcaacttttccactggctttgcatccctgcacaagttcccactttcaaatcagaccaataacttggagccgaaacatgaaagtaagattacatatctgttcatttacctagagattccaagattgaagatctcattagcagttttgaccttattcttaaactcaatgtgcaaagcataagctatatagtagacagcatgtgtctttccaatctcattgacctccaaaaacttgtaaatcacttccgcatcagcgcaatgctccgccttcaaaacacacacaaaaactatgagtactctctccataacaaagaaagaatcatctagagggtttaattaaagatagaatcattacatattccaaccagactttaagataacgaagatcatccttgtaacgttcagagtgccaaaatttacgaacacattgctcatatatcactaacagtcctgaacattctcctcctggtggaaaagcctcttgtacccattttatacaccttccaaagaaaccaattaagaagctcagtttacaaattggtcacagcataaagattggttcaagaaaaatttcaatttttcaacaacccaatcaagaatgataaaaggaactcactctatccatggagataaagggtcatctccttcatactcatcaatggcttcaatcaaattcctaattcacaaaaacaacacaaaattagacaagaatcgagcgattagactaaaacccaagagcaaagatgtgagattgaaatcagtacctgcgtttctcgatgagattctttctcaattggtggtcagagtgagatttgagagcgtggttgagaataccaacattgcgacctctcttcaatggccggacgttctccttgaaaagctcccactcgtatccagtctcctgcttcgaattaagaaactctgcctctggatctgaaacctgaaccttcgtttcggctgccatcgtcgtttcttcgagcaaattttgaatatcagagagaatatagccgttagtttactcaatgagagagcttcgcaactttttgctttgatgtacgcatactcggagcgtatagacgcttttgatgggcctaacttagatgggccatgatttgatttcttaaacccattaagtggccatctaaaccgaattgtgtatactcctactacaaataatcgataagagaagaaaaatgacaatgagcgaaagtaaaatagtaaaagaaatgacagaatacacttcattaattcaattggctgaacaaaataacacaataatccagagaaaattatttttactgttttgttttcttctaaattagatggttttggtcttttggagaataacaatcaaagcaaaagataaaagagaagatgtactctttttttaccttctttaaataaattacgagcataattcactttttgacttggaagctaaaaaaaagttcatccacaaccacaagatgctctctgtctgtcggttcaacaagggatgatcacatacattgcgttacacgctaaacctagtgtgctcaattatgaattcctaaacaaaacgtactcaagattagaagttgtatacaaagtctgtttttccattgtaacaacttccaccgacaataaaacagtaacagtttattgaagaaaatgaaatgaagaaaacataataaaagaattgatatttatggtatccttcagtttgggaatgtgacacacatgatctcctttattgacgtttaagtttggaaaaaaaaacaagtctttaaatgcatgcaatcgtattcgcaatcaatatacattttgcttgttattactaaagtctaaaactaaaagccttttgccgtacgtttaagaattccataactggaagaacaaatcatgtttttaattcaaatgtttaaaacaaagtctacattcaaaggaatttagaacacactttttttttttactttttgctgggaattcacaaactctttaacgagtctattcacatttcacctttccgtgcccaaactcattcgatttctctaaccgaaactaaatcatcaccaaagaaggtacaccgttacgccaacttgcccaaaggaccatgtgtccccaccatgctgccaattgggagccagcaatacataaaacagacttgatccaactttttacaagttagatgcagtgtctttttcgtaaatcataatagatccaagcccattctcgtataacctccaccacatcactcctcatatcatatgtgagacagccacgagtcttctaatttctacacgccgtgtcggcaaagcctctcgtcacttctctctgacgcttgtcgtcacttttgaatttttttaatttttaaataattgataaccgaaacggtgcgttttactcaccgtcgtcgggaaaaaaaacatg

SEQ ID NO: 30665 - DNA, 3000 bp, Unknown; identical to SEQ ID NO: 11112
  misc_feature (1)..( 3000): 2750-1469P.txt file - cDNA_ID_3034382; gDNA_ID_2214478; Annot_ID_183219

SEQ ID NO: 30666 - DNA, 3000 bp, Unknown; identical to SEQ ID NO: 11084
  misc_feature (1)..( 3000): 2750-1469P.txt file - cDNA_ID_3034390; gDNA_ID_2214478; Annot_ID_183217

SEQ ID NO: 30667 - DNA, 3003 bp, Unknown; identical to SEQ ID NO: 25366
  misc_feature (1)..( 3003): 2750-1469P.txt file - cDNA_ID_3034394; gDNA_ID_2214478; Annot_ID_183215

SEQ ID NO: 30668 - DNA, 3003 bp, Unknown; identical to SEQ ID NO: 25367
  misc_feature (1)..( 3003): 2750-1469P.txt file - cDNA_ID_3034398; gDNA_ID_2214478; Annot_ID_183213

SEQ ID NO: 30669 - DNA, 3003 bp, Unknown
  misc_feature (1)..( 3003): 2750-1469P.txt file - cDNA_ID_3034406; gDNA_ID_2214478; Annot_ID_183208
gcagatgattgattgttacattcaaaccctagcgaaagtcgttggaaggtataatcttcagattatatatgttaattgtctaggttgctgttgaaatataatgaaaaatgtatgaaaaaatctagggcagaaaattctgtttactttgtgtatttgactctgtatagtgtttgttgttggtttttggttagtgaggaagaggcgaagaagcgaatctacaatgtttcatgtgagaggtatttagggtttggttgtgagattgatgaagagacatccactaagcttgaaggtctttttacttagaacttgtttcttatgtttactatgtgttaactgataataaagaagagtattcttaaagtgttactttgtttacaacaggtttaccaggtgttctgtttgtgcttccagattcctatgtggatcctgaaaacaaagattatggaggtaattgttctgcctactattcaagtttaacctatatgtttgctttatttctccaaatgaaatctttgctagtgccattgtcattgcaaattttgagtcttagtgtgtgcctctcttgaaacatgaaggaaatatttttataagtccatcttggcaaagctaatgagtcttttggctatgattagctttgaatgctaatggactgacatcgtctattttctcttaaccgatttgtgcagatagttaataatatatctaactgcagtctggtttagatgaaaacatatattgcatgcaactctagagtgcttttctcttggaacgtgaagacgtgttattgattatcagtccatcttggcgaagctaatgagtctttgggctatgattagctttgaatgctaatggactgacatcaaataatttttatctaagccgacttttgcagatagttagtgtaatatctacctgcagaccggtttagataaaacatacattgcatctcctgagtgcttcttgtttcaattagtccattttggtgaacctagtgaatctattggctctgtgtgcgcactaaattaatgacatgaccagttgagaagataaaatatatacgcactgatagtatctgtgtgtcactctccctagccatgtaaaagatagttcaaagttcatcttggtaaagttaataattcttttttagcaatgtttagtttagaatgctaatagacttgtatcagtttcttcacttggtgtatgtgtggattttgaatagcaacatgattaatttcctggttgagaaaaagtatatatgtaaccataataacccggtatagagatgattggaggttttagtaaagaaccatggaccagaagtccttcttggcaaagctagtagctttctgccatttctagttttgaatgttaatggactcacatccagattcgctctttcttgtgctgtgctctttatattgaggaagcatggactcaattacgagagatacaccagctttacatttctcaaattaaatctcaactatacagaagaacatttactgtgatcgaattctgatttattcttaatcgttgtcgttgacttgcagctgagctgtttgttaatggagagatagtccaacgatcaccagagaggcagaggcgggttgagccacagccgcagagagcccaagatagaccgagatacaatgacagaactcgttactctcgccgcagagaaaacacaagatgaactgtaactgaagatggtatacatacacctaagctaagccagtatgaggatgatgatgatgatgatgataatggtggtgaggatgatgttactgccgccacacgagggctctgtattccagtccgttgcagttaatggaccgggcttactttggatattgttgaaattctaagttttgtttctatgtaacaattttatttaataatgtaaattgaggtttcactgttttaggaaattactttgggtagaagattagttttcttttcaagaacaattcatgtgggaaatggtaaatttattttagtaatcttttagaatgctgaagcatgctaaaaagagacgattactcttgtggtcaatctgtggaaaagcaaatacaatttggggttaaaaggaaacaatgtcaaaataaaagggcgatctgatgatatctccaataaataaggggaaaatgaaaaagtaaacaagttgattttaaaatccagcggacaaaatctgatgtgagtttttttcttttaatctctcgtccccgaaaaaaagttgacgaaactctctaccggaggcgctagttttcgccgtcggcgaggcaatttaactttccggaggtgcgacgcttctactccgcttatttttttctgctcttgttatttctcgtctcatgtcaagcttctttatgccttctctttgggtgtaaatagttggattagtcgcgaaaaaatcacgattggttcttcatttcgatgtatattagggtttgtgtgagcatatgattgctgagaagtagctagtaattgaatgtttatgtggttagtgggtaggagaatgggctgtggagatatctctactctgcgccgtctagttctttaggtcgtggattacttaatgcgattagattcaatcggatcgtagttctgatctattcgttcatcttgaagtttctagtcaagtagttaggaaatggtgttggtttttagaggcgcagtcactgtttcttgtacaatcagttaaataacttgctttttctggtggttaggagcttgttaaatgtgatcgaagatctatgatatgataaaaaaatctggaatagtattgtgttggtaggtttctgtttctgtgattttggctccatgtatcttgtaattttgaagttcctggtaatgatttctatgttggacgagggagtggaaactcatgaattcagctgtgcattgccttataattgtcttttgttctcattctattagtttgtgatttatgtctgctgatgattgtgctctctgctcattatctcaagggaataaagcaggatg

SEQ ID NO: 30670 - DNA, 3000 bp, Unknown
  misc_feature (1)..( 3000): 2750-1469P.txt file - cDNA_ID_3034414; gDNA_ID_2214478; Annot_ID_183202
agtcagattacaaggacgagctcattgttaaactccatgttaatggtggttgattgcggattggtggactacataattgtgcagatgcaggaatctgaatcatcgtcctctgtatcgctaacttcgctgcaagcataaaatggcagacgtaagatatatagttgttttcaattgccaaggggaaaaacaacaatgtaaaagagtaagttcttaaacagaagataactactctattggaccttcaactaccaatatggatgtaaacgacaagcttttccaatgggtttagttagtgtttctagacatagtaagtagattatcttcaaggttctttactaaattcagattccacaaccccaaattgaagtgagaaacaggactacaggtttgtttcgtctatcagttagtacactaaactgctgccagataggagcacaaacgctataagaaatttatcagctacattacacagggaagccaaattgtttctcataggctcatcaacaaaaatattggaaatagtcaaatcaatactaatctaaggtttacaatatggctagagcaactataagaatttctctatggaaaccattcttaaacaaaaagaccaccagtcaaagatcaagaagaccactccaaaagcacggaaatagccaaaacaaaactaacctaaggtttccgatacgaatcccgcatttgcaaatcattaacatttaagtaagagctagaccaaataaaagagaagagaatcacgatacagcgaaaaacttgaaataatactctacagagatagtgttgttaaggatgatattaccttggttcataaactaaaacctcagcaagattgtctcctttaatgtcattccactgcacagtcctcttaatcttgtcagtgcttctagacatgcctcctttccttggaggcaataaacattgtgactcactttcttcttcctcaaagatttgatcttcaatttcactgctatttaaactaactatagccttattctcacatccattagcttctttaccctctccacgacccgtatccatagcaaatcttcaatctatggaaactaaaccccaagcttaaacaatctggagaagatagagatatcactcgtgttccctaattcatgtcaaataccaaataccacctgatcattcataaaccctaagctccctaaccattaacctcaatttcgcttcagtattcaggggtttgaatttgatcctgatacaaaacaaaagataaatatgaatctaacaaaccctaatcacaaaatctgaaaatttgtgaattctaatatatcaaagtcaacgcttggatcatgaatcaagatcaggatacgaaatcagaaaactggaaatgagaaaaagcattacttacgtagtaaaatggctgcgttttctctcgattagacgaacgaaaaaatctcaaattttctcgaggaaaaaaatcaaaactttgacaacgattaacacaaacaacaaacacccatatcgaatttcaacaataatcgaatccaacaatccagggaaacctcgaatttcccaaaattttgttctgatccgataacgagaaaaaaagaaaagggaaagtgaaggattgaaatctgagagacgcgtttctctcagctgagttctgattgggtgtcgagaaagtgtgcgaaaagaaaattcgttaaataaggaattaacggctaagatcaaacttgagatatttttgtagatgagattaaaacttgttttggcacacggtaggtaatctcgttatgagattatacttcggccgttgactaatcatttttaattagcaaacttgcaactttttaattacttgtttttttggttaaacaacaatattttaattaaacaacttgttgagcttttatgtgttctataatttaataagctttgaatttttcatgttgacaaattcaatatagacttctagatttataattgataataaattaaattgatagaggtctagttatcttagcatatgtatagttttatgtgactaagattacttttatagttttaaattatataacaaatcagggtattttacaagttgtattatcaaaatgaatctatataaataaaacatgaatttatatattgatggtcatcataacaaagacacattttgctaaaagattttattttcctgtttcataaaaaaataatattaataaataagttataaattcatgtcagataatatggttttacaatgaccattcttttaccctaagtaaacctcacgtccacactgaatagaaagaagaattgtgacttagtatgtggggtaaactaataactatatgttggtgaagtcaataatagcttgcgatttgtgtgaaaccgacgcttaatgttcattggattagcttggattacattccaagtattgcttttttaatgataagattaatgtccacataatgacaatagaaaaacaatcatttatgtttctaacagtagaattttgcctttgaggttgaataaagatcagggaaaaaatatatgaaaatctcattttccatggtttcgatattttagatgtaatctaagtttttggaaaaaacacattctacctctgtcaaattccttctgtgtcatcacgggaccgtgcgaatcggcgtccatcggatcccacagctttagtccgaaggctgagaaagcattaaaactctttatcaacgggcctatgtttatattcggctcacaggtacatccacatgttacgtttcagtggcagatacaatagctaaaatgttttcttagaaagaaagataaaaaaatgattgcaaatttaaactgacattttactcaacatccaacaattcaccaatgcacgaaagaaaaagcgcacttattaggctctcacacagatatatgtgcaatgcacacataaaaagttatagattgatgacattgtaaattataattattgtaccctcaagtttcttccgaggtgtttcaagaatg

SEQ ID NO: 30671 - DNA, 3000 bp, Unknown; identical to SEQ ID NO: 11074
  misc_feature (1)..( 3000): 2750-1469P.txt file - cDNA_ID_3034418; gDNA_ID_2214478; Annot_ID_183197

SEQ ID NO: 30672 - DNA, 3000 bp, Unknown; identical to SEQ ID NO: 11072
  misc_feature (1)..( 3000): 2750-1469P.txt file - cDNA_ID_3034422; gDNA_ID_2214478; Annot_ID_183194

SEQ ID NO: 30673 - DNA, 3003 bp, Unknown
  misc_feature (1)..( 3003): 2750-1469P.txt file - cDNA_ID_3034430; gDNA_ID_2214478; Annot_ID_183192
tcttccttcacttatggcatttattctgcttagtaaccttggagcatccattactgaagtttctcaagacgctcttgttgcggaatacggtttaagatatcagataaatggtcttcagtcttatgcacttatggcttcagcagttggaggaatccttgggaacttactcggtggatattgcttactcaagacacctcctagaatcttgtttcttgcttttacagctttgttatctcttcagctcattgtttctttatcttctaaagaagaatctgttaacttgccacggatcggagaagtaactccagagataagctctgttttggggatcgtaaagaaacagtttttggatcttaagggaattgttcaggtagatgaaatctcccagcctttgatttggatagtatcttccattgcattggtccctcttctctcaggatcagtcttctgctaccaaactcaagttctaaaccttgatccttcagttattggtatgtcaaaggttattggacagttgatgcttctctgtttaactgttgtttatgatcgttactggaagaaacttcccatgagggcgttgatccatatcgtgcaactcctgtacgcgttttcattactgtttgattatatcttggtgaagcaaataaatctcgcgttcgggatctcaaacacggcttttgtgctctgtttctctagtgtagcggaaattcttgcacagttcaagattcttcctttctctgttttgctagcaaatatgtgccctggaggctgtgaaggatcaatcacttctttccttgcttctactctgtgtttgtcatcagttgtaagcggattcactggagttggaatggctaatatgatcgggataacatcgaagaattactcaaacctgcctgcaggaattctgatacagtctttggcagctttggtgcctttgtggtttattcattatgttccaatgttagagcctggttttgagagagaagggaagagagctatgagtaagaaaagcagaaggaatagacgtgtagggagagtcataggtcaggaaagttttgcttaccggcgggaaagagaaacataaacaagaatcagtctgagttatagttagagctagttcttcagctgacataacattgtttcttgggaggagaagattttgtgcccatgtaagtaaggatggatactgatgttggtaaacataaaagtcccaagattgacaagaatctcataaatccaatcaaagcaatgttatatctcagttcacaccaatcttgctgcagcaactccaagaatctccccactgtttcattcatcgttcttggtttggagacatgagatgtcatttcttccaagacaagccaacgcacagtgtaatatcttgtactaggataacaatgacctagaaatgaaattaaagttttggttagaccattttttgaatagtaatgaaattgctatgtaatgaaagaaaatttaggatgtgaattaaagttttgattagaccattttgaatagtaatgaaattggtatgttattttgtaagagatttacggttttcagaaagattgtttgaatagatttattagcaaattggaatattcagtggctgagattaaagattccgatgatcttgtggttgtgattttaggaacctagtaaattaggaggtgtcactttagggattaatggttttgcatagttgatttctctatttaagagcaactctgacttctctattgcttcattactcgaaatcctatgttcctccttggctcttccacctccgatcacctaccacaacaagtttttctcctccttttttcgagtctttctcttccccttttcaaaatttttgaccatccatcatgtttctatatcatgaagggaaaccatcatcgtcacaaagttcattctttccgagtaacacttttggtaagatttctaacacatatatcacgtttaaactatcctctagagtttaaaataaatcatatatgttagacattgttcaacattaaaatatggtggaggcaatagatccaaagtttactagaccacttatttttgccgatcaacgacggtcaatggccaagtcatattctcaaatttttttctagtagtgatccgaatactctgaccttctctcctagtctaaataggattctaggaatctatctttgacatcaaagattttgatatgaacatctaagtgagcagggtccaaaaattaaatattagtctaaaaagtgtaattttctttataatttattttttggataaaaaatgaaagtttttgtaagttaatatattgatataatcactttcaaagatttcatatatcaatataaggaaatgaatattcttttatgttataaaagatatattttatccaaaagtgataagagcacttgaatacaaatgtggattgtactggcatagaaacaaatcttttatatattaattgagaagtatatttcagagtctaatggtaaaattttaaggaaattaccaaataaatgacattagaaattaaatacaaataatttttcatttattttcctttaatttaaatagaaatgtatagttcctttttgcttgaaaaaaaataaaatataaaaggaaacatacatttatatttaaattaatgaatataataaaatatattgtatttaatggaaacgtcattttggtaactttcttataaaaaaaataagattctagtctgaaatatattttttaattaatatagaaagatatgttttaatgttagtacaaatcacattaaacaattttgaactattaaaatttaatgtagacgattaagatcaaagttaaaaaaaatatctcaaaaagatcagtcatttcctctataaatacgtgattttagtccattgtcaaaacgtcaaaaacttgtacgcaaggatggaaaaaccaaataattagtacagaagaaaatatttgtctcttaagtcttaatagatccaactagccgaagaaatg

SEQ ID NO: 30674 - DNA, 3003 bp, Unknown; identical to SEQ ID NO: 25377
  misc_feature (1)..( 3003): 2750-1469P.txt file - cDNA_ID_3034442; gDNA_ID_2214478; Annot_ID_183188

SEQ ID NO: 30675 - DNA, 3000 bp, Unknown; identical to SEQ ID NO: 11070
  misc_feature (1)..( 3000): 2750-1469P.txt file - cDNA_ID_3034445; gDNA_ID_2214478; Annot_ID_183187

SEQ ID NO: 30676 - DNA, 3003 bp, Unknown; identical to SEQ ID NO: 26934
  misc_feature (1)..( 3003): 2750-1469P.txt file - cDNA_ID_3034470; gDNA_ID_2214470; Annot_ID_182995

SEQ ID NO: 30677 - DNA, 1314 bp, Unknown; identical to SEQ ID NO: 26933
  misc_feature (1)..( 1314): 2750-1469P.txt file - cDNA_ID_3034470; gDNA_ID_2214471; Annot_ID_183046

SEQ ID NO: 30678 - DNA, 3000 bp, Unknown; identical to SEQ ID NO: 11010
  misc_feature (1)..( 3000): 2750-1469P.txt file - cDNA_ID_3034487; gDNA_ID_2214471; Annot_ID_183036

SEQ ID NO: 30679 - DNA, 3003 bp, Unknown; identical to SEQ ID NO: 26563
  misc_feature (1)..( 3003): 2750-1469P.txt file - cDNA_ID_3034495; gDNA_ID_2214471; Annot_ID_183028

SEQ ID NO: 30680 - DNA, 3003 bp, Unknown; identical to SEQ ID NO: 26550
  misc_feature (1)..( 3003): 2750-1469P.txt file - cDNA_ID_3034502; gDNA_ID_2214471; Annot_ID_183025

SEQ ID NO: 30681 - DNA, 3000 bp, Unknown; identical to SEQ ID NO: 11007
  misc_feature (1)..( 3000): 2750-1469P.txt file - cDNA_ID_3034507; gDNA_ID_2214471; Annot_ID_183021

SEQ ID NO: 30682 - DNA, 3003 bp, Unknown
  misc_feature (1)..( 3003): 2750-1469P.txt file - cDNA_ID_3034510; gDNA_ID_2214471; Annot_ID_183020
ggaagaaactactgcaatatagttttggtagtgccaaaagtgatccaatcaattcacttcgctaagcaatagttatgcggtggtcggaggccggtctagtgggaggggaaggttctgccagccggtcgagtgtttcagatagttcttgagtatatcggttggagattcgacggtccattcagaatagtgttggattggagagaacacatagcgctctccgccctgactaagacacgatttggctccgttcaacaacaaatccccttctgatcttacgaatccagctccgggtttctctttatcagcggcctaatcaccaaacacaaaaaaacgtaatgttaactataacattataaagaaaatgatttaagaacctcaagaacgtacaaaggatattacgtaccttctcagtgatgtacttaaagacagttttcttttcaccagcttcatatatgttgcactgagaatgtatctatcaaaacaacgtcaaatgtatgaacctatgaacaaagatgatggcaaaatcgtaaatgtaggttcatctatgttatcttccgattacggacctgagattcgacaccagcaccaacagcgtaaatggcccaatgacgagtgtagttgttgaagagatggacttttgcgaagcgaacgcgagggtgtcgctgacgtgtaccgtcgaagaagcagtgatgtatcgtaactcttatgcatcggtccgtaacgtgacttgtgtccgctcctattaacatagttttgttgtggttcatgaaatggcatctgaaatatttgtttgaaacataaaaacatgaacacaatgggtagtcatagtatatgtaatctgtaaaaaaaatcatgtttaaaacgatttttagaatatcttttcaatacaaacatagactcaaaacaatataagatttaacttacttagtaccataaaagatttaagagacaaaccttgagacagtgatgtcagtgctttctcgtgtgatatcaatcaaaccatcatagtaattcttgagactacaccgatcaatccaaatattgtgcgattttggtttgatctgaatagcgtctgcgtctggtcccacaccgccttcaaattcaagattgcagattataacgttttcacactcttttagccttaacccttttcccgttatcttcactttttgtcctctcccgtccaccgttgtgtgcgatgatacgttgacaaacgaagacagattgatcgttcccgatacatcgaacacgatccataaaggttctggcctcttgcaagcctctcgcaacgatcctggaccctcgtctgcacataagattattcgtttttatatgaactaagactcgaaccgcacaacatcgtactgccactcaattttaatatgaatttgaaaccagaggtgtccaaatttgactaaaccgacccaatgcttagacatcaatatggtggatatcagaattactttggcgtaaatgagtaagaatattttaaaaagacgtaagcagctctgatccaatgataatttcatttacattaccaatttgaacatggttaggatatcagccaccattttttcttaagatatatgcaagcaaaattcagaatccaacaaatggttaatttgcttttttttttttaccacagaaaaacaaattacgttgcttttaagattttttttttttgtttttaaattactttggaagttttgttcctatttggagtatttggctgacatatcacttgatcatattttttttctatttggagtaacaaaacagagaactacaaattaaataaaaaaaatatataaatccaagaatttgagggataaatgaaggaaaaaggggacttttgaaatttaccagctaaagaagtgacgtggcaaatcggaccatttagaccaccaacggcggcgcggccgaaaccttcggcctttccggcgagagagcggaggctggagtctacgtggcaataaggtcccactgtcatgtggtgatcggatggcgatgacggagctggagctggagctggagcggctgtatatggtggtgggaaaggtgaattgggagcttcgccgggaaaattagaaccgccgtgatgggatctgtgaatgccatgtaagtttcccatatctaatttatataacaaatgttgaattcaatttcggacagtttcagtttttgtatttttgggatataattgctctttgtttcaactgaaccatattgatggtagctttgttggaactgtgccagaatattgttctttttttgtcggaaaaaaaaaaactttttcatttttttttgttgccgacacaaatctatttttatttatttgaataaaatgttggaaaatgtttgtctttttgttaagacgatttcaaatttatagatattttcgcatgataagattctttaatttttatagagtccctttttattttgaatttacattttcatatcaccacttagcttaattttaaaaggaaatgacaaaccaaaataaaaatatgacaaatttttttttttggttattggacagaagtttaagaaatgtggctaaaggcttaaacatgatttagaaataatttttcaaaagtatagatatccttaatgaagcccaacacacatgtttgagactcgtcacaagtgttgacaaaccaaaaactaaagcccattgctaactaaccaagtttttttttccaattttcctaaaccgtatattgaagatatatgtacagtattcggtgaatttaaatcggaatgaaatgctgacgtgggaaacatccctaactgaagaagatgaagaagaagaaaaggcaacccaaaaaaaggtaattcagctgcttctcctacaaataatcagatcgcaaacccttgccgtgacactgaaggcaccggtggccgacggcttattcatctttctccaatcggagagtcgtcgttttttacaatatcatgatcccgctttgaaatttctctgttttctaatctctcaaaatg

SEQ ID NO: 30683 - DNA, 3000 bp, Unknown; identical to SEQ ID NO: 11003
  misc_feature (1)..( 3000): 2750-1469P.txt file - cDNA_ID_3034514; gDNA_ID_2214471; Annot_ID_183012

SEQ ID NO: 30684 - DNA, 3000 bp, Unknown; identical to SEQ ID NO: 9878
  misc_feature (1)..( 3000): 2750-1469P.txt file - cDNA_ID_3034546; gDNA_ID_1974096; Annot_ID_180709

SEQ ID NO: 30685 - DNA, 3003 bp, Unknown
  misc_feature (1)..( 3003): 2750-1469P.txt file - cDNA_ID_3034550; gDNA_ID_1974096; Annot_ID_180708
ttttcaggtctttgagaatcggttttactagattgaagacgagagttttgaatgattggtgaatttgttgatcatcaatggagaagaagagatcaccaagaagtagtaagagtcctggacctgcaattttccctaaaagccctcttgtctacgagagttataagtctggttgtggttggaaattgataaagttcttcgatttcggtcatgtcaaatctggtaataagagacttggttcagagaagaagaaattcgtcagagattctgctggttagtagtttttaaaacactgtttcttggatcatttcgttacatgatcttagtgttaatttgattcttcttctttttttgtaggtaatgtttatactaaaagtcagcttgatttgcttaagaagcttcatgagaagtgtcagtgtaatgatgtaagttttttttgtagttttttggtttagcttaaggagagatttgtgagtgagaaactaaatctcttgatttgttcagcggattgtggaagaagagagatcatgtaagcctaaaacaaggagaagatctttgagttctgatagagaacttgagaagtatgaatctaaacctgttcagggattgctagagagagagataagaaggatcaagaatctaaaggatgaaacttgtgatgtcccggataaacaaaagcaatcttcgttgagtgaaattgagaatgatagtgataagcagatggatatgaagaatgggagagattgtaagaagagttcagagattaaccttcaagcttgtgtgaatgaagctgctgaaacctttatctgttcaaaggcagaagagaaggggaaagatcggtctaagcagttcatggaggcgttagatattctaagttcgaacaaagaattgttcattacactcttacaagatcctcattcattttcggcgaaaaaaagcttagacttggagggatctaaggtaaaagaaccgcgtgataaatctccatcaatggctgatgatttggatagcattgttctcttgaagcctagattatcaagctcggttgatgataaagtgtacttgagattcaaacatctagccaagaagttgaaacttgttgttggatctaacaaagacagcaatcacgcagaaaacaaacccgaaggtagcagtagaggtagagaaatcgaggctgctgcttttagaacaagtgatgtttctaccagtacagttggtcatagaagcccggagtcaccggtgtttaggcgcaagaaacgggttgaatccgatgttttcaagctaagtatcgagaacgatgttttgccaaggagattcatggtggaaaggcaacaggagagattaaattcttcaccggtttatgaagttccttatgcattgagtagtttgcagacaaagctcaaagaaagaagacagaagctagagaagaagagagagagcttcaagttgtggtctttggacaagaacttcgaggtttttgacccgaatccatacaattctaatctaaggtttctcgaaaacaattgtacaggtaaaagattacataacttttaacaaatcatcttcaagccaatgagactaaactgttaaaatgtgaaacaggttcttctgagtacaaaagtctgagaactcatgtagaagacggattcgtggaagatagatatcttgagagctcattagcggtaaatactgagagaaagagtagacatttgttatgtctctactgtctacgctgatttggtgttaatatatgctttataatcgttgcaggagacgaatttgagcctagaaagacaagactgcaacattcatgacccgaaacaggagcaggaacaaccgagtcctgtctctgttcttgaaaggattcatttggaagacgaaacagttatccccggaaatgttaaaatatctaaccttggtaaaagtccatgaatcaaagctttcactattatcatccttggatctgtttgatttacctgaaaaagtctgttactttcttgcagaagagaagattggattatcatttgatgatcctaacattgatcttatagaaaaagaatctgttcatgagtttgtgaagaaagttcttgaagcttcaagattgaattggactaatcttatggcaaggtgcaacgaagacacatcactactcgatgaattctcacacggtagtcacaacgaccagcttcttcttgttcttgattacaccgacgagattctccgcgagatttaccgtcaagacatcaagttttggcctttctcgccatcgaagagctcgagagtcctcaatctagaatcatcccttagagaagatgatctgattcacgagacgatgagacattttgactggagtttactctgctctgactctcctacaagatcattggatcagatcattgaaactgatctaataaagccatgtctttggttggattttggtggtgaatctgaaggtgttgtgtctgatattgtggaaaagattcagcaacaattggtgcttgagatctctcatgagctaagaacaatgcagagaagcatattatgtcgattaatctgaatctcttcggagatattcaactttttttttgtctgtataaaaaagtttataatttgagaatctactcttcatttttagttatctaaattaagaaagattcgatcttttgattctttcagccccgaacataggctggttcaagtaaaaagcttctaattcattgaaaaggttttgacttttgaccaattgagattttgtattggatttagggttttagcagcggccggaaattgtgggcaaaaagattcgaactttttttcattatcccaaatattaatgacaaaagatctcggctttctcgatttttgtgattcagacaatattcacaaaaccctagttgctgctcctgctctgtttttataagcctccacttcccgccaagcccctcttagccataaacagtgaaaaacccttttgttccttcaccaagctctaagaccctatccatg

SEQ ID NO: 30686 - DNA, 3000 bp, Unknown; identical to SEQ ID NO: 9882
  misc_feature (1)..( 3000): 2750-1469P.txt file - cDNA_ID_3034554; gDNA_ID_1974096; Annot_ID_180706

SEQ ID NO: 30687 - DNA, 3000 bp, Unknown
  misc_feature (1)..( 3000): 2750-1469P.txt file - cDNA_ID_3034558; gDNA_ID_1974096; Annot_ID_180705
tcggtgattggagttactggtacggatgggaaaacgactactacgtatttgattaagagcctctatgaagcgatgggtgtgagaacaggaatgtttagcacagtttcttgttatattcatggcgataacaaattggatacgcctaatgctacgatgaatcctgatgctgttttggttcagagtttgatggctaagatgttgcataatggaactgaatctttggttatggaagcttctcctcaagaacttgctttagggaaatgtgatgaagtggatttcgacattgcggttttcacaaatttgactagagaaaatacggattttcgtggtactgatgaagagtatagagatgctgaagccaagttgttttcaagaatggttgatccggaaaggcataggaaagtggttaacatagatgatccaaacgcagcattctttgtccagcaagggaatcctaatgttcctgttgtgacatttgccatggaaaacaccaaagccgatgttcacccgttaaagtttgagctttccttgtttgagacacaggttttggttaatacccctcaaggtatactggagatctcttcgggtttgttaggacggcataacatttataatattcttgctgctgtggctgttgggattgctgttggagctcctcttgaggatattgttagaggtgttgaggaagtcgatgcagtcccaggaaggtgtgagttgattgatgaggaacaagcttttggtgttattgtggatcatgcaaacacacctgatggcttgtcaaggctgctagattcaattcgagagcttaaaccgagaagaatcattaccggtatagatattttcttccatctaatagatactctttgcctgttcggccgttcctatggtctttatatgtgtggtcatctgattattttagttgttttatttatttattgaagttattggttgtgagggtgagaatgaaagagggaaaagaccgcttatgacgaaaattgctactgaaaagagcgatgtgacgatgttgacatctgataatccgaggaatgaagatccatgtaagtaactctaagaattagattgagtctatctcccttgagtgtttctggaggtatattaacagttaattttccaatgtggttttagtggacatcttggatgacatgttgtctgggattggatggacgatgcaagagtatttgaaacatggcgaacacgattactatccgcctttggcaaatggtcatagactcttccttcacgatattagacgtgtagctgtacgttgtgctgttgctatgggtgaagaaggtgatatggttgtaagtattcaaataaacccacactctatacagtactttactgagtgtgttatcaaagttgctggatttacctttatgagcaatcaaagtaatatagttctcgggtaaatagctttgcttgacactgatttttgcaggttgtagctgggaaagggcatgaagcgtatcagcttgaaggtgaaaagaaagagttttatgatgacagagaggaatgtcgggaagcattacaatacgttgatgagcttcaccaagctggaatagacacaagcgagttcccatggcggtaagtagaaccgtaacagctaaaacaaccaacgataaccaaagtttctaatctgtgaagagttgctgaaacttgtcaagatgcttcacgatcactaatctgttcttccttgtattactgtgcttctgcaggttaccagagagtcattaatatctctgtggtgaaatcattagaagagaagttagcttagtccatgaaaccagattttcttccaccatggtccaattctcttgcgaagatcgatttgcacagaggtaatgaattctacacaagtgacataaaaatcatgcccaaggaaaagagattacaccactgggaggtacttaacgttccaatcaccattaccttaaagttattccattgctcacttcacctgtttttttggacaagaggaaacctaagctatcgaaatgtaatattagactaaacttaattcagattttctgtcattgttaccgcaggaggaagattttaaaggtggaagaagatgcgtacaaattttgtaagggttaaaaacccaaaaatgtaagtggttctgttttgggtatgttttgatagcatgtgtttaatttagatgaaccaattcaaaccgaaccaacaaaaatagattccggtttaaattatttattttcttacatgtatccaaacttgaaaaaagtgaattcaaagaaaaaagaaaacgatgaaaatacggtttcaatttcttaatatgaaaaattgagaaagtaggaagacatgattgaacaataataagattaggccttgtgatatattgtgacaagaacataaattacgaatgtttggcaatggtgctagggaatatagtcttttgaaactattaagcatactttgaattttatattctggttataaattaaaagatttcccaatatccattcgtatttttgggaccactccaccaaaaccaatctaatcaaaatataaaaccaaataaataataatttgcttagagatagaaaacatgttatgtccgaggaaattgtcctaaatgtcgcaacaaacgtcaattcattaatcgttttgtttaatacaaatttcgacaagattgtgatagatccagaaccagtttagctaaaccggttgaatcagaagaaacgccaaaacccggtccaatagctcgacctaacgccgtcgttttcaaagttccttcactctacttccttctcgcttacgtcactttccacagatccaacaatgatatcagataaaattaaaatattcccaatatattttctaagaatatctccctatttatttttatttatttaaactattttaatctcttccgtgtttcactcttctctctctctcgcttctcttcattgtttgtgtgtgattacagcgaagaagagagaatccttggagcattccatg

SEQ ID NO: 30688 - DNA, 3003 bp, Unknown
  misc_feature (1)..( 3003): 2750-1469P.txt file - cDNA_ID_3034562; gDNA_ID_1974096; Annot_ID_180701
tcgttttgttaaggaagtctgaggggtccatttctaagatttttcttatccaataacaatctccgatttatgttcttcctaattagaccatggttctgtggattacgtcgagtagtatcggttgtgggtggaggcgatatttttttgcaaatgtcagaccaccatgcttctcttagccaactatgccggacgcttatttttcagagttcttccaggatttgtaatcattcggaggtgaccgtccgtcgtgtggaacggtctgaacataccatcaccagtacatgtgcttgcgaagccatattcgagtttgagaacattttgagatacatgatcgttagattccactagtaggaagtagattagatgaattagaattgaggttttagaataatttttaaaaaatgtgaaggaagcaaaactgagtttttggtatctgatttgagaaatgcttaagtttgatttgtaggctacatatatataacattctcttcacatatttgtggtctaatagtttcaaaattctaataactgctgattaattttggtaaagtttgatcaggtttggttacggaaaatgtttatttcttcaaattatagtatctcaaatgaagctttttaaacatacgtgcccacatgaacaaggcaagtgaacttggtctctttctaaccacatttacacattattaatttattatatatccaaatattatagctaaagggttcataaagctggtggtaatggattttttctgataagttcgaatcttaaagtagatttatataatctgacttttattgttctatattgtctttggtatgccttttacttggaagaaatctcacatacacttcttgttcatttgttcatccagctttgatgcacgtgaaatctggtgtcatgttattatctcaacaaataactataatttatctgcgaagttaaacttttaattagaggataatagcgaattttctcacttcataattagtctttgcaaaattgtcttcctttttaagacttgttaggaaaatactaaatctatgagtgcaaagttggttggttacacgtgtcaaaagcatgagttcggaagtggggttgatgacctaactcattgaacttatgattttcttaataatccaagttatgattttcataaaaatttatattttcttaaacggacaataatgtgtttttaacttttaacgacgtgactcttttgttttcatttcagaaaacgacttaaatctaattcccaaagctcaagttcatgttcctaatataactaagaactaaataatttgtgttctgtttataaaaaatattgtgatttagtaaaagtagacttttaatgtactttctaatcgaaggtcaagatttccttagaaagatttcattttattaaatatcgacaacaaagatgacatgtttaggattaaattggtgtcttagacctaatctatgactcttgtattggaactagatgttgatgccgacaaaaagaagacgaatgaaataggtgttgatgatgatatttaatttcaaggcctaaacttttttcagcttattaatctcgtaagaaattatatggatttttatcgatatgattaaagtattaaaccagattattattagctacagatattttttaaaaatatactttcccaaaggtaggtgaaatgcttatcaatctcaataaaaaaaataaaagcaacatgacgaatgtatccttaaacttggccataaacctcatcattttctactttttttttttttttttttttttttatctttttacatttttaactctttagatttaattcttctaactcccaacaatctccttaccaaaatttcctccttaaaattcaagttttttggaacgttcaaaatagtactataagtttgtttttattagattttagtgagctcaatcggtgacagctaaacattattgcacaattaaatcacaataactctctgcctgtcttccttttttgtgtaaatgcttcaataataattttcccctttttggaaccaagaatcagtcaattgcattgattcttttttaaccaagtaagctaccaaagtttgtagtattattcaaagatgaaaccaaaaactactgtaattattggtcacattatgtgactcacatagatatttcaccaaagctgaaaaagtcgctttattattgggtatggggtagagaaaagtaaataagacccaaatataaagtcaagccaccgtgcaaaacaaattgaaattgcgttgtgacatgttcttataaatttctgaattatcttattacttagtttagccccacacttaatgtgcacacgagaaacctaaaactaaaagagatagattcgattctcccacacgtgcgcttctgctgtgtcacctttctctttgaaaggaatgatcgtcattttcttttgcttaaattatcttcaatttttttttccttaaaatatcttcttccactaatcttcgttagttatgcacacaaaattctgaaatattttgacaaacaatttgtcatttttttttttaaagagaaaatagtcgttataaattaatattttaaacaaaataatgatatcttaataaataaattagagaaagaaaacagggaaaaaaacaaattagtcaaaattttcgcaagtgcaatggacaaaattacccctaaagatcgtataatttacaaagaactttgtctttgccgtgttttgaccttaaaccttgacacacacatacacacgaacacacatatacatatacatgtatatatgtatttttctggaagagaaacaataacattcccagaaatttcggggttacgtgtcgctttatttgtaaaacgatttttcagattttgattgttaaagaagctttctgtgtattatttttgatttttactagagaaaaactcgaatgctctgttttgttctctcgagaaaattctcagactcagagaaaagtaaaaacagagaagaaagatg

SEQ ID NO: 30689 - DNA, 3000 bp, Unknown; identical to SEQ ID NO: 9883
  misc_feature (1)..( 3000): 2750-1469P.txt file - cDNA_ID_3034569; gDNA_ID_1974096; Annot_ID_180698

SEQ ID NO: 30690 - DNA, 3003 bp, Unknown
  misc_feature (1)..( 3003): 2750-1469P.txt file - cDNA_ID_3034573; gDNA_ID_1974096; Annot_ID_180697
atgcaacgcagactcgtaaggttaaaaaaagagtatatctacaggaaaagcttggaaggtgatgagcgtaaggtctatgagcagaagcggctgataagagaagcccttcaaggtctagtgatgattttttttttcagtatctgttgaaacaatcattgattcgatgtgtatttttcgtttttctgattttggtttatatggtttaacagaaggaaagccgattcctactgagctccgaaacgtcgaagccaagcttcgacaagaaattgatcttgaagaccaaaacacagctggtaagaatttggaagctagatttttccaattggtttgaacctgtgatatgaatggtttgtggcatcagctaatggttatcatctaatcatgttgttactagttccgcggagtcatatcgatgatgaatatgcaaatgctacggaagcagatccaaagattttgttgacaacttctaggaatccaagtgctccgctcatccgattcactaaggtattgttttgtttagtttccgtcgttgaatagatgctgacgttataatgttcctgattccttttcattgatggtgtggtttctgttgcaggaattgaagtttgtgtttcctaactctcagagaataaatcgtggtagtcaggtatgtgtgttgttctggcttctgcacttaaagtcatttggaaatatctaattctctttttttctgtaatctggttttgttttgcaattgatcattgcttgtggtttcttcatcgatgttgttaaattgattgccaatggtattagctcccttttgtttcctgggtataactattgcatgtgcatagacttgtatcagattattgttgaatttatgcgcaacactggtcatatcaatgaattgcatattagatcaagctttataatttaaaatgtagttgagtctgtccaattctgcagaatctagatttcaaataaaagcaagactaatataaacgatcatttaagctggagttgtactgacacttatattcaacacaaaacctctctatgtaagtgtaacacggaaactatgttgcattcgaatcgtaatctaagtttctttcccactctgttaatttgcaggtcatttctgagatcattgaaactgctcgttcccatgattttactgatgttatattggttcatgagcaccgtggtgtgcctgatggtctcattatctctcatctcccatttggaccaactgcatactttggattacttaatgtggtaagtaactctttgaggatctgatttttatatccaaatctttcttctttcaactcctagtttagcctttttacttaatccaaagtcccttctgtttaggtaacaagacatgatatttcagacaagaaatccattggaaaaatgcctgagcaatatcctcatctcatttttaacaactttactactcaggtatatctctagagccaaaattcacttcgttcttactgtaatttggtattggaaaccatcaagcttcgtcgtgtctcatagaatgatcgctctggtttattcatttctaatgtaaacatattttcaaatttgatttccctttgttttgcagatgggtcaaagagttggaaacatcttaaaacatatcttccctgctccaaaactggatgcaaaacgtatagttactttttctaatcaatccgattatatatcattcaggtaaaattttctcacaatgatcagattttacgaattttaattggtgacatcaattgtagtatgcaaagcctaaggtcttaaggcttatgttagcatttggtaatctgatccacatagaaacagcatgtaagaacactgtaaatacaacagatggagatttttataaattcttgtgggtatatatatataggaatcatgtctatgataaaggagagggaggtccaaaatcaatcgagcttaaagaaatcggtcctcgatttgagttgcggctctaccaggtacgcattctgcttaaccgaatcaaaactgttttcctcgagtaaaataatggtttgataaagaatcattctagttccttagtaacaatgttgtttctgtgtaatgcaattatttttgcaggtgaaattaggaactgtggaacaaaatgaagcagagatcgaatgggttataagaccgtacatgaacacctctaaaaagcgcaagttcatcggtgaatgatgactaaacggaacagctttgaaccctttatctaaattctgttttacttatcattctgttggaagagctgttcagtttttgtgtccttagagaaaattgcgatgattttgttttaacgtttagcttataaaaacaaaactttcttgtcttcaattagtatttatcttcaaccatatactgttgcgtgagtcataataaaaaattttgtagtagtatttttatccacgaattcaaacaaaaattatctgagcagcatcgaagtgctaaaaggtattggaaaatggataaacacaaaattgtcaaaattctaaactataatttttattttttaattataaatatctttcatcgtgttgttatatatatatcagtcccaggtttcgtctcatagtttcagttgtgtctctttcatctgatcatcggatctatcggtaatttacttcttcgtcttcctcagatcgatttgatctctgtgaaagtcgcgaaatcgaattttaatttcgtttaatcatttgcttgcttcccagttttatttttgttttttgttaatattatatcgaattttctcggccatatttttcattttaaattctatccattagttttataaaagtccataacttactgctctgtgttttctcttttgattcttctctgtttatagtgagtagagagagttatcatctagggtttatagattggagattttagccgcaacaaggaggaagtgtttttaatttaattttattgttaagagttattgttgctttagggatttttagaatttgggtgttcttttaaatg

SEQ ID NO: 30691 - DNA, 3003 bp, Unknown; identical to SEQ ID NO: 30690
  misc_feature (1)..( 3003): 2750-1469P.txt file - cDNA_ID_3034573; gDNA_ID_1972138; Annot_ID_179199

SEQ ID NO: 30692 - DNA, 3003 bp, Unknown
  misc_feature (1)..( 3003): 2750-1469P.txt file - cDNA_ID_3034585; gDNA_ID_2096290; Annot_ID_195346
aagggggtgagtatgagctcttgagggagatttttccttcaattttctttaagcaagagccttgatcgatcattgttataactacatatattatatatattgagagagagaggtagagaaaaaaaaaacttatatgtaacttaagatcttattttgtctctcttatttgcatgtacatattttttcatgaaagaatgagacagttgggcttgcttatatatttgatgatgtttaatgtgttaccgttggatacatattttcgcttccattttgtgaaattatattttcttcttttggttagttttttacattatgatattatgctgtgtaatttgtactatcatatgtagaagcgaaaaagacataactctagctaggagcctacgattgatctcccaaatgttgattataatatatacatatgcttttgggaaacttaagtattaaattgacaagttcaaatggtcaacttcttactgatttatatcttaataatcaaaaattacaaaaaaaagttacaagctcatatgtgatgaagaaattagaatcggaaatttaatgtaagggtgttgatataaaaggttcaagttgtagacgacgaatatctatgtgtgtgaacaagtaaagaaaaaacaaaacaagttgagatctaaccttgtgtcctaagagaatggacccgaataaaagatttgactgcttctgctttctatcttatccacacacacatggaaacatagactgtggaccaataatattacccctaccatcaaaactgaaaacaatgttttaattcaaaaaacgaaaaataaaaagaaaatactaaacaataataaaattatatatcaaatctcagatttataaagagtgaatgaattacaaaaaaaatttgaaggaacgagaaggatgcgaagaagaaccttagaaaaagatctctttatatattaacttgtaaatgtgtttgtgcaaatgaaagtataggcaacaaagtaatagtggattctctatatataagtattttatgaggaacaagaggaccaaatttctgaattaataagcaatactattatttgggagcgcatttgtgtcatataccaaagtcattgaatttagctgaaacttgaaatcatgagatgaacgagtcatgagatcatagaacatgtggatttctgaaatttcaacatgcgcgctccaatgtaacttcagtttcctatttgaaaactattcttaaattttgaaattcaactgatatgtccaatctcgaatcttttcattatcaattatcatactcaatttgtattaaatcacttcaaatacagtagtttttttttttttagtttaaagacgtttcttaaaggttttaaatgttatgacacattcacaattatcatcactggtaaaatttgcattggagtgttcttggaaaacattctttcaatatagtcataaaattacgtttgacatataattcttacaaacctaaggtatattcgcaaaaatgttatagcaactttgagaaaacatattaaatatatacataaatcctttctatgttctagattttgactaaatatgtacatghttttgactgaagaatgatttggcctacacagataactattaaaatgatcatataccaagtcaaatcatatattgaatcatacgggaaatccatttgacacaaatctgtattagatggaacatttattttagtattttcatattattttgcttataaaaagaaatctcggtgataatgattttggttttgttttcggggtcgttatcaaattcacctaacaaaaacaaaaaaggaagccagaatgttagaaagagaagcaaagttataaaagatcttccgggagaatcaagtaattgccaaaccccctagtccctagacaactacaatcatatgacaaacattatattattttagaaaatacatacaaaagctccgtttttaaattgaaaaataagcttatatctaaagaaagatcaatttattacgtcaattttaagaagaattttaagcatattctaatggtggaatatcatctttcaaatacttcccaaacaccaaatctaggcatcgaaaccgttgtggacgtgtagatatcatttgtaatctattgccaatgaccgattgattgtatcatcatcaaaatgaaaaatgcgtggatattgtaaaaataaaaattttagttgacaaactcatgtcatgcgacataactcattgggtcaggcaaaatactacattcgaatccaaatctggcaattatagctagcactattccttgtatcaaaccggtaataaagctagaggtaaagttggcaaacatagatagtttataaacaactatgctttcggatatcattggtcttctttttgacttacattcatattatataatgttgttgcaagtatatgatatgtttcgaatgaaaagaaaaaaagtttcgaatgaccaatcttctcttctcgatcaataattggattttgctggtaaatgaattatttactatatatcttctttgatacgtctcttcttatttaaatgacataaaacaaatacaataatccaaattttaggcacgtcaacattattaactcttaagtggacataaataatctcactcttgacggtctttcaaaggtattgtattagcatgaaattctatattaattcttaacatttacctttatcttgtttttgttcctaagaacgttttctaaaattctccaaaatgggcccaaaagtatgaaatccaaattgagcccaaagttgtgatccagtgaaacgataaagctctcacgaggttcaagctcccacaagctcagatcgtgggcggtaaaagaaacggttaactaattgtaaaaaatgatttttttttttctacttcactaaaatattacagttttttttagcaaaagtaaaagtttcgagaaactctgaaaaagcagttttcaatcttaggagcagtgtatgtgtcatgtacatcgagatg

SEQ ID NO: 30693 - DNA, 3000 bp, Unknown; identical to SEQ ID NO: 9909
  misc_feature (1)..( 3000): 2750-1469P.txt file - cDNA_ID_3034595; gDNA_ID_2096291; Annot_ID_195395

SEQ ID NO: 30694 - DNA, 3003 bp, Unknown
  misc_feature (1)..( 3003): 2750-1469P.txt file - cDNA_ID_3034595; gDNA_ID_2096291; Annot_ID_195417
tttcttctgactctttttcaaattcgataaatgttggttgatcgtatctttcattatagttctatgattcagagtatcatttcctattagatccctttgaattccatattcgaagttgcgatcaggtctcttcattaaaaagaatcgattcaatacatttcttatgtacccatagggactatattggaattggatttgaatcatatttcggatcaatctatattgattgactgcctccattatgttgttgctagcaaataccactcttttttgatcttccaaataattcccgcaggagatccggacccaaatttttctgagccttcgataaaaagattcattttcttcataaaaaataggaggtagaaccaataaagatttcttttttgattcatccctgaagttgaaaacctccttcaagaattgtctttgatccaatccgtaggaatcaatagaaaaggcaaatcccttatgatacaccagatccggctcggttattgatagagtgaatagatctgccatttcttgaaatctctcttctgactcgtggcgtaacgtgtatccccccctcttccgttcatggaatagatgaaataaatcaaaaaatggatttttgttcaagaatgaaatcttattggaactgtccatatccagttcatccttcggaaccatatcacatcccagatctgatgaaataggatgaattgagacggtattttgtaaatacgtaattatcttgaatatattaactatttctttattttccgatcgcctggaagggacaaaagaaacatcttgttctttcttcaacaatttctgatccctagtggacctctcagtaggattcgaacccagatgaagttctgaccatctgtcagagaaaaaagaacgaatggctcttgtaggattcccaagaaattcttcgctttcttccggaagcagatgattattcattcgcttctcacgttccgtgaatagccggggcattgaggaatagccagaaaggtatttagggaatcggtctgattctatctctcttccttccgtttgaataaaggaaggatccaaaagaatcgatctttcttttagttgttgaatctctctttgattgatcaatgtgtgatagtgatattccgaatcctcattactaatggaatcgaaaggatctatgaattgatcagaagatccgttcaattggctagaatccgttacttgaacgaaactagatcttgtagaatcatattgaatatttgacgatacgtttcgtaccttgctaaaaaatctatccttgtttaccaaccacacattgtctaaccaaatccaattctctctcgatattttcctaaaaaaatccgattcgtgcggattcttcccccaactaacgaagagatcttggtggaattgccacatatgaaattgagcacaattttgcaaagaaatagcccacttgtttctcgagaagagatgggaaacatgctcaatatcatttgattgaatagttgacccagctccttgttgtttgcagaaaccctccacttcaattggtattttttcacgaaaagcaaacatgagataacaaatccagtctttcactaagatttcgaatagctgtcccgaattcaagttgattatgtttcgcctcttactcggagaaagacgatcaaacaattcccaatcatggcccttgcggatcggatcatccatataatatacaaaaagaaactccagatatttgatatctttctctttaaatgagatatcaattccagcgacggtttcattagatatcttacaacaaaaacccctcttttttccgatccagttcctccaccaccgcgaactccagttagattcaggcatgatacacttttgagttattgggagaacccaagtactctctttcggatcccggaaacagctctcagagatcttttttccttttgtaagatacaggagcgaaacaatcaacctattgatattgcaagacccaaaagattcttccgatgtatcatttctgggtccaatggaattcataggtataggaagaagccctttcaaatagagatttttgctttcgaccatatttcgattgttaatacgatatagaagggccgctactacaaatagtactacacccttgatcgtgaaatatcgattgcttgttgaaccctgtgaattgcgcaaaagtaggatactaaaaatccgagggtccaagagttttctaaaacgttcttggtggaaaaaaatatgaatgaaagatcccactgaattgaattgggtccatgaatctaagaaatagtgagcattcttgatctctctcactatttctctcaattcgaaaatccaggatttgaattgatgtcctttcattgattcctcctaaattgcattgatttatcctaaagatttcatttcaattggaatttggttattcaccatgtacgaggatccccactaagcatccatggctgaatggttaaagcgcccaactcataattggcgaattcgtaggttcaattcctactggatgcacgccaatcggaccctccaataagtctattggaattggctctgtatcaatggaatcttctcatcatctatacataacgaattggtgtggtatattcatatcataacatatgaacagtaagaactagcattcttattgagactagaactcatagggaagaaaatcgatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagcatg

SEQ ID NO: 30695 - DNA, 3003 bp, Unknown
  misc_feature (1)..( 3003): 2750-1469P.txt file - cDNA_ID_3034602; gDNA_ID_2096291; Annot_ID_195415
gaaaagaaaagaactgtcttttctgtatacttatgtatactttccccggttccgttgctactgcgggctttacgcaattgatcggatcatctagatatcccttcaacacaacataggtcgtcgaaaggatctcggagacccgccaaagcacgaaagccagaatctttcagaaaatgaattcctattcgaagagtgcataaccgcatggataagctcacactaacccgtcaatttgggatccaattcgggattttccttgagggatattggtaaggaattggaatgtaataatatcgattcataatggattcatatcgatacagaagaaaaggttctctatcgattcaacaagtgctgtacttatgggaaagcgatagagaaagagaaaaaaaaaaacgaagatttcacatagtgatttttttttttttttttgatcaaaaataaatctgattgaatttatttcgtaccccttcgctcaatgagaaaatgggtcagattctataggatcaaacttatgggacttaagaatgatggaagggaataaaatcaaaaaagaaatcaaataaagaaaagagagagaaaataaagaaaaaataagtaaatcaaaatgaagtagaagaacccagattccaaatgaacaaattcaaacttgaaaaagtctctttctgattctcgaagaatgaggggcaaagagattgattgagaaagatctcttgttcttattataagatcgtgtgattggacccgcagatgtttggtaaaaagaataatcttatcctttgagaataatcaaaaatagaaagtgttcagttggaacatgaaaacgtgaccgagtttgtcctagttactcttcgggacggagtggaagaagggaggagattcgcgaacgaggaaagggacccaatgacttcgaaagaattgaacgaggagccgtatgaggtgaaaatctcatgtacggttctgtagagtggcagtaagggtgacttatctgtcaacttttccactatcacccccaaaaaaccaaactctgctttacgtaaagttgccagagtacgattaacctcgggatttgaaatcactgcttatatacctggtattggccataatttacaagaacattctgtagtcttagtaagagggggaagggttaaggatttacccggtgtgagatatcacattgttcgaggaaccctagatgctgtcggagtaaaggatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccacgagacaaaagatcttctttcaaaagagattcgattcggaactcttatatgtccaaggttcaatattgaaataatttcagaggttttccctgactttgtccgtgtcaacaaacaattcgaaatgcctcgacttttttagaacaggtccgggtcaaatagcaatgattcgaagcacttatttttacactatttcggaaacccaaggactcaatcgtatggatatgtaaaatacaggatttccaatcctagcaggaaaaggagggaaacggatactcaatttaaaagtgagtaaacagaattccatactcgatttcagagatacatatataattctgtggaaagccgtattcgatgaaagtcgtatgtacggtttggagggagatctttcatatctttcgagatccaccctacaatatggggtcaaaaagccaaaataaaagatttgagcccttataaaaagaaaacagattcttgaacccctttcacgctcatgtcacgccgaggtactgcagaagaaaaaactgcaaaatccgatccaatttatcgtaatcgattagttaacatgttggttaaccgtattctgaaacacggaaaaaaatcattggcttatcaaattatctatcgagccttgaaaaagattcaacaaaagacagaaacaaatccactatctgttttacgtcaagcaatacgtggagtaactcccgatatagcagtaaaagcaagacgtgtaggcgggtcaactcatcaagttcccattgaaataggatccacgcaaggaaaagcacttgccattcgttggttattaggggcatcccgaaaacgtccgggtcgaaatatggctttcaaattaagttccgaattagtggatgctgccaaagggagtggcgatgccatacgcaaaaaggaagagactcatagaatggcagaggcaaatagagcttttgcacattttcgttaatccaggaacaggatctatatagacacatagatccatggatccatacatctcgatccgaaaagaatcaatagaaaaagaaaaaatcggaattgatcgatctctttctcgaaacaaacgaaaaggaaagaaaagacgaaacagaaatcatggatcaactaagccctctcggggacttgcttaagaataagaaagagcaatctcatgtaaataccatggaataaggttttatcctattcatggggattccgtaaatattccattccaaaaatcaaaaattggtttttttttggagattggatgcagttactaattcatgatctggcatgtacagaatgaaaatttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttatatttcatctcttcaacaagtttcgtaatgagcataacggccctattgttccgatggagagaagaacctatgattagcttttcaggaaatttccaaacgaacaatttcaacgaaatctttcaatttcttattttactatgttcaactctctgtattcctctatccgtagagtacattgaatgtacagaaatg

SEQ ID NO: 30696 - DNA, 3000 bp, Unknown; identical to SEQ ID NO: 9902
  misc_feature (1)..( 3000): 2750-1469P.txt file - cDNA_ID_3034606; gDNA_ID_2096291; Annot_ID_195410

SEQ ID NO: 30697 - DNA, 3000 bp, Unknown; identical to SEQ ID NO: 9903
  misc_feature (1)..( 3000): 2750-1469P.txt file - cDNA_ID_3034610; gDNA_ID_2096291; Annot_ID_195402

SEQ ID NO: 30698 - DNA, 3000 bp, Unknown; identical to SEQ ID NO: 9906
  misc_feature (1)..( 3000): 2750-1469P.txt file - cDNA_ID_3034614; gDNA_ID_2096291; Annot_ID_195399

SEQ ID NO: 30699 - DNA, 3000 bp, Unknown; identical to SEQ ID NO: 9907
  misc_feature (1)..( 3000): 2750-1469P.txt file - cDNA_ID_3034616; gDNA_ID_2096291; Annot_ID_195397

SEQ ID NO: 30700 - DNA, 3003 bp, Unknown
  misc_feature (1)..( 3003): 2750-1469P.txt file - cDNA_ID_3034620; gDNA_ID_2096291; Annot_ID_195396
gaataaaccaatttaaaaatgggataacatcctcgataaggcataagttctaatatcataagtgcttcttcataggaacgtccacgtatttgatcaattactctccgtgctttatgggcagacatagatatatattgccctaaagcatatacttccgtatatgatttcttttttctcttctttatcataaggtttacctctcactcaaaaaaaatctatattcattttttttaatttatttaattaacgacgagatctattatcatttttggcatgtcctcgaaaatttatagtaggtgaaaattctcctaatttatgtcctaccataagatctattatataaacgggtaagtgttcccttccattatgaatagcgatcgtatggccaatcattgtgggtataatggtggatgcccgggaccaagttattatgatttctttttccgcctttgtattaagcttctctatttttcttaataaatgctttgctacaaaagggtttttttttagtgaacgtgtcacagttaattaactcctatttttttaagacgaagaaagaaattcgattttctctcctatttactacggcgacgaagaatcaaagtctcactatattttttcctttttctagttcttcttccaagtgcaggataaccccagggggttacgggtttttttctaccaattggagccctcccttcaccacctccatggggatggtcgacagggttcataactactcctcttactacaggacgtttacctagccaacatttcgatccggctctacccaaacttttctggtttaccccaacatttcccacttgtccgactgttgctgagcagtttttggatatcaaacggacctctccagaaggtaattttaatgtggccgatttcccctcttttgcaatcagtttcgctacagcacccgctgctctagctaattgtccaccccttccaagtgtgatttctatattatgtatggccgtgcctaagggcatatcggttgaagtagattcttctttttgatcaatcaaaaccccttcccaaactgtacaagcttcttccaaagcatacggctttctggatgtagatgatgatatctatacggatggatcttatatatatcgtagaattcttctatatatggtagaagtaccacacgagtggatatataggaatcaaaatctgccgaataacttatgttatgatcttctacatcctaggtcttcccgttccgtcatctggcttatgttcttcatgtagcattcagaccgaatgactctatgaaattacgtcgatacttccacatattatgggtaacgtaggagacatctctatttttccccgggggaatctttagaattaccactgcttagctttcaattcgcctctgaccatcaaatgaaatgtgaataacccgtcctcctctctttgaaacaaggggcgcttatggttctgtcggtgcttgaaacaattttgtcttctccatattactatatctctagagtcaataattttatatgaggaactactgaactcaatcacttgctgccgttactcttcagttttctgttgaggtctatcctgtagaggtactcaaattggatcagtgatcgatttctaggtttcgtcgtaaacctaattggttacttccaattacgtaaatcaaatagttcaaaccgcactcaaaggtagggcatttcccatttttataggaacttctgtaccagaaacaatggtatctccaattatagcccctctgggatgtaaaatatatctcttctcaccatccccatagtgtatgagacaaatgtatgcatttcgattagggtcgtattctatggttacgattctaccatatatgtcttttgcatttcgtcgaaaatctattttacggtatagacgcttatgacctccccctctatgccttgcggtaattattcctctggcattacgacctttaccacaatgatgctgcccacagatcaaattatttcgtggattggatttcacttgactgtctacggctccattgcgtgtgctcggggtagaagttttgtataaatgtatcgccatgctattaagtattttgatttaagttcttttctttctaagaggtggaatagaataacccggttgaagcgtaatgatcatacgtctgtaatgcattgtatgtcccagaataggtcccattcttttaacctttccggggagtcgatgactattcatagctattaccttgacaccaaagaagagttcgacccaatgctttatttctgtcctagttgatcctgattcgacattaaaagtatattgatttttccccaataaccgaatacttttgtctgtaaatactgcatatttgattccatccataaatcgattttcttccctatgagttctagtctcaataagaatgctagttcttactgttcatatgttatgatatgaatataccacaccaattcgttatgtatagatgatgagaagattccattgatacagagccaattccaatagacttattggagggtccgattggcgtgcatccagtaggaattgaacctacgaattcgccaattatgagttgggcgctttaaccattcagccatggatgcttagtggggatcctcgtacatggtgaataaccaaattccaattgaaatgaaatctttaggataaatcaatgcaatttaggaggaatcaatgaaaggacatcaattcaaatcctggattttcgaattgagagaaatagtgagagagatcaagaatgctcactatttcttagattcatggacccaattcaattcagtgggatctttcattcatatttttttccaccaagaacgttttagaaaactcttggaccctcggatttttagtatcctacttttgcgcaattcacagggttcaacaagcaatcgatatttcacgatcaagggtgtagtactatttgtagtagcggcccttctatatcgtattaacaatcgaaatatg

SEQ ID NO: 30701 - DNA, 3000 bp, Unknown; identical to SEQ ID NO: 9910
  misc_feature (1)..( 3000): 2750-1469P.txt file - cDNA_ID_3034624; gDNA_ID_2096291; Annot_ID_195393

SEQ ID NO: 30702 - DNA, 3000 bp, Unknown; identical to SEQ ID NO: 9911
  misc_feature (1)..( 3000): 2750-1469P.txt file - cDNA_ID_3034628; gDNA_ID_2096291; Annot_ID_195390

SEQ ID NO: 30703 - DNA, 3003 bp, Unknown
  misc_feature (1)..( 3003): 2750-1469P.txt file - cDNA_ID_3034631; gDNA_ID_2096291; Annot_ID_195389
attttttttatagagtttttatcataattttgcatataatagaagtagtaattataaaaatattatatattaattatcaattgggtttttgctaaacggagcctggatacttcattttattagtccgatcacgtaaaccataaaaaaattttgataatctaatatcaatctaaatactccctgcatttaattccactttattttttgcgcttcgcgttacaaatttttgataattcaatcaatctttttgagcgaaacagaggatatctcgatcgagggagaaaatggggaaatcccatatagcccgatatatctgacaagtcgcactatatgtcaacccaagatgtatctccttctccaggacttcgaaaaggtacttttggaacgccaataggcatgaaatgaaaaaaaaagagaatgaagttctctatttcactttgatgtggaaacgtaaaattggggtttcgttttttaatactattatccttttttcctactttattaatcatatttaaattaatgatatttaatacataagttgaataagctaaaataaaatataaaataaaagtaaagtaagagagaatgaataaaactaaaggaaattttttacgaacgggcttctgaatgatcaacaacaatagctatcttggttcatagaaaataggattaacccccattgcatattggtacttatcggatatagaatagatccgcttccctttttttctatgaattgaattgttccattattactaacagaatagaacaaatattaatcctttctccgaaataattacctaaaaagggggggtacgtagcatagttttttccaatgcaataaagttacatagtgtctatttttcgttgataaaggggtatttccatgggtttgccttggtatcgtgttcatactgttgtattgaatgatcccggtcgtttacttgctgttcatataatgcatactgctctagttgctggttgggctggttcgatggctctatatgaattagcagtttttgatccctccgaccccgttcttgatccaatgtggagacaaggtatgttcgttatacctttcatgactcgtttaggaataaccaattcttggggcggttggaatattacaggggggactataacgaatccgggtctttggagttacgaaggggtagccggagcacatatagtgttttctggtttgtgcttcttggcagctatttggcattgggtatattgggatctagaaattttttgtgatgaacgtacaggaaaaccttctttggatttgcccaagatttttggaattcatttatttctttcaggagtggcttgcttcggttttggcgcatttcatgtaacaggattatatggtcctggaatatgggtatccgacccttatggactaaccggaaaggtacaacccgtaaacccggcgtggggcgtggagggttttgacccttttgttccgggaggaatagcctctcatcatattgcagcagggacgttgggtatattagcgggcctattccatcttagtgttcgtccgcctcaacgtctatacaaaggattacgtatgggcaatattgaaaccgtcctttccagtagtattgctgctgtcttttttgcagcttttgttgttgctggaactatgtggtatggttctgcaactactcccatcgaattatttggtcctactcgttatcaatgggatcagggatactttcaacaagaaatatatcgaagagttagtgctggactggctgaaaatcaaagtttatcagaagcttgggcgaaaattcctgaaaaattagctttttatgattatattggtaataatccagcaaaaggggggttattccgagcgggttcaatggacaatggggatggaatagctgttggatggttaggccaccccgtctttagaaataaagaagggcgtgaactttttgtacgccgcatgcctactttttttgaaacttttccggtagttttggtagacggagacggaattgttagagctgacgtcccgtttagaagggcagaatcaaaatatagtgtcgaacaagtaggtgtaactgttgagttttatggtggtgaactcaatggagtgagttatagtgatcccgcaactgtgaaaaaatatgctagacgggctcaattgggtgagatttttgaattagatcgtgcgactttgaaatctgatggtgtttttcgtagcagcccaagaggttggtttacgtttggacatgcttcgtttgctctacttttcttctttggacacatttggcatggtgctagaaccctcttcagagatgtttttgctggtattgatccagatttggatgctcaagtggaattcggggcattccaaaaacttggagatccaactacaaaacgacaagcagtctgatgcaacattgctttttttcttctagtttctgtttgttattttatttaataggtagggtactgtaggaatctttatttaaatcgctgccgtttctttgactctttttctttctttatcctcccaagtaaacaaaacgtaaacaaaacaggtatgaaagctataattgtaaaccacgatcaaatttatggaagcattggtttatacatttctcttagtatccactttagggataatttttttcgctattttttttcgggaaccacctaaaatttcaactaaaaaatgaaataatttttcattatcttcattaacgtaatcagcctccaaatatttggaggctgattacgttaactagtccccgtgttcctcgaatggatctcttagttgttgagagggttgcccaaaggcagtatatagagcatacccagtaaaacttacaagtaacccagatataaagatggcgactagggttgctgtttccattattatagaattgaaagaccacaccggatctatgctaagatcatttatttacaacggaatggtatacaaagtcaacagatcgtaatgaatacaaaataagatttatg

SEQ ID NO: 30704 - DNA, 3003 bp, Unknown
  misc_feature (1)..( 3003): 2750-1469P.txt file - cDNA_ID_3034635; gDNA_ID_2096291; Annot_ID_195388
tttcccccgcttaatggatactcatttgttatcattgggggttttctaaaaaatggagttgattggatttgcaccaatgtaaaccataagtttcagacacaatagagtatatgaacgatctatattttgtaaataatgaatcgagttcgtccattctattttattcataggtactgatccgtgatatttcaaaaagaatttcctttttatgtctcagtctatgatctaaacgagtcgcacatacacccgagtacatgttcctcgtcgctgagggcatccccgaagcgctggggatttcgtgacgtttcggattggctgtcttgtatttctaataagttgtttaatggttggcatacggaatcatataaataatgggctggtttagattagttctaaccggctaattctgaattacttctcttcaagattctcttcaatatttttttatttttatattgaagagaatattaaactaaacctttaatctaaaaagatataaaattctaaattgtagatttgcatgaaatcgctcctattttttattgaaccgctacaagatcaacaattccatgagcttgggcttctgttgctgacataaaaacatcccgttccatgtcttcggatataacccatataggtttgcccgttctttgtacataaacccttgtgatggtttcgcgaagtttaagtaattcttccgcttccaagataaattctcccgtttgtgcctcataaaacgaactagcgggttgatggatcattaccctgatgatataatagaaaaggtttttctatttcgcagaatgagacgggataacaaaaaaaaaaaaatagataaatttgaataaccgtacaggctttttttgtgcattgcatacggctccacaatggaattgacttttttgacctttccttaaatcatccaattaccatccttcttttttttgtaggagttaaaaaaatactatgatggttccgttgctttatatatcattgttttgattcgtcgatgattcagcaatcccaaagtgtctttttttttttttacggtgtgaaaacaaagtttgtgacgctgaaatgtgcccgaataggtaagatatcatttgaaaaacctcttccttatctcatactactctttcaatatataatcgaatttttttttaatctaaaaaatttcatattgaattcgaagtgccatgctattattacttaactaattcatatttcaaatggcgaaggcatagtatttttttctcgaaaataaaaaaactcattggcgccaagcgtgagggaatgctatacgtttggtaattgctcctccgactaggataaaggatgctattgaagcggccaatcccatgcatattgtctgtacatcgggtcgcacaaattgcatagtatcataaatagccattccagatattacccatccaccaggagagtttataaacaaataaagatctttggtatccttttctatactgagatatatcataagactaataagttgattcgagatttcggtatcaacctcttggcctaaaaaaaataatctttctcgataaagtcggttgattaggataattttttattccttaggagccgtacaggcaccttttggtgcatacggttcaataaaaattgtgaaaaaatcaatgtgttgattccaacctacccttttttcatagagggtttttctttctaacttataacggaagggcttgccccaaaagtaaaagaaattttgagttttggcgccttttattagatattaaaatcctctaaaaaaatgattgattcattgatatttttttttttcatcgagattcagttgaaatggcgatggttttttcttgttcctgaacgggcttcttcctttttttattccattttttaggtttatgctctaccccgagtaaaaggaaaaatttgcccgattttgatttgcacatataggacaaatgaaccaaataccgcgtctttttttactactccttcttttttttcaattcagttctttcacttgtcttctgtcaaatagtcaacaaattttgaattatattatatattatttgtatttgatttgagcaacagttttagatcgccctgtttcaattttttttatagagtttttatcataattttgcatataatagaagtagtaattataaaaatattatatattaattatcaattgggtttttgctaaacggagcctggatacttcattttattagtccgatcacgtaaaccataaaaaaattttgataatctaatatcaatctaaatactccctgcatttaattccactttattttttgcgcttcgcgttacaaatttttgataattcaatcaatctttttgagcgaaacagaggatatctcgatcgagggagaaaatggggaaatcccatatagcccgatatatctgacaagtcgcactatatgtcaacccaagatgtatctccttctccaggacttcgaaaaggtacttttggaacgccaataggcatgaaatgaaaaaaaaagagaatgaagttctctatttcactttgatgtggaaacgtaaaattggggtttcgttttttaatactattatccttttttcctactttattaatcatatttaaattaatgatatttaatacataagttgaataagctaaaataaaatataaaataaaagtaaagtaagagagaatgaataaaactaaaggaaattttttacgaacgggcttctgaatgatcaacaacaatagctatcttggttcatagaaaataggattaacccccattgcatattggtacttatcggatatagaatagatccgcttccctttttttctatgaattgaattgttccattattactaacagaatagaacaaatattaatcctttctccgaaataattacctaaaaagggggggtacgtagcatagttttttccaatgcaataaagttacatagtgtctatttttcgttgataaaggggtatttccatg

SEQ ID NO: 30705 - DNA, 3000 bp, Unknown; identical to SEQ ID NO: 9913
  misc_feature (1)..( 3000): 2750-1469P.txt file - cDNA_ID_3034645; gDNA_ID_2096291; Annot_ID_195373

SEQ ID NO: 30706 - DNA, 3000 bp, Unknown; identical to SEQ ID NO: 9916
  misc_feature (1)..( 3000): 2750-1469P.txt file - cDNA_ID_3034649; gDNA_ID_2096291; Annot_ID_195370

SEQ ID NO: 30707 - DNA, 3003 bp, Unknown
  misc_feature (1)..( 3003): 2750-1469P.txt file - cDNA_ID_3034653; gDNA_ID_2096291; Annot_ID_195368
gaaaaaagaaaaatcaaataaaaagataaatgaaaccattttcatccccttgctcggaaacaaaaaggggagttgatgtattgaatccgccgggactgacggggctcgaacccgcagcttccgccttgacagggcggtgctctgaccaattgaactacaatcccatggaaataaagcgggtagcttacatattccttcttatgatttcattttaatcatttcaattttaaattcaaatttttgttttgtaacaaagaaagtcacaagtgatatattgatatctatatggatatcactttagtgagagcaagacggattactgggtaatccttacattattatcaaatcaattgataatctattttttacaaaaaaatagattattttatcgactctgttcattaaagtttctctttaaaggatccatatcggaatccttagcaagatcaagatcggaattttttatggaaaaaaaaagtaactaaacataagaaataaagaaaaaagtaaagtcgaactataccctataccctgaaatttgacctttttttcttaccccttctctgtcatttatgcaaaaaaaaaaaaatggttatgtagacagctaattattgggccgagctggatttgaaccagcgtagacatattgccaacgaatttacagtccgtccccattaaccgctcgggcatcgacccaggaagaatctattctaactttatggataatccatgatcaacttcctttcgtagtaccctacccccaggggaagtcgaatccccgctgcctccttgaaagagagatgtcctgaaccactagacgatgggggcatacttgctcaaccgccatcatactatgatcatagtatgatcagtttttttaaattgtcaatataatgaaatgaaatggtatgactagcttataaggttttttcttttttctatagaattctatatcattttttttttacatttgtattcatattctaatcataattctataacaaataaatatactttctttttatatttgaagtggaaatattaaaattaaaaaataaataaaaaaaaatctaaaaatcgtctagtacggaatcttttcaagaagtgattggtctaacataaaaaaaaaaaagaaaaaaagagggttaagtttcgttttttttttactttccttgatagattgcctcatctcattgttaagaaatagtagtatccctgtctaacactaatccaagaaagtcagccagaatccatcttctaattagggaaaaaggtggatttataagttaagttatcaaaaatttgctttttttttttttagaaaattattgttcagaggataatccgtatctcttcatcacatgtcaagataaaatatcttgggtgtatgtcaacttgctgagtacatgtataaatcaaattaatttcgttcgatgcgctaggctattaaaaaaaaattcattgcatggatatttatcaaatccaatattaaaaaagcaaaaaataccccgttaagtaaatttgaagtcaattcaaattctcatttctagttcccaaatgagctactaaccactatgcgtctattgtatatatatttaatatatatatatatatagattttatttactaccggctcagtcaggaattaaaccaagacggcccttttaactcagtggtagagtaacgccatggtaaggcgtaagtcatcggttcaaatccgataaggggcttttacgttctttactttctaatagtcaaaatttcatttgaaagtctataatttaatttcaaattttgttaatttcattctaataaatttcattctaataatataataactaataataaagttagcgagtaatttaaaaaataaaaatgaacatttgtatattataatacaattacaatgaataatgataagtcgtctcttgaatcgccaaatatatattctttttttttcgatttttcgatagattagaaatcgacaaatccaaaagaaaaagtaagtggacctaacccatcgaatcatgactatatccactattctgatattcaaattcgatagagattaaattgaaacagtagattttttttatttcatatttttgtattaggaaatccgtcgatatctcttattgaatcttcttgtttctatatatttcataggaaatatattgcgttcctgcctagagaaagagagtatttttgcaaagtaataactaaaagggcgtttcaatattttttttgattcgagaacataacaagatcctacattctctttgtattaagaatcaatttgtattaaaaataaacaaaaatcgaatcataatcatggcttcagatatcaattaaatatttccatattgatgcatccgagatgacaatgtaatgtgatcgaaggtgtatgtgagaaagaaactctcatttacagtttcctataattttatttaaatattgaattaaatataaataagaaattttccccttttttgacagatacataagggcatgtacatatagatatcaaagaaaatagaaaaaaatattaaaagttccctttttgcttcaacccgtcaactaaaaaaagggtataaaaggaaaataacaatagttgatactatagtatttaatagacaagtatttaatacacgcaaaaaagaaaaaaaaaagttctttattctttatctgaataatgagtcatccgacaattcatgatttagattcaactacttatacttattaataaactaatagcaaggaagaaacaaattgagttgatccgtttacctaagtaaggaccaataaaatcaaaaattttgatcttcgaaaccaattaaatgaaattctaagggttccattttatggggcagtgcgcgagaaattaaatcataaacaaatgatagaatttgagcgccctgaaaatgccataatatataacatcaaaatctataacattaaggtgttcggaaatggttgaagtagatgaataggaggatcgctatg

SEQ ID NO: 30708 - DNA, 3000 bp, Unknown; identical to SEQ ID NO: 9915
  misc_feature (1)..( 3000): 2750-1469P.txt file - cDNA_ID_3034661; gDNA_ID_2096291; Annot_ID_195364

SEQ ID NO: 30709 - DNA, 3000 bp, Unknown; identical to SEQ ID NO: 9914
  misc_feature (1)..( 3000): 2750-1469P.txt file - cDNA_ID_3034665; gDNA_ID_2096291; Annot_ID_195363

SEQ ID NO: 30710 - DNA, 3000 bp, Unknown; identical to SEQ ID NO: 9918
  misc_feature (1)..( 3000): 2750-1469P.txt file - cDNA_ID_3034669; gDNA_ID_2096291; Annot_ID_195361

SEQ ID NO: 30711 - DNA, 3003 bp, Unknown
  misc_feature (1)..( 3003): 2750-1469P.txt file - cDNA_ID_3034706; gDNA_ID_2096292; Annot_ID_195434
caattgttattaagtaacgtccttccaaacccgttctgccaaacccgtcctgtaaaaaaaaaccgcggtaccccgctagttgaaatttataattaaaataaatattttatggattgcgattgtgttttagtttgtcaaacaaaattttgttttaaatagttgtcgaaatctagttcaaattttggagaaataagatttagtgaattgataagaaatgtatttagttgcgtttgctcattttaagggattgcaattgtcttttgggttgtcaaacattttttgttttaaatagttgctgaaatctagttcaaattttggaaaaatctgcgtgatatatgggattgaaatatatttggaatgtttttcgtttgttaatcaatttattgctgaaaaaactaataattaaaagccagtgacagccattgtaaataagtttcaactccaggatttatttcacaaaatggatgcaaaaatatatatatagattatatctatatatatgtattttaaaatctttctcactttaacctcaacatccaaagtttatatgtatatatagtttatttgctcgatatgcaaaagcgtctgtagtccaacggttaggataattgccttccaagcaatagacccgggttcgactcccggcagacgcatttatattttttaacaatcttttctgaaaatttgaaaagacaacattttgcatacaccaaacatatgtacatatgttgtgttcttgttggactcgatggtttatcaaccccaggtccaataggacaacacgaaattatcatacaaaccacaatgattgattgtccccaaacccttatttctgttaccaactccaccatattgtcacaacttttcccctgttatcaaaacttccaaatcaatgttctatgaattttagtttaaatttttaccaattgtttattgatttatacgaattcaatcaaatgtaaaacaccaaacagaatggatcagtaaatataaaactttgttatcttctccaaaatttacattttcatgtgtgtatagactatagtatggttacgatgaagttgatgatgttggtgaccaaggagtcatatccatgggataactcccaagcacccgcaagaacgatgtaaactcctgaacctcggcaagcgcgttctgagcacgcgcctccgccatcgaggcctcgaagtcaacataaaacatgtactcaaaatgcttcgccgtcccgacattggcatcatccacgaccctgatcggacggttgtgattcggcctcgattcgatcttcgtcaagctaatgtctctgaaggcgaaagcagagagcaccttgaaaagcacgctggttcctttctcgtgcgcaaagacaatgctagtcttgaacggtctatctgttctaggtatgattggctcacgcgccagcatcacgaagcgcgtcacgttactcacgtcgtcctgaatcccatcttccaaaatctccaacccgtatatctcggcggcgcgtgcactcgcgatagcggctgtgtcgcggaggttgttagaggcgatgaactcagcggctcctgcggtgtcatcaactgcctcacgtgcgacattaagtccgagctttgtgagcgtgtgctcacactgagcgagaccttgagggtgtgagatcacacgtgtgagaaactctttacgaacgccgggaagagccagtaaacagtgatgaacagggagttgaacttcgccgactatatgaagacggtgacggaggaggagatcgtaattacggtggatagaaccgccgagagagttctccaccggtaaaacagcacgatctgcgatccaaagctccaccgcttgaaacgcaacctcaaattgatcgcaaggtatagcttgacaattaggataagctttaccagcggctgcttcagagtaagcaccgggaacaccttgataagcgacgcgtagattagatccgtgcatcggagccggcgagagatccgtcatgctaaggggtttcagtggattatgacgatgctgtggaaccaacggattgctatcagatttctcaatcggaacaagattcattcctggaactcgtgcggcggcgctgttatggccgttgagatgatcaactccgccggaaactggaggcacaggtaaggattcagattcttcttgagaaataaccttgcttgttagaatagcgcaggagctctgccattcagaacgaccagatcgcgcgataagcgcagtcgccgtcgccggctggctagcacctaatattggagaagaagatgatagagctttcatgttttagcaatggcgtcttaaaattggttattcaagctcaatgaaatagcaaagtcgagaatgtagaaaaacatgttttcctggggtagttcgtttgtgtggtcacttctccacctaccacaaccaccttacaagtcacagtcgtatggaccataccggcatttaactgaaaattaattcgacccgatccggtttaagttatttggtttcataaaccgattttctccataccccaattgagatatgagagtgtttaagactttaccggaggtgattcgagttcaaggagacagtctacacttgtgacttgtgagtcggagcttgagaacacctacagctacaagaaggaagtttgttttcgcctcgagctagaaatcctaatttgtcatcatcgtctcgaatggaaaggctgtgttcgaaatccaaaatgcaaatgcgataaagatgggcttttagataggcccaattagagtccaaaaatgaggggcttatcagtgatttggttgccaataccaaaagcgcgggaaaatgataaaagatttttttttcctctctactctttcactcactttctccggcatccacgaagccctaccagtaaaagcccttttgttgaccctaaattctccttcaaagcttctccaggaataaagctcctctctatataggaatctctctctgtcccgcgtaatttataatcgccgcaaaatg

SEQ ID NO: 30712 - DNA, 3000 bp, Unknown; identical to SEQ ID NO: 9927
  misc_feature (1)..( 3000): 2750-1469P.txt file - cDNA_ID_3034710; gDNA_ID_2096292; Annot_ID_195432

SEQ ID NO: 30713 - DNA, 3000 bp, Unknown; identical to SEQ ID NO: 9926
  misc_feature (1)..( 3000): 2750-1469P.txt file - cDNA_ID_3034719; gDNA_ID_2096292; Annot_ID_195428

SEQ ID NO: 30714 - DNA, 3003 bp, Unknown
  misc_feature (1)..( 3003): 2750-1469P.txt file - cDNA_ID_3034723; gDNA_ID_2096292; Annot_ID_195427
atttattaaaataggtatataaaagtgatcgaaaattatgtgtaaatcaagtaaagaaagaagagtatatctacagaatcaaatttgattcaggcactattactccttcgtttcttacggacatggtttggttcgtgaacaaataaagtctctacctcttggctcccgacgtcggtggcttcaaagaaccgaagatctttggacaatcttgtcttctttgtgagagaaatctcacgcggtcgctttcttggcggcggaggacacgtctccacctccggaatcttgtgatcacttgaagttggagtacacagagattctaacaactcttctttcttcgagctatcttgatgatcttcttcttcttggcttctgggtttctgctctactgtcttttcttcttctagggtctcgagaagcttagacatggtcacatggatgtgaaagtttcgtgggcttttaccttccaaaggaaagaatattaatttgaaagtgaaattggaatatagaaagtgatatcatataggtagagagagagagagagagaaaaaagaaggggattaaagagtttgtattttgcgaaaatgtacatgtatgaattaatcttgaatattcggatattcaatgctttttgtgcaacttaattgtcttgggaattagaagtgaaacttttcaactgcccctatgtccaaacctatagaaatactatgccggagtcaattagttagttagattcatttgtgtttactgtttaacgtaattaatttgaatataagtttggttaattacccttgttacctattaaaacttgaatgttaacggagaagcttatccaaattaatgtctcatgtgtcacatcattcttcgattgtatgtctaaatacgtacaaatggttggcataggataccatttcatcaacttaaaaataatattttcatttcataattgatgtccactttccgactcgcccctttggaattattcgctccttcgcagcctactatataaaccaatcagataccgccatgtcatcctccactgatttgtgttcgagaattgctcatgttactgtagtcttttctccatgaacaaaattacttacaacttacaaggctaaatgatgtttgataggtttaacattttaattactctgtgctctatataagtccacaatttgaataatcaaactgaaacctgtattttaagtttgtccccccattgaagtaagtatatggttatgttggcatttagtgtttgcatcgaatggtcgtttatgtcaatgaaagacgtcccgtcgctgccattgaacgtacgtaataagcattaaatcttaacagtgtgatgcaaaatttctcttatagctcatcatcctcttttttttttcttaagaatttgttgcatgtgaagatatttggtcactagagtatcgtttctatagatgttcaagacagtagtagttggaaggccgtattgaaaacagtctgagatggtagaaagaaaatcttattttacattgatctaatatatgaagactcttctgatgatgcatatatatatttccaacttcgtttgcgctttattcctacggattgtcaaacttttaagagaaatatgttgtccttttaggttgttattggtcatcagggagatgtaggggccatgactgtacattctttttggcctatcaaaactcgattctcttttttaactcattggattcgtgctgatcatgctctttgagaatgtattcttatagtcaaattcaaaactgttgtagttaacatttgttaaacaattaatggctttaaagtcatacttttgatacctactaaaataaaacgttattaattatgttgcaaatggttagaaggtgtaagatatacaatgcaatttggttaggattccagaaaaggctaaagaacagtgacactactagcaaaagtgaaaaaaaaaacatggccatatttatgtatacaaagtctacgcttaagaggaaaatgaaggcaacagtaaaatagtgaagaaaatgacaatcttataactaagaagatagagacatataaccccatttagtaaagaggaaagttgtaatgagaatggaaaaaataaaacctagagactcagttaatgggttgaaatttcaggctaaaatatgtttcgtcttcttgtacgactacatataacacacataacaaaactaaaactcgtaaggtgtatgtgtgaaactagttgtgtatatacataagaacaaatggtgaaaaccagtagttagggatagatctctgtccaaacatattcttgatcgatcttagatcaatcatgcactcatagagatctacttcgtttgtttgtttattagactcattatctctatgagtgattgagtattatatgaatccgtttctaaacaaagatgccgaaggagttgatgttggggtctgatcgcgccagaaaacttaggtttttctctctgtgtttgaaccaaaagtcgtggtaactctgtctcaaagaatctaataaatctctaattagaccgtttgtaagtaaaagaaaaaaagcttcaagttcaatgaaaaataaagataatgattgggacttttaggtttgtttgtgcttctttaattattttctaacaaccttttatagaaaaaaaactctagactagtgaaaattcggagagtttcatgttgctgcgactacaccacgtctctatctaaacagaaaagggtcaggtaaaggagattaatgtaacaatcgcacacgtggcacctttttctttgtcgccttccaaatcattaattaaatttccatttatttattttctctgctgtcatcaccaataattttaatttaatttttaccaaaaccagaatcaaaattttgaacggagaagaagattgaattcagaaaggaagaggcagatctgttattctctgttgaagtctgattgatctgatcggagctattgcggaggaggggtttactgcaattgcacggtggtaatg

SEQ ID NO: 30715 - DNA, 3000 bp, Unknown; identical to SEQ ID NO: 9929
  misc_feature (1)..( 3000): 2750-1469P.txt file - cDNA_ID_3034727; gDNA_ID_2096292; Annot_ID_195422

SEQ ID NO: 30716 - DNA, 3000 bp, Unknown; identical to SEQ ID NO: 9919
  misc_feature (1)..( 3000): 2750-1469P.txt file - cDNA_ID_3034735; gDNA_ID_2096292; Annot_ID_195420

SEQ ID NO: 30717 - DNA, 2683 bp, Unknown; identical to SEQ ID NO: 14596
  misc_feature (1)..( 2683): 2750-1469P.txt file - cDNA_ID_3034789; gDNA_ID_2684204; Annot_ID_137266

SEQ ID NO: 30718 - DNA, 3003 bp, Unknown; identical to SEQ ID NO: 27150
  misc_feature (1)..( 3003): 2750-1469P.txt file - cDNA_ID_3034794; gDNA_ID_2096294; Annot_ID_195494

SEQ ID NO: 30719 - DNA, 3003 bp, Unknown; identical to SEQ ID NO: 27151
  misc_feature (1)..( 3003): 2750-1469P.txt file - cDNA_ID_3034797; gDNA_ID_2096294; Annot_ID_195491

SEQ ID NO: 30720 - DNA, 3000 bp, Unknown; identical to SEQ ID NO: 9936
  misc_feature (1)..( 3000): 2750-1469P.txt file - cDNA_ID_3034801; gDNA_ID_2096294; Annot_ID_195489

SEQ ID NO: 30721 - DNA, 3003 bp, Unknown
  misc_feature (1)..( 3003): 2750-1469P.txt file - cDNA_ID_3034805; gDNA_ID_2096294; Annot_ID_195487
gagcttcctgatttcggaccaacagtacttttatccatcacagcagaatggctgtaaaccaaaaaacacaaaacaaaaatcatgagaaggatcatctatagagtatatccatgctggaaaaaggcccacccatctttaactgagggtgttatacatccacctataagtcacatagaatcaaggagaatgatacataaaaggaattagtactataggatgacaatcaccttgagaccagagctatatctttcgtttttatctcttgagaggttgaagttgatggatcaataacctgctttggaccgttttcttttttgaaagaattctttgcaccagcaacatctgatcagaagtaaacattcaccacacagttcatcaattacagaaaaattaaaaagcaacatgttacagactgccgctagggaactttctctttcacattctttcgctaaacatactaaaagccaatcatgaacacaactagtatgtcctaggaggaaaatcaggaaagaatcaatactgagtaaatataacaaaaagtattgtgaccgcaagtaaccaccttccagagacaactaatgtggcatattaagagatgcgagttcatatgattgtaaaacattgagttcatcagattgttatttaccatttgatgcatgacgagaagagaaattcatccgaccacccctgctaccacggccccctccaccagatctccattgtgattcagcagaatccttgttgttgatgttctgtaccatttcaataacattgtcaatacccatgtcccaaatatatgcggtttaatagacatcctttacacagaaacccatgaagagaccaaaagaactgcaaaaaccccatacctctttcctcttatcacgcttttttttaacctcatggaatggatctgcagagtcataaacaattttttgcattagcacataagattgtatagaaaaacacaacaaaaaaaaacttaaaacatatcctagcaaccatctctaaattacatggtacacaagcaggttacatgaagcactcgaaaagcctgatgcaataccacatctccaaagaatcctattttcataacaatttgttttggtaagatgatgaaaatgtggatttctaagcactagattcatctacaacgcagcagtctttgtttagaactcatacctagcaaaagtattattcctagacaaaccactcagaaaaattctagttagaagctaattctctttgtttcacacatcactagtgtaagtaattgattcccgtatattccaaatcaattcgtgaacctttttttgtgaaaaggaggttacaacacaatatcacataaacaactagagacagcttaaaacttaataggcgaagaaaccgatgatagtgaattcagataaaatctgaaaaaaaaaaatcaaagagcagagaaatcagatgctaaaacctaagttacaggagaaaaccccaaatcgaaaaatacaatctcgatccaatcaaagaagagaaattaggtaaagaaaaaagtgcagagaaggtcgagattataccctgaagaagtaagcgttgagcggtctcatcaggatccatgttacattcatgaagcattgcgataatctcatcctcgctatagttcccagcagtggtctccttaatgttctgaatcatcttccgagtagtagccgaaatcgaaaccctagcgccactgccgaccatcctctcttctatcaaacgtaaaatctcgcttctgatattttaacaggaatcgaaatctggacctagaccaaaagaggtctgagtacctatatatgtatacgaagaggcgagtgataaatcagtacgagaggatgggatttgaaactagtttgggtcgacgaaggagaagaagaaagaagaaggaacaagaaaaaaaaaaaaaaaagaggaagggggcgagagaaaggaatgagcaaaataatacgcactgtgattttggaagcgtagggctctcttttcttttttcaattttgttttgcattcctttgtagctttttaatattgagtttttttgtttgttttaatctgaatctttggtaaataatgataaccaaattgttgtcacaatctttttttgtccacaaatatatttaaattaggatttaggatatcttctgaatatttacactacataataatgacaaacataaaacatagtatttaagaaaataagaagaagataagttttgattgtaacttgatcatattaaatctcaactatctcaaacgatgttacccatatcattatgagatgagcgatttaatgattagcatattattatttatatttttacatctcagtaacgtattattgttttctatgtaaatatttaaattatcaaataattataatacgttattattatccccaccatgataattacatatatatttaatttactgaataagtttattttttttgtctttggtaatttcttttacaataccaaattaaaatattttaaaaattggatttcaaaaacataatgagttatatggttgtccaaatatttaccaggtccagtacgcttttagcattattaatagcaattagcaactctagggattgtcatttacataaacaaatcttcaattttttcattaattttcctgtgttttgggtccctattgcttctaaattctaataaaccgtccagatattgctgttatggaaacaatttttcaataaatctcatcaactgattctatcaaaatctaatcactaggctttttcccattagcattagcgcataacaaagttttgaatattaatatcattatccataggcagcttagattttttttccttagcatcaaattaaactcaaaaccgaaccaaaccgtaaatccacaaactaattttggttcgaatttaaaaacattatcttttaattttgtcatgccccctctgctaagtgcaaccattcgtcttctcgcttcatcgttttctcttttccgatg

SEQ ID NO: 30722 - DNA, 2683 bp, Unknown; identical to SEQ ID NO: 14596
  misc_feature (1)..( 2683): 2750-1469P.txt file - cDNA_ID_3034805; gDNA_ID_2684204; Annot_ID_191329

SEQ ID NO: 30723 - DNA, 3003 bp, Unknown
  misc_feature (1)..( 3003): 2750-1469P.txt file - cDNA_ID_3034847; gDNA_ID_2096295; Annot_ID_195534
tataatttgtagttaactacaaaaatggcagaagaggaaaaggacttccataaacgaagtaaacaaacactaaaaatcttcaacacaccacacacacacacaaaaaaaaaaaaaaaaaaaaaactttttgttattgcgtaaattgtaagataatccagttcggccactgagactattatgtaaatcgtcattgtattcaaagattcaacatttgccaaaagaggtttccgaagttttggtagaaaccaatttgatgcaggtaagaaaaaaaacaccagatctgaaatacaaaacaacaaagaacagaagcgagaaaaagctaaagccggtaaaaccagatcgtagaaacgcaaaagaaaaacaaaaacttgtattagaaaaaatgtaattcaaacatcattcttcaatcaaacatcaatcagatgaagaatccgaaccagcgacgaagagattcagaaattacacaaagagaagaagaacccaaaaaaaacaaaaaaatgaaagagagagagatcttaccaatatgaagagagcagatgagaaatttgttgaggaaatacaaaaaaaacgtaacgccaaatttcaacaaaagtctccaaaccctaaattctcctttcttcggcagcctctctgtctctcacgatctctccttcgccttttctttaaaactttttttttgtttttttttgtatttctctttctcaaatattttttacaattcagtttttttgcgattctcaatactttttggggtaaacaatagtaaaaaaaaaatacaaatttttggtgttgagagaaaaatagggcgagaaaattctataaggtgggtgagagagagatatatgtggatatgagagtcggtttttatataattgcctctcctcttcttctccatagtttcaaaacaacaacgacacatttttatttcattttctatatttcccattttgcccttttcttgttacaagattggttaacctaattaggcaaatttattcaatttttattcatatggactacaaattttctttgaatttcatttagcacgcaaaacttgatttgcgcttccgtggaaatttcctttggacttggaaatttttttttgaaaaatcgaaccaatcaaatttgtaattggagagaaaaagacacatatccgaatgtgtgagcaagcttgttgtcaatactggcaccgacgctgtgtaataataagtgggcagagacaacaaggtacatgtgcatcaatctctatcttacttgtatttattaagactaacgaaaactacatttaaactaaacctaactctagctttttctcatttttttagtttaaccataaaactttgtcgaacgtgtaaagtcagccttcggatttatatatttattccaccgaaaacataatttaaattaacttcttcaaaattttacgtaccaagtaatctatacaaataatgttattatacaaaagcaacgtgttatttttttcaaatcgaaacaatatagccaatccaaatgtttaggagagtaggtagatacacttcccaacaagaacatcacaatatataattaccagtttggagagatcaattttgccttcagctatcattttggtagcgtataagaggctaacaagaagatatgataagctattgaggaccaggttcatggaattgactatgattgccaatctttacaaggaccatatccgtctcttgtttgctccatattcgtggttaaatttgacgatcataataaatgtgagacacatgcatgcatgagatgatggcaagcgtagatcaataaaagtttgacaacacatatactagggacatagataactaccacgatcgagagacgtgtgggagatgcacactcgcacaagcatgcttagcatacgtcttgaaggagacggtataaaactttgtagagcatgtgatctactagtacttccgaagagccatatggagaaggagacttaagcgaaacgtacttacaattctaaaatgagccatgagagcagcctattagtcctcgcatacgctacaagaggagcctgggaccaataatagtataaccattgagaaagtacagtagacatcgactagatcacaataaactttattttatgttgactatttcgtcattgatgatattacttatctttgattattattaaatctctcatttggacgctttaatttgcttggagacgagtcaagaattaagtcaggagaaacagcagcgttgataattctgttttcattttgaatatatatcgtgtttaatttggtttacattaaaaagtcttaattaaacaaaaaagatgattcaaaacctttagttgcatttgcatatttatttttcatatacaaagaagtacagatgattatgccttttgaaaacctagttattacttattgcatagtttattttctgatcaagtaaaaaaagttatgaacacaattcttcttatgaatgactctcaaaattaaggatgttgccttggagatttataggagttagcctacttttcaccttgaggatcaattttatagtcaaagctaataatgtttgtggtctatattagttaccacttgtttactacatccaagcgattgaattcgcatttcccatactcttgacttaattaaaccttgagatttcatgatttattatgcaaaatttaatccttcgctatctatttgttcctaaaagatataaattgaataaaaacgtaactctccaattaataagaaaaacttctttaattatttttctaggttaattaataaatttataaaacaataaatatcatattagaaattcatactaataaattttgagacattttattgaaatcttaatgtggatagtgctgcaatcaggaaaggatgacgagacaaaagatagagaagcaaaagtaagctgataaggtttgatacagtagaaaatactatctcttaacttcttcttcttcttcttcttcttctcctatctttgaaaatg

SEQ ID NO: 30724 - DNA, 190 bp, Unknown
  misc_feature (1)..( 190): 2750-1469P.txt file - cDNA_ID_3034847; gDNA_ID_1620762; Annot_ID_50017
gaattcacacttgactcttctttatatgtgtcctagatttggttcagctatatgatcatttctatttttggatttggctgaattcaacaaagcttggtggaatttttcagtttaatatgtctgtctctttgttcttggattgatatctattcagtatgtcctatatttacttacacaccttcaggccatg

SEQ ID NO: 30725 - DNA, 190 bp, Unknown; identical to SEQ ID NO: 30724
  misc_feature (1)..( 190): 2750-1469P.txt file - cDNA_ID_3034847; gDNA_ID_1620762; Annot_ID_167172

SEQ ID NO: 30726 - DNA, 3000 bp, Unknown; identical to SEQ ID NO: 9957
  misc_feature (1)..( 3000): 2750-1469P.txt file - cDNA_ID_3034854; gDNA_ID_2096295; Annot_ID_195532

SEQ ID NO: 30727 - DNA, 3000 bp, Unknown; identical to SEQ ID NO: 9952
  misc_feature (1)..( 3000): 2750-1469P.txt file - cDNA_ID_3034862; gDNA_ID_2096295; Annot_ID_195530

SEQ ID NO: 30728 - DNA, 3000 bp, Unknown; identical to SEQ ID NO: 9951
  misc_feature (1)..( 3000): 2750-1469P.txt file - cDNA_ID_3034865; gDNA_ID_2096295; Annot_ID_195528

SEQ ID NO: 30729 - DNA, 3000 bp, Unknown; identical to SEQ ID NO: 9958
  misc_feature (1)..( 3000): 2750-1469P.txt file - cDNA_ID_3034876; gDNA_ID_2096295; Annot_ID_195525

SEQ ID NO: 30730 - DNA, 3003 bp, Unknown
  misc_feature (1)..( 3003): 2750-1469P.txt file - cDNA_ID_3034887; gDNA_ID_2096295; Annot_ID_195522
ggcgccggatgcttgtgaggttagctttttttgttctaccccatcttaattttacttcttcggtgtgttataaacaaatcaatatctgtcaccaaattgtttgttggtgatgataaaatttaggcagcttctgtcacatagttttgttcaaatggtaaaagctgatgctgtagttgataaaatgcatgtattttgagcaaatattctacctttgtatcgtactgagaaggtcgaaatgggataagctgagaagatctcattcttgtatccatttcccagttttgttgtggaaactgaaaatctcagttttgttgttattggtataatgtgctgtgtataagtttatctcatgtaggatagtgtttgctaaagccggaacttttatagaatcgagttgtgttcaagatatctttcgtatataaaccaaactagagtttatagatgtttgaccctaatcaatcttttggattgggaagtttataggtgttacgcatgcttacatgttctcctgtattttggtttagccttgaggaaaatgaaaagctagtgttgactccattcgaaaagaaccttgacatctggagacagctttggagagtgcttgaacgcagtgatttggtaagtctttgtcaataatgtattaaccttctcaataagttcaatttctgcgttttagttaattgcaaaacagttttgattacttatacttgtccttttttcagattgttatggtagttgatgctagagatccactgttttaccgctgccctgatcttgaggtaatgcattttctcccagcttgaaactccacttggcaccgtattcctgattcatatttacttgaagattcatcgtgacacaggcatatgctcaagaaattgatgagcataaaaaaataatgcttctagtgaacaaggcggatcttttacctactgatgtcaggttagccaatcctcttgtgccttaatactttgcctccaaccttttttgtattctaaccgattggtttaacttttgacttgtagggagaaatgggcagaatatttccgccttaacaacattctgtttgttttctggtcagccatagctgctacagctaccctagaaggtaaagtcttgaaagagcaatggagacaacccgataacttgcagaagacagatgatccagacattatgatatatggcagagacgagctgttgagtcgtttgcaatttgaggctcaagagattgtcaaagtaaggaattctagagcagcatccgtatcatcacagtcatggactggtgaatatcaacgtgatcaagccgtggttggatttgttgggtacccaaatgttggaaagagttctacaatcaatgcattggtgggtcagaagcgaacaggtgtcacctctaccccaggaaaaacaaagcatttccagactttgatcatctctgatgagcttatgctatgcgattgccctggtttagtcttcccttcgttctcaagctcaagatatgaaatgattgcttctggtgtacttccgattgaccggatgacggagcaccgtgaagctattcaggtggtggctgacaaggtccctcgccgtgtaattgagagtgtgtacaacatttctcttcctaaacccaaaacctatgagcgtcagtcccgcccgcctcatgctgcagagctcttaaaaagttactgtgcttctcgtggctatgttgcctcgagtggactaccggatgaaacgaaagctgcaaggctgattctgaaagattacattggaggtaagctgccacattatgcaatgccacctggaatgccccaagctgatgaaccggacatagaagacactcaagaactggaggatattctcgaaggttcagagtccgatgactctgcagtaggagatgagacagaaaacgagcaagttcctggtattgatgatgtgctagatgatctgagctcgtttgatcttgccaatgggcttaagtcttcaaagaaagtgacagcaaagaagcaaaccgcgtcacataaacagcacaaaaagccacagaggaaaaaggatcggacttggagggttcaaaacacagaagatggagatggaatgccttctgttaaagttttccagaaaccagctaacacaggtcctcttacgatgcggtgattatcaaattgtagtccatccaagcaaagatggcaaccgaagctacttaaagtttttttttttttttcaaaaaatgtaacagcagttgaacctgtcgcagtagttctcgagtgtcttgatgtttttgtttttatgattaaagtcttattttggggaaaagtagaaaaaagtgacaactcaaatctggtggaaaatggagaattgtttttgccagttggagatacctatcgctttgttttgagaatataatagccataaatagagttttcatgtaactttaaacttttttcttatttggggtttggactcttttgaacaataaatagtgataatgaaactttaaagtttaaacatttcaataaccaattcttgttgctaaatatgtcattaccaaatcgatataaaaccaaagtaaatagaaatgttatagtgatttcggttcgtacgtttggcaatgagttggttcgtgtctctcgttccattggcgtccttgagggttaagactgattaggctttgttgtacttatggagagaggagagagaaacttgagataaacaaaaaaaaaaaattggtttttcctaaatgtgtgaatgtctgcttgctgcatcgttttattaatttccctggaaaataactgtttctgtttgttgtaaacaagcctcgaggatctgaccggtgaatgaaagaaaactagggtttcgattttaccggaatattctccgagagagcggcaagtttaacatcagatatgttgttgatcacagattcgcttttctgcgaattttagctggatcggtctttctttagttagttttttttttttgttttcccacttttgaagctttttgataatg

SEQ ID NO: 30731 - DNA, 3003 bp, Unknown
  misc_feature (1)..( 3003): 2750-1469P.txt file - cDNA_ID_3034891; gDNA_ID_2096295; Annot_ID_195521
gactcaaatactgatacaattttacaaaaaggcattcattactagtaagacctacaaaattgttccacaagttgaggagacaagttagaaataccaaacaactttagacaagtatttccacttcgacttagagctcctctcaatcgtgccttttcttcctcatgcatcctcaacagcctaagaatctctcgcacacgagggaaaaatgcaccaggacgaacacaataaggtttaagcacagtaagaagtgcctctgcgtcaacttcaaacctatcaaacttttgtctccgtaaaacaggttctcctgagaaaaatttacgagaaacataatggtcaagcccttccgcgagatttctccacaagtccaagaagtctttcgggttcatgtttagatgaagaacacacagatgccttcttaaattgtccaatgcttctgcgacaccctgagacactgttaaattgctggagctggtaatgacgtcttcgtcccatgaaactgcattgttgtggaagtggtcgctgcaaagattgtcaaattggtggagaaaaactgttataatctccataagccaattggtttccaactcaacaaggcttttcagttcttccccaaaaaagcagccttggcaggaaacttcaggttttctatcaactttgacactggtttcggcagcccacatctctacaaaaaccaaatcatcactccattctcgtagttttgattcaagataccgagcagcattaaccggtccacatgcttgtatcagtgtatcttcagacaaaccataatgagagagatcagtctttttgaactccaataacagaattttgaatatacaccagagaaatctggtggcagtagctcttataaattggatccttggtagaatggccggtagagatagaccatggtctatcaacctccaagtcctattaagaaaagagtctgctactaatggcgctttataatcttctcttgtagatagaacatactttgcagactgtgagttggattcattaccaagtctagttctttcactatcaattacccaagctttctcattcttaatatcctctttactttttctataagcatcctttagctcaatcttcccccaggttttgagccactcaggtttcttacaaaacagtcccattactgatataccttgagaaaacgctgtcgaagagccttcataagatagacaagtatctgtattcacaaaagactgcattcgcttatcaaatgtaaccatctgatcgacaagatggaaccacgatgaaataccttcagatttcatgtgcttctccttgtacatatctataagcccaggaaaaacttttttctctaagaaaccagatagcatttggaccatcgctgaaacccaagcttctttagcactacagcttactaacatagccctatcaatcaaaggctgtaagaaatcgtcaaccccatcagcaaagtctcttgtaactttatagacaagttcaaaaataaactcaggttgctcagcccattttagaaaatgatactccatccgagatgcaaccggtttaactagttcatcggtcgcccaaagtccatcattatcagtttctttggtcatattaagcttctttcgtttttccttctgcgtattatgttgctgtaaaccacagaggagtagaaagctttgggaataagactcttttttatctccttgcatcaagagtagaggattagggatactatcaacctctccatgctcgactttggatgttgcaagttttggtggccagccaagagatgagagaaaagctcggtgatctgcgataatctgtggacgaagaacagacagacttttatctactctactatcaacagaatctacaaggcgacgccaccgtgagtgatgccttgtaacatcaccaagtatttcttcaatctcattcatggtcttaatagcatgactgaatctctcttgcttcaatgcaagatcctgcacgtacaaataaaaagttttaatctttcatatttaccaatcacaactccatatagtacttaacttgtggattgaaaaagctttacttgaagcgtacttcctttgcgtttacttatcggatgaaacacagaatcttcaagatcgccaacaagactttccaactttaaggcagtcactgaaaaattgaatctttcttagctagctcttgatgataatgttcaagaatcaaaaatcgagtcaaactcaccgaaatatttacgccgattctgtatacgacacaattcctctacgacttgctgtaactcccaattcgtttgctttccgacagaatccgtagctacaatgaaaaattggagacaataagaaaactcaatatctttacgtcaccaaaaataaaacacgagggtttggtaacttacggagacagaggaggctctccaggttcaatctcaaatcttcgagtgaaactttagcggaaagtgaggttgagatccaggaaacggcgtgcttcgtgagatccgtccggagatggagaagacggtcgtttagatcagaacagtcgtggtttaaattggacgtcagagtcgaagcgcggaggagcagatcttggaggtctacgaaattaccgtcaataaagcctagtgcgagaccgggaagggtggccgggtttggcaagacgaacgacagtggaagtggatgttccatcggaagcatttgccgggaaaaaggttgttccttttgttttctaaagccttcgtgtcctctgagtctaatgatgggttatgttatgatttttaatttcccttaagtttaactaaaaattagtatttactttgaagaaaataaaaagtaaaaaaaatcgctttgataaaaaaatttagcttctccgtgcagcgagtgtagtcggcggctgacgttttctttaccctaacacttttgaagcaacataacaaacgcgccgcgaatccatttttaagggtttagagacttttagggtttacttgagaacagagagatg

SEQ ID NO: 30732 - DNA, 3000 bp, Unknown; identical to SEQ ID NO: 9961
  misc_feature (1)..( 3000): 2750-1469P.txt file - cDNA_ID_3034899; gDNA_ID_2096295; Annot_ID_195518

SEQ ID NO: 30733 - DNA, 3003 bp, Unknown
  misc_feature (1)..( 3003): 2750-1469P.txt file - cDNA_ID_3034901; gDNA_ID_2096295; Annot_ID_195517
attctctaacttgatctcctcctcttagattactcacccgtcatcataagccaataaaaagcaaaatgcataagaattaccaaaagatttgaatttgagaacaacctcggattgtggagaggacccactttgttgacgaacaaagggacatgatcgccggcattataatggttcgacgagcctgatccgattccgatccagaaggtcaatgcaagtaggacttgtagtacagtaagcagaaattgcgccatgaattggcactcttcttctgctgggttccaaaagaaacgaatcaatatgtgcaacaagaagagctccagaagcagtcatcttctaaaatcttaatctaacaacagctcaagaagaaaaaaattccatagctagagagaacacaaagtcacaagacgacgtcgtagaggcacaaagtcaaacctgaatggcttaagccgaactgagtggttttgactagaccatcatcagaaaagtctccaagacggtagtcggatgttagatcgctcaagtaatttttggttttgttggtctcacgttttcagctgcccatttgatttcagtttgggcttttccttatctctaaaggcccaatttcatttaggtttagtttatttgatcattatccttactataaaggcttcgcctttcgagaaatttagggtttcttctgtctgtctcgtcactcaggtttgtgcctcaacgactgcttcacttctagcttgattcttcttcttcgtttatatgtatactgtacattagattattcttgtttctcgagcttctgctatagattttgattcttttttttgttgtctttgtttcgtttccaggatcagatcttagctaaattgagacaagctcaaaatgaggtacttgacgcatctcttacattcactgtttaattagagaacaatacgtctctgaatcgtgattcagagacgtattgttcttctgtcatatgcaataagtttaattagagaacaatacgtctctgaatcgtgattgttttttggatgtgcgttattgatagctttatgatgttaatagtctaggattgacacgaagttgttctgcagttttgcataaatgctctttactaaggcctctaaatttggatgacaaatctaaatcttgcctcataaaaatttaggtgtattaagataagattattttgtatggtagtgtctataatgtgggttgttcatgttgaggttgtcaatgttgtgtatttttgtttgtttagttaatttgcttaactctgttctttgtgggttaatacagtaagcttcagagtgaggccgttcgtgaagccatcactactatcacagggaaatccgaggcaaagaaacgtaactttgtcgagactattgagctccagatcggtctgaagaactatgaccctcaaaaggacaagcgtttcagtggatctgtcaagttaccacatatcccccgtcctaaaatgaagatctgcatgctcggagatgcccagcatgttgaagaggtgatatatcttttcatggaaattgatcattttgtgctctgtttcttgtataatggttttgtgctcatttcatttggtggctctattagtttcatttgatgttgtatatgtcttctgaatgtagatgcatgatgttttcggaatttggtcattgtttatttaggcttcatttcttgcataattaaatatttgcttatttcatcttgtatcttttcgtaggctgagaagatggggttggaaaacatggatgttgagtctctaaaaaagcttaacaagaacaagaaactcgtcaagaagcttgcaaagaaataccatgctttcttggcctctgagtctgtcattaagcagattcctcgtcttcttggtcctggtcttaacaaggcaggcaagttctggctacagctaatattccattgttcttctttacatccgttttgattttggataggttttagtagtctatttcttttgtcaatgtctttttgatacaatgccaatcctttatcctgtgagattatgcttctttgatgattcttaagtaacattcctttgctttactttacacaggaaaattcccaactcttgtgagccaccaggaatccttggagtcaaaggtgaatgaaacaaaggcaacagtgaagttccagctgaagaaggttctgtgcatgggagttgcagttggtaacctttcaatggaagagaagcagatctttcagaatgtgcagatgagcgtcaacttcctcgtctcgctattgaagaagaactggcaaaatgtcaggtgtttgtacctcaagagcacaatgggaccaccacaaagaatcttctgagctttcacctacttaaaattggtggctataagacacttcttcttaccctttcgtttttgtttcagacatatctgttaaacagtgtaagagttgtgctgctactctcctctttagcttttggtttggataatttgaaataactgcagtgattttggttaatggattttgtagcttatattatctttgaattagatgtgcttatttcaaagacgaatcaatccacagatgtgaataaaaacagaaattttcgttttcaatttgaaaattgtcctcgtggactgttccataaccaaattctattgactatgcagtaattgatctttgaattaaaaggatcaacccactgattatactccaattgaataaatattcttctttaatgttgtttataatctcttaagcaagctctaatgatgtatttttgaagcaaactctaatgcttttatggtcagtatatttattctcttaagttttataactaaattaccatttttttttgccaaagcagacaacaaaatagcgaagtgcgttccaaaagttagcgttttcgtctccgtccccaaatctctcagctaccttaaatcagaattctagggttcttccgattagggtaaaatcgaatccagatttcccaaaattctgatctttgatttataaaagatg

SEQ ID NO: 30734 - DNA, 3003 bp, Unknown
  misc_feature (1)..( 3003): 2750-1469P.txt file - cDNA_ID_3034905; gDNA_ID_2096295; Annot_ID_195516
ctttggaaattaagtgattattctaaaagcacaatcatgtttcacatttttcctactatgaccgtttcaatctatatactcaaggtaaatatgtatcaggtgatggattctcatcatacatagtcaatcaaatccacatgtttggatagaaaagaacgcagtacagtataagaatacgtacctccaccaccattcatgatcttcaccggatagctgaatgtaggtcaagataataccgacactcgaactcaagaagataagcacaatgaatgtaaaaagcattattccaggcgaggtatatatcttaaatccccacaagcttgcatagagttggtgccattcgagaacaactgcactgaaaggtacaaagcctccaagaaacacctgatacagctttctacggtaccaattctgtggtggaatttctcgggggtttcttttaacagcggatgggggttgaaactctaataatccaaatcggttacctaacactcctcccaacatgagaaatgggatattcaaaagagtgaaaatgagtatgatgatgactattgtgccaaaggggagtgcagctgttgccccataagtaattgccacagtgttgagaaccgaaagtattatgaagaaaggaaccggatagaggatcccagcaagacgaacactccttttctgaaaaaggcaataatgatttaacaaataaggttatacgaacaatgaatctttcgaggtcagaaaaagtagaaagcactagaaaagtcaatcacctgtttatttccctcgaattggctatggaaagaagtagatgtgtaaccagccactattgatgttagagtgtacatgatgacgagagaagtcaacagcattccacgattgtatgggtagagaaaaccggtgaaggccaatgcaaatagagcaataatcctgaagacgaaaaacaagttagaaacaacaataataagaagccaaatgttttttttttggtaagtagaagccaaatgtttatagataatagaagcttacaacagtaataatggaattatagataatagaagcttacaagattagcaactgagtaccagttcctaagattgcacaaagccagctgatgttccgaggacatcgaaatacatcactatgtacgagtttccaacctgcttcctttctctcttcttcatctccgatagagtaactgaaatgcataaaggagaagttaaactcaaaaatgtaaattttatcaccacatccgttaaactacgcaaaacaagaatagtctcctaagaaaaaattgtcaccttcttagttcattcttgagatggcgcatgaagagaaaagatataagtccaattaacaaaacaacaacagttatcgagttgagaaatgagaagaagtgaatcttctggctgataggatgaaacgacgcccgggagtacttattcattcttgtctcagagcgttctgaagtcagattccaagaaaccgagtatgtaaattgaacatcaatctcagtgttctcggatatatcaaccatataactcggatcactaaaactgttgatctcaataactttgtctgcattgtacagaacattgaactttaagtgactgaatatataatacttagtatgcttctccccttgaccaaaataatctccctctacttttccaacaaatccccacaaagggagatcatcgtagtacatttgaaagtagtaatcttgagcaataatatctctgaacctggcaatatcactcgatgttaatctcttccggcacaatacaaaatgagttttgtcctccctaaatttcagcttatataaagagctcattaaacgatcaccattaagaacttccccaagagtttcctgtttctcaatcacaggccctacaaaatataaaacaatcctaaatcaaaagaccgaaactagggacagatacaaatcctaatgtaaaactaaaaggacatcattgagaaacctaacctcgacggcagaacggcaaatcatagtattgataggtctcactgcaaacaaaacaaaacaccaaactttaaaatggggtttaagaaaatgtgccatctttgagttccatggtcaaactaaagctagaacaaaaacatatcttacacattctctaacttgatctcctcctcttagattactcacccgtcatcataagccaataaaaagcaaaatgcataagaattaccaaaagatttgaatttgagaacaacctcggattgtggagaggacccactttgttgacgaacaaagggacatgatcgccggcattataatggttcgacgagcctgatccgattccgatccagaaggtcaatgcaagtaggacttgtagtacagtaagcagaaattgcgccatgaattggcactcttcttctgctgggttccaaaagaaacgaatcaatatgtgcaacaagaagagctccagaagcagtcatcttctaaaatcttaatctaacaacagctcaagaagaaaaaaattccatagctagagagaacacaaagtcacaagacgacgtcgtagaggcacaaagtcaaacctgaatggcttaagccgaactgagtggttttgactagaccatcatcagaaaagtctccaagacggtagtcggatgttagatcgctcaagtaatttttggttttgttggtctcacgttttcagctgcccatttgatttcagtttgggcttttccttatctctaaaggcccaatttcatttaggtttagtttatttgatcattatccttactataaaggcttcgcctttcgagaaatttagggtttcttctgtctgtctcgtcactcaggtttgtgcctcaacgactgcttcacttctagcttgattcttcttcttcgtttatatgtatactgtacattagattattcttgtttctcgagcttctgctatagattttgattcttttttttgttgtctttgtttcgtttccaggatcagatcttagctaaattgagacaagctcaaaatg

SEQ ID NO: 30735 - DNA, 3000 bp, Unknown; identical to SEQ ID NO: 9962
  misc_feature (1)..( 3000): 2750-1469P.txt file - cDNA_ID_3034909; gDNA_ID_2096295; Annot_ID_195515

SEQ ID NO: 30736 - DNA, 3003 bp, Unknown
  misc_feature (1)..( 3003): 2750-1469P.txt file - cDNA_ID_3034909; gDNA_ID_1590766; Annot_ID_150021
ttgacaacaaacaaagatccttcaacgtccttacgactctgaatgacaaaagacagatcaatcattaggtagggaagcaaacatcaaattatgtaatcgaagattgattgagactaacccattggctgagctcaatgttgaattcatagaaagtgacatgagcggctgtgatgaggatttcctcgatgtatggatcgatccgctggagaactgtgagattgaggagcctcgtactgttttggtccagatttgggattatcttcccgttttgagacatcttttataaatcaaagatcagaattttgggaaatctggattcgattttaccctaatcggaagaaccctagaattctgatttaaggtagctgagagatttggggacggagacgaaaacgctaacttttggaacgcacttcgctattttgttgtctgctttggcaaaaaaaaatggtaatttagttataaaacttaagagaataaatatactgaccataaaagcattagagtttgcttcaaaaatacatcattagagcttgcttaagagattataaacaacattaaagaagaatatttattcaattagagtataatcagtgggttgatccttttaattcaaagatcaattactgcatagtcaatagaatttggttatggaacagtccacgaggacaattttcaaattgaaaacgaaaatttctgtttttattcacatctgtggattgattcgtctttgaaataagcacatctaattcaaagataatataagctacaaaatccattaaccaaaatcactgcagttatttcaaattatccaaaccaaaagctaaagaggagagtagcagcacaactcttacactgtttaacagatatgtctgaaacaaaaacgaaagggtaagaagaagtgtcttatagccaccaattttaagtaggtgaaagctcagaagattctttgtggtggtcccattgtgctcttgaggtacaaacacctgacattttgccagttcttcttcaatagcgagacgaggaagttgacgctcatctgcacattctgaaagatctgcttctcttccattgaaaggttaccaactgcaactcccatgcacagaaccttcttcagctggaacttcactgttgcctttgtttcattcacctttgactccaaggattcctggtggctcacaagagttgggaattttcctgtgtaaagtaaagcaaaggaatgttacttaagaatcatcaaagaagcataatctcacaggataaaggattggcattgtatcaaaaagacattgacaaaagaaatagactactaaaacctatccaaaatcaaaacggatgtaaagaagaacaatggagtattagctgtagccagaacttgcctgccttgttaagaccaggaccaagaagacgaggaatctgcttaatgacagactcagaggccaagaaagcatggtatttctttgcaagcttcttgacgagtttcttgttcttgttaagcttttttagagactcaacatccatgttttccaaccccatcttctcagcctacgaaaagatacaagaaatgaagcctaaataaacaatgaccaaattccgaaaacatcatgcatctacattcagaagacatatacaacatcaaatgaaactaatagagccaccaaatgaaatgagcacaaaaccattatacaagaaacagagcacaaaatgatcaatttccatgaaaagatatatcacctcttcaacatgctgggcatctccgagcatgcagatcttcattttaggacgggggatatgtggtaacttgacagatccactgaaacgcttgtccttttgagggtcatagttcttcagaccgatctggagctcaatagtctcgacaaagttacgtttctttgcctcggatttccctgtgatagtagtgatggcttcacgaacggcctcactctgaagcttactgtattaacccacaagaacagagttaagcaaattaactaaacaaacaaaaatacacaacattgacaacctcaacatgaacaacccacattatagacactaccatacaaaataatcttatcttaatacacctaaatttttatgaggcaagatttagatttgtcatccaaatttagaggccttagtaaagagcatttatgcaaaactgcagaacaacttcgtgtcaatcctagactattaacatcataaagctatcaataacgcacatccaaaaaacaatcacgattcagagacgtattgttctctaattaaacttattgcatatgacagaagaacaatacgtctctgaatcacgattcagagacgtattgttctctaattaaacagtgaatgtaagagatgcgtcaagtacctcattttgagcttgtctcaatttagctaagatctgatcctggaaacgaaacaaagacaacaaaaaaaagaatcaaaatctatagcagaagctcgagaaacaagaataatctaatgtacagtatacatataaacgaagaagaagaatcaagctagaagtgaagcagtcgttgaggcacaaacctgagtgacgagacagacagaagaaaccctaaattcctcgaaaggcgaaggctttatagtaaggataatgatcaaataaactaaacctaaatgaaattgggcctttagagataaagaaaagcccaaactgaaatcaaatgggcagctgaaaacgtgagaccaacaaaaccaaaaattacttgagcgatctaacatccgactaccgtcttggagacttttctgatgatggtctagtcaaaaccactcagttcagttcggcttaagccattcaggtttgactttgtgcctctacgacgtcgtcttgtgactttgtgttctctctagctatggaatttttttcttcttgagctgttgttagattaagattttagaagatgactgcttctggagctcttcttgttgcacatattgattcgtttcttttggaacccagcagaagaagagtgccaattcatg

SEQ ID NO: 30737 - DNA, 3003 bp, Unknown
  misc_feature (1)..( 3003): 2750-1469P.txt file - cDNA_ID_3034913; gDNA_ID_2096292; Annot_ID_195443
gtacttggcaattgatcagatggagtggacgatctctattcatacacaaacctgaaatgtagaagttaaacagaaaatcaaaagtctaagagtgcttaattaaaagagctttatccttgttaagaaaaagaatggagctttatctttggtaaagaataaaagagccttatccaatatgtagaagataaataagatgattggatataagattaattggaccgatcacaagaaaatggaggtagattattaagaaaactatcgacttctctaggtagaaaaaaattgagcgagaagaaaattaaatgagagtttgtaatttagtccataaaataaaaatagaagaaagagagcagaaaaagaggaggaacccactagaatcactgactcctactccacaatctctctctctctctttgtaaccgcctgtttgtgcttattggctctttttcatcaaatctctttttgggcttattcacgtacacattttttcaataatctatcatcttttctgtagtattattcatcgtattcacgtacatgcctatatcaaaatacgtatctgtatatgtgaaagtaaagtggtgaaatttgcataaaagaattgggtttcactctatcatcttagcagcatggatcatgcatgaagttattttttctaagtagtctgtgtgttaatctaaaaccaaaagaaaactaacaggaaaattctagaattatatcaagaatctttgaatgggcatgatatatacagcatatactttatatttttgccaaaaaaaaaatgatatatatatctttagtctagtaaacaaatatatactataactaaatgatcgaatacaactccccagctatagtttaagctaaattatatatattatttggatgatctaatgagtttgttattggaatagtactagagatagtgatgaaataatgttaatacacataatcataaattcataatcaaagacaatgcattaatgtgggataaggaatgtttgttgatttgtgtatgtatattaaaatagcagaatcgagtgagtttctatttctaaactacaactctttttgttaaatgacctttgagacagagagagggataagaatagtatgaatataatacgtctacttatatgtaacacactatacataattacagatttttttttagtttcatcttcagtctataaccttttgaaagccgagagtgataatatgtgaaacagtttctgaaagttttttcttcttctcaaaaattaacagcttttaggctttaagtttcaaatttggatataatagaactagagcaactttctctagtcggttaacctaacatacttaagtattgaataattaactattttgcctctaccagttcaaccaaaaaagccttagaataatgacaattatgtagaccaataagataaaattaaacggccttcttgcattaatcgtaaataaatatagaaaatagcattaaaattatcaataattattgtaaacatctcaatcgagtgttatttaaattgattagtttggtattatcctataattttgttgatcggtcaacatccactccctgtcatcacctaaatcctaatgccacatttcagattcctttcctttattagaaattgttatatgcctcctttgattcgtatagctgttttagtcaatgcagctctcttgcaaatccacatttgtcatggctttattcctttagtttgtgtcataatgaccccctccgaattgagaatttatttttcacggctctttagatgctttttttgggttcggtagaagtatataactcacggttaagcttttatagaatctcaatattaatttgtccatcaaggcatcaaaataatgtttagattaccatctcagcccaataccggccataatcttatatggaggatgcatattattatgtagacatcaatgatcaatcactttgggacaactactcaagctcgttttctaacgaattgggatttttgaattacttactcaaaatagtgtagtcggttttggtctagcatgatctaaaaagtccaacaagccgagaggcccaaaaccctaatattcaaaacttcgtggcctaaatgtttcatcctgtgtaattttcttcaacaaccattatcttgggtgaaaattgtcaaatttgcatattttccattattgtcattgactttctgattcggtaacagtcatatgatgtaaaaatgggccacatccttatttggtttgcttcaggcccatattcgtttgggctgttagattgtagcaatggtacaaagatctgcaattgatgtaatttaaccttggttaatggtgtaattttattttattttgttggggtcaaactgaaagcctcaaaggataagagtttttttctgttttttttttttcacacttttttttgttttgttagaattcataaaagggtaatataaacttgttaaaaagaaatacagtagatacgtcatatatacagaaaaagtaagagagacagatgttatcaaataggggggagtaaaacccactctaatactacttgttatgcttaaatataaaaatgaataaaagacttggaaatcaaataaggaagtgagtgattcccacgtcgcaccttcctcctaacccttttcttcatcgccactcaatctttctctctgcaacatcctctcttgtaacgtgtaacttgccaaccttttcttttttattaacccaagttcgttgccggccattaccaattcctttatcccataatctcttctctgcttccttcttccatcacattccccaaaaagtctcaacacagagcgagaagaagactcaggttttgcgagaggagagatagagagacttagaaagctcggtaagtccgaactttggtggttcggcggctctacgtcgtctgtaggtcgagtcgtcctggagctcgcccgttgtttctcgacggcggaggtggaagacaacgaccgaccagccatg

SEQ ID NO: 30738 - DNA, 3003 bp, Unknown; identical to SEQ ID NO: 30737
  misc_feature (1)..( 3003): 2750-1469P.txt file - cDNA_ID_3034913; gDNA_ID_2096295; Annot_ID_195514

SEQ ID NO: 30739 - DNA, 3000 bp, Unknown; identical to SEQ ID NO: 9921
  misc_feature (1)..( 3000): 2750-1469P.txt file - cDNA_ID_3034917; gDNA_ID_2096295; Annot_ID_195513

SEQ ID NO: 30740 - DNA, 3000 bp, Unknown; identical to SEQ ID NO: 9967
  misc_feature (1)..( 3000): 2750-1469P.txt file - cDNA_ID_3034936; gDNA_ID_2096296; Annot_ID_195566

SEQ ID NO: 30741 - DNA, 3000 bp, Unknown; identical to SEQ ID NO: 9966
  misc_feature (1)..( 3000): 2750-1469P.txt file - cDNA_ID_3034940; gDNA_ID_2096296; Annot_ID_195563

SEQ ID NO: 30742 - DNA, 3000 bp, Unknown; identical to SEQ ID NO: 9972
  misc_feature (1)..( 3000): 2750-1469P.txt file - cDNA_ID_3034944; gDNA_ID_2096296; Annot_ID_195558

SEQ ID NO: 30743 - DNA, 3000 bp, Unknown; identical to SEQ ID NO: 9973
  misc_feature (1)..( 3000): 2750-1469P.txt file - cDNA_ID_3034956; gDNA_ID_2096296; Annot_ID_195553

SEQ ID NO: 30744 - DNA, 3000 bp, Unknown
  misc_feature (1)..( 3000): 2750-1469P.txt file - cDNA_ID_3034982; gDNA_ID_2096298; Annot_ID_195602
ctccattttgttttttgagtagtatctaaatatctttatgtttttgtaaatgtagaattgaagatgaggctccacttcctgtaatttcacaagactggcttagaaaactctatgaagaactggaaaagcagagacttagcttaccagagaggtactttcagattgtgatttatgaataagttctcccttttttgagtttcagtgttaaattctgcgttagatcataatcgtttagtctcattttaatgtagactcaatgaagacgagcttcatagattctacagggtgtcaaatggagacttcacatccttactatcttcgataaaaaagacaattcattggagggagacttacagaattctttctgaagaagaacttgagacatggtcaagtttactcttttggcatggatatgataagaaccaacgaccttgcctcattgttcgtttggggctagcttttctaaagttgccatctcatgagagacctcgtttcgctcaggcaatcagtacgtccttactccttagtggctttactacattttccagtattttatttgctacggtatcattttaattttccactattgttattgtttcagtatctcaggtagagcacggcgttttgcatcttctgacccctgagaattcagaacttacagtgttagtcgattgtgaaggattatctcctctgaggattcccatgcagatgatgagatcttgttcttccattcttcaagatcacttccctaaccgtcttggctgcctattcatcattcgcctccctcctgttgtccgtgtcatttcccagactttcatccaagtaaaaaatctacctaagctaacttcaatttttcggttttcttagtctttgttctcggatctatgatcgttgcatatcccttgcctaaacttatgttcttctctcatagattcttagaccaaccacacgcaagaagctgagaattgaaggggaaactttccatcgagtcctctctgaatacctccagacacttccttcataccttggtagcaactgcaactgcaaaagatgctcaaatctcaacgaacaagatccaccacagccacaaacacacccaagaagaaagagaagaagctcgagtgaaacagagaagctagacgacagccactggagttacaatgcccagacacctgatttatcctatgaagacgagccgagcctgaacatatgcagccaagttctgcgaacagcagtcgtgttcttactcatgatatggctcttcggtgcactactagctggatttgctgatcctgagagcagacccttttaagcttccataaggtaagaaccatccataattaatttcaggcacatgcgtatgtcttctgtatacatagtaatagtaagtgtgataggcgttgatatatacatagtcattagtgaataaaccccatctctcatccagcgtggtcattgcaaacgcggactcaacgtagttttgggtcttggtttagggttaatggttgttgcggttgagtacatttgtacgttgggagaaagtaattatggtccagttaaatcgtgatgagactttggtcaccctctgcagtaaaactctgtgtacaattgttgccattgttggtaatgttttgtaaaaatcagatttatttaatgtgattagaaattgagaaatgtgtagctaaaatccttgatggatcatgctaatcatattttgttaaaaagctgagaacacaaagaccaaagtcatggatcatttcatgattctttttcagtccaaaccaaactaaaccaaacagaaccaaactaagttttatagatttattaaaatcgaaataacccgaacctaaaccgaaatgtccgcacccctacttttcgttgctgcaagttataatcataggtgagtgtcataaacttagtttaatcgatgattttttgtacaagtttttgtcttttctcaaaagaaaagaaatgattattcattcttcaccctgatttaaaaggtttacgttttctattttaagaaaattaatcgaagaactgatacaaaatcatcactgatcaaagaaatagtttatagttgtcaaacatgtataggacgtttactaatttttaatttcttctgatgatataataaaaaaatatattattatactcgtaatgtacaaaactgaagtcaaccagagaacaagctttttattagttctacgatctagcaagcaaacaaacaaaccaataataacaaaactatttgatgtatcattgtataaacaaacatttttaaaaaatctgaacttaaactacaataactaacaataattaaactatgctcaataataataatcggatttttcatcccaaataggaaaatgtatatgagaattcaaacaaattaattttcataaaacatgggagtatattgaaaattttagctagaaatctttaacaaaaagaaaaaaaaaaattagctagaaattcgcctaataataaacaactaaaattccctaaaattgtggaattttagtttcttgacgagtaaagaaaatgccacatcagataatacgtttggtcaaacgttgtcgttgtaatcgagtaaccacaaattaacatttgatattgatttttccacttttcgtgttttttaagtcactaatcttatctcacccaaaacaaattaaacaaacacacaaaaaaaagtctaaaaaaagaatttctcaacaaaaaaataaaaatatctaacttttccagataatatattcaaaattttacagagaggaagaagaagttcccgacacttgtgagagactataaaagtatacgatctcctcctctcgctctcttcagatcacaaagttttcgtttttagggttctctcatcgatctcgtaaatactcctctcgaaccctttctttaatcggaatcttctttttctctgttgtttgattcgattttttttttctcaaaaaaattcagggtttgtgatcttcttcttcatcaatg

SEQ ID NO: 30745 - DNA, 3000 bp, Unknown
  misc_feature (1)..( 3000): 2750-1469P.txt file - cDNA_ID_3035041; gDNA_ID_2096299; Annot_ID_195646
tacaaaattgtttagtagactacaatttttagataactttgtctatcattttcccacttgtttagtataggagcatttttgtcagttcaaaccacattaattcaaaattatgacagtttggaaaaaaataaaaatttatggcattattggtaagtttattggtcaaagtggcaaccaaaacttttggtcaagtgacatttttggtaagttttttggtcaaagtggcaaccaaaaatattattcaacatgcaacccaaacttttgaagaaaatttattatatatggagactacaagtaaaaagcctcaagacaaaacctacccaacgtggttaaaaccaccaactcttatatgagacaaaagagaaacacacttttcttggagtgtttccactttattacttcattcagaaagactagttgtcacacaaggaacacgagagtcgagagagtaatatatatatagagagatagagcttaagcaatggagaaaatggaagagaagaaaaggatagtgttagttccggttccagcacaaagacatgtaactccaatgatgcagcttggcacagccctaaacatgaagggcttctctattactgttgttgaaggacagttcaataaagtaagctcatctcaaaactttcctggttttcaatttgtaaccataccagatacagagagcttgccagagtctgtgctcgagagactcggaccggtcgagtttttattcgagatcaacaaaaccagtgaggcaagcttcaaggactgtataaggcagtcgttgctgcaacaaggcaatgatatagcatgtatcatctacgacgagtatatgtacttctgtggagctgcagctaaggagttcaaccttcctagtgtaatattcagcacacaaagtgctactaatcaagtttcccgttgcgttttaagaaaactcagtgccgagaagttcttggtggacatggaaggtgcctaaaaccagcttaataacctatcttgaaaccattcgtttcactaatacgtcattttgttttggctttttagatcctgaagtgcaggaaacgttggtggaaaatttgcatccattaagatacaaagacctaccaacttcaggagttgggccactagatcgattatttgagctctgtagggaaatagtcaacaaaagaacagcttccgctgttatcatcaacacagtgagatgtctagagagctcgtctctgaaacgtctgcaacatgaactcgggattccggtgtacgcattaggccctcttcacattacagtttcagcagcttctagtttactggaagaggacaggagctgcgttgaatggttgaacaagcaaaaaccgaggtcagtcgtttacataagcttggggagcgtagttcaaatggaaaccaaagaagtgttagagatggctcggggtttatttaatagcaaccagcctttcttatgggtcattcggcctggctctatcgcaggctccgaatggatagagtcactgccagaggaagtcattaagatggtctccgaaagagggtatattgtgaaatgggcaccacagatagaagtacttggacatcctgcagtgggaggattctggagccactgtggatggaactcaacgcttgaaagcattgtggaaggagttccaatgatatgcaggccctttcatggcgagcaaaagttaaacgcactgtgtttagagagtatttggagaatagggtttcaggtgcaaggtaaggtagagaggggaggggtcgagagagctgtgaagaggttgatagtggatgaagaaggtgcagacatgagagagagagcccttgttttaaaagagaatctcaaagcctctgtaagaaatggaggctcctcatacaacgcattggaggagatcgttaacctcatgtagcagttcttaaaagaacataatgaacttcatgtatcataaaagaacattgatttttattgaccctacaaagtttacaatgttcgattttataatttatagacccgtttggagcatcatgccaaaggaaaattttaaaaagattagaatttcgaggcttaccactaactcctcccaaagactctttgcctttcatagtgtagaggctttcatagtgtagaggcacaagcttcccagttcttgaatatgtttgaagaaatcccctgtcaacaccgaaatacagttttagcaaaaggattcacaaacacaaatttctcgcgctttatgagagcacgatctaaatagcaaaggaatctatgagtataaagaagatatatccaaaggttgcatgtgctattgctatttgaacataaaaatacggtataaatacagaattaagtctcaaatgttgacaaacatatagcagagaataataacacagcaatacagcagatggtattcattcttacttctcaaatgctcttcctaagcatttgttggaaagattattgcttcttaaaaatgagttatactaaatctttgaatataaagaagatagaggtttgcatctactgattgctatttgaacatcccttagaaactcactaacagactaataaattgtgctatgtataattatactgacctgatttacagagtaggtgtttggtttatgaaaatcaaaatcaaatacgattatctcttttggcattttactcaggatagaattgatgcagcagaaaaagacaatttttttggtatggaccatcttttgatatgaagccaaagtcggcaaaagaaccaagaagacaaaaccatctttgcttttttttttttggttatcaagatagagagatataccaatgtcaataagtaaagagagccaagaaaaacgaaatacagatgaaacaatgtccacaagtctgagaatctgatatttatctcagaaacatactcattttaatattctcatagatcggtcacagggaagaaaagaaattggaggaccaaattcggaaagcacgaggcagagcagttcttgtaaattttcgaaatg

SEQ ID NO: 30746 - DNA, 3000 bp, Unknown; identical to SEQ ID NO: 9983
  misc_feature (1)..( 3000): 2750-1469P.txt file - cDNA_ID_3035045; gDNA_ID_2096299; Annot_ID_195643

SEQ ID NO: 30747 - DNA, 3000 bp, Unknown; identical to SEQ ID NO: 9990
  misc_feature (1)..( 3000): 2750-1469P.txt file - cDNA_ID_3035052; gDNA_ID_2096299; Annot_ID_195633

SEQ ID NO: 30748 - DNA, 3000 bp, Unknown
  misc_feature (1)..( 3000): 2750-1469P.txt file - cDNA_ID_3035098; gDNA_ID_2096300; Annot_ID_195688
taaagtttgccacttggaacgctaacagagcttttctatctctaatgcgcgcgtgacgtccacacgcatcggatcggagaggcctgacttaatgaaaatgatttactttttgtttcccgacaaaatatttgattaagctttgttcaaactatttactgtaagagaacattaaaataaggtaaaatgggatcccgaaaaagatatacaattagttacaggatttgtttattacaagagaaattgtgattcacatttagttaagggtaactatataaatggattcgtttactattttattgcctctcagattagttacgacttcaacgaatcaaatgtacataacataaagtcttatacagttatgcacatgtaataagagatatactatcaatttaggtctgttgtctgttgataattacattattgaaaaactaatctttttttatataactaaacaagtaatggttgttttgtaggaaaagacgaaaaatattatagcaatttaaaaaaacaataagaaaaagtgtatgctctatattaattgaactaacctaaaacctgaacactttacaaaatgataaccatgtgagacatatatattgatgcaataacaagtagagtttatttttattacgctaatgattggttattttaggtatttattaagattatttagtatctaaacattgtatttcttatttagatatgtacaatatgtgctaggacaatatgttattatagttttgtaaatgatcaaattttaatgtccctacgtagcatttttcatactcgtctgaatttgacactaaaaattagatactttacaaaactataattttgtatttctggtttatccaacagctatttactttttcctataatatataaatcgcgaaagatgttactttttcgtaatgaaaaaatgacttgaaaagattaaaactttgcgacaagatttaactatcttttatataaaacatgaacttcatatgattttcatagataaaaagactttgacaaactatactatgcactcaacaaaaaaaaagaactatgaactcctatatatgtgtaatttaagaaaaatcctgttatttattgcgatggtacggaaaaaagaataatgattgagaaacggctaattattgttttgttctataaagaaacatgaatatcaggattaaaaagagctaaagtgaaaacggcataataatttgacatacaatgtcacgtgaactaatttgcttggtaacgtaaattaagtgagatcactttgcaaatctcactttctttaaatatcttattaaagcaaattccagaatgtcgtcatattttaatgatagagaactagtggaattctcaattcattacatcatatttatatggtgtatcgatttatattacttgtatatctatatataactaaacgcacaataacttaaaatataatttttcgctacacatgcaaattgattttgcaaggtatatagtcattcagattgatcatttgtagttacttggttggttttaaattagcaacgaaatcacgtaagcgtcaacataaggaaacatgtagaataaaagtgaatgaactaatcactaattaagaaaaaatattagtttaaaccagtgttttcacgcccgacccgaaccgtccggtccgaccggttaacccgtaatccgaacatttttccggtttgggtttagtgctaaaacccaacaagttcaaaaccgaaaaaacccacaaaaactcgcaattaacccgtgacccggtgaaccagttgaaccggtcgggtgtgggttttaaaaagttctcttgattttacaataaaatatgggattttagactttattcaattatttttagaagttttttcagttcttaaattcatttgatgttttagattttgttgatgactttacaataccgccttaaaattgaatcgaatggtgagagagacaaccgagattagttgttttaattcacgatgttttattaatttatttctgtcattgatgatctcctaatatatttgttacggtgttagacatttattggatttcaaatttttaaccactttattattattgtttgattttttctatatatatatatatatatatatatatatatttgggtgtaaatgattttatattttgttaaatataatataattttatatttgattaaatatgatatgattatttttgttttatatttataaatactacaaattttttttattataaaatactctaaaatttctattagtattaaatttattaaataaattttaactaattaacccgtggtccaacccggttgacccgatgacccagtgacccagaagatagtccggttcatcgtccgggtcgggtttcaaaacattggtttaaaccgaagttggcaaatatacttattacgttgtgtaaataagttaaataataggattggtgaaaaccctcaaaatcgtaaaatgattaggtcataattatgtcattgtatatatagagaattagagatgcatacgtagaatctagacataatccttaagaaaatagcttgcctaaacagctgagattgacaagcattattaacataactaattatgttttatttcttaagccaaaacctaaaaaaggttatttggtaacagaattgttatttgtacgtcaaaatgtatatgatttggtaatggtttagcgtgtgaattattgttgcgggtctttttttgttatacaactacaatgacattaacgctttttaaaataaataagaaattcaaacattattcaaaatattattgttcacacaaacatttctcctttttccatctcccacacaaaccccattcctccctttagccctaacccctatatatacgtgaagtccccgaaacactaagctcgtgccattagcttttacattaagagaaaacacttgcaaaactaagtgctatctctcttcttcttccttctcctaacaacttatataccatg

SEQ ID NO: 30749 - DNA, 3000 bp, Unknown; identical to SEQ ID NO: 30748
  misc_feature (1)..( 3000): 2750-1469P.txt file - cDNA_ID_3035098; gDNA_ID_1972174; Annot_ID_179942

SEQ ID NO: 30750 - DNA, 3003 bp, Unknown
  misc_feature (1)..( 3003): 2750-1469P.txt file - cDNA_ID_3035102; gDNA_ID_2096300; Annot_ID_195687
ctacaatgtgatcaagaaatctctctcagaggttcttgttcattactaccctgtcgccggaaggctgacgatcagtccggaagggaagatcgccgtcaattgcaccggagaaggtgtagtggttgtggaagctgaggctaactgtgggatagatacgatcaaagaggccatctcagagaatagaatggagacgctcgagaaacttgtttacgacgttccaggtgcccggaatattcttgagattccaccggtagtagttcaggtgaggttttgatcgatctcttgcgtactaattactatatttttcgattagcttttacataaacttaggttttgcgggaaaataatgtatttacaatgacggcgacatgcttatagacagcagcaaactagagtagcaaatatcctacataatgttcgggagtaatttgcttattttagccacttgataattgatataaatgatcgcatttaatgtcagaaatgagtttaactttttgagtatcaatcacatgtgattgtccaaaatgtagatttatgggagttttgcttgagaaattcaattatacttatttatatgatatatgacaaaatacttttttgtttgtaatagtaaaatcttaatataaaaaaaaaaatcttaatataaaaatataatccaaaaaaatacaactatatatgtaaatatctaaatcatagtttattttaataacaatctccctgaatatcattgggaaaaatgtcaaaaaaatcacgaactttcaaatttgggatgatttaatcttgaactccacggaagacaaataaatcgtaaagtttttgttgactttcaaaataaataacaaagtttttgttgacttgccatttgagtcatgtcgttaaataggttaacagaattattttacggcgttaatatctcgtgtatctgctctgttagaacaaaacgacatcgtttattgcagagacaaaggaacgtcgttttgtttgttgaaacaaatttaaaccctaaatccccaaatcgatttattatctgcgattttgaggtcaaggtgggtctgtgattttgagataatgaaatcgatttggggatttagggtttaaatttgtttcaagacaaaacgacgatgttttgtctctgcaataaacgacgttgttttgttctaacagagcaaataaacgagacattaacgccgtaaattttttctgttaacctatttaacgacatgactcaaatggcaagtcaacaaacactttgtcatttatttcgaaagtcaacaaaaactttacgatttatttatcttccgtgaagttcaaaattaaatcgtcccaaatttgaaagacatttttcccgaatatcatttatgaattatgatacaatgttactaaaaaaatcatttttatgtctcatgcatgtagtaacgaacacacactaatatagtaacaaatgatcagacgttactcttaaaaactagagtggtcatcatgttcaaactttaaggtacattagaccatctaattagaaccatgcgtaattagtattgttaagtaaccaaaagaaataacgacgatcaatagtaagttttttttttttgtgtgtgtaaccaataggtagtacttaagttaaatgtatattatttcattcctatttctttaaattggtatcgattcattctaaaatgttgcatggattttttttaacatctttagataaagttttatgttccgttttttttttcaggtgacaaatttcaaatgtgggggttttgtcctaggactaggcatgagccacaacatgttcgatggagtcgccgctgcggagttcctcaactcgtggtgcgagatggccaagggtcttcctttatccgtcccaccattcttggaccgtacgattctccggtcacgaaaccctcccaaaatcgagttcccacacaatgaattcgacgaaattgaagatatttccgacaccggaaaaatctacgatgaagaaaaactcatctacaaatcatttcttttcgaacccgaaaagcttgagaagctcaagatcatggcgattgaagaaaataacaataataaggtatcaacatttcaagccttaaccgggtttctttggaaatcaagatgcgaagctctacggtttaaaccggaccaacgggttaagcttctgtttgcggcggatggacggtcaagattcatcccacgtctcccgcaaggatattgcgggaacgggattgtgttaaccggtttggtgacatcatcgggagaattagttgggaaccctctttctcactcggtgggtttggtcaagagactggtggagctggttacggacggcttcatgcggtcggctatggactacttcgaggtgaaccggacacggccgagtatgaacgcgacacttttgattacatcctggtcaaaattgacattgcataaactggatttcggttggggagaaccggttttctctggaccggttggtttaccagggagggaagtgatcttgttcttaccaagtggtgatgatatgaagagtatcaatgtgtttcttggccttcctacttcagctatggaagtgtttgaagagcttatgaagatctgaaaaagaacatacattttcataatcaaattatgatatattctaccaaattataagcaaaggaaaattataatctagtcattatttatacatgttatatttgaattcacgtttgtatccattacaaaaatttatgtaattcgcagaaaatatatatatgtcaaattaagttatcggaccggatcgggtcaaagaaaccggattggttaacaaagtcaaacaaacaaatattgacttgagtttcagattccagtaaaatcaaaccggatcgggtctgaatttaaaccaccgggtcggctccatctaaaatctgaagatcatctccgccttatcttgttgactatctctgtactacttacgagcgcaagtgagagagtaacagagaaacgtagagatatagcaaaatg

SEQ ID NO: 30751 - DNA, 3003 bp, Unknown
  misc_feature (1)..( 3003): 2750-1469P.txt file - cDNA_ID_3035110; gDNA_ID_2096300; Annot_ID_195682
gaggaaacaggaattgcttgtgcagaacctgagacaacttgtagaagagaagaaaaaagacatgaaggagattgaggagctttgttcagttaagtcagaggaacttaatcagttgatggaagagaaggagaagaatcagcaaaagcattaccgtgagctgaatgctatacaagaaagaacaatgagtcacattcaaaagatagttgatgatcatgagaaattgaagaggctgttggagtcagagaggaagaaactcgaaatcaaatgtaatgagttggcaaagcgcgaagtgcacaatggaaccgagagaatgaaattgtctgaagatcttgaacaggtatccatttactctctgtatctctcttttcaagatatatgttcaagaaataattggtttttttctcttatcagaatgcatctaagaatagctctcttgaactagctgccatggaacaacaaaaggcagacgaggaagttaaaaaacttgctgaagaccaaagggttagtgactttcttcttctttgtaaaaatggttgggcttattttcgtgattactgagaaaattctgtacctaacagaggcaaaaggaggagcttcatgagaaaatcataagactagaaagacagagagatcagaaacaagcgattgagctagaagttgagcagttgaaaggacagctcaatgtgatgaagcacatggcatcagatggcgatgctgaagttgtgaaagaggtggacatcatcttcaaagatttaggtgagaaggaagcacaactcgcagatctcgataaatttaaccaaactcttatccttagagagcgcaggaccaacgatgagcttcaagaagctcataaagaattggtaaacgtatgtatcattcaaagtgttgttcttttcaatcacatcgaaaagctatgagaaagcttgacattttactaaaatcttggttttgtttgtttcatgtgccttcatagattatgaaagaatggaacacaaatatcggtgttaagagaatgggagagctcgtgacgaaaccattcgtggatgcaatgcagcagaagtattgtcagcaagatgtggaggaccgagcagttgaagttctccaactttgggaacactatctcaaagattcagattggcatccattcaagcgggtcaagctcgaaaatgaagatagagaagtggtaagaccgccttcttgactctgtttgttatgttgaatctctctgaaagattaaaaagcttttttggtgttgttgttaattgtgtttaggaagtgatagatgatagagacgaaaagctgagggagctaaaggcagatttgggagatggtccttacaatgcggtcacgaaagctttgttggagataaacgagtataacccgagtggaaggtatattacaacagagctatggaacttcaaagcagataagaaggctacacttgaagaaggtgtcacttgtttacttgatcaatgggaaaaggcgaaacgcaagcgtggaatggcttagaggtttaaccatttttgataaccgaacaaaaatatgttttcatttgcaattgttatttgctaatataggatttcgattgatggtttgcagctgcaagatgatggacatgggactgaataaaaagccgatgcggtttttagttgcagagaaatgtgtttggtttgaccaaactttggtggattctgtttgtttttcttctcagaacttagtgaataattgacacaactttgatgtcttgcatcggttcttttcattgtaacatttgtaggagtttggccgctttggacaataagaaataaaaatatcattgtaatataattcacatgtaaaacaactagatttggcctctcttctgtctcatatcttaagcatgtcatttagaaccttttattgtaaaaacaaactttgtcatgagttactttttgtagtcaaatttgatattgaccccttccttattatgctaacactgttttcatcttataaccctataaatctaagtttcgtgaatatagccaaaatcatctacatcattgcaaagaaccttaaaggagaaagaagaaaaccggcttgagagagatggaaaacaactcaggagctattctctttgtgatcttagctatgaccattgttcttcaagtgaggccagggttctctcaagcactccctacgatccccggacttttcccaccgggtcttcctattgatatcataaaatgttggtcatctctctttaacgtccaaggatgtgtacaagaaatctacaaatcgatattttctggtcagtttgctagcattgaagccccatgttgtaaaacgttttcagctatagatacaaactgttggccacatatgtttccattgaacccattcttccctcctattctcaagaacaactgcgagcgtattgctacgactccatcatcaacacacaagtgaaggctacacacaaatgttgcgagccagttgttagcttcgaggtttaagaagttcttttatcgatttgagagatcacaatgcccaataatccaaaattctccttgcagtaatttttttttttttgtaatctttagcttaaaataaacaaagctaagctttttgatgtactcgtatgtgtttgccatgtagtttgttaaaagagtggttataacataaacaaaattttgtttgcgtttatatatgaaaatattgttcttacactatggaataaaacatatttcagcatttaaaatttgtaaaaacgacgaacacgaacgcatatcaataccataccaaaaagattatatcgtacatgaaacttgttgcagacaatggcatgactaatgggcctctattaacttagcccataaggcccaataaaactttccaaatagtttcatttttcagattttgaagaatctcccgacgactcctctctgtctcctcctccgggaagctttctgtctctctctctctctctctacacaagaccttgaagaatccgattccataacaatg

SEQ ID NO: 30752 - DNA, 3003 bp, Unknown
  misc_feature (1)..( 3003): 2750-1469P.txt file - cDNA_ID_3035113; gDNA_ID_2096300; Annot_ID_195675
aataggcataaatactacatataagttttttggtcagtagtttcaaaactatttatatatcaagttcaaaagcggagtgttcttgttaatttggaaaaaagcttgaggattctactaaaaagcaatgcacactaagaacaaatttgtaaaattataatagagaaaaagagaactaaccggttcctttttgaatccaaggcgaaaccataatggtaggaacacgaacacctaaccggtcgaatttaaagaaaccaggagccggtccagtattcccatcgggatttggtataccgacataaggagtcttgacgtgatcatagaacccaccatgctcatcataggttataactaggagcgtctcgttccactgtggactcgacctaagtgcctcgtacacttctttaaccagcttttgaccgttagccacgtcatgcgacgggtgatcatcgttagccggtaaacctttgagatcgaaatacctcggttcgattacggttaagctcggtaactttcctttggccgcgtctttcttgaatttcaaatcgtattgatgcaaattgaaaatgtactttagctgtcggagattacggtagaataatgtggtcggaatattctgaaagtatattccgaagtcgatgtcgttgctatgaagcgaatcaaatatcgtcttctgtggatacctgaaattaaatgatgaatacataactatgcaaaattttataatagtttatattatctcaatattttctatggaaactaatcttaaaaattcagtaatcaagtgtgaaattaaactaatgaaaattaacaaggactaatgaaaataataatttaaagaaagaatttgataatgttacccttgagcgagttgtttcttgacatggctagtggaaccatgtgaggtagccgaatagacaaataaccggtttggttgagtcggaccgggaattgaagaaaaccaccggtcgaacacagcgaattccttaaccagctcagcataaaccggaacagcttcaggcctaaagcctttcattacagtctccgacaaatttcccggcatggaaagcgcttgctcaacgaaacccatcatggacgggatctgacccggcccagacccgaatacttgttgctcaacagcttcaaacgaatgacccggatccggatccacaaactcagcatcactagtgaaacatatagtttgtgtagaattcggaaccgggttacattcttgacccgttacaccgtttattgtcgggtttactgagttcttcatccatcctaagagatgatcgaaagatcgattctccaacactaaaacgacgacggttttgattggtgattgccattgatgagatccttgagctacatgtgtttgtgtgagaagacagtagagtgtgagaaagtgtgagaaagttaaagaaaatcttgaagctgatgatggtttcatggatgggttttttcttgggaaaaatctggttaagcttttggtgtagaatttgtgtctgtggttttgttttgccttagattggttacatgaaagaagaacataaagacagtggagagataattgtctctttgtaaccaaaatacaaaaagataaaaagttttaaatatatagtattataaagattttgggtaaatgtgaagtgtagagagcaagaacaaaaaagctgtggtgtctatttactgctttatttgtttccactactactgctttgatttaggtgggctcgatatgtagaagaagattctgttctcactgagaaaaagtaactaaaaacgcagagatttactcggtcaatgaaattcttgaattttggctgattttattatttgtagctatattataaaacttggaaatatatatgcacgtgaagtcgtgaagagttggtcttgagaaaaccacgtagatgacctcagggttgatgttgttttcttgtagattttagtgttacaagtggattcctagagttctaaatagtttactagttgtgagagatcttgacaaatgtatatcataactttaaaaacataaattggatccacaatccatacaaatgtttataactttatatctgagttttttttaaggagtattgtataaattctctgtaccaagagtatcggaaagtagtattaatatacttaaaataattgaacaataaatcatcatcatggtagttacttttgtctaaggtgccccactgatcttccattaggaaaaaataattggaatttgggagttaaaggaagaaccaatgcttagtgctttttcattctccaaatttctttagtatttttagtttttctgcctcaagtttagtgtttttagaccatgtacataggtgatataattagagtatcaagagtcacaaaataatttttaatatatcaaacaatagatttaggcctgatactgtatcagtgcagtgattcttttgatacccagtatcggatgacgtggaggcttatgattcgtctgtgaaattcgtttttttctggaaaaaaaaaaacatttttctctccgatagtctttctactgttttagctaagtagctacattttccgcaagtgagtaattttgccaacttttcgtgattatgcgacataattttacagtaattttgtaactctatatttttataaatttattttttgattttgcaaatatttttttttttaatgataccaatatcggtatcaccactggaaacaatttattaccagtatcataaaaaatctcaaataataaataaacattaaaattaatattaaaatattgttaatgatactcatagtgtatcaactatgtgcatgctctaaaaattgttagtttaccatatatagtttattttgtgattcacaaaacaacggaataacgaaattatttcgaattttttgtaaattaaataattacgtaaaaacgcattagaaagatgttgaggaacaatttcatttcttcgctcttaatcaagaccttattacaaaacaaaaggaaaaatg

SEQ ID NO: 30753 - DNA, 3003 bp, Unknown
  misc_feature (1)..( 3003): 2750-1469P.txt file - cDNA_ID_3035128; gDNA_ID_2096300; Annot_ID_195665
acgtggagatcacaacagaatgagttcggtttggaaagaagatattcacgcaaagatctggagtgatccaagatcttgaagactaacctagaagaccaaagacctcgatgatataaatagaggtgctaaggtgcttgctagagttggccatgattgtgagtgaaaaagctagtgcaacgcttttcattgttagagactaaggtttagtctgattggaattctagagagatcaaagagtgtgttcttgtgatatactcttgtgtgtttagagaaatctcaggtgacaagatatagtagtttagatcttgtgtaaaaccaattaaggtagttgtaaacttcttaatcagatttctaataaagtgatactcagtggttcttagtttggggaatacgattcttggttcatccggaatttcacatctacctaggacgacgaaacccaatatcttggacaaccaagaaacggaaggggtggcaagatcatctatagaagtagagtatagggttgtcgcaaacacggcctctgaactaagttgggtatatatgtaatattttcacataacttggaattactttcaacacaccacttgttgtgtactgcgacaacgtcaaaaatatcttcctttgtgctaatccggtcttacactcaaagatgaagcatattgctatagattatcatttcatccgtggttaagttcaacaaggtgctctccgagtagttcatatcaacacaaaggaccaattagcagatgtgttgatgattggagtgtcacaagcctctccatcttgagggggcgtgttagtgatacgattacgattcacatttatctcataatatttgattactctgttttaggtaatgtcttaattgaaaaaaactagagtctcgtctcttattcttatataaatatgttgatgtacaaaaccctaaatatatgagaaatagtttcttaacatgttcaggtcatctataaggcaagtaaaacacatgcttaagtcataaaatagaatctaaagagacattattctgaaatgatcaacttggtctacttagcctaattttaagtcaatacatacaaatttgatctctctaactatatttgtttttctctttctagtgttctttttctttccaatatatatacatagcatattttgaattctttttgttttatggagtaacgtcaaatattataatagccgcatataaaattagaatttattaaatattaatttataacttttttattgtagacaattattttaggaaagcaaagtatatttagacgaaaatagtattaggatgaataattttttgaaagtcctaatgttgcatattttttgttttggtgaacaaatttcgtgttgtagttcttaaacatctatactattaattgggaatcattgaaaataaacaaccttacgaagggtaaaatattacaaaaatactattgattgttagtatttttaaataaattctgattaatttaaaataattataattatgctttacatttagaaatatataaacaataaattgtacatacttattttgaaatattttggttttcttttttctttttttcaacctgatttttttttaaataaatccataatatattattgaacaaacttttgaaataatgtaaactaatacatttttcattcaaaacaaattatccaacaaaaataatttggattatgagtactatataaaataatttgaaaccaaacttgacatcaaattaaatatctaactggtatgagtttgggttatgaacactatatagcatgtacgtattttgtgacacaaattctatttgtgatgtttacaggttggtagtattttttttccacatatacagacgggttatgagacgaaaaatttatgatacatacatcacaggttttccattccaagaaatataagtcaaatatacgtttttattttctaaactaatcaaaacattataactgttataacagtaatcaaaacattataacagtttgattactggtgtaaaataggatataaatttggttttagtttgggttatttatctgtgtgaattcggatcttaaaatataattatataccaacataattgaatttcgattattattcttaactttataatatttatactattacaaagtttaattataacaaaatattatatattttaaaaatctatttaaaaagttctattttatatgtatatgagatttcaaatatctaatatattgtattataatatatattacaaaataaaaaaaaataatttacattgaattaaaaatatgaatccgcacatacgtaaaagttaggatctagtaatttgtataaaaaagaaagaagaagatagttatccatttcataggtcggctgctaatttttggcggatttctaataattatatacaatccaattaaataaatgaaatatgtcgtggaaagtggaaactatataaaggatagagataagtacgacttcgacaaatggagatatattatcattattattattataatcattatctttcgctattcctgaccaatacccaaatgatctccgctactctttccacgtgtcaaaagcactgaattgaacggatgagatcttaagtcactaaccaaaacaacacttgaatttttttataacaaatcacagttccacccaatgaaatccattttgtttcaaaataaacccgtatctttataatgaaactgaaagattcaaggatgtttttgataaattaaaaactatgtagggcttcattcataagatttaagacaacagggtttatgaatttgtctctgcttcacgatctctctactatggtgtactgtatctttcaatctatagttcagttacaaagatcatcacagccaattttagaaaacttctgacggaaaataaaaagagaggatttatttttatctttctgtgttaccggagaataaagacggtaccttttcactgttgacttaacggagaagatg

SEQ ID NO: 30754 - DNA, 3003 bp, Unknown
  misc_feature (1)..( 3003): 2750-1469P.txt file - cDNA_ID_3035156; gDNA_ID_2213622; Annot_ID_195758
ccagaatttaaggagcatcgaggtaagagaagtagatgtaacacgggatacttatattagtatataccacatgttatgcatgctttgtttgctaagttctagcaatgatcaacagatctctgtagaaaaagttgctctcaagtcatctgaagtgagagatgaagaaatcagaagagcagttgagatggccgatgctttccttcgggctggcagggagactctaattatgagcagtcgtgaactcatcacgggaaaaagttgttctctatctcaaatctttatatatttgtgtcgttggtataaaatcatgactgaggaatatcatcattaacgggtctatattcattttgacagcatcttcggaaagtcttgatattaacagcaaagtgagctccgctctggttgaagtagtgagccagatatcgaccagacctcgttatattcttgctaaggtatttagcttctatatttatctttccatctcataaacttcctgacacactctgtcaatccccagttgaaatggtaactgttctatgatccaaagcctttcgatttttttttatgacactgtaacgtcattgtttagggtggaattacgtcatcagacacagcaacgaaagccctgaaagcacgacgtgcacttgtgattggtcaagcccttgctggtgttccagtatggaagttaggtccagaaagtagacatccaggggtcccctacattgttttccctggtaaatcttaatttgtattcaaaacatttaactgaataaaaataggtattcttaatcaactctttttccttatatgtaacaggtaatgttggtaacagcacagcgcttgcagaagttgtgaagtcttggtcagtggtagcaggacggtcgacaaaagagctgcttctggtgagtatccttctcgttctctagcttcatatatctcttctcatattgatgttgtctttctatgtaaaacagaatgcagaaaaaggtggatatgcagttggagcatttaacgtgtataacctggaaggaatagaagctgttgtagcggccgcagaggaagaaaatagtcctgctatattgcaggttagtgttctgaccaaaagtggatttctgatatacaatagcaaccaaagattaacattctgttctgagttgttcaaagatgtccgacacaaagagatttgataactgaactttttttggctaccttttttaggtccatccaggtgcctttaaacaaggaggcattcctttggtttcatgttgcatctctgcagctgaacaagccagggtaagtggctttgtaactgtacgttgattctgcattagatacataccaaaattttaggcaatcatgtacttttgaactcgctctctagctttcatctgtggtttttcggaatagacattgaaatcaaaacttaatagctgatcctaaatacccagtacatgggtctgactctgagccccctgattaatacgcacaatgtggcaggttccaatatccgtacactttgatcatggaactacaaagcatgagctattagaagctcttgagctagtaagtttgagatctctatcacttatgtgcaatctctgtgtcatcttttacttattcttatattgaaaattcataccaaatcgatttcttgcagggactagattcagtgatggtagatggttctcatctttccttcacagaaaatttatcctacacgaaatccataacagagttggcccgttccaaaaacattatggtggaagctgaactaggccgactctcaggaacagaggatggcttgactgttgaagactatgaagcaaagctcaccaacgttaaccaggtccttgttggttttaagccccgataaatccaatctctcacctaacaaatttatgttgctaaaccaaactacaatttattattatgagttttcaggctcaggaatttatggaaactggtatagatgctttggctgtgtgtataggaaatgtccatggaaagtaccccaagtccggtccaaacctcaagcttgatttacttaaggtgaattatattcttgtgctgactgaagtaagttctatgagtttgtgtcattcttattctaactgatcaccatgtatgtaggaactgcacgccttaagctcgaagaaaggcgtttttcttgttcttcacggagcttctggtttgtctgagaaccttatcaaggtatgagtcgatcatgtttgaaagtttcttgtttggtaatagaaaactaataaaatcggcgggaaattttttcttttgatggagatcttgatatgaatttaactgaattaacgtctttgtgggctatgaaaattgttgactgaatgagatcaggaatgcattgagaatggagtgaggaagttcaacgtgaacacagaagtaagaacggcttacatggaagctcttagctctgggaagaagaccgacattgttgatgtcatgtccgcaacaaaagcagccatgaaagctgtgatcgcagataagatccgtctctttggctctgccggaaaagcttgagttgttgataaaaaaatgtccgatcaattagttaagtacaattgtacatcacatccaaagaataaaaaaacaacaaatattacatcacatccaaagaagatgaatgcattgtatgcaatgcagatgcagtgttgttggaaataaagaaatcatttttagtactgtttaactgttttttttttctttttctcagtcaaatatataaatagaaactaaatgggcaaatatttaattgttgttatcggataaaactactaattattcatggctataaaatcctcgcaatcttcgccgtttatcttcccgttccccgatcaaaaatatcccaaactctcacacacattctcttcattgggactcatattcttctttcttttctttttctttcttttttcgtgtttttattttgctatctccaagtatttatctttatgacttgctttgttcctatccatg

SEQ ID NO: 30755 - DNA, 3003 bp, Unknown; identical to SEQ ID NO: 26565
  misc_feature (1)..( 3003): 2750-1469P.txt file - cDNA_ID_3035160; gDNA_ID_2213622; Annot_ID_195757

SEQ ID NO: 30756 - DNA, 3003 bp, Unknown
  misc_feature (1)..( 3003): 2750-1469P.txt file - cDNA_ID_3035172; gDNA_ID_2213622; Annot_ID_195751
tgaatcgtcagatgaatttcaatagagcatatttctgatcatacaaaaattctacaaaaaaataataattgcgatttgggtcacccggaaaatatccagacccgtaatatcacaagcagtcggatctaaagactttcacggagaaaagggtgaccgagaagctgcgacgccgtccacctctcactcgattctttacggagacaacagtcaacaaaactcctaaactcgtcggaacatccttccggcgcacgcggtggttctccaaagcacacgacgcacattaacgtcgcccagtcaggtctctgtccctgaggaagcaacggaaaatgtccgacgaagagctcaagtatcatcactccgaaactccagatatcgcctgcgtaaacatcggagttttctccggcggcagagtcaaatctctccgggctcatgtaagcgcaagtgccgacgtaggaattgcagtaatctaacgatcgggtaatgattttgctcactccaaaatcagcgattttaacttcgtttctcgagtttaagagtagattcgcaggtttgatgtctctgtgaacgatcttgagtgagtggagataacttaaacctttcaaaatctggcgggaaaatcccgctagttgtttctccgtaacggcgccgcggagagattctaggtttccaccgtccatatactccatgaggatcgaaacctctccgacgattggtttctcgaagatcccttgacacctgacgacataaggagaatccgtgcgacggaggatctccatctcgcgcgctaattgtcttgtgaaagcaggactcatgtcgccgttgactgatttcagagcgtatatctcccccgtggttttgtggtggactttgtatacgatcccgctgcttcctcttccgagaacgtggagtttctcgacatcggaagctgagattccgttgttgatgacgggggcggtggatgaggcaaaggagaaccaggggaggtgaacagagagcggtgggacagggagacggaggttgatttgacggcgtttacgaacaagagccatggaaatagaagagagagagagagagtgatgatggtgatcgaagagtgatggaagttgcagtttttatatggagacttgagtgggatttaagtgaggagcctgggaagctaataaatctttccattaaatgttaatcactcttttttgttctttatcttaattattatttgttgagttgtatctaaaaatggcaactagtgtgtctaccgtttatgtttatcttgcacgaggttaaatgcatgggactgctatctgtcctacttacccggaacctggctatagtggcttgtgtatattgagataaatctacgcaataatgattagatttatatacatttaaagagtttgttttagtgattttgaatggtaactcaattatcaaagtttgttacagcctgtatcgtgataattacaaattacaaaggcgttataaaagcgttacttttaacgttttgcattaatgattagatttatatgcatttaaagagtttgttttagtgattttgaatggtaactcaattatcaaagtttggtacagcatgtaccgtgatattacaaattacaaaagcgttataaaaacgttatttttaactttttgtactacttatttatatagttttgcattctaatttacagctaaaacaactttaaagctttgtgttacctatcagaatcgttatcttcacattcaaacacataatccattgttgttgaaaaataataatactttcaaaacatttattttagtgatattaatttgacttgatagtaagattattatttactcataaagacattggtggaatttagttatataattttcatatactaaactataggagattttaaagtttaatgtgaatttgtgaggttcaatgtacctcggaggctaaggacttctaatgaaaatgaccaaacaataagttatatttaggccatcatgcaaaagctttccaatggccatcgccattaatattgccaagttaattattaatatgattttagtaaaaactatgattagatcttcagattcttagtggacagtcacacatgaccctacggattacaagtatttagcatgtcgattgtcatgcgcgtatatatccaaagaatactgaataaaaataatatgaagtcaatcaaatgaataacaatcaaattatatgaagtcaatcaaacctttatgaatgtgatttgcttctttttccaaccaaaaaacttgtttgtttatttgttagttgttactcccaaaaaaatgtagtaagctttttatgccccatgtattatatatcaagacgatctccaaacatgactatagtttcataggatggattggatatcaggacatgtgtgaatttactaatttttagtattgaaacaaacaacatttcaaccaaaattttttaccattaaaattaatatatcgacgtccgatagtataaagcttgaataaactgaatttcgtatcagtagccagtttgaaaaataaatttgttccttgagattttggtgttcttttccaaaagaaagaacaaagaaaacaaaaggcccttgtaaaaggcggtttagttcataaagaaaactgggcctatctaaaaatttgaactaatgccatatttgggcttagtaagcccggcttacgatacgacgtttatagtcggatctgattcggatccaaacccgtttgatggatccggctcctaccaaatcacttcagatttctgtataagctaaaaatccttgaatttttcagtaagttactatagcatccgagaatttcattctttaactctggttcgtaatcggaaaactcaaagacctgttgtgaagatatattggagaagaaaaaaaaaacgatttcccggcactgaaatagcattatcagatctcgttcccaccgggaagatttcccggcacactgaaattctgacttggaatcgtctgtgaaactatg

SEQ ID NO: 30757 - DNA, 3003 bp, Unknown; identical to SEQ ID NO: 26569
  misc_feature (1)..( 3003): 2750-1469P.txt file - cDNA_ID_3035176; gDNA_ID_2213622; Annot_ID_195749

SEQ ID NO: 30758 - DNA, 3003 bp, Unknown; identical to SEQ ID NO: 26570
  misc_feature (1)..( 3003): 2750-1469P.txt file - cDNA_ID_3035180; gDNA_ID_2213622; Annot_ID_195748

SEQ ID NO: 30759 - DNA, 3000 bp, Unknown; identical to SEQ ID NO: 10059
  misc_feature (1)..( 3000): 2750-1469P.txt file - cDNA_ID_3035184; gDNA_ID_2213622; Annot_ID_195747

SEQ ID NO: 30760 - DNA, 3000 bp, Unknown; identical to SEQ ID NO: 10057
  misc_feature (1)..( 3000): 2750-1469P.txt file - cDNA_ID_3035192; gDNA_ID_2213622; Annot_ID_195743

SEQ ID NO: 30761 - DNA, 3000 bp, Unknown; identical to SEQ ID NO: 10071
  misc_feature (1)..( 3000): 2750-1469P.txt file - cDNA_ID_3035196; gDNA_ID_2213622; Annot_ID_195742

SEQ ID NO: 30762 - DNA, 3003 bp, Unknown
  misc_feature (1)..( 3003): 2750-1469P.txt file - cDNA_ID_3035200; gDNA_ID_2213622; Annot_ID_195741
cgccattaagtttgattcagtatggagttgaataagcagatcaaacatctagagaccttgaacaattatattgaataagaaataatgttccatattgctacaaacattatctatcgttttaatgataaaaactacaatttatgcgccaagaagatgtttatggttggtcatgctaagaatccgccaatgctagacttgcaaaaggcatcaatcatctaaacagagagtatcaacgaaaagtcttcaagctttgacttcaacttgcttaggaactggtaccagtaacccgagacccgttttactatcaggagctacatgagaatacagattctccttatacaatggattcgatgtcactatccgtacaccggagtccctgcggatctccaaaacctcaggcaatccatcagcacatcccttggacatgccaacatcaatcctaatggctttatcattacaaacaccgttgataccagcatcctggattgtatgtcccatgatcatcctcttaaccccgggaatagtggaaagagcatgctcaagagctgcacaatcacatttgtgagccatttcttccgagaacttcctcaaccaaactacagagttccctcctctacaataagcaggcgcatatcttcctcctttaaacccgttaatccaaccccgaacctcctcgttaatcctctccagtccatactctatatgctcagctaaaagaccaccgtgaacaaaaaccgaatcaccaacaacagcaactgtttgattcttagtcaagaatctctttgcaatcggaccatcaggtctcaatgcagcaatcctagctctaattccttcaaaacagtcggctctcatacgagggaagctcatcggaatcccttcgtaaggatccttaggtttatcaagaccactgcataaagtcttcatcttgttccctaaacaataccaatcagcccaaatctgaaattcctctaaacctttcttagtcacatatctaaagtcaccttctatattcatgatctcatggttcccattcatagtcagaatcttacctccagctctctcagcctctcgtttcaatttctctaagaaataaagtatcttcaactcctctccacctcgatctagtacgtcgcccacctgaacaaccatcgttgatccaccagtccatctgtccgacgaatcaatcagaccagcgatcttgaatgcttctctagacttctcgagatcgccatggagatcaccgattgcaacgagtcgctccggcttctcgaacctcgtttgcagaatctcattttgtgagctaggatcttggggcaggaagatgccggagacggagtaatcaacgaaagtgtcgacgaaggaagagatgagcttgggaatgcttttgcagattccgctagggttttctctgcttgacattttccgtgataaatggcggccaagaacaatgcgcctttataagtttccttattaagcagtttattaaattaattcattgactagccaataaacgaagccaattagtgagtgactctttttgtctgtgtatcttctagatattgttcaagttgggctttggatctcctacaaggccacgcccattgttttgttgctcatgaattaagtaggcccattaacccagatagttggaaatgagttgaaccagagtattggactctgagcagcagagcagcccagagttgagaccagacgagatcttccaagcttagttgtataaaccaacgatgagtgaccggtattgaagtccctttactacaatttgcgagctgtcttatgtctattttatatacaagagttacagtacacaaatagttttttactaaaagacaagaaataagaaaacaagattcattctccttatgacaacaaaaaaaagaaagaaaacaagattcattcatacaaaaaggaggaagttgtgtcagaattgcaaccaatttaaatacatttagaaccgtcaacgcctctattgtttgttgtgactcttccaagtatgaaggttattgtattaatttatcctcaagttttttataacattgatatgataatggttttaaacgctttatgcgttattgtaaaatttatttaccccacaatagaaaaagaaaaatgcaattgtttagttttcataagtcacaatcgtagaaatattttaatataaattgaggtgtttgttgtatgtttatttgttctctttggataagtcacgacttgccaagaagaaggagcgtgagagatcgtgttaatgtggggtctttcttcttcaattaattacgatctaaattgctgagtttttttttttaataatgatttgactttcttttcctactattatactaaaatgatattttatcccaaatgtagtaaatttaatagcgatatctaatataagtttcagctaaatttaattcaatactcttttttttttttttttgaaaaacagtaacactgttatttgaaaaaattcaaaagcatttaaatatagtggaaacaaaactttatcctttgaacttttttataaagaaaaagtttagattcttctactgtttaaaaagaaaagaaccattaagtacgttaatgcggttaccgaacatgacattaagctttcgtttccttaattatccgagtggtccaattctttaattacgaaattatgaaagcgaattaataattagttaacgaaagtgacattgagaacgcgtttgcgtttcagttatggcgtgcaaacaaagctaaacaaaaaattcagagagattaaaaaaaaacaaaaggaatccaaaggaaataaatgattttgtttgcttttgcttgcaaataaaaatcattaaaaaaaaacgaggcgtaacaggaaggagaagaagcaggggtccatcatcaaatacaacattgtagcaattgcgttttcgactttatagagatattttcatagagatggtctcgaagctaacaagttgacaaatttcttcgttataagagagatagatg

SEQ ID NO: 30763 - DNA, 3000 bp, Unknown
  misc_feature (1)..( 3000): 2750-1469P.txt file - cDNA_ID_3035212; gDNA_ID_2213622; Annot_ID_195738
gtgggcggtgaaattgaggttggacaaggaactagtccttaacaatgccttaatggacatgtactccaaatgcggttgcattactaatgcacaaatgatctttaagatgaacaataacaagaatgtggtttcttggaacacaatggtaggaggtttttcagcagagggtgatacacatgggacgtttgatgttctgagacagatgctggcaggaggcgaagatgtcaaagcggacgaggtaaccattctaaatgcagtgcctgtttgtttccatgaatcattcttaccgagtttaaaggaacttcattgttactccttaaaacaagagtttgtatacaatgagttagtagccaatgcctttgtggcttcttatgcaaagtgtggctcactgagttatgcccagcgtgtgtttcatggtataaggagtaaaacagtgaactcttggaatgctttgattggcggccatgctcagagcaatgatccgagattgtccttggatgctcatttgcagatgaaaatttctggattgctacctgatagttttactgtctgtagtcttctttcagcttgttctaaactaaaatccctgcggttgggaaaggaagtgcatgggtttataatccgaaattggttagaaagagatttgtttgtttatttatcagtactctcattatacattcattgtggggagctatgcactgtacaagcattatttgatgcaatggaagataaaagcttagtatcttggaatactgtaatcaccggttaccttcagaatggatttcctgatagagctttgggcgtctttagacaaatggttttgtatggaatccagctttgtgggatttctatgatgcctgtgtttggtgcgtgttcgctgctaccttctcttcgactggggagagaagcgcatgcttatgctttgaagcacctcctggaggacgatgcgtttattgcatgttctttaattgatatgtatgccaagaatggttctataacacaatcatctaaggttttcaatggcttgaaggagaaaagcacggcatcttggaatgccatgataatgggatatggaatacatggcctagcaaaagaggctataaaactctttgaagagatgcaaagaacaggtcataaccctgatgacctaactttcttaggtgttctaacggcttgcaaccatagtggtctgatccatgaagggctgagatatctggatcaaatgaagtcttcttttgggctaaagccaaatttaaagcattatgcttgtgtcattgacatgttaggccgagctgggcaactagacaaggctctaagggttgttgcagaagagatgtctgaggaagctgacgttggaatttggaagtctctgctcagctcatgcagaatccatcaaaatctggaaatgggagagaaagttgctgctaagttattcgaattagaaccagaaaagcctgagaattatgttctgctttccaacttatatgcaggattggggaaatgggaagacgtgagaaaagtgagacagagaatgaacgagatgagtttacgaaaggatgctggatgctcttggatcgaactaaacaggaaggtatttagctttgttgtcggtgaaagattcttagatggttttgaggaaatcaaaagtctttggagtatattggagatgaagatatcgaagatgggatacagaccagacacaatgtcagtacaacatgatctaagtgaagaggagaagattgaacagttaaggggacacagcgagaagcttgcccttacctacgggttgattaaaacttcagaaggaacaactattagagtttacaagaacctaaggatctgtgtggactgtcacaatgcagcaaagttgatctccaaggtcatggaaagggaaatagttgtgagggacaacaaaaggtttcatcatttcaagaatggggtttgttcttgtggagattactggtaagtaggactgtaataaaattggtgaaaacagatgcattagtaatagtagctcttagtaaattcagtattgtgtgtatttatgttcaggcgagacaaacatcaatgttaatatgttataataagctatttgttgtgtgtttgttgtaacgcaattacatagattataaaccaaactgatatataccaagtgaaactgaacttttttcaatgcgaaacaagttttaaatctctcattggtcagtgctcctcactatatataacgtctatccacattctctaacttctcaaaaaacaggaagagaagcaagacgcaatgaagagttcaatgagcatcattgtcttcttgtttgtgaccatcttcaccatctctgcttcttccttgaaccctgaggaaacttgcatacaaagaaacatcaaccggtcacaacctccaagctcttcactcgaacccaagacatcaaagttcgactttcttgtggacaagttgtgcagagacatggctcgtgccgtcatgttctctgtgaggataaccggaaaattcccatctcactatgtgaaggcgatgtgtaatgtgtttggaaatgacgagaagaaagtgaaagagtatgttgtgaagaaatggttgggaggttcgaagctcgtgtctagtttatcttgtgcttttcattgaaagagtataattgtctttagtgatattagtctattaacaattagctaaggttttcatccgaaagtcaaaaagattatgcaaattaaaacgacacaattagtaaagaaattatgctcaaaagtcaaaaacttacaaataacagtttttatgcaaaattaacttcagaaatttatgaatagcaattccataaaaatatatcataagaatgtgtaaaaaatcagagatttattctcctttttgctaccgaatccattactcatgttattgagacccaccccactaaactcataggttaatcactctcggataagaacattcgaacaattaccgacacacaaaaagtttgaagagaaaaacaaaaaatg

SEQ ID NO: 30764 - DNA, 3000 bp, Unknown; identical to SEQ ID NO: 10054
  misc_feature (1)..( 3000): 2750-1469P.txt file - cDNA_ID_3035216; gDNA_ID_2213622; Annot_ID_195737

SEQ ID NO: 30765 - DNA, 3000 bp, Unknown; identical to SEQ ID NO: 11047
  misc_feature (1)..( 3000): 2750-1469P.txt file - cDNA_ID_3035228; gDNA_ID_2214475; Annot_ID_133120

SEQ ID NO: 30766 - DNA, 3000 bp, Unknown; identical to SEQ ID NO: 10094
  misc_feature (1)..( 3000): 2750-1469P.txt file - cDNA_ID_3035243; gDNA_ID_2213625; Annot_ID_195836

SEQ ID NO: 30767 - DNA, 3000 bp, Unknown; identical to SEQ ID NO: 10096
  misc_feature (1)..( 3000): 2750-1469P.txt file - cDNA_ID_3035250; gDNA_ID_2213625; Annot_ID_195833

SEQ ID NO: 30768 - DNA, 3003 bp, Unknown
  misc_feature (1)..( 3003): 2750-1469P.txt file - cDNA_ID_3035298; gDNA_ID_2213626; Annot_ID_195882
tgtcagaacaagaaaacaagaacacgaagttagaaacaggaacaagacttactcgaacttggaatagatattcccgaggataaaccgccaatgaaacagacttgtcaaactgaaaagtgacagttgggaaccgatctaatctgtgaatttgacagaaaatttcagagggtcaaaacatcaaacattatatactaggtgtataaaatcagtcattccatcagattcagctaaatccaactccatttcaattccaaaagcaaaaactagtacatttccagcaaataacagtaccatttcaaacattctcactaaacaccaagaatgacaaagcgatgagttaaattcttacttgtctgtataatggaaacaagtaaacgactcttgaactgtatgcaaagtaagctctggatgtgaagccaatatctgatggaaactcaagggaaaaaaacataagtgttaagaactttgtaaaataagacagaaagaattcacaagtaacagaatatagtactgacctcattcagtaacgggttataaacagcatcaggaagatacaccagagttgtaccactatcaataataactcctttgtcatctcccgaatcaaaagcattcgaagaaagttctaaaactgaattaccaacttcaattgcattgaggttgacactatagtgagctctgtgaaagagttgcaaacagtgtaagaaattcaaaacttcttgacaaagaaccaaagaagaagagctttaagagaaaggcattcacttacgatttagagagcataggtgtagtctttactttcggcgacacgacttctccaatggcgaatataccacctccattgttgttatccaaacaatgcgcaaaagaccttttgacctttccttgtgaagctagctgcgatataaacgatgaatttgattgtccaaatcccattatcccatcaaccgcagcttgtgactctccgagctgaccagactgtttagacccacatctgtataagaaccacaaataacagtgattcagagatttgcaagccacaacaagctacaaaattcatagaagaataaagctgtttttccttaaactaacccgaagataatagttccgttggtggaaccggtttgacgatttccagtaactaaatccaaatgaacaacatctttcaccaagtatccattagttgaactcccatcgccatacataataacatactgacaagtagaacctgagtgacactcagatctttggttaacgtaagagcaaaagttgtcactgcacgaaacagattttgcagtggacgaagcatccacatcataaggtgtcagctctacctgaaagataatgaaactatgaaactgaaaacataatgtaacttagagttctgtttttttttttggagggatagaattgatggtatataccagatcacttttcctaggacatctgatgcaaccagcacaattcacccataagatatcacttcctgtatcaacttgaacatggaagtctcttgatggagttccgagtccgattttagcgaagtataaactgaaattaaaaacaacaaacataaagaacaagaatcaacattttaccgtagaagacacaagaagaagaccatttcataatgagtcaagaaccaatcaaagagttgagaatctcaatagattcaaaagctttgttttttcttcagattccacatttaaaaaagacaaaaaaaatccgactttttgttaaaaaattcccaaaattacaggttctggtaaatggcgattcgaacccaatagactcaggctggctatcgccgccgagaggaatatcgatggcggagaggagtcttgagtgacggtggacgtcgtgagctctgagagctccaagatcttttactctttttccggcgaacttgcttcgaacttcaaataccaaattctccgaagccgtcgccgccgtcgagaattgcgggtcaatcagcaacgccgccgacagcaaaatagccgacaagaaccactgtctccgcctgagatccatgaccggagatatccctaactaagttagttgagaaatccaaacgaaaaaaatgaagagaagaaaaaaagcaaaagaaagaaaagtatagtttggcggtggagtacgatttaggacaaagaagaagaagaagaaaaattggtactttccaaataaaaaagtattttaatcattaactaaacaacattttgaaattaatttaagactggctagaaaattatgtactatataataagattccatgactacaaaaaaaaaaactaattaaatttcaagattgtaataattatttaaaaagaaaactgaaataactgctagaatacacttttggcagctgtaaattattttcacttgtataattcattttttcacatgaatatgcattgtcacattattaggctcatttttaacatttttttaccgtctaatgtagattttaacaaacaaacaaaaatcgactctagatgataatgagtaatgataaaatcatcagttgtcataaattgtaggattcaaaactgtttttgatcacaaatatgagagttttccttagatacaaaactagtaatcactgaactatcatgcatgttgttggtattttgtattttagtctaaaatagttaaatttatggaaaataaaagaattcatgtttgtctcatcattttgagggaccgaaccgtaatttcgcagtaagaaacataaatatcaatcttaattcctcaagaattctacacctcccgttccatctatcacgaaaacaaataattacagtaagtacccccgaatatccttgttcatccgaagcaattcgaggataataccgtctttttctctttaaaatccaattaacataaaataaatatttgctcagtccgttgagacctcacacacactctctctctgatcattcaacttttcgaaattttgcttcatcgtcttcgtcatcgtctctctgttgaattcctcaaacaatg

SEQ ID NO: 30769 - DNA, 3003 bp, Unknown; identical to SEQ ID NO: 30768
  misc_feature (1)..( 3003): 2750-1469P.txt file - cDNA_ID_3035298; gDNA_ID_2213626; Annot_ID_132066

SEQ ID NO: 30770 - DNA, 3003 bp, Unknown
  misc_feature (1)..( 3003): 2750-1469P.txt file - cDNA_ID_3035301; gDNA_ID_2213626; Annot_ID_195878
atcaaatctgcaggtcatctgatggaaaatattgaagccaagaatttgctgcacagggcttttagtgtatttttattcaactcgaagtatgagttgcttctccaggtatgtacatatgcttgctttgaagtctagataagtcaagtgctgtatacaaatggatcacaggcgtgtgactgggcatggctatgtcatatctagaatcacatttttgaagagaaaattaatttcaaaaatatgggaggttagatcataggcttgattctagagattttcttgcacatgttgggtgttgctatgatgatgggatgctctcgtgatcgtagatggttggtgggttttaataatctggctcatatgtcatctgactggtttcttctcgtttgaacagcaaaggtcaaacacaaaggttacgttccctctagtgtggactaacacttgttgcagccatcctctttaccgtgaatcagagcttatccaggacaatgcactaggtgggtatctactggcaaaacaatttagtacttctttttactatctatgtagaaaactgtagcttttctcaactagtgacctcactgttactcatcaggtgtgaggaatgctgcacaaagaaagcttctcgatgagcttggtattgtagctgaagatgtaccagtcgatgagttcactcccttgggacgtatgctgtacaaggctccttctgatggcaaatggggagagcatgaacgtaaataccatttctcaagactcttggttcccattttcttgaacagaataataaaaccttaagcttcttctgtgttggccttccttttgcagttgattacttgctcttcatcgtgcgagacgtgaaggttcaaccaaacccagatgaagtagctgagatcaagtatgtgagccgggaagagctgaaggagctggtgaagaaagcagatgcaggtgaggaaggtttgaaactgtcaccatggttcagattggtggtggacaatttcttgatgaagtggtgggatcatgttgagaaaggaactttggttgaagctatagacatgaaaaccatccacaaactctgaacatctttttttaaagtttttaaatcaatcaactttctcttcatcatttttatcttttcgatgataataatttgggatatgtgagacacttacaaaacttccaagcacctcaggcaataataaagttttcgtttttatcttaattaatgaatgaatgtcacaaagtttgtgagatgtacaaaaagcgtcgaggaaaaggataacaaggaaacagagtcgaaaccagagaaaaggcaacgcaaagattccttttttcgaagcttaacgacaacccaccttccatctgatttaagtaaagttaaaagtcactaatttaatattattgaacgaccgaaacaagtatgttgatgactttgttctcctttaaattatcatcacttcatttctcagagatttacgcacacagagttctcttcttcgtcctagtttcttctattccaggtaaatgaaataagattcgatcaaaacccagatggattttgaaatagttttcttgtgaattgaatgaaaagtgtgtatctttccttctgggttttgattgattgactgagaatatatatgatcactttatctagactaatctcgatttgtcttttgctttctgtgtttgagtaatttctcgtaaatctcatataatcaaatccccagattacttgttttgatcataattcttgattcaggtgagaagaaaaaatggcgtttgtgaccactgcggaagtgtgtgacgcgaatcaagagatgattcgaagtggccagctccgagctctgcaacccgtttttcagatttatggtcgtcgtcaaatattttcaggtccagtagttactgttaaagtctttgaagacaatggcttaatccgtcacttcctcgaagagaaaggtattaatgattcttgcttataaaattcaaaagactgaaactttactcgtagagctatgaactttcagagtatctttgacatggtttattggtattgttacattttagattcaattcttgtgttacttacttgtcaaatagtttcaattgttctttgcttgaaactatgtttgaagaagtcttaagatcatctctctatgatttagaactactgctcagtgtttatatacttcttcagtcactttgctaatcaagttcttgaatactagagacgagataggtctttcaaaaacccgagtcaataaaccaatctgttctctgtagcattcacatcaaaagctcaataatgttttaaatgttaaaacaggcaatggtagagttcttgtggtggatggtggagggagtttacgctgtgcgatactaggaggaaacccggtcgtacaagcgcagaacaacggatgggcagggatcatagtgaatggatgcatcagagacgttgatgagatcaatggttgcgacattggagtgagagctttagcttctcatccaataaaggctagtaagaaaggacttggtgaacaaagagtctctttgaacattgcaggcactcggatatgcgatggcgaatggctttatgcagatactgatggtatccttgtttctcagattgaattatccgtttaaaaggacacaagtgatgttgttgatttgttaaaatctgtaagctactacttttgtgctttgtgtttctgtaatggctatcagagtaaaagttggcttctttgaatatgattattgaactattgaatccgtttcgagttgataaaaaaaaacatttcgtaaagtgaaaattgcaaaaagatccttgaagtatccatacaagcatttttcgtagatcaatttccaataactggatacttcgagggtcattttgcagtttaccaattttctaaatccgccttcttgcaatttcacagtgcttcgttttaggtcaaacacaacgaaagacagaaaaccctaatcactccggcttcagctctgtgtgtgataatg

SEQ ID NO: 30771 - DNA, 3003 bp, Unknown
  misc_feature (1)..( 3003): 2750-1469P.txt file - cDNA_ID_3035301; gDNA_ID_2213626; Annot_ID_132063
ttaattaatgaatgaatgtcacaaagtttgtgagatgtacaaaaagcgtcgaggaaaaggataacaaggaaacagagtcgaaaccagagaaaaggcaacgcaaagattccttttttcgaagcttaacgacaacccaccttccatctgatttaagtaaagttaaaagtcactaatttaatattattgaacgaccgaaacaagtatgttgatgactttgttctcctttaaattatcatcacttcatttctcagagatttacgcacacagagttctcttcttcgtcctagtttcttctattccaggtaaatgaaataagattcgatcaaaacccagatggattttgaaatagttttcttgtgaattgaatgaaaagtgtgtatctttccttctgggttttgattgattgactgagaatatatatgatcactttatctagactaatctcgatttgtcttttgctttctgtgtttgagtaatttctcgtaaatctcatataatcaaatccccagattacttgttttgatcataattcttgattcaggtgagaagaaaaaatggcgtttgtgaccactgcggaagtgtgtgacgcgaatcaagagatgattcgaagtggccagctccgagctctgcaacccgtttttcagatttatggtcgtcgtcaaatattttcaggtccagtagttactgttaaagtctttgaagacaatggcttaatccgtcacttcctcgaagagaaaggtattaatgattcttgcttataaaattcaaaagactgaaactttactcgtagagctatgaactttcagagtatctttgacatggtttattggtattgttacattttagattcaattcttgtgttacttacttgtcaaatagtttcaattgttctttgcttgaaactatgtttgaagaagtcttaagatcatctctctatgatttagaactactgctcagtgtttatatacttcttcagtcactttgctaatcaagttcttgaatactagagacgagataggtctttcaaaaacccgagtcaataaaccaatctgttctctgtagcattcacatcaaaagctcaataatgttttaaatgttaaaacaggcaatggtagagttcttgtggtggatggtggagggagtttacgctgtgcgatactaggaggaaacccggtcgtacaagcgcagaacaacggatgggcagggatcatagtgaatggatgcatcagagacgttgatgagatcaatggttgcgacattggagtgagagctttagcttctcatccaataaaggctagtaagaaaggacttggtgaacaaagagtctctttgaacattgcaggcactcggatatgcgatggcgaatggctttatgcagatactgatggtatccttgtttctcagattgaattatccgtttaaaaggacacaagtgatgttgttgatttgttaaaatctgtaagctactacttttgtgctttgtgtttctgtaatggctatcagagtaaaagttggcttctttgaatatgattattgaactattgaatccgtttcgagttgataaaaaaaaacatttcgtaaagtgaaaattgcaaaaagatccttgaagtatccatacaagcatttttcgtagatcaatttccaataactggatacttcgagggtcattttgcagtttaccaattttctaaatccgccttcttgcaatttcacagtgcttcgttttaggtcaaacacaacgaaagacagaaaaccctaatcactccggcttcagctctgtgtgtgataatggcggcggagagatcgtccatcactctcggagggaaaggttcttctttatcttcttcctccgtttacaatgttgcttccggcgtcgctaatgttcgaattgactcttctgcgatcgagagattctccactagaaacgttccatcgatcaaaaggagctcctttggtatccctcaagggttaacgaacgaagaaactcgagcttctctggctgttctcttaaacaagcttattttgtcgacttctggtcctccttcttcatccaccgctcgttctgttcttccgcttaagattgttgagattctgaatttgaaggctgagagtttggaattgggtgagattgatgtgacagaaggggaaaacattgtgttggagaagtcgtgtgcttcgttgattgggatttgttctattatagatcacaaatcgacgactctttcacagattgtggattctgttgctgcgttgagttgtgaggttacaaaggctgatatagcttcgtttagcttgttggattcaggagatgggaatggtgataaagatgtgattggtgttgctggtgatctcaaggttttgcttaacgggtataaaggtacagggaaattagaaatagaagagatttcgaaaatcccttggattcatgggaaattcaggtatgtggtgaaaagcgtgcacgcggatgctaggagagaattgaattccggtgttaaaggaggcaaaactgggtctggaaacactgggattggtgaggctttaggaacaacattgttacctttgttaacggcgattaaaaacttgggagtgtgttcgttccttcgtgctaagctttgttttgagaagattgtggatgagaatctgaagaaatgtttatctgaaaagatctgtgttgagaatgagaatctaaagaatagctataagttagcttatactgctcatttggaagaggattactgcaggtttgctcacaaactgaatgagtgtctgggaattgtatggagaattgttggtttggaggcagttgctgccttttttgctcttgctggtggagaattgtttgttcagaagagcggagatgcggacaaagaagagtcgaagaccgataagaaaaagaagaagaatgagaaaaaagcagttgtgggaaaggggacaagcctagttatccagtttatcaaagatagattggtgagtaatgacgcagcaagtgatggtgaccagatg

SEQ ID NO: 30772 - DNA, 3003 bp, Unknown
  misc_feature (1)..( 3003): 2750-1469P.txt file - cDNA_ID_3035305; gDNA_ID_2213626; Annot_ID_195874
aaaccagatggtatttatctcctaacgatgtaccatttcttagttttccttgttcatacgatcagtaaaatgaaagaaaacaaaaaatgatcattttttgtttgtttttaaagataggagacgtgcagaagaaacagaggaaatagagcaatcggaaggaacatcgttgaagatattcactttccgggaattagctacagccacaaagaatttccggcaagagtgtttgctaggagaaggtggatttggtagggtttacaaaggaaccctcaaatctactggccaggttcttccttaaatctccagaatttggaatttaggatacattcatgagaccatcaccaaagttaggtatttttcaatgagccatcatcagaatcagaagaatttgtcttgtaggtggtggctgtaaagcaactagacaagcatggattacatggaaacaaagagtttcaagctgaggttttgtctttaggccaacttgatcatccgaatcttgttaagcttattggttactgcgcggatggagatcaaaggcttttggtctatgattatatctctggaggttcacttcaagaccatcttcatggtactaaattgagagattctcattgaacacattttttttactttgaaagaaatgacaatttgaattttgcagaaccaaaagcagacagtgatccgatggattggacaactaggatgcagatagcgtatgctgcagcgcaagggcttgattacttgcacgataaagcgaatccacccgtgatatacagagatttgaaagcttcaaacattttgttagatgatgacttttctcctaagctttctgattttggtctacataagctaggacccgggacaggtgataagatgatggctttatcttcacgagtaatgggaacttatggttactctgcacctgagtatacacgaggcggaaatctcactttgaaatcagatgtctatagctttggtgttgtgttgcttgagcttatcacgggtcgaagagctcttgatactactaggcctaatgatgaacagaacttagtttcttgggtaataaataacaaaccctaatattattgcactttttcaaccaagttaaaacaagaagtttttatcttgctgaacaattcatgttatcgcaggcacaaccgatatttagagatccgaagaggtatcccgatatggcagatccagttttggagaataaattctcagagagaggattaaaccaagcagtggcaatagcttcaatgtgtgtgcaagaggaagcatcagctcgtcctcttataagcgatgtaatggttgcgcttagcttcctttcgatgcctacagaagatggtattcccacaacagttcctatcttatccttcaaagacaagagcatgtctatagccttaagccgacatgattcaaatcttgtatctcctcctcctgagctagctacggaagatgacaaatctagtacctcatcaggcgaagaatcatctttggagagcgaaaaggagagtgtgagtaagaatgagtataagaagaaacatgaagaggaagatagctcaatggaatctgatgatgagtctgattctaactctgaacatgaaaaggaccaaccaccaaagcctattgatgagaagaaccaggcgcaaagcttgaagataaagtatagatatagctgggaagatattgatgtcaatgatgagaggctaagcagtaaaagcagccaaaaatcaaacgacgaaagtacttcttcgcgttatgatagcgacagagatcaagacgagaaagggaaagaagaagaggaagaggaagaggcagaagaaaagcatactcatattgaacacattgatagctcaaaaactgatgatgatcaaagtgtttactttgataatgatgatgattcaggagatgacaatggaggctctttgcatcggataaaatcagatgttgcgatcgattctattaaagagtgacatttttcaagattttttatcaatccgttgaagctcacaagaagtatttgaaacttttttgggtttatttttgggaaaaattcttaattgggtattaaaataagatacatattgacggtttttcttaacaaattataaccatctctctttatacatgatgaagatgttttggattgatagattaataaagaaacaagttgtataatcagataatctgattgagaaaacttatctcagcttttgtaatcctttaaaaaaaaatgttacgtacttgtgtttttctttaaatagtagatgaaataataatagtttagcattttaaagaaaaacaagtatgagataatcaaaccctagataagaatcttaataatcaatcttagctgtgactcatatagcctatgagcaaatattacattattcataggaaatggaaagtattagattctcaatttggatatactaaagtagatacttaaactgatagataaaagacatatctacttcttatcctatttttgcaattaaggatagtctttgtgttttccatctttttgtcaacgacacttgtcaaaagtttcagtctgtggaatcaaaatttttaaatgagaccacttagttttacttttctttcatgattcgaccactatactttctaagaatatttattttaatcaaaattagataatgtttacaggattgacccaaattagattcgtaaagaatcgtcagctatgaggtcaaataaaagcagagaaaacgacacgtgtcaggatcttggagattcctgaagtgaggtccaccctaaaatccatttaaggttttctaagcaaatcaacaaaggaaggaaggatcctaccaaaagctcccaaaatctgagtacgcttttcaaagttgtctcctttatgaaccccacttgatcccttctcctcctataaaaacatcttcttctcagatcaatcccatcaaatctcgggtcttgctctgtttctctctttttgattcttttagaggtttactgaattcgatg

SEQ ID NO: 30773 - DNA, 3003 bp, Unknown
  misc_feature (1)..( 3003): 2750-1469P.txt file - cDNA_ID_3035305; gDNA_ID_2213626; Annot_ID_132059
atttatctcctaacgatgtaccatttcttagttttccttgttcatacgatcagtaaaatgaaagaaaacaaaaaatgatcattttttgtttgtttttaaagataggagacgtgcagaagaaacagaggaaatagagcaatcggaaggaacatcgttgaagatattcactttccgggaattagctacagccacaaagaatttccggcaagagtgtttgctaggagaaggtggatttggtagggtttacaaaggaaccctcaaatctactggccaggttcttccttaaatctccagaatttggaatttaggatacattcatgagaccatcaccaaagttaggtatttttcaatgagccatcatcagaatcagaagaatttgtcttgtaggtggtggctgtaaagcaactagacaagcatggattacatggaaacaaagagtttcaagctgaggttttgtctttaggccaacttgatcatccgaatcttgttaagcttattggttactgcgcggatggagatcaaaggcttttggtctatgattatatctctggaggttcacttcaagaccatcttcatggtactaaattgagagattctcattgaacacattttttttactttgaaagaaatgacaatttgaattttgcagaaccaaaagcagacagtgatccgatggattggacaactaggatgcagatagcgtatgctgcagcgcaagggcttgattacttgcacgataaagcgaatccacccgtgatatacagagatttgaaagcttcaaacattttgttagatgatgacttttctcctaagctttctgattttggtctacataagctaggacccgggacaggtgataagatgatggctttatcttcacgagtaatgggaacttatggttactctgcacctgagtatacacgaggcggaaatctcactttgaaatcagatgtctatagctttggtgttgtgttgcttgagcttatcacgggtcgaagagctcttgatactactaggcctaatgatgaacagaacttagtttcttgggtaataaataacaaaccctaatattattgcactttttcaaccaagttaaaacaagaagtttttatcttgctgaacaattcatgttatcgcaggcacaaccgatatttagagatccgaagaggtatcccgatatggcagatccagttttggagaataaattctcagagagaggattaaaccaagcagtggcaatagcttcaatgtgtgtgcaagaggaagcatcagctcgtcctcttataagcgatgtaatggttgcgcttagcttcctttcgatgcctacagaagatggtattcccacaacagttcctatcttatccttcaaagacaagagcatgtctatagccttaagccgacatgattcaaatcttgtatctcctcctcctgagctagctacggaagatgacaaatctagtacctcatcaggcgaagaatcatctttggagagcgaaaaggagagtgtgagtaagaatgagtataagaagaaacatgaagaggaagatagctcaatggaatctgatgatgagtctgattctaactctgaacatgaaaaggaccaaccaccaaagcctattgatgagaagaaccaggcgcaaagcttgaagataaagtatagatatagctgggaagatattgatgtcaatgatgagaggctaagcagtaaaagcagccaaaaatcaaacgacgaaagtacttcttcgcgttatgatagcgacagagatcaagacgagaaagggaaagaagaagaggaagaggaagaggcagaagaaaagcatactcatattgaacacattgatagctcaaaaactgatgatgatcaaagtgtttactttgataatgatgatgattcaggagatgacaatggaggctctttgcatcggataaaatcagatgttgcgatcgattctattaaagagtgacatttttcaagattttttatcaatccgttgaagctcacaagaagtatttgaaacttttttgggtttatttttgggaaaaattcttaattgggtattaaaataagatacatattgacggtttttcttaacaaattataaccatctctctttatacatgatgaagatgttttggattgatagattaataaagaaacaagttgtataatcagataatctgattgagaaaacttatctcagcttttgtaatcctttaaaaaaaaatgttacgtacttgtgtttttctttaaatagtagatgaaataataatagtttagcattttaaagaaaaacaagtatgagataatcaaaccctagataagaatcttaataatcaatcttagctgtgactcatatagcctatgagcaaatattacattattcataggaaatggaaagtattagattctcaatttggatatactaaagtagatacttaaactgatagataaaagacatatctacttcttatcctatttttgcaattaaggatagtctttgtgttttccatctttttgtcaacgacacttgtcaaaagtttcagtctgtggaatcaaaatttttaaatgagaccacttagttttacttttctttcatgattcgaccactatactttctaagaatatttattttaatcaaaattagataatgtttacaggattgacccaaattagattcgtaaagaatcgtcagctatgaggtcaaataaaagcagagaaaacgacacgtgtcaggatcttggagattcctgaagtgaggtccaccctaaaatccatttaaggttttctaagcaaatcaacaaaggaaggaaggatcctaccaaaagctcccaaaatctgagtacgcttttcaaagttgtctcctttatgaaccccacttgatcccttctcctcctataaaaacatcttcttctcagatcaatcccatcaaatctcgggtcttgctctgtttctctctttttgattcttttagaggtttactgaattcgatgtgtttgattatg

SEQ ID NO: 30774 - DNA, 3000 bp, Unknown; identical to SEQ ID NO: 10126
  misc_feature (1)..( 3000): 2750-1469P.txt file - cDNA_ID_3035309; gDNA_ID_2213626; Annot_ID_195871

SEQ ID NO: 30775 - DNA, 3003 bp, Unknown; identical to SEQ ID NO: 26593
  misc_feature (1)..( 3003): 2750-1469P.txt file - cDNA_ID_3035317; gDNA_ID_2213626; Annot_ID_195869

SEQ ID NO: 30776 - DNA, 3003 bp, Unknown; identical to SEQ ID NO: 26594
  misc_feature (1)..( 3003): 2750-1469P.txt file - cDNA_ID_3035325; gDNA_ID_2213626; Annot_ID_195867

SEQ ID NO: 30777 - DNA, 3000 bp, Unknown
  misc_feature (1)..( 3000): 2750-1469P.txt file - cDNA_ID_3035334; gDNA_ID_2213626; Annot_ID_195862
gagccaaaaacaaagtcaacgacaaaagtggtcatgaatatcgtctcacgattgactgacaaatacttcacgatttgattagatatgaagttttataatgtgaagttggtaaccactaactaataaccctacttcacaggagaaagaaaaaacattttagatatgaaaaaacaacattgacccagaaagatatatatttgcttagagattttgtatgaaagaattactagtgctgataaactatttagttcaagcttaaagggaaatcgattagataatttttcgaattatttgaagaaaacatattgtgatctggacttataatttttcatgtgatataccatttacaccgagtcatgggcagttgccacaactttatctcatgttccaactcgtaccagactgggtacatatgcacatggggttcaataaatttattagtgggatactctttgacataaaacactattaggaaaaaatggaattaaaacctattcataaattcatataattacgcacgtaaataatgtttttcacagtaatattagaatttgaccttagcaagttgatggtttttaaaccgtggaagcaaatagaacatgacttccacatacaaacatcatcaacactagagataaatcatagatatagaaaatcatatttatgactgaaatattaacaattacaacttaatgggctttatggctacatttttgtaggctcaaatcaattgataatgaagcccatttcataaatatgtaaccataataagttcggccatgacacattgggcgggcttacacgtataacaaacacaacagttaagagcaaaagacacaaaaaaagtgtagagacaaatcgccaacttgtagaaacagattaaaacagagtagtaagtgtttgataatccaaaactagatgaatattatcaaatatatctaaaaagaagttttaaggacattttggacggccttctttagtcttccagttgttgtaacatggacaagtttgtttgttgccgaaagtgccaggaggaacacaaagacattttttgcaacacttgaggcaaaagaacatgcatggcttcttgtgtgatgttgctgaacaacggaagctacactttgagttgcactctacaattgaagtttccatcaaaaaagcatatcacaacaaacaaacaaaaaacaaatcattgagatctttatgttcatgcttataattcacagcatacagtatactagaaaactgacatttcacaaaataaacaccattattgttactttaaagtttatttatcaacattatcaataattagtgattaataaattaatatgatcatatgaaacaacaaaagttttgagtccgtacgttggggtttgagtttgccaccaccacgagcagcctgtcatatatatataaaacttcaatatcagaaaactaatagccattaaatttttaaggaatgtatagcctttggtcatttttacctccacgagcagcctgtaatatataaaacttcaatatcagactttaataaactgaatctgttttgagtggtttacctgaacgaggttggagactgacaataaaaagagaagagtcaagaagaaaagagcatttcttctgatacaattcgccatttttttggttaaaaaatcttgattgccaatgaatgattcttaagaaacaataaaacggattaaagatatttatagagaaaatgattagtgtggatttccttcaatggtattcaagaaatttggtattgccaatgttcatgccgtgattctggggaagtaggtcattttaatttctaattacgtaccacacttgtcgtttttgtctcttagacaatgtcaaagactcaacagtgtaaattactaatcactaattacccacgtatagagaaccaaaagactaaaatcttgccttggaaaaaaaaaaaaaaaacatttctctcagtgaaaattggaaaattatattgtgtagttgactagtgtctaaacgctctgtttggaaaatgaaaatgtcactaatgataatatctgtatatagaaaggggaaaataagcgagtttaggaaattaattaagctaattgtgaagtgcgactaaaaagaaaaaaaagtgtaatagaaagcgaaaaatgcggcgaagttgagcatgtgatctttgtgggccatttcattgattttttgttttgtcatattatttgtgtttttagttttaatgtaaaaaaaatctgattaattttaaaaggactggacaattattaatggacatcaccataaaatctgtgaccataaatttttataaaaggcccattagcccaacggttttccaattacagaatttgggctgaaacggccgaaaataatcttaggatgacgaaatggccattttgaaattctcttcttcgtttggtctattattttattttttaacgttaacggcctaacaagttttcctaacttaaagataagtgggaacagataaaacaattaaaattaacttccaatgaaattaccaaattaacaattaagttaataatgtaattctaaattaggcttaagaagaaaacttaaatatttatgtttatataattatctgtcagaagtgcagaattcttatttttccagagtagagaggagtgctttcatggcggtaaaaggtaaaatactaatcactgtaaaaatctcttaactcttgcgttgtgtttaatactaatagactaaaattagtaattaatttataaataattgcgtgtgtatatgcacgtatgtccgtacgtatctacgtgtaggtcctagatatagagaatccttgaggtggctatttaatagcagctctcattatctgggctctgtgttttgaggaaaagcgatttatcgagaaacgaacttagggccacgccagagagagagagagagagagagagggaaatcgaatctggattttagaggaactagggtttgtatttgtactgcgaaaatcaattaatg

SEQ ID NO: 30778 - DNA, 3003 bp, Unknown
  misc_feature (1)..( 3003): 2750-1469P.txt file - cDNA_ID_3035342; gDNA_ID_2213626; Annot_ID_195856
tgacgtaaagaaaaaccatgaatcttcgtcaatgtatattgtggaccctgcaaccaagtgcactcgggtttttggatccggagcttttccaggtttcactggtagaattcgggttgacccgattactggtggagcctttaattcacacggaatcaaccacttgaaattcttgattccttctatttgggaccctaagaccaaatcttgctggactcctatgtaaaccgttattattacgacatgttacacagtttttacccttcatgaacttttaaggttgttttgttattggaaatattcaatatacttggaaatacttcatgaacttctagttccaagtcttcatgaactagactttgaacgatcctcgtgtaaattaaattctgtgagaaagaaaatccatgatttagcagataatactacagtatttgacaacaacaacaacaaaatgttgataagtaagaaaataaagctcgaagatttgtaactattcatgattttagaaaatcggaataatgaatagtgtacttatttggacactgaataagaagttacacaagtcccgattgaaatttaatttactaatgatcgttacaaaattatttgtctctttgtcatcaatcctgttagtgaatattagaattattattcattgtaaacaaataggatcatccagattgagaagtaaataattttatgtatgttacaaatgaaataattaattgatcgtaaaacctctctgaccttatatatatcgagtctcactattcaactttttcattgcacttgtcgtacaaaggagtaaacattgatatgggaaaggtatgtgcattcctgtctttggtaattccagtaatttgttaagtaaattatgtgaacttatattttgtgttttggatttggttctaaagaacaagcaaaatggagaatcagacaacaagtctgaaaagaagaaccagaaaaatggagattcatcagtcgataagtctgataagaaaaatcaatgtaaagaaattgttctgaaggtttacatgcactgtgaaggatgtgcatcacaagtttctcattgcttgaggggctatgatggtaatactctattaaaagaaacattattagattactttccctctttaatggaatcatatatatatggtctcgatcataagaatcaatgtcaaatatttaatcatttatcattgagtgaaattgtactataatttaacttaagcattatctagtctggtttcagttttatttttctttcctgtaatctagagaagttgtctattaattcccacaatgacataacgaatagtaatctctagttcttaaagcatcaattaaaaaataggattaccgtttttttcttcttactcatgactcataagtagctattatcttatttgtcttataggggttgagcatattaagacagagataggagacaataaagttgttgtgtctggaaaatttgatgatccgttgaagatattacgaagagtgcaaaagaaatttagtagaaatgctgagatgatttccccaaaacataaccctaaacaagatcagaaggagccacagcaaaagaaagaagtaagttatttccaattatttcgtgttagaacttagatatatactctcatttatatcataccttgtctaattaatctgagaataacaactaacatatctaatcatttctaaatattttttgcatgattttagagtgctcccgagatcaaaactgcaattttaagaatgaacatgcactgtgaaggatgtgttcatgaaatcaaaagaggcattgaaaaaataaaaggtaatctttgtatatacatatagaaataatacgatatcgaaagttaaaaaaaacaacttagaatatgtttgtttgttttgacaaattaaaaggcattcaatcggtggaaccagaccggtcaaagtcaacggtagtggtacgaggagtcatggatcctccaaaacttgtggagaaaatcaagaaaaaacttgggaaacatgcagagcttctaagtcaaattacagagaaaggcaaagacaataataagaagaacaataataagaaggaagaaagtgatggaaacaaaatctttagttaccctcctcagtattcatctcaacatgcttatccctctcagatttttagcgacgaaaatgtacattcttgttcaatcatgtgattttttgacccgtaaaattagagtctttttaagttatcttttatggttttgatttccttgctacacatttctatatctcaatagattttaatttaatttaatttttgagtgacactttatgaaagtaagatttggtgtcatgtgtatactcgattactagattatgtttgtagttgtgggccttttgtacaattatttgtaaaaaaaaattaacagggcattagagtataaaaaaaaagaatgtgggtatatattatattttaataacttagggtctattttgtaatataatataagttgagagtacttgttgcatttaacccaaaaagaaaaagacaagggaggacgaagatgaattgtctcaatttttagggttcatcaaaatttgaacaaaagggacctgttttgctcaatttttgatagcagaagacgaatctggatctggggtcacttcaagtaagtaaagagttaaccttttgcttttttttgtaccataaattgtgttcgaatggtacgattgagaaattgcttacgaatcaatgaaataacagttaagattttgatgatgaatgctcatgaaaatctatttaagtttgattgagaaattgaagaagagaataagaaatcgagagatttattgcgtaaatggtaatactttatgtttcagttctgctatttagatccaagcttgaatatgtatcccttagctttatttctgtaggttaagattgtttggttgttgaatgttctttgtttgtgcattgcctttgcaggattgaattaagaggtttttaagtaagttgagatg

SEQ ID NO: 30779 - DNA, 3003 bp, Unknown; identical to SEQ ID NO: 30778
  misc_feature (1)..( 3003): 2750-1469P.txt file - cDNA_ID_3035342; gDNA_ID_2213626; Annot_ID_132043

SEQ ID NO: 30780 - DNA, 3003 bp, Unknown; identical to SEQ ID NO: 26600
  misc_feature (1)..( 3003): 2750-1469P.txt file - cDNA_ID_3035344; gDNA_ID_2213626; Annot_ID_195854

SEQ ID NO: 30781 - DNA, 3003 bp, Unknown
  misc_feature (1)..( 3003): 2750-1469P.txt file - cDNA_ID_3035344; gDNA_ID_2213626; Annot_ID_132041
agagaagaagaaagaagctctctctctctctgtctacacttatattaaactctggagatagcttttacctctgctcttttatttatacactctgatttttttaattccagaaagcggtggagtttcgcagagtgatataacgtgtcgtaatctctaccgttgatctgattacctctgcaacgtccgattattaaattaaaaaattagttttgttgttaagataagaaataccacgtgggctggactaacgtgcttggcctttttaaaaaaacattaattaacgtacgtacctggtctttttctgattaacgtatctggtcctaagctctttttttcatacgtggcactggactcgcgttacttttctcaattttttccatttgcgtttcacgtttttttttggataattttctgctactcaaagttttgttgttacgaaaacgttgagtctctctctctctgcttgccgccgagacggccaataattttttttttaagacaatatttataaatctgaaataaacatcgatccagatttgtggattatagaaatcttatcaaattttataagattatttctttctatgatatctaacggctcatcatgtaagactaatctaaatttgtaacgaagaaaagtggaaaacacataacaagtgtattggcccgcctaatcgagttaatagggcaaggaaattctcctttactgcctaactcttctccagtttgatttttattttttgttgtggaggggaatattttaaggttctcttaccatagtacagacttataacgaataataataaaaagcagattatgaatcgaaagtacgaattttttcaaatccatttttttcagatagaaaaaacagtacgaatttttattgttaaaaatggttatattattgaaaatggaacaatttttcatttaagagaatcgaatattccattcataaatagtacattagtactctccttctaaaagaggcacgtgattggttgtcgcaaagcacacgagccaagatgcttcacttggaacgagaaaaagccccaagagacagaggagagggcaaagcaagcaagcacctttttctttcccatgctcgaaactcggttcttgattgattccttcgccgaagattaaccaatcaaatccaaacaaacccactcagatccagattcgttaaatctatccggatccatttacttcaacgggtcggatccagtgatctggcacttcacaatgggaagtggcttttctggttcttcggataccaaacaatgtcgcgatttcctcgaagattcatagatgattcatcaatggaagatgcaggaatctctctttgcccaagtattcactatagacctataaaccctaatgatctagatcgtttggagcaaatccatcgcgatatcttccccatcaagtatgcatccatctacttggattttcctatgttggtgtcttgtgaaaagatttctaaagtattgatttttgttttgtcaggtatgagtctgagtttttccagagtgttgtgaacggagttgatatcgtctcatgggctgctgttgatcggagccggcctgatgatcactctgatgaacttattggttttgttactgccaaatttgtgcttgccaaagatagcgaggttagttttcattctatgaattcgtctttttgtaattcgaacaataatgatctttcaggtcctgtaatcaccttgaatgttgaactagttcataatgcttatggtttttggttcgtctgtgatcatgtacactaaataaaagttatttcacttgtcaaaaatctttagaacagcggcttgtaataatgtctgaattatgattgaataatctgttttgggagctctggtaatgcaattgagtctagtgttgtttttatcttcttattatctatcttcatcagctggcagatggtttctgtgtcttgcacagatagatgatcttatacattacgattcctcgaaaggagaggagactttgatatacatcttgacactcggagttgtagaaacatacagaaaccgtggaatcggtacatgactcttataatactaataagtatctgaaacatgttctatatattgcttggttttataatttctgatgtttctgcaactttttttaactctcagcaatgtcacttattagtgaggtaattaaatatgcttccggtttatctgtgtgtcgcggagtttaccttcatgtgattgcacacaacaatgctgcgatctgtttgtacaaaagattgatgttcagatgcgtgcggagattacatggattttatctaatcaatcgacatcattttgatgcgttcttgtttgtctacttcatcaacggttctcgaactccttgctcacccttgtaaggagatttactcacagacaaaacaagtctttgattctcttgtactctataatggtttacaacaatttactgtaatttgcagagaggtggcgatgtttgttgtgaattatatgaagagtggtatcaagtcagtggcatctaagctggctaacaaggatgagaaaggtttgaaatggctgttttgcaaagacacggattgtgtctaaccctcgcaaaccaaaccgaagctagggtcatcatcagcgtacgaattcatttaacttaaaactatatttcccattcatttgatttctcattgtgaactctgtaatgaaaaggtaaatagtcaccgttaatgtactgttttttgggttttatacgctgatcattacgtgtttataaggtgtaaggaagttcttatgagtttttcaccacccttcttaaaatagttagcttggttgaaaatagctcttttgcttcattggcaattatccaaaaacaaaatcaccagcttaggatgtcaaaaaataggttaaacgataattttatttacttccctcaaaaaagcctgagaaaatccccatcaaaggccaaaagaacagaaaaaagtttttttcacgcggtggcaatg

SEQ ID NO: 30782 - DNA, 3000 bp, Unknown; identical to SEQ ID NO: 10180
  misc_feature (1)..( 3000): 2750-1469P.txt file - cDNA_ID_3035453; gDNA_ID_2213634; Annot_ID_180975

SEQ ID NO: 30783 - DNA, 3003 bp, Unknown
  misc_feature (1)..( 3003): 2750-1469P.txt file - cDNA_ID_3035469; gDNA_ID_2213634; Annot_ID_180963
ttctacaacaagcccggcaaaaacaaataaaaaagctacaagtttaagggattcaacgagaacttatagaaactgaaataacagtttaatcaattagtattggacggctttggtacaacgaaaataaaactactaaaataaatatagttatcaattagttgcaaagtgtagtatataaccatatggttagttaaagagagatattttagtgtggtatcaaatatttcagttcaaattaaaaggtgaaaatggaaagccaaaaaaagctaataactgagccatatagagaaatagaattgttatttttgttagtcaagtgtgggttaacccgaattcaagttccacttgaagaggaaacttcgtatcaaaagacaaaaaaccatgtttggtccggaaaaagttttcttataaaaaagagagaattttccggtaaacaaaaatactgtagaaagtacacaatatataaaagaaatcatctagtaggaggagtaatgttttgatataccaaaaacaaaaaggaagggtaataatgtttgcaaactagtcattatataaaattgaaagtggttgcctatgaatacaaacatgttcatgcaagtgtacttccatgtgcttctcctctcattctcaatccacccaattctgcttcacatgtgcatatgtacatatatgcatattgtggtccgtacgtaacgtttgtttttaaatattattattgttatacgatttacaaatacttatttttctagcactcttaaataaataaaaacaattgcgtaaaatatgagataattgaaaaaataaaatatatatataagctaaagatataaaagtgtcaaaatttaaaaaggttaggtcaccattctctgtagattttagggcgagaaatcaagtcttagggttaagtttaagagttagggtttatgatttattttttgaaatcttaatttgagtttaatttccagggtttatgaagaaatatatacagatactttacagtttataatttggagtttggattaggactaattttaacaccttttaactctcacaaaatctaaactattttcttaattttgatattaattttatattattttcataaaatttcaactattaatcctaggaatatcttatgtttaaaaataaaagtttaacatgatctccgtgtggatcttttaatcaatattcaagtaagtaagttatttttacattcacatagaagtcagaccattataaactaaatccattaaaaaaactacatatggtaaaagactaaaagatggtcttatttccaagtattatggaaaaatgaaaaatgtatttagcttagtaaatatcttgagaccagcaaaatgattgagcattgggaatcggaattctgacaaaaccaatcaaatgtgacagattattagagtataactagtaattaatgtaggcttaaggcttcatgacaccaaactgtaagtaataaatttgggtattagtacatgagtaattcattacaaaaccaatttcagtatcttgtctttagattttttgttgaagccaaatacgttctcgcaaatcttccatctaaaatgatactaacaaatgatcagaagcataacaaaccaacaaaataaaataaatttccagcccataaaattggaaaaaaaaaaaaatatatacggaatcttccgtaacgattcgtacatgttttcactgtcatataatgtcacaaatcacaagactgcatttgttctgatctaatttatattcaattactaccaaaaccataattatttatatggatcacacgtttattttttatacgtctgacattaacaaatacacatggtaaaaactgttggaaaacaacaagtttagttaatagtacagttttgctatatagatcgtaccatttgttttcgtgataataataacatatatgaatctatataattcttaaccgataattaattaacacggaacttacgcgttcataggcacatatgacatagaagaaaagcatcgaattttaaaatagttcaacttgtgactaatcattatgcatgttactgtgttttggtgaattggaaaaagcttgatctgaaagaataataataaaaggcagtttgtataatgataaaaatataacagtatataataaggtgggagcataagtaacgtgaaggcagtttgatctgtcgggaattttttttgtatactttatgctcctaattatggtaattagataagttaaagtatagttttaacttaactcgtgaactcatcattttttttaacaagaatcccgtttctgaactcaaacgcaatcacaaaaacaaatacgtattgggattcataaatgccttaataaacgaaattttgtttttttttcttcttttcttttgaattatagtattgggctcacaacataattcaaaagtctttaatttacttattagatccaacaaacagaagtgatccgacccaatactttgggccgtagttgggcctaaataatattctccgtcggattatttgcgatcacttccttcctcattctcgccgtcgatcagcttctaacggcgcctcatcggtcgtcaagccttaccttctcatcccagctttggtagattctcttctttggtttagctgtttcagtctttgattttacttagcttgatcctccgaatatgagaataatgtttctattatgtttatcttcattcttcaatgtgaactcatgaatctggaatttgggcaaacaaagagtttcttccgaatgtgaacttgattgcttacaaattttgaaacttttttgtttatttgtttgctttgttcattgttgaaattgaacaaagtctttgatctgctcagtgcccacctaatatgatttatggtgtcagatggcatggcttgtggtttctgtttctctgattgttatatggttggcttctttctgcaaaatattcttccgagcaacatctatctccggagctgctattcttgatgatg

SEQ ID NO: 30784 - DNA, 3000 bp, Unknown; identical to SEQ ID NO: 10209
  misc_feature (1)..( 3000): 2750-1469P.txt file - cDNA_ID_3035488; gDNA_ID_2213635; Annot_ID_181013

SEQ ID NO: 30785 - DNA, 3000 bp, Unknown; identical to SEQ ID NO: 10200
  misc_feature (1)..( 3000): 2750-1469P.txt file - cDNA_ID_3035492; gDNA_ID_2213635; Annot_ID_181011

SEQ ID NO: 30786 - DNA, 3000 bp, Unknown; identical to SEQ ID NO: 10191
  misc_feature (1)..( 3000): 2750-1469P.txt file - cDNA_ID_3035496; gDNA_ID_2213635; Annot_ID_181002

SEQ ID NO: 30787 - DNA, 3000 bp, Unknown; identical to SEQ ID NO: 10184
  misc_feature (1)..( 3000): 2750-1469P.txt file - cDNA_ID_3035499; gDNA_ID_2213635; Annot_ID_181001

SEQ ID NO: 30788 - DNA, 3000 bp, Unknown; identical to SEQ ID NO: 10203
  misc_feature (1)..( 3000): 2750-1469P.txt file - cDNA_ID_3035561; gDNA_ID_2213635; Annot_ID_181019

SEQ ID NO: 30789 - DNA, 3003 bp, Unknown; identical to SEQ ID NO: 26621
  misc_feature (1)..( 3003): 2750-1469P.txt file - cDNA_ID_3035564; gDNA_ID_2213635; Annot_ID_181018

SEQ ID NO: 30790 - DNA, 3003 bp, Unknown; identical to SEQ ID NO: 26633
  misc_feature (1)..( 3003): 2750-1469P.txt file - cDNA_ID_3035578; gDNA_ID_2213636; Annot_ID_181069

SEQ ID NO: 30791 - DNA, 3003 bp, Unknown; identical to SEQ ID NO: 24838
  misc_feature (1)..( 3003): 2750-1469P.txt file - cDNA_ID_3035586; gDNA_ID_2213636; Annot_ID_181064

SEQ ID NO: 30792 - DNA, 3000 bp, Unknown
  misc_feature (1)..( 3000): 2750-1469P.txt file - cDNA_ID_3035599; gDNA_ID_2213636; Annot_ID_181060
gaataagagattatattattacttttgtttaatactgctaggaagaaatcaaatattgggtcaacaaaagaagaagctttttcagtcttatggtcctttgatttcgacccttctttttgaattctaaattggcccacttcgtttttcgtttttagtttgtaacgaaacttgaaaaaaaaaaatggattaagatttgaggaattataacttttagtagtcactagctagttgaataattgaatcgataaacataagactttaatcaactgatcacctatgcaactctcagtgtcaactcttttacattacaaaggaaacaataaaaatcgtttagcgagaccaggtagagatcgagtttgatctcgacaaagaagagcaagagtttaagaactcaatgcagtcctcaatggcttctgcacggtgagactctgatccgtttagagactttgacttcatcaaataaagagacgaagaaacgttactggaagatgacggtgtcgttttggtgttcatcctgccgaatgatatataacgaaacgttttgccaactctgtctccaatactgcggagtaatctcttcgtcgttgccggcgagtcactgaagctgaaactgaatattccaacaacgaccctcctgcgaccatgccgtgatgagctgtgtgttgggaagatcagttcgtcgtttgcttctgggtccggactaaagcgtactcttttggatgctcttcgagacatattcttgtctgaaactttatcgagagagagacagagagaaaaagagaaacaaaatggagacgtgagggattttgaagatttatttatgggggcaagtcatgtataatgtttggggaggaattttattaaggaaggaaatttgaacaagttacttgtttatacatgtacaactacacgtaagttatttaaccaattgatatgaaatggtttccaatatctagatttgtttaattgattcttgatttttttccattatagcttgtagaatttctacgaagatgatgcgatttgtaaaaccaaaattatagtcaaaagaaaagacaaggaaaaaggtttgaagtaaaagagtaaattgagtacttggaataaatctaggtttgaagtcgaagattcaacaataacaatataagtaattaggtagataaattctcatatgtatgatgaaataaatcaataagacaaaaaaaaaaaaaaggttgattctcttcttgtcactgttgtgagagctttgtttttttaggtgaaatattaggggtcctacccccaatgttccccattcattataatactttatgtgtaaacataggcatatatatagagaagttttgagatatatatcaggcccggctcttgggaggtgctgagtgtgctagtgcaccgggtttcacttctttattcagttttttctttatattttagggtccaaattttcaaataattgcaaaataggatttagtttttaaatatttagagttttaggtaaagaaatttggagcatagcacaaggtccaataatttattgggccggctctgatatatactaagacactatatagaagtttgattatgtcaaacaagaaaatttgaatgagaagtttgaatatagagagacttatcaatatcactttagttcaacattagatgtaataacagttaaacaattttctaaccaatccaaataactcaggttaagttcatctcaattatttgtttggaagtttcatttgaagtacattaatctcaattgagacgaatgtcatagtccatatattttgtgtacctcgtcatctttgggccgaaggaacaaagaaaacttagcccgattaggatccattcatatatgggcccatataaggcatttagtgtaatagatttttgcatcatcatgtcttgagattttctattagaaaagtcgaaacaatcaaataaaccaagagaaatattgaaagcaatcatgttggcattgagtaaattatgtaagatttgaattctccgaggaacacactacgtttgtatgttgcgttctaactttagaaagattaaaaaccataaaatattggtaatcgagaaaatgaagttagatctttcacatgcaatgatatgcatatgggacagccaagcagtttatatgttgtgttgtgttgtataatataagacaagatgctttataattatgtgaagcgaatattcattggaatagatttccgattccacatttctttctctttttttggttgtatttataagcaatataaaaaaaattattatataaatatatataaagaatatatataaggttgtcttggcgtaattatttgagttttatgttatatcgatctacaagtaattagcgcggctaatgatatgatacgtaacgaaaagtattttgaccaaataattacaaagtcaatttttttttgtcaggagtacgttattgtgattgtgttttttttttttttgtagtaattgttttctcaagtgtttaaacccctaatgtatgcataaaccattataacaacaacgatttttctataacttctgtaatattaataaaagataaattttagcatatgctaaaacgagtattaggatgcttatctgtctctgcctcacaaagaggatatacctctctttcgtcttcttcagattctctctgacggttgttaaaaatccgattataacgacgacgacacccaaatcctcacaaatatataattattaatttaagcttctctgtcaaaataaaaaggagtcatgacgactctttcttctataaatctctctatacctcctcatttgcttcctagcacgactaacacttgttcttcttcctctgcaacctcttgttctcctcccaggtcttcttcttttgttcttcattcccctctttcgtttggtcaccggagattacccattagcaagaaaagcaagctccgcttctgtggagtgattacaaaggaagctgtttctgggtccaacgatatg

SEQ ID NO: 30793 - DNA, 3003 bp, Unknown
  misc_feature (1)..( 3003): 2750-1469P.txt file - cDNA_ID_3035648; gDNA_ID_2214467; Annot_ID_133049
ggtttcggtggatgaacaatgaacagaacgagagagatcctgataacatcaacaacaagaagaagaaaaaggaatctccattgttgatttactccgtctcgaaagcaaagaaacgaatcgtgtctaagttcagaaggagacccttatcgccgaatacgtctccttcttctgggttttggaaaagagtctgcttttgtggaattgaacctgaccctgaagatgacaactttaagcttagggttctgctacagaccaatgatttcttctccaaggattctaatccacatctctgtttgtaagttcagatatatatatatatatatatatatatagtgtagttttcatttagtataccaccaatatctgtatagatcttcttttaaacttcatcaatatcaaaagtgtgttcatcaatgttaccaaagatttttgcagaacagagtgattattgttaatgaatcttgtatatctgcctcttatgctcatcattaatatctgtgggtctttcttgtctctcttcatagttccgtatgatagtttctatatgtctctgacaatgtcactctttgtccataatatccaaactagtttgtaagatcagaaatttgagcccaagtttgaatctcagagtatcacactcaacgaatattaattgctaatgtctgatatctgtttccatgtgttgaatatctctactagtaaagcccaagtttattttggcaagtgttgtttacctttgacacatctagggtaaccattttcaatggttttatgaatagttgaattttactgagacactgatgtagttgtggttttgaaattgctatatggatttaatcatctctatgaagccgcggaacccttgtgctagttatgcttactaagtcttgattatgcaaatggttatctccaatcatcgtttgtttattgaatctgattctaagtgattatgaagaaggagcttggatagttaatggttgatgtttcagagttgtagcatgcctctgtgtccttttttgagacacgatttccctctaaactcagctgaaagttcagccattaaatctactggattgaaagcactaaagaggaccttaatattcttgcagtatggtatgtttcaagaactgtcgattgttcaaagatatatatatatatagactcttaaacatgtgaaaactggtctcatcgtaatcaatgggccaaatatagtcaaaagagtatctacaataataaagaaaagaatgaaaaaaagttacaagcttttgcttagaagtttacatttttatgttcatcattgtatatcattattagattagtgctctggtctgaaacttatttatttctttggtgggaattttcccttaatcttctgaatctctggtgctgcagccccgaacgccttggcaagcaggtcatcaggaatcggtgggttagaaccaaacagagatggtccaacaacttgagtcccgggaagctggctatcgaaagcagcgaggacggaagcaggagctttgttagggttctgctggaaatggaggagagctttggggaaaacgaaaacgtctcctttgttgacgtgtttggagatgagtttcccggtagtggttaagaaaccgacgaagagacggccttcaaggacgaagatggcttcagaggctcttgggtgaagatgtggtgggttaagtccgccaggtgcgtagtcgatccgagagatggagactcccagagtgttgaggccaggcactttctcaacgttggctcctgtaacagctgagcccattgaagagttggctgtggctgcagcagtggctaagcctatgaagtagaagtcttctggtgttacttttgctgggtctttgcaagggtatccgttgactttcaaacctaatcagaacatgataaaaagtcaacaacaaaatattggaattggtcttggttgtttcaaaacaccaaagctgcgtttgcagttaactatatctggtaaatgtaaatgcaagcagaacataaatggtatagagagagatgtgataccgttggagagatcagcaacacaaaagtcttgaagcatatttgtatcggcgagggccatgtgggcggccacgagcatgaaggtgacgaatatagggatcatggaagttgccattgttgattgttgttgtttgtaagatgttattgatgagtttgagaaaatactttaacattgtttctcaatttatatatctacgtaaagaagatttaaccaatggaaaaccaatggagaagagataattatggagaggggccatagatgtgttaattttaaaattttgccataattaggtttaggtgttctgatcgttggttaaaatttggtgtttaaaaagagttttgttttgttggacacattaattagcctatagtttataggatgacactcaccataacaaaaacaccttcaaactctaataatcaccaaactcgaaatgattgatgattttggttgtttactggtgaaagaactcaagaggtttgtttggttcagctaaatccaaaccgggatagaaataaaaccaaaaccttaaaccggcttggaatttctctatccatgcatttgcatgatcataacatatacaatattaaaataaataaataaacatttggggtcaagaacgtacaaaattagatagaatatgggactcaataatatattcataaattttcaagattaaacaaattccatccacaataatgtcccaagtaagtccataagatggtggctgaataccaactaagcaaattcccaaaacctcttattcaattatacaaaaacatgcatctaagcacgtagatggtgtaatctcttgattatttaattaacaatactgaccaaacacaacctcaactgcttcaacattattccaatctgtcatctctgtttgtcttcacatgtttttaataacttcttctcttccttcttcattcctttaatccatttttctcgatcttggctaatccatcatg

SEQ ID NO: 30794 - DNA, 3000 bp, Unknown
  misc_feature (1)..( 3000): 2750-1469P.txt file - cDNA_ID_3035648; gDNA_ID_2213639; Annot_ID_132234
ttcggtggatgaacaatgaacagaacgagagagatcctgataacatcaacaacaagaagaagaaaaaggaatctccattgttgatttactccgtctcgaaagcaaagaaacgaatcgtgtctaagttcagaaggagacccttatcgccgaatacgtctccttcttctgggttttggaaaagagtctgcttttgtggaattgaacctgaccctgaagatgacaactttaagcttagggttctgctacagaccaatgatttcttctccaaggattctaatccacatctctgtttgtaagttcagatatatatatatatatatatatatatagtgtagttttcatttagtataccaccaatatctgtatagatcttcttttaaacttcatcaatatcaaaagtgtgttcatcaatgttaccaaagatttttgcagaacagagtgattattgttaatgaatcttgtatatctgcctcttatgctcatcattaatatctgtgggtctttcttgtctctcttcatagttccgtatgatagtttctatatgtctctgacaatgtcactctttgtccataatatccaaactagtttgtaagatcagaaatttgagcccaagtttgaatctcagagtatcacactcaacgaatattaattgctaatgtctgatatctgtttccatgtgttgaatatctctactagtaaagcccaagtttattttggcaagtgttgtttacctttgacacatctagggtaaccattttcaatggttttatgaatagttgaattttactgagacactgatgtagttgtggttttgaaattgctatatggatttaatcatctctatgaagccgcggaacccttgtgctagttatgcttactaagtcttgattatgcaaatggttatctccaatcatcgtttgtttattgaatctgattctaagtgattatgaagaaggagcttggatagttaatggttgatgtttcagagttgtagcatgcctctgtgtccttttttgagacacgatttccctctaaactcagctgaaagttcagccattaaatctactggattgaaagcactaaagaggaccttaatattcttgcagtatggtatgtttcaagaactgtcgattgttcaaagatatatatatatatagactcttaaacatgtgaaaactggtctcatcgtaatcaatgggccaaatatagtcaaaagagtatctacaataataaagaaaagaatgaaaaaaagttacaagcttttgcttagaagtttacatttttatgttcatcattgtatatcattattagattagtgctctggtctgaaacttatttatttctttggtgggaattttcccttaatcttctgaatctctggtgctgcagccccgaacgccttggcaagcaggtcatcaggaatcggtgggttagaaccaaacagagatggtccaacaacttgagtcccgggaagctggctatcgaaagcagcgaggacggaagcaggagctttgttagggttctgctggaaatggaggagagctttggggaaaacgaaaacgtctcctttgttgacgtgtttggagatgagtttcccggtagtggttaagaaaccgacgaagagacggccttcaaggacgaagatggcttcagaggctcttgggtgaagatgtggtgggttaagtccgccaggtgcgtagtcgatccgagagatggagactcccagagtgttgaggccaggcactttctcaacgttggctcctgtaacagctgagcccattgaagagttggctgtggctgcagcagtggctaagcctatgaagtagaagtcttctggtgttacttttgctgggtctttgcaagggtatccgttgactttcaaacctaatcagaacatgataaaaagtcaacaacaaaatattggaattggtcttggttgtttcaaaacaccaaagctgcgtttgcagttaactatatctggtaaatgtaaatgcaagcagaacataaatggtatagagagagatgtgataccgttggagagatcagcaacacaaaagtcttgaagcatatttgtatcggcgagggccatgtgggcggccacgagcatgaaggtgacgaatatagggatcatggaagttgccattgttgattgttgttgtttgtaagatgttattgatgagtttgagaaaatactttaacattgtttctcaatttatatatctacgtaaagaagatttaaccaatggaaaaccaatggagaagagataattatggagaggggccatagatgtgttaattttaaaattttgccataattaggtttaggtgttctgatcgttggttaaaatttggtgtttaaaaagagttttgttttgttggacacattaattagcctatagtttataggatgacactcaccataacaaaaacaccttcaaactctaataatcaccaaactcgaaatgattgatgattttggttgtttactggtgaaagaactcaagaggtttgtttggttcagctaaatccaaaccgggatagaaataaaaccaaaaccttaaaccggcttggaatttctctatccatgcatttgcatgatcataacatatacaatattaaaataaataaataaacatttggggtcaagaacgtacaaaattagatagaatatgggactcaataatatattcataaattttcaagattaaacaaattccatccacaataatgtcccaagtaagtccataagatggtggctgaataccaactaagcaaattcccaaaacctcttattcaattatacaaaaacatgcatctaagcacgtagatggtgtaatctcttgattatttaattaacaatactgaccaaacacaacctcaactgcttcaacattattccaatctgtcatctctgtttgtcttcacatgtttttaataacttcttctcttccttcttcattcctttaatccatttttctcgatcttggctaatccatcatg

SEQ ID NO: 30795 - DNA, 3003 bp, Unknown; identical to SEQ ID NO: 30793
  misc_feature (1)..( 3003): 2750-1469P.txt file - cDNA_ID_3035648; gDNA_ID_2214467; Annot_ID_182887

SEQ ID NO: 30796 - DNA, 3000 bp, Unknown; identical to SEQ ID NO: 30794
  misc_feature (1)..( 3000): 2750-1469P.txt file - cDNA_ID_3035648; gDNA_ID_2213639; Annot_ID_181164

SEQ ID NO: 30797 - DNA, 3000 bp, Unknown; identical to SEQ ID NO: 26653
  misc_feature (1)..( 3000): 2750-1469P.txt file - cDNA_ID_3035680; gDNA_ID_2213639; Annot_ID_181163

SEQ ID NO: 30798 - DNA, 3003 bp, Unknown; identical to SEQ ID NO: 26659
  misc_feature (1)..( 3003): 2750-1469P.txt file - cDNA_ID_3035707; gDNA_ID_2213639; Annot_ID_181146

SEQ ID NO: 30799 - DNA, 3000 bp, Unknown; identical to SEQ ID NO: 10281
  misc_feature (1)..( 3000): 2750-1469P.txt file - cDNA_ID_3035749; gDNA_ID_2213640; Annot_ID_132262

SEQ ID NO: 30800 - DNA, 3000 bp, Unknown; identical to SEQ ID NO: 10267
  misc_feature (1)..( 3000): 2750-1469P.txt file - cDNA_ID_3035749; gDNA_ID_2213640; Annot_ID_181210

SEQ ID NO: 30801 - DNA, 3003 bp, Unknown
  misc_feature (1)..( 3003): 2750-1469P.txt file - cDNA_ID_3035753; gDNA_ID_2213640; Annot_ID_132259
tgaacccgggacaaaagaactggactcggtaccaatcatgggtacccaccaagactcagtaagaagatgatattttggttttacgctctgcgagactttctctcgagtgatttgttgttttgtttctgtgtcattttaataaaagctgtcttggatctaaagctggacaattgggtttcggatctggaattgtaattgttactgtgtaataatttgctgattattaagtttcttgtttcttcacctctggctaggaaagtagaaaagttctaataagtagaagtatttaaaaatatattaatcaaataacttcatcgagaaaaatatctttcaagattttttttttcttcgaaaatcttcaaagaaaattgaatacagagtttatgatctaaaaacaaaaaacaaaaaaaaaatcttccaacaaaatcttaatactattaatacatctaaatgagagatttttcccaaaacggattatgataaccagataaatcgaacgcagtgccagcaacaaaacgtttttaatggtaattaaaaatttaaacgagatcagcaccacgttttttaattatccttcttctgtcgtttttatggtcaactttgttataaaaaaaaattataatctttctaaacaaaaaaaaacgaaactggaattttgattaacagaaacatccaatatcaacatttaattggttttacaatttaaaaacaaaaagggtttcacagtttgactctctctatttatgctaacacactattaagactaatttcctatttttttaattgaaaatcagaatcttaatttgaaattaagctccgactatttaaagcttgtccactgttccgttaacatctataatcaccctggcatacatacttgtcgtctcccttcctcacgtttctctcctctgcaaattcgaagctccgttgagctcgaatcagagaagtagctatttcgtacaaccccagaacgatatatttttttctgggtttccttgaacataccacactcacggtcacgggatccataccaagcttccgtagccatggggtttgatcccgagaaccaatcgatctcttccgttggacaggtttcgcttttctcattatcgtcttcttttccccattcttctttcggtttaggtttccgatagcaaattgtactgatttttgttggttcttctcccggtcggctttgaagacttttgattgcaatgtatatcttagggtttggcttgattttagatatcctttttatgaagtgattgtggattttgatgtctctgtaatgtgtggagcttgtgaaaattgggatttcaattttaagaccttagcttctgggttttggaataacgattctatcctaaatctctctaatttggtatcaagtcactttctgatgcaaaattcctgaaactatatattatgtaggttgttggtgattcttcttcaggtgggattactgctgaaaaggaacctttgttaaaggaaaaccacagcccagagaactactctgttcttgcagccattcctccgtgagtctctctcgttctctcttgtttattagtcatcaatttgtggtcccagattgttttgtttatttgctatttattgtttgttactactatttctgctgaaagcaagtgggaatcttttggatatgcacatgatactgatttttctaaaagcatgctaagaacgtaagaacgtaacaagtcatttattgcaggtttctctttccagctcttggagcattgctttttggttatgaaattggtgcaacatcttgtgctatcatgtctcttaaggtaatggtttaaccttgtctaaaactgtgcttctatactcaagtttgatttttttagctttctcatatctttagcagttaaatgacgctacttcatagttcatgcctgcatttgcactgccattacgtttccttggatttctcctgcatagttgttatgcatgtacatctgttcgattgtctaagcctattaaattctgaatgactaatctgcttttgcctcagtcgcctactctaagtggaatttcatggtacgacttgtcttcagtggatgttggtataattgtgagtctacctttcttggatcttctacatgttggttattgcactattttttgttcttattttctccctaaattgggaagctgtgatctttcttgtggaaggacaaagaaatttgcttacgacaattttcatacttttgtgcagaccagtggctcactgtatggtgccttaattggctccattgttgcatttagtgttgccgacattataggttggtttttctcaactgtcttcatctgagtatgtagcagcagtctccttcatctgaaagaaattgaattgttggactaaattttcaaggaaggagaaaggagctgattttggctgcattcttgtatcttgttggagccattgtgactgtagtagcacctgtcttttccatactgataattggacgagttacgtatggcatggggattggactggtaagataaatcacacatctttattgtttgcctgctaaaatgtgcatcatgcatttgactaagtagttaatcatagtcaacctttccacgaatagctacttggtagaaatatgcttcacgctattactgaacatgtgttatccaatgcatccatatactaccagtctatcactcatagaccaacctggcagtgtttgcattcttctgtattcatatattggcttactccttcgatttattgattggtggaattcgggacagagtttacccctatatcgagacagtctgagatatataattcatcctattcttattctcctgtctcactctattttacgaagttgagagccattgtttataaatattgtttactgttcaaatcaagatgtttgttctactgtgagtgaatccatgcagctagggagtacaattttaagcattctttttaactggaaagttgatatgtttccttgcatttagaccatg

SEQ ID NO: 30802 - DNA, 3003 bp, Unknown
  misc_feature (1)..( 3003): 2750-1469P.txt file - cDNA_ID_3035753; gDNA_ID_2213640; Annot_ID_181207
gatggctttgacggtggcgaagagtgcgttggaggcgattagagagaaaggtctcggcggtttcatgaggatgatccgagaagaaggcttcatgttagttctctgtctctcttttccaatctctcttcctctgcttaatttcttcaggattataccctcgatttcattagttagatcccaaataatctagaaatttacaagaattttcggtgtttgttgaagtttgtttgcaatgaatggttatcattcttcggtttttttcactcaaatgttaaattttcttgatgtgaaatgaaaatcaaacactttgtttttggtgaacatcaattttgaacggtgatggtgatgcttgaaattggcataatgtttctggttgcttataagtctaagatcttattgtttgtattccgaggtaatcactagtttatggaatttctctaattgcttctttcaattttttttcttcattgcaggagatgcctaccagatgggaacctcttgtaagtaatttatctttgataattagtgcttagtgtttcacttctttgtggattacgaatatgattcaagtggttgttcaagagttctttacagaccaagttcattttcatattcttatatgtgtatgttgttgtgtgagcgaacataattttgtcagattcattatactgtgaacagagctcgccaattcttgaacagcttactattctttgacttggactgctgatagatgttatgttagttgattttggagttcagtaaagaaacagtgacagtaaatgatggttggtattccagagatagtgtagttacatgtttgaaggaattgacaatattatgccataaggctattcaagttgatgaggaataagagctcaaagattggtgaggcctgttaatggtgatgaaattggcctacaaagtagtcttgaaacttgaaagatcttaagagtcaaaatttatgtgcctctttcaccaagtctataagctggatttgtcgttctcataggctctagatagttggtgcatttggctgaatatagagaaccttttcctcagatcatttctttatgcgtaatatacatataacatatacttagtgttgcttctatgttgtgtattgagatgttggaagcatgtatatatgggtcacatagtatatacacagtatgcttgaatattgtgtcttattaatagtttccccattctttatattgtagcttgctgttgagtcgtattttctgatcaatactgttttatttctatatttgatgaaggcaaactaaaatacataacataggagcgacacttgttggtgttgacaagttcggtaacaaatactaccagaagctaggcgatactcaatacggtatgtagttcctttaacttcatgttttacctatataaaatcatgctttaacctaaaaaaattgatgccactgtaggattcatgatatttgttactaaatattcagggaataacccttttaatattgacttcaaatgtttgtttattctgagtggtacagtcatggaaattgtagccactcactcagcatttgttatttgttagctcactgcatgtatcttaatagaatgtttagtcaagaggcttttacattgaaacaagcaatcactttgtgaacaggtaggcacagatgggtagagtatgcttcaaaggatcgttacaacgcatctcaagtaccagctgaatggcacgggtggcttcatttcatcactgatcacactggcgatgaggtaaaaccaagagccatttcaaattcgctgtctcgttcaatcaatagataatatattgccttgtaacttgataataaataccaatgtctctgtttcaagctcttgagtttgaaaccaaaaaggtatgggcttgagcataaagagaacttctctggagaaggtgatgcatacatctaccattcgaagggacataccttgaacccgggacaaaagaactggactcggtaccaatcatgggtacccaccaagactcagtaagaagatgatattttggttttacgctctgcgagactttctctcgagtgatttgttgttttgtttctgtgtcattttaataaaagctgtcttggatctaaagctggacaattgggtttcggatctggaattgtaattgttactgtgtaataatttgctgattattaagtttcttgtttcttcacctctggctaggaaagtagaaaagttctaataagtagaagtatttaaaaatatattaatcaaataacttcatcgagaaaaatatctttcaagattttttttttcttcgaaaatcttcaaagaaaattgaatacagagtttatgatctaaaaacaaaaaacaaaaaaaaaatcttccaacaaaatcttaatactattaatacatctaaatgagagatttttcccaaaacggattatgataaccagataaatcgaacgcagtgccagcaacaaaacgtttttaatggtaattaaaaatttaaacgagatcagcaccacgttttttaattatccttcttctgtcgtttttatggtcaactttgttataaaaaaaaattataatctttctaaacaaaaaaaaacgaaactggaattttgattaacagaaacatccaatatcaacatttaattggttttacaatttaaaaacaaaaagggtttcacagtttgactctctctatttatgctaacacactattaagactaatttcctatttttttaattgaaaatcagaatcttaatttgaaattaagctccgactatttaaagcttgtccactgttccgttaacatctataatcaccctggcatacatacttgtcgtctcccttcctcacgtttctctcctctgcaaattcgaagctccgttgagctcgaatcagagaagtagctatttcgtacaaccccagaacgatatatttttttctgggtttccttgaacataccacactcacggtcacgggatccataccaagcttccgtagccatg

SEQ ID NO: 30803 - DNA, 3000 bp, Unknown; identical to SEQ ID NO: 10277
  misc_feature (1)..( 3000): 2750-1469P.txt file - cDNA_ID_3035757; gDNA_ID_2213640; Annot_ID_181205

SEQ ID NO: 30804 - DNA, 3003 bp, Unknown
  misc_feature (1)..( 3003): 2750-1469P.txt file - cDNA_ID_3035769; gDNA_ID_2213640; Annot_ID_181199
gatctcagaaattaattatacccctaaactataagattgtttaagaatacaccctaatgattggggtttgttctgacaattactaaagccaggggttaaaagcggaactttctgattctcattaccttgaagaagaagaagaactgcgacggtccgaatcatcaggggagtttggaaaagaagagggagagttaacaccttcatctgcgtccgcgtctacgtctctggtgtagtttccgcgtctgcgttcttcacccaacataagagactccatctgttcttgatagtgcattttttcttctaagcggcttctaattgattaagagttgagagaacagtggcatttatacgactataattattttaatgaatgtgtttatatagtcggcccgttattaaagtttatttacaatgtttacgcaatggatattcgaatttaaaacattatctaatgagctctgtttgtcaaataacatgtcacgcccatgaacatgggttctggttttgcggtctttatataataagtagggtatttttttatgtcagagataagatattttgggaatgatggaacaagatgacgacacgtggaaagagtgaagaaatggacggagtttaaatacttgtttacgtggtgggtggaaacagatggcacgaacaacgaggccatcgagaatctctgtgtaacgaatctaacgatacgtgtcgaactacgttgaacagattcaaagacttttgggccatgattgataaatgaactttattttatgtatttatggaccgtttctaaggccccttagcacatgatcgctttgaaaaaacatatcaagatgtgtaactaattggggagaaaaatggaaatacggaggaatctatacgttttcttcaccaaagagcaagtagaatgttttcctctactttgcttcttctctttccttattcctgcgtaaattaaatgaactaattttctactgcttcaactggtaagacacagagttagaataacctgttctttactctaataatattcctctaatcagggccacccaatcatataccctaagggtagattgcaaagccagatttgtgggctaggaatattcctatttcgttaacttaatacatagatgctaacatattgttcatgttccaaaaacaaccagatattataatttgtaaatcaaaatcacctttgatcactgctcagctaagtatggctatgtatctcctcccactaagatactggacatcaatctcaatctctacttcaagtccatacatttcgaaagtaagagtggccgaagttcaaacattttaaaagccaactacgagaactcagaatatgtgaaagccaaagaaaagaaaagaaaagaagtgtttcacaacaaggttcatggagaagcaaatacatgatcatcagtattctttccctaatctatctaaagcaacttaggatgtaccccacgcttaaactcaattatctagaacctcaaggacgattgattactctattctacgctaatcgatcatttagtaaacaaatgccgattgcttggtatgggtcaatctatggttcatgatcggttcttgtgtctaacaaagcatatcaaaagcacatactactagttcagatttcagatgcatcagtatatttgtataaaaagggaaatgcacctatgagacaatttggatttcacccggaaatcaataaccagacattgaacacaactaaacaaaagggttccctgattaccaaatctgtatccacaagctctaattcatagaatgcataagagaaatcacagtgggtgtggcacagaatcaattcaataaaaccatcaatcatgtgtgtgtcattaatgcataatgcctatcctgaagagaagattatagagtcaatcaaaattcaacaagaaacaatcacaatctggttacaaataagaatccaaacatagaaaagtaggataaaatccttcaatctccacaagataaaagacacatatcagaaacgttgaaaaagagaaaacctagccaaatgggaaagataaccaaaaaaggcattacactaattgaacctgagacgagacgatcaatccttgttcctgagcctctcgatcctctggttaagatgctcgatcttgacaaccaaattggtgactgagtaaaggatccagtagaacacaagtgcagccgcaatgagaagcgcgtttcgctgggatttcatcatggacttctggtgacgaagatgctctgacggtgtgcaggaatcgccatcgcacgaaggcatagtttcgtatttccagtagatgtccattaagaggaagagacagaaaggaactatggagagaaacggtttgaggagattacgcgtgacggcgactaatcccttgcggagtccgtcgagtcctggcatcgtcaatagcaccaccataatcgcttcagccgccgccgcgtaacctaaaaccacccactcgagcgccattatcaccggatcaagctagatctgaagtctcttctcttcctcgcaatcgcagcttgaattttctattttgcagactcattttttgctggggaagaaaagagaagatgtaaggaacgtgatacacgtggcggtcaacgcgtgtcgcacgtcgattaagagggaaaatgggcttaaatgggctgaatttgctaaaactcggcccaaaagaaaagtatagatatattaagtagtccgtttctttaaagtcggctttagattcacacagtgtcgatttgtcaagtaacggcgtcaaaagcgaaacggcaacgtttggtaggtgagacacgtggatcagatagtgttttgtctcctaatccaatctctttcaaagcatacataataaatgcatatatataagcacacattaaacggagttaaactcatcatacattactgactaaaagaagcaaaatcttgagtagaaacaaattttcctgtatctctctctcttgtaatctccgacgaagaaacacagttttatg

SEQ ID NO: 30805 - DNA, 3000 bp, Unknown; identical to SEQ ID NO: 10265
  misc_feature (1)..( 3000): 2750-1469P.txt file - cDNA_ID_3035771; gDNA_ID_2213640; Annot_ID_181196

SEQ ID NO: 30806 - DNA, 3003 bp, Unknown; identical to SEQ ID NO: 26670
  misc_feature (1)..( 3003): 2750-1469P.txt file - cDNA_ID_3035775; gDNA_ID_2213640; Annot_ID_181192

SEQ ID NO: 30807 - DNA, 3003 bp, Unknown; identical to SEQ ID NO: 26671
  misc_feature (1)..( 3003): 2750-1469P.txt file - cDNA_ID_3035779; gDNA_ID_2213640; Annot_ID_181190

SEQ ID NO: 30808 - DNA, 3003 bp, Unknown; identical to SEQ ID NO: 26672
  misc_feature (1)..( 3003): 2750-1469P.txt file - cDNA_ID_3035783; gDNA_ID_2213640; Annot_ID_181189

SEQ ID NO: 30809 - DNA, 3003 bp, Unknown
  misc_feature (1)..( 3003): 2750-1469P.txt file - cDNA_ID_3035787; gDNA_ID_2213640; Annot_ID_181188
ggggttttttgttgttgttgtaggatcttgctgggtagtgtgagcaatcatgtggtgacaaatgcaacatgtcctgtcacagttgttaaggctaattaaagtgtctcttgttctttaattggacccagttaataacattagtagttacgtgtgtcactcatgcattgttttgacatttatacgtttgttgccttctacaaatttgtgtgaaactgattggtactgtttcattaataaatttcagttaaatgatatttactctctttttgtttgtgatttgtgaacgttacgtaaaaatcacaaaaaaaaataattagtttttctaattcattcatgaaaaatcttcgtggactaaacaaaaaagatgtgaaaaaacaatccccatgtttgatccagattaattcgatccgttaatcaaaagatggtcttaatgagcataattcggggataaagtcgaatatagaaatagttgttgaaaagagaaatgtttggattgaatcttgtcagcttgatgtgtggttgatcacatgaccaatctatgtatggaatatggatgtcgtgtgtgctgattcattcagatatgacaagtggtggatgggataattcacgatatgggccagattatgagtttgttttaacttgaatggcaggccgaatcataatggattcatgatcattatgtttgatcatagcctagttggacttgtatccctagatcatgatcaaagtgggcttataaacatggccgagatgggtagttctaaatcaatttgttggatcagaagaaatcaagaaagagacagtcgttggagcttttctgatctgcttttggatgatcacccattagattgaaaattaaatttttcattctccgctcgatggctgatttgtaaacttgttccttcatgatagaaatttatgggctaaatacagaaagtgaacgttagaatttggttttgggtagaagaacaactatcatatgattaaagattaatcagatgatctaaagatagttttggtgagtacagttcggaaatatagccgttgatgcatgatgtgtgactttcaaaaatagaaatagccgttggatttaaatttaaggtcaatgaacaactgtcagatatgcttaaaattaatctaatgatccaagaatggttttggtcaatacttcgagtatatatagttgctggtacgtgatatgtgaccttgcttcaaatataaaacgagccgttgaattttaaatttgggtggatgaacaacgtactgtcaggtatgatgattaagattaattcaatgatccaaaatccaaatattgtttcggtagacggtggtacttaattagtgagactttcaaatattaaaaagagatgttgaatttaaattttagtttgctcaaaagaaaaagtttctagtaaaaacaaaacaaattatgtttaattaaggtatgtaatatggttatgcataagactagtgttgatgagatgattcacgatgtcgtatggattggattatgagtattcttaaactcgaatgggttgccaaatcataatggcctcattaatttattgtactaaactgaattataatatatgttcttgagcgaaaaaaatccataatttataatttcctatctagctatattggattgatccggctgttgacaatctggtcctgatttgaatcggtttctcgaatcatgcaccgtaatcgtagtctagccatttaggattgtatcactaacagtagtgtcactttaaaatgttggagatttagactatgaatagtaatataaaccgcacccaaaaccgcactgcaacaggtaacagtatcaaaatctctctctatatatatgtattttcgttactatttgaaccgcaccgcacttctcccacaccgcaaaacgcagtcatcattcggacccttaagacaaaaataataataacaatttatatagaattttaccaaaattgatgtcaaaaagagaattttttattattattttaaaacctaaaaactaatacaatatagagacgtaagaaaaatgccatcttttttctttcctcatgctacacacctttagatcaatgtttcctatagattttacaatttttctttccacattactaatttgagtatttgcaatctgttgaataagttgtcattgttcttaaaaaggtacttttcaataaattgtcatttctatctatataatcagtgatatctttccattctcttattttataaataagttagcataagaaaatatataggactaaaaccatttaattaatatttaaaacactaattatgaatttgtttaattttttactaaaaatttatctgattagcacaagctttttgtaataaagtttacaaacctttttgtttgtacaatagacatttagctagatatcaaaatttaacatataaacaatagaaaacatttatgacaaaaaacaatttagaaaacatatcaaaaagcctaattgacacttgacattgttgaaactattgatttaacacattgtattttcatattatatataaatttatattcacctttcaaaaatacatttaataattataaactaaataaaaaatgtttgtttgacttgttttatttcagccttaaaaataaatcgaccaataatatttagaaagaaaatcttatctcaataatttaagttttgcttagatttaatttatttgttcacctcaatgcattttatacaaaacaaatattttatatttaatacatatgtgaattaaatattaccttttaacaaataatgtaattaatatcttttaacaaataattttacccactcaaatagtaatatctatatttccccccttcttccctttttatgaattaatgtatattttaaaaaaatatccttaagaccaccctttttcccctataaatactgattaacttgtgccttaacaaaaacaaaaaattattcgcaaacacaaaaaaaattgttagtgaagaacaaaatg

SEQ ID NO: 30810 - DNA, 3003 bp, Unknown
  misc_feature (1)..( 3003): 2750-1469P.txt file - cDNA_ID_3035794; gDNA_ID_2213640; Annot_ID_181183
gctttgattgctcgagctcaaaaattgaaactttagctttgggaaccactgtggttatatatttgctatatcagatacttataaactctcatctgtagttgatggttttgtttgtttgaagatttgctggttgattgttttttcttaatgtggttaatcagatgggaaaagcaaagacatgttaacaatgaagttaaatgaagatgagtggttagaatacgagagtgtgatgcaagatgttgtgaagagaagtgggcttaataagagcatattttatgatcttaggggtaaccatgacaactttggtgttccgtctgttggttcatctgttgatttcttctcaaagtatagcatcaatggacagatgggaaggaaaggaaatgttaacaccataactgttgaggttggttatgctctcccagcctggtctatagtttgttctcttgattattttggttgtgatgaaaagttatatgttacagtgtgctaacggttctgtgttttgttatacagactagcgaacgtaaacatctgtttgtcggtattgacaccacaatgcatattggattacgcggcccaacaaatctctttgggcatccaactgatgaacttttgagctcactcgactcacacctctcgcaatgggataaccaatcagcaaaacctgttgcaaaaatatcatttgggcatttcccattgtcattcacagcgctgtcacattctcaaaagagccttaaagatgtttttctgaagcactctatctcagcttatttgtgtggccatctacactcaaggttcggcaagaatcttaaaagacatcatcactctggtggtatcagtttatcagataatgacttgtttcagctgaatatgaggcagagtggtgctgaaagtacttcgaactgctcttttggagccttaccagctgcagagttctgggaatgggagatgggtgactggagaaaaaacagggcaatgcggatcatggccattgataggggtcatgtttcatatgttgatcttgacttcaagtcaaaaccccagaagactatcatattaccgacctttccattagattcacgttttatgtcaacatcctttgcacgtcacaaatacgagtgccaacatatgatctcatcatcgtatgacgcaataagagccattgttttttctcattctctggttgtggaagttgtagctagagtttatgactcaagccctggatttgataatctggtcatggaagctccaatgagaaaacatggaggcgattcttcttcttccggggcaacattcttttcacttccatggaattatagggcctttgaagatcccttacctgatagattttggctgcaaatagaagtcactgatatcaaaggcagattaaccttatcagaaatgcgaccattttccatcaatggtctaagctctaaagtttcatggacatggaatgagttccgtgtcatgggctgccagtgggcggcattatattacccgattctttggcctgctctatatagtttgtttctcgtttttcttatccccaaatgcatcatcatcgttttcaagaagcagtacactctcaagaagttcattgccaagaaaggacctatcacacttgtactgtggattctccaagacctctgcagaatgcctgtggtttggttcggttacatggcatacttgttctatctcatattctttccttggttctccggtgaagtgtttgctgattctggagacagagcatacatgactattatgggatgggtggtgacgagctcaggcgcagataggaaacatgaatacattggacaacctgatgtaatggttgtggtgatcccacatgtggtctttgttgttatccccagtgtcttggttgtgtgttgtctggttgctgagagagaaatctacaaagatcacattcgaactgtctctggtaagaaagaggatgaccatgaccggggaaggaagaagagatcacaacgccgctcactgttattctcgaacagaagactgtttcggaaatcggtcttgctggcttcattagctctatattggaagcatttcaaggtaccacttgtatattaactaatgattcgtttatttccatcttgcattggcaaaaacctgcgatcatgttcatccgttgtctgttttcattctgcattcacttctgaagtatattttgtttttattgacagaattgctgggcattaggtagagcttatgagatgaatgtggttcattttccaggttacagccttgtagttccattgttgctactatatgttatctgcaaaacccataaagttccatgagatttgaatctatggaagttttggtgtttttatgattttgattatgaagaaacacatttatagggggttttcttatgtgttgtttgatagagttgatatactatatagatcaagaaagttagaccaaattattctgtatccttttgcttttatttttttttacagctagaccaaaaaagtacaagtggttttgctcaatttggaaaaaaaaaacattaaaaatattaaaaaacaaaaatgaataatgacgtaagcgaaagcttctgtcatagtctcacagtcacaacaaaacagtcaatcccccaaagaattatggtagcagtcaataatcccataaataatcttcttcaacagtttttttctcttaaatttttgtttcgaaaaccgctcactacttcttaatcgaaatgactgactgagagctttagcttttgatcgttcgtcttcgtgattcctttcttcttcttctctccgctactgtctgtacctgaaactactgtcctcgatcgctgctttgtctttcgaggttctctaatttgttttttcttattattatctctggggtttgcttttgcgttaatcctctttctgctcgacttacggcgatttttgatatttgcagattaaaaagttaggtttttttttcgtaaatctactgtatatgttttagatgaccatg

SEQ ID NO: 30811 - DNA, 3000 bp, Unknown
  misc_feature (1)..( 3000): 2750-1469P.txt file - cDNA_ID_3035832; gDNA_ID_2936581; Annot_ID_194897
gaaaacttgtgtaatggcatatttagtttgcattttagacatcttgcggaataaattaatgaacaaatctgcaaataaacgtgactaacaaaagcccgttatttcgtgataccacaggtttaccaattagaccttttatcaactatcatatttttttgtttgttaaaacacatcttatggcttgtttgtgcagttccagtggtagagcgggtagctcggtggcatctgttccgaggacaccaccatttccaggaagcaacgctcggacccgagacagaatgcaggctcttcaagcctattaccaacagtcttctgcacagtcacaccagccggattcgcctatagtctctcgagggcctgtattcccatctggccggaggcccgctagaggaatagcttcagggatgggatcaacgtcatcttcttcagatcaggcaggtgggagtggttttatccggtttaacatatgggagagagatccttatatgcaatcacaacaagcctactcggttaatcagatggacagagaaccaaacatttggacatcttcatttaatgaaggatcaggaagcttccatcagaggcacggtggcggaggaggatcatcttaagaactgagtcagtacccgttcgagattctcaccggtcgggcaattctcatgatggacaaaaaaccaaaaaaagaaaaaaaaaacattgggaatttgatatttgagaaaacctgaaaaactgcatgctcaagttatgtgatgaattgataatctaaaaacacaaaatggtatgtaatggtttggagagagactgcctcccccagtcggtggtgtgacccccgtgcggttcgaggtctgggtatgaatcgggggagcgaaagaggtctttgggtatttgttttttaatgtggcgacattgggtatccaagttattaccctaatgaaactttctttcttctatctggttatgttaaattttaactgtcgagtttttcttcatattactatcccaaattttgatggtctttcttttgttttgttttttccctacaacataaaaattgacgtcaaatgaccaagactatagtctatacgtgacatcaaaatcgaacagtccaaaccaaagtcaaatgaccaagacctgtctatagtctataatgttacaacaaggccgccttttttcttctaattcagcgtcgtaattgcaaaataataaaatagtttaatagtaaaattgagggatacaaaaacaaaaggtagaactttcctcctccgattttatctcagcctatataaattaccggcgaaaggctttatttttcttccaagttttgatttttccaaacaatggtggaatcaaagaccaaatttgaagaaatcagaaaatgggtctccgatcacaaacttcgtaccgtcggtaattatccttgtttcttcttcttcttctcaacattccttttctcttgggtcgtttattgtgatcttagatttcatcgccttaatgtcatatagtagaattgattattaacttgttacggtttctgttaccgtcttggatttcctcttgattccactgagacatttttggtcctcaattcttaatgttctttgacatgcaaagatattagagaatgcattcccatctactttatttttggtgttttgatatttctttctgctaattctgaacctgtattgttttaatttgaccgttgttgaatcaggttgtttatggctaagtggtattaccggttctatcgcctataactggtcccaacctgccatgaaaaccagtgtcaagatcatccacgccaggtgaatcttctaatcaaaaggattgattgattataaatggttgaatgatttttttgtaaagtttttgagtctcatttgcattttgaaacattttctgtagccatgaacatttatagttgagcaacatcatcatctccatgtcccaaaagcatgtacatttctctgttcttgcctgtaagctatagttgttatcgacataaattttatgttcttagccaaatcatttgttcgagacatccagtcacatggtactgtacgaagcacttttctcaccgagcttcttctcaggttgcacgctcaggcgctgactttagctgctttggctggagcagccgtggtggagtactatgaccacaaaactgaagctaccaaccgctatccgaagtttctgccaccggaaaatttatctcacaaagactaaaaactctaaactcctaagctgcaatggttggttgcagcgttttctgtttggtacaaggtctcgtagctagagagaatttttgtagacctttcagggaaattttcatgtaattgacaaaaacaaatttttgcttattacagtatatcattcttttgatacattcagatggattgtcatgtgttgtagattgcacacaatatacagacttctaagagataatgtactgaaaacaaatccatgattaaattgaacaactagcatttgttggtggaacacaaaagaataaatatcctcacttgtctaacgagttgtgggagttattacaatttaaaaacaattgggattatttttggatttaacaaaagtttggggatcttgtggttatttatagaaatataaattagggcaacaagaccactttaaatgggcaaaaaccctagccatctgtttcattctccccaaagcaaaaaagacgccgctcgtctcttcagagaatttcaccttctagggtttgttcaaggtacacgctgctactatctccctttaatggaacgggcttcagtttctgatatagtagattcgatagacttgtctctcgagatgtgaagatggaatgagaagaaacgagtttttagcttcatttcctcttggattagcttcatttttcatctacttagagtgtaattgactatgttagattgaaagtcgaatctgcgatacagatctcacttcccattttccaggttttgagttagtcatagtagctagaaaatg

SEQ ID NO: 30812 - DNA, 3000 bp, Unknown
  misc_feature (1)..( 3000): 2750-1469P.txt file - cDNA_ID_3035832; gDNA_ID_2213641; Annot_ID_132281
accaattagaccttttatcaactatcatatttttttgtttgttaaaacacatcttatggcttgtttgtgcagttccagtggtagagcgggtagctcggtggcatctgttccgaggacaccaccatttccaggaagcaacgctcggacccgagacagaatgcaggctcttcaagcctattaccaacagtcttctgcacagtcacaccagccggattcgcctatagtctctcgagggcctgtattcccatctggccggaggcccgctagaggaatagcttcagggatgggatcaacgtcatcttcttcagatcaggcaggtgggagtggttttatccggtttaacatatgggagagagatccttatatgcaatcacaacaagcctactcggttaatcagatggacagagaaccaaacatttggacatcttcatttaatgaaggatcaggaagcttccatcagaggcacggtggcggaggaggatcatcttaagaactgagtcagtacccgttcgagattctcaccggtcgggcaattctcatgatggacaaaaaaccaaaaaaagaaaaaaaaaacattgggaatttgatatttgagaaaacctgaaaaactgcatgctcaagttatgtgatgaattgataatctaaaaacacaaaatggtatgtaatggtttggagagagactgcctcccccagtcggtggtgtgacccccgtgcggttcgaggtctgggtatgaatcgggggagcgaaagaggtctttgggtatttgttttttaatgtggcgacattgggtatccaagttattaccctaatgaaactttctttcttctatctggttatgttaaattttaactgtcgagtttttcttcatattactatcccaaattttgatggtctttcttttgttttgttttttccctacaacataaaaattgacgtcaaatgaccaagactatagtctatacgtgacatcaaaatcgaacagtccaaaccaaagtcaaatgaccaagacctgtctatagtctataatgttacaacaaggccgccttttttcttctaattcagcgtcgtaattgcaaaataataaaatagtttaatagtaaaattgagggatacaaaaacaaaaggtagaactttcctcctccgattttatctcagcctatataaattaccggcgaaaggctttatttttcttccaagttttgatttttccaaacaatggtggaatcaaagaccaaatttgaagaaatcagaaaatgggtctccgatcacaaacttcgtaccgtcggtaattatccttgtttcttcttcttcttctcaacattccttttctcttgggtcgtttattgtgatcttagatttcatcgccttaatgtcatatagtagaattgattattaacttgttacggtttctgttaccgtcttggatttcctcttgattccactgagacatttttggtcctcaattcttaatgttctttgacatgcaaagatattagagaatgcattcccatctactttatttttggtgttttgatatttctttctgctaattctgaacctgtattgttttaatttgaccgttgttgaatcaggttgtttatggctaagtggtattaccggttctatcgcctataactggtcccaacctgccatgaaaaccagtgtcaagatcatccacgccaggtgaatcttctaatcaaaaggattgattgattataaatggttgaatgatttttttgtaaagtttttgagtctcatttgcattttgaaacattttctgtagccatgaacatttatagttgagcaacatcatcatctccatgtcccaaaagcatgtacatttctctgttcttgcctgtaagctatagttgttatcgacataaattttatgttcttagccaaatcatttgttcgagacatccagtcacatggtactgtacgaagcacttttctcaccgagcttcttctcaggttgcacgctcaggcgctgactttagctgctttggctggagcagccgtggtggagtactatgaccacaaaactgaagctaccaaccgctatccgaagtttctgccaccggaaaatttatctcacaaagactaaaaactctaaactcctaagctgcaatggttggttgcagcgttttctgtttggtacaaggtctcgtagctagagagaatttttgtagacctttcagggaaattttcatgtaattgacaaaaacaaatttttgcttattacagtatatcattcttttgatacattcagatggattgtcatgtgttgtagattgcacacaatatacagacttctaagagataatgtactgaaaacaaatccatgattaaattgaacaactagcatttgttggtggaacacaaaagaataaatatcctcacttgtctaacgagttgtgggagttattacaatttaaaaacaattgggattatttttggatttaacaaaagtttggggatcttgtggttatttatagaaatataaattagggcaacaagaccactttaaatgggcaaaaaccctagccatctgtttcattctccccaaagcaaaaaagacgccgctcgtctcttcagagaatttcaccttctagggtttgttcaaggtacacgctgctactatctccctttaatggaacgggcttcagtttctgatatagtagattcgatagacttgtctctcgagatgtgaagatggaatgagaagaaacgagtttttagcttcatttcctcttggattagcttcatttttcatctacttagagtgtaattgactatgttagattgaaagtcgaatctgcgatacagatctcacttcccattttccaggttttgagttagtcatagtagctagaaaatggcttataaagtatatagagaatataggcttctttatttgtatcagtatgatttgtcaatgatctatagacacagtcttatggattgttttttggattttacagagaagtcttgggaaaatg

SEQ ID NO: 30813 - DNA, 3000 bp, Unknown; identical to SEQ ID NO: 30811
  misc_feature (1)..( 3000): 2750-1469P.txt file - cDNA_ID_3035832; gDNA_ID_2213641; Annot_ID_181254

SEQ ID NO: 30814 - DNA, 3003 bp, Unknown; identical to SEQ ID NO: 26681
  misc_feature (1)..( 3003): 2750-1469P.txt file - cDNA_ID_3035836; gDNA_ID_2213641; Annot_ID_181250

SEQ ID NO: 30815 - DNA, 3000 bp, Unknown; identical to SEQ ID NO: 10295
  misc_feature (1)..( 3000): 2750-1469P.txt file - cDNA_ID_3035840; gDNA_ID_2213641; Annot_ID_181247

SEQ ID NO: 30816 - DNA, 3000 bp, Unknown; identical to SEQ ID NO: 10287
  misc_feature (1)..( 3000): 2750-1469P.txt file - cDNA_ID_3035846; gDNA_ID_2213641; Annot_ID_181245

SEQ ID NO: 30817 - DNA, 3003 bp, Unknown
  misc_feature (1)..( 3003): 2750-1469P.txt file - cDNA_ID_3035856; gDNA_ID_2213641; Annot_ID_181239
ttcaaattctggattgtaaaaatgttatttgttctgtaggtaattgtgaatctaagaatgcgtttgtgatctgatttggaataattttcactatgtatgtattaggtgatgtaaagagtccaagacttgtgccaaagcctcatggagctactttctcaatgcaatcaccttgcttggaacttggattttctcagccaccggtaaaaacttttccgcattgaaaaacatataatgaataagcctatcatgagtttcctttaatttgtttctgagtatttagtgtttgttggctgtttactttggtcatttagatctatacaaagtatccctatggagaacaacaatactatggagttgtttcagcctatggatctcagagcagggtaatgcttcctctaaacatggaaacggaagatagtaccatctatgtgaactcaaagcaataccatggaatcataaggagacgccaatcccgcgcaaaggctgctgctgttcttgatcagaagaaattgagtagtagatgccgcaaggtaacatatagaaactagtttgatacttttgtgcaaatgagattttattactgaattagtgtgtttgcttttgttatgtatgttgcagccatatatgcatcattcgcgccatctccatgcattgcggcgtcctagaggatccggtgggagattcttgaacactaaaagtcagaacttggaaaatagcggaaccaatgcaaagaaaggtgatggaagtatgcagattcagtctcagcctaagcctcagcaaagtaactctcagaattctgaagttgttcatccggaaaacgggaccatgaacttatcgaacggattaaatgtgtcgggatcagaagttactagcatgaactacttcctaagttctcccgttcattctcttggtggcatggtaatgcctagcaagtggatagcagcagcagcagcaatggataatggctgctgcaatttcaaaacctgatcctttaccgtttcacagtcaaacggagagagataaagaactcttgccttggtataaaggattttcctttttgccaatccgctttggctgtgaacaggcaaatcatctttggctcattctctattaaggtaacttcgccgtgaggtgaaaaaagctttgatatatttatcttcagtgtaaaagtagttaaaactggtgaagaacaatgatgtgtttggtcactaaacccacttgttccaactagtagtgtgtgttttaagaaaactctgttatctgattttgtagctctctctggctttgtgtgtttctcaaacaactgtaacaacttttaagttatgtggtttatgtaacatatttaagacctgtgtttttgtatatttggtcgaatttatgttattatttgcttattatccaggacttatacagcaaagacagagtaaaaaaaattctgttccaaatctaatggttgatcaatctagctatcgatccgagatcgaaaaaaaatcgagcaacgttcaaccactcaactaagacattccatttgtcaacatgtgaaacgatatattatatatatcctaaacaaccatggttagcttttaaccgcagttaatgttacatgtattaaacgtctaaattataaatagatggcggttttttcccaagtaaatctgtagtgaaaaataaatgcggaaatggctacaaaaaacgtaaaatatttagagtaaaaaaaaataaaaacgtaaaatatttagcactctataatataataagattatacttgaaactgcatttacttttgtttaagaataaatattaaataaatttaacattggattaggtatataatctattgtagtggccaaaatctataatatctttaagttttagatagctatatgtgatatccatgatatgattaataatatattagcaaatatgaaagaaaatattcatattctattactatgtttttactgtaaaatgatcatgatttttttttgatatttatagcttggataaataatataatattataaaataattcgcttagagtattagtaatactgttttatatatttttcgtagggtgaaaacaatttttctgtaatatatatttgtgaagttttgtattattgtagatgaagaagatattgacactctatatacaggattatatgtttttgaatttgtttttatattatagatgtagtattatggttatgattgcgtttttaatttttgtgttatatgtttgtataatactaatgacaaaatctgtatatagtctagtaaaatttgggcaattatttaaatgggtaaaaagtcactatgataacgacacatcagcatgacaattttgttaataacacttgaggataaagtttattttatagaatgattatcaatttatataggggatatcaatcgattctgataattcatcttggttggactttggtcaattttggttttgtgttggtagtattgtctgaaaatattatgaaattccagctgggttgaattatcaaatgaaaacaaaaatctaaaaccgagtgctagacttattgttttgtaaatagttgattggtgaatttcgtataaataccagtactaaactcattggtccttgttcgactagttcttgttgaactggttgttgaccttgactagcagcccgattcttagcccgttttgattcattggccagatttggtagcttgggtttttggtgtcttccacctatcggtcttcgtggttcatcgtcatcattcattgtaaaattcctgaaatatagaacataaaaactaataaatcaaattaaaacaatccatatgaccttaattaattagtaatcaatattgtgattcccgtaactaatgtttagtaatcaagttaagagaatctagacctgtaccatgacttgatatactcctgtaactagaatatatggtgagagagacagaaaatacataaataagcatgttagatatatatattgattgtactatcattatg

SEQ ID NO: 30818 - DNA, 3000 bp, Unknown; identical to SEQ ID NO: 10301
  misc_feature (1)..( 3000): 2750-1469P.txt file - cDNA_ID_3035864; gDNA_ID_2213641; Annot_ID_181234

SEQ ID NO: 30819 - DNA, 3000 bp, Unknown; identical to SEQ ID NO: 10315
  misc_feature (1)..( 3000): 2750-1469P.txt file - cDNA_ID_3035915; gDNA_ID_2213642; Annot_ID_132310

SEQ ID NO: 30820 - DNA, 3000 bp, Unknown; identical to SEQ ID NO: 10319
  misc_feature (1)..( 3000): 2750-1469P.txt file - cDNA_ID_3035915; gDNA_ID_2213642; Annot_ID_181314

SEQ ID NO: 30821 - DNA, 3003 bp, Unknown; identical to SEQ ID NO: 26692
  misc_feature (1)..( 3003): 2750-1469P.txt file - cDNA_ID_3035923; gDNA_ID_2213642; Annot_ID_181312

SEQ ID NO: 30822 - DNA, 3000 bp, Unknown
  misc_feature (1)..( 3000): 2750-1469P.txt file - cDNA_ID_3035927; gDNA_ID_2213642; Annot_ID_132307
tgcgatcgcctctggttggaggcaatgtctgcaaaactttagtaaatacaatgctttatccaacatggaagcttttacttgtttctggctatatatatccttcattacaaggcctttcgatattctttaagactattaaagctgtatcttccatttttctgttttgccatcatcttcgttttctaccggatactgtctttttcacagccccaacagagactaagaactgatcaagtgaagagagagttctcatatcgtctggaggaaaatagctcgcagcttttcccattagtgaagtgaagagaagagagagcgaaggacgagttacatatctttcccctagaagatcctctaggaacccaaacgcagctagaaaatctgatcttcctgcgtttattggagcttcgaaatgagctgggataatccttttaaatctccagtcacgggctatctcatcgatccaatccctcacctgaatcatcagtgatgatcaaatcaaaacaaacattttggaaccaaaacaaagatttaaacagagataaggaaccttctcagggactttgctaaagaccaaagtctttacaatgggagaaacgatcagcttctgtgacattcgtgcgaagcttgcgtttggttccaagagattcgagggaccaagaaataggatttgcagaaccattctttcccatcctgcaagtggtaaaacaaacagaggccactgagatctaagatcaagaaataggaaattgacttttaagaactgctaacctttttggcgggtgttaggattatcaaccacaggatcattaggaatgtcttttcctttgctaagtatcttcacagctagtccattcttagccgaggccaacaaggattcgttgctgatactcgagggaggtttccgcgggacgaagatcacagcatcagtgactaaaagggttcttgaccgcttatggtagaacgctacttcgacatatggtccaattcctggatacacaatgagaaagtatgatttctaaatcttccaaccaaaccagattgaaatactgaaaggaacataccaacttctggggagcttaggactttctgttcgatctcctcagcccatggcgtagataagtccctgtctttgatgattttagcacgaaagataccgaaaaactcaagtggtaagttcaatggccagctccattgtcttggtgcaacccatacttgagccttggggaactttctagaaaaaggaccgacaaaaatcttgtgctcataagcaaacgttggcaggacaatgtactcaaccggagctcccaactccttaataagctgccacacaaaaaagagaagcgaaacaaccaatagagttcaatcattctctatttatcaaccactaagtgttacatgtcaatgtaagtagagaaatgacaacaaaaagtatgatactttgtcattcaacaattctttggagctactatattagtaaacacaaagaacaaaatagaacttatgttttgactgtcaaaaaaaaaaaaaaaagagaacaaaatagaacctggacacactctttggtgggagcaataggagcatgaacccataaacctccagattttagtttgatgacagtcattcgtatattagtggacacgctgctaaaccctaaagcttgttcttgttcaaacatccatatgcaacctttaaccgcctgcaaacaaacaaggttcaaaattttgtaaaaattaagagggattcgggcataattgacttgtgattctgaaattggagatgactgattaaagaaccctaacggaattgagagatggagcaaaagctaacctcggttctgatggtgcgccggttaaggaaaggaccaagaggaaaaggaaagccagtgaagttaatataaaagcgtttactttgatcgccgtctacgtcatcggtaaggacggtcttgctcgtcgaagaagcggagaccatcaccggactgttaaattcccggtttacggacatgggtcgacctaaattaaatgacccaccgagaaagttggtttttttatccaatggaagtttgggtttcggaagaaacgaagaatgtttcgggagatgaacggccatggccgctgccgccattttcttcttcgcttctcagttcgtttttttttttttttttagttcaggtaaggtttttttattattattgtacaatggaactagaagctgatgtctggacacgtggaccggtttaaatggatatttcatcctacgtggatattacaagaaatattgtgtggacataaaatgttactccgtttatatcattttgaaacgtcaaaagaaaggaaacaaattaagaatatattcttggtcaaactgaaaggaacattagagaactttctcaatttcttttttttaatttacacattttaacaaaattactaattcattcatgtgaattatactaaattaccaagtttaatggcggtggtcaagcttgcgcgtggaagctatgatggaaaataatagaacacgaaaagctacttgtcatatgtgacatggcattcaaaatgtgaaattccccaacggctatcaacagtatactgtatatagttacaacttttaaaagtatcatcgattaaacacatttttataagattcgttttatttcaatactatgttatttaagtaaataaatcctgactttatgattaagcaattgagaccaactggatgactaaaaaaaggaaattaatatccggaaaaaaggtaagaaatatgaccaaaatgaaaaggaaaatattacttttggttaattacataacgcttatcttgtacttttcgtcaacctcgaggtttaattaaaatttcgaaggttagtcgaaggaattacggatctagagagatcttttccctgaaaaagagacatatttatctctcagattgaacttcgataaacccatccccccccacaaacgacgactcatccttttttttttagagtactgatcgatg

SEQ ID NO: 30823 - DNA, 3000 bp, Unknown; identical to SEQ ID NO: 30822
  misc_feature (1)..( 3000): 2750-1469P.txt file - cDNA_ID_3035927; gDNA_ID_2213642; Annot_ID_181311

SEQ ID NO: 30824 - DNA, 3000 bp, Unknown; identical to SEQ ID NO: 10313
  misc_feature (1)..( 3000): 2750-1469P.txt file - cDNA_ID_3035929; gDNA_ID_2213642; Annot_ID_181310

SEQ ID NO: 30825 - DNA, 3000 bp, Unknown; identical to SEQ ID NO: 9287
  misc_feature (1)..( 3000): 2750-1469P.txt file - cDNA_ID_3035956; gDNA_ID_2213642; Annot_ID_181288

SEQ ID NO: 30826 - DNA, 3000 bp, Unknown; identical to SEQ ID NO: 9287
  misc_feature (1)..( 3000): 2750-1469P.txt file - cDNA_ID_3035956; gDNA_ID_1972053; Annot_ID_178373

SEQ ID NO: 30827 - DNA, 3003 bp, Unknown
  misc_feature (1)..( 3003): 2750-1469P.txt file - cDNA_ID_3035959; gDNA_ID_2213642; Annot_ID_132286
tgttaaactggtgggttattgtatcgaagatgatcaaaggctgcttgtatatgagtttatgcctcgaggaagtttggagaatcaccttttcagaagtaagtaaaacaactacaaccttcatattctaattacactgtagagttattttctttccttttctttgttttcgatttgggtaacaagtgtctacaatttagagatgtgtctactccatattgttaaagtgattagaatctatacagctaaaattggaacctttctgctctatatggtaaagttggtaccttttagtgctgtcttagatggtttatattgcttgactgtattgacccacgaagcaataagtaaatccctcgcattcattgtttcaagatttttcggcgtaaaaaatgtgtttaaaaagacacagtgcttttgtatgatttatcttctcagttatcattgatgcaaatctttttatttgtgaattaacttgtgcttcgtgttgaagggtccttgcctcttccatggtcaattcggatgaagattgcattaggtgctgcaaagggtctcagtttccttcacgaagaagctttaaagccggtcatttatcgagatttcaaaacctcaaatattttactggatggggtatgttttcctcttctttatatcaagggatcaacatcttatatacacgtctgtttctttgcttctaaagtcttaccatgtcccaatttcaggagtacaatgctaaattatcagattttgggcttgccaaagatgctcctgatgaaggcaaaactcatgtgtctactcgagtcatgggcacttatggttacgctgcccccgagtatgtaatgaccggtaagttttgttttttgtctttgcatttcattcactcctctacttatatcttctctgtatggttgaatatagaaaattagaaacctacacatatggttgatgcaaagtattactatgatgaaacatacatctaatttctttggtttgagattatatataactactgtcctcttattactccttaggtcacttgacatcaaaaagcgacgtttacagtttcggtgtggttcttctcgaaatgctgactggtagaagatcaatggacaaaaatcgaccaaacggtgaacacaacctcgttgaatgggcgagaccgcatctcctggacaaaagaagattctaccggttacttgatccgaggctggagggtcatttctcagttaaaggagcacaaaaagtgactcagcttgcagcacaatgccttagccgtgactccaaaataagacccaaaatgagtgaagtggtggaagtacttaagcctctcccacacctcaaggacatggctagcgcttcttactacttccagacaatgcaagctgaacgtttgaaagctggttctggttctggttctggtcgtggattcgggtcaagaaacgggcaaccagtgtttcggacattgtctagtcctcatggtcaagctggttcgtcgccttatcgtcatcagattccgtctcctaagcctaaaggtgcaactacttagattggctcgcaagtgtggacgcaagcaaacgtcttttttaaccgatgtaaaaccgacattgttaaccgatttaaagaaggaaaattaaggttgttccgaagaagatccgaatttgtgtatttactacctttgtgacctcatgtttcttcgtctgttgtaactcttgaacaaattgtctgttagggtaatattgtcattatgtattagtcgtttcgtatcgcttcaccagcatgcaaccaccacttcttcaatgtaaagatagatagatatcaagaatggtaatggaagatgtgggtgggggtgagagacattttgctttgaaattttgaaaattttcttctctttgatttttggacttatctacttgtagcttgtcgataatcgagttattaaaatataaatacgaaagaagaaaactgacaacttttcttacgtgaaacttttatactcacatacaagttatccactttcttggttaaacatgcgagccgcaaggaccaacgacttttatatacaaataatttccttataaaaaggattacagtaagatactttgcacactagcaagcttgatgattgtatatcaacatcataatttttcttattaagttatgataaaaaacattcaactataatttaaaatataatggaccgttccgaatttccataaattcggttaccacctccaccattttacatcaaacagaaaccaaaaaattagatttagatatatatatatatactagtagaagtagaaccatcttgttctcgtatattattacgaaaccctacagttaacagctgcagaataatataaataaagcgacactccacttttttctcctacattttgttgaatttgaacctttaaatcaatagtatataagaacatacaatgtaatagataacgcgtttactcaatcaaaaggaacaagtatatactactagataactcttgtttattggcgtctgacaaggctctgtagtatattcaacgatacgattatcctcttttcttcgataaaagtatattcgattctcttactacagaaacatagtttacattaatgttagtgaaaaataccatgcacggaaaatcaaagatttaattctgtggtttgtataatttgaagtgtataatgaaactattttttagcctaacccaaaaagaattaaaaagaaaaagtaattgttataaaaacgaaaagcatatttatcaaatattattattgaatattctccaagatataaacaatttgacttttcaatgaaaatgccactattgaataataaataggaaatttccgaggagtagtacaactagatgacaacttgacatgatcttcttcttacttttgtctatataacactcctgcgactttcttctcttcaacaaacttacagagagacaaatacctataataagccattcataatcttcttgcttcttgttcagaataatg

SEQ ID NO: 30828 - DNA, 3003 bp, Unknown; identical to SEQ ID NO: 30827
  misc_feature (1)..( 3003): 2750-1469P.txt file - cDNA_ID_3035959; gDNA_ID_2213642; Annot_ID_181287

SEQ ID NO: 30829 - DNA, 3003 bp, Unknown; identical to SEQ ID NO: 30827
  misc_feature (1)..( 3003): 2750-1469P.txt file - cDNA_ID_3035959; gDNA_ID_1972053; Annot_ID_178372

SEQ ID NO: 30830 - DNA, 3000 bp, Unknown; identical to SEQ ID NO: 10346
  misc_feature (1)..( 3000): 2750-1469P.txt file - cDNA_ID_3035977; gDNA_ID_2213643; Annot_ID_181364

SEQ ID NO: 30831 - DNA, 3000 bp, Unknown; identical to SEQ ID NO: 10339
  misc_feature (1)..( 3000): 2750-1469P.txt file - cDNA_ID_3036000; gDNA_ID_2213643; Annot_ID_181357

SEQ ID NO: 30832 - DNA, 3000 bp, Unknown; identical to SEQ ID NO: 10333
  misc_feature (1)..( 3000): 2750-1469P.txt file - cDNA_ID_3036011; gDNA_ID_2213643; Annot_ID_132325

SEQ ID NO: 30833 - DNA, 3000 bp, Unknown; identical to SEQ ID NO: 10341
  misc_feature (1)..( 3000): 2750-1469P.txt file - cDNA_ID_3036011; gDNA_ID_2213643; Annot_ID_181352

SEQ ID NO: 30834 - DNA, 3000 bp, Unknown; identical to SEQ ID NO: 10343
  misc_feature (1)..( 3000): 2750-1469P.txt file - cDNA_ID_3036023; gDNA_ID_2213643; Annot_ID_181347

SEQ ID NO: 30835 - DNA, 3003 bp, Unknown; identical to SEQ ID NO: 26710
  misc_feature (1)..( 3003): 2750-1469P.txt file - cDNA_ID_3036029; gDNA_ID_2213643; Annot_ID_181340

SEQ ID NO: 30836 - DNA, 3003 bp, Unknown
  misc_feature (1)..( 3003): 2750-1469P.txt file - cDNA_ID_3036031; gDNA_ID_2213643; Annot_ID_181338
tctccgaattgtacccatcggagcttcgttttctccggatcagccatacagagagagaaacagctccgattacaaccgaaactccagaaatcagagaaacggttactgaaccggtgatctgctgcttcttctcctttgcgtcgtcattgctgattacactagggtttggtttctggagttcttgagtaccttccggctttgcagcgacgaaatttggggttttgattttttcacacggcgtttgcaatgggaagccacagagatgagagtttccagcgaatgcgtttggtccttgattcaacagagatcccacctgaggtacttttccggtgagattgttgtgactaaaatctaagctgacgtgaactcgaaatcgaccgtacgacggtggaatctcgccggtgaattggttgaaagagaaattcaaggttccgacgaggcttccgagttcagtgagtgactcagggagtgaaccgttgagatgattggaggagaaatcaaggtggttgagtgacttcatggacttgatttgggccggtattgggccggagagtgagttgtgagagagatcgatgtaccggagcttggttgcttcgaagagacgaaccggtatggttttagagaaattgttgtgagctagatcaagccggtttagcgagttgagtaaaccgagttctgatggaatgtaaccggagagactttttccgaagagtacaagagttgtgactcggccgtttgtgcagacgattccggaccaatggcaaggagtcgggtcggattcagaccagtgggtcattactcgggtcgggtcgttatcgacggcggatttgagagctaggagagataaaccgtcggaattgagagaggagcaaaagctcatgcagagaaagatggaagaaacaacaagtgaaagaatcgatggtaacttcattttttgcttaggatataggaatcttgaaactttttggttgttaaagaagctacaaattacagatgattcatatagtgtgaggcaacgagaagttgcagaggaaaaacggtaaacagtgaagacgaaggagaagaataatgggagatttgaccgaggtatgattcttttatggtttcatgttagcaacgtggtgtaatgtagtcatgatcaattttttgaattcttgtccatatactatggtttgaaattttaataatatatacactacagttctaattaaaaatgtgatatattgggatttgcgttttgggtttttgacattttgtggttatttttgaaactttttgaagtttagttattgattgatgcaggtgggttgttgttacatttttaatttgtgtgtatccgttggtgatatctagggtcactggatttttatagcattaaaactatatataggtatcaaaaaaaaaagttacaacaaatttgggatacaaaaaataaacaaagtgttatcttaaatgctatagtctatagaatcttaactcgtataggacctcttcactcttgagccatgaaaaaactgtacagtcccactgggtcgataattgttttacttttacaagattcagcagtaactaaaaaaaggattaaaatatgtttaagaataattgaaaataatcgaactcgacctattgcatatgaatttgaattggatagaggatgtcatatttattcaaattaaaggagggaagagacggtagagagtggattgtgtcagagaaaaatcattaaccaaccgacaaagtaaccacacaaagatgcatttgaaaatatgccacttttggctcctctactcctagtcttaatgggcaattccgaaatatacacgaagagtcacaagtcccattgttgttgggttagcactttgtcacggcccaaattcaacttattcacaacatcaaataaatatatgcatcatatcatcacatccgacttttgttaacaattacttttttcagttaaagaactttcaagaggaaatagtagtaccttaaaatcctacaaaaccttgtcgtgcaagaactgggagggctacaaattgcggtcaatgtacgcaaacatcttaccgtttttggtacaaacactagaactccaatgcagtgagtgagatgggccaattttggcaatctcaatcaacggtccatgtggcccaataaatcactaaaaacggccgaatttttagatccatgtaacttaaataattggtggggacggaaagtcttgtcgttttcatttattcgagtgtggcactctgattcatctcaagcttattttttataaaaagagtaattttagaggctgaacaataacgaccttgaacaaaataaaataaaataagagggtgaacaacgaccagtcaaaatttgaaaatttactcaccagagtctataaaaattaaaaaggaaaggaaaaaaaaagaatgaatcatagtgaaatgaccttatttatggctccaactatagtgattagtaaccactaaaccagaaaaaaacaagtgacccattacacagggattaaaaatactaccgaataaagcccaataggcccaattcaaaagcgtctctctatcatcgtctctccaaaccccataaattggatatttcctttctctaaaaatttggctttattaacagacgcactccaaagctaacgttgctttcttcccactccaaatggctcttgtgctctcagaacacacacagatataataaactcttaacgaagaagaagactttttcttttcttgagcaagctctgagaaactcacagagagggacagagagagaaatatttcattcgctactctctttaataccgccattgatgcaacctccttcgcgttaactgtcaaaatactccccaactgacaaaaattaaattcctttttttctctctcgattttaaaagctctaaaaggaacgagttgatcaagtcggtcggttctggttatcactgaatttcattcaactcggtttattccggtttaagtgtgattttcccggctaatg

SEQ ID NO: 30837 - DNA, 2285 bp, Unknown; identical to SEQ ID NO: 10370
  misc_feature (1)..( 2285): 2750-1469P.txt file - cDNA_ID_3036051; gDNA_ID_2213644; Annot_ID_132360

SEQ ID NO: 30838 - DNA, 3003 bp, Unknown
  misc_feature (1)..( 3003): 2750-1469P.txt file - cDNA_ID_3036059; gDNA_ID_2213644; Annot_ID_181391
tcaaaacaattccatcatatttaagcaaaaaataactaattatagtatatgttttaaatgatttatactgtaatatttattattgtcatttttgtttgttacatacgtcttcgaattatcacattaaaagagaaaattattctaacgattatatattttcccaagactgcacccaatgttaaatctgatatggaaaataattttcttacaactttcagatttattttaaatataaaagttaagcaaaaactataatatatatatatttgagatttctatatgagataaagttctaaaataaattaaagtttacaaaggcagagaaatgaagattcataattaggtcaggtgctaagcacaatcctcctctaagaaaattttggtcgatacatttttagctgcagtattttatttcaccataagaattagtaacatgttggaaacaaaacgtacctgagatcaaaagaagagctagacagagaaatgttagaccatttttttcttcgatcaacaatgtctctctatatataccacattttatactattccctaatatgtaaaacgatattgccatttgtcatgtgattattattagggtgggattatctttgattatctttttgttataaagtcaatgcgacagtaatatgaaagacacaaggacgcggatacaaattataatctataagaaaagaaaaaaaattatttttaaaagggctaaaagaaaacaaggttattcaaataatattgacaaattacacttctcgacaaatttttctgtgttttttggtttctctattcgctcagattttgtgaaacgtctcttctgattttttattttttcctatcgatcggccaaaggtttttgaatagtcactttaagattcatttccaatcgaggccaaaggtttatcaagagtcgatagaatctgcggcattgacattcccccggaaacaacaatctctgcagatgaagaatgagtatacagtgttcagtatctttccacaaaataatttgaatgctatataacaaacgataaatgtatctagtatagacaattagattctgaaatctcaccaattccttcccggacagagaggtttggcctgataacgtcattactgttgacaagtagtatatctccaatgtaaaggtggttcgtgggaacgtatacacagcaaagttcctcctcggttgggtagttctgcaagaacgaatagcattattacattgggtaaaaagattacgaaattatggtaaaccatataactcgaaattgtttgtatcctcaaggagacgttctggaaagaataacaaaatccttgagcaaagtattttcactcacctggagaacaacagttgatgtaatgaagccaaatgcatattcacctacacggggatgcctgatgattgcaacttccttgaaagcttgtgtattttgatctgtgatgagaaatggataagaacaagatgagataggagatcaacttaatgttgagaagcaaaacaagatttttataagcaagctagaccaggcgatatggcagtgctgatttgcttggaggcgttgtagatgtgacgaacaaatggcatccgcttgataaaccactctcccaagttcagaaccgatgcccccaaccacgaagacatgaacaccccaaccaagaagatgaatgcaatggaagtcaaaaaaccgaaacctacaaaacaataatcaaactcattgtgggaaaccgatatcaagttgttaataggataaagaggggccattcaaattcttaccaaatatgttgattccaagtagtgcatatattggagagaagaatccatcgacaaagtgaataaaccaccatgttgtatagaaagtaactgcaataggaagtaggataacactgcaaaaagcaatggagacttaaaactaatctgtggaagttttcatcaaatgccaaaatttcaactcttccttaccagcctgtcatgaacttctttgacgcccaacccctaatgaacaagcttaaagtctgcagaaaagagctaaagcatcaggccacaatgctctataagttatacatgcttgaaaacatgaatgagcataatacaaagactcaagaatctgaatgattccaaccacaacaacttggaatgcaaattcatactctactcaatcacaactaccaaacttatctaagcaagtgttcttgtgatatactgaatctagggcaaaacaagttccaagattttgaactaaggggagacagaatcgaccaaatctatgaataactatcatccaattctactgttagtttcgcatgaatcttgaaatgagaaaacgaagaacacgtttttagatcaggtgacaaaaactagacctcgtggccggattgatgcgaagaagaagcagaggaagaagaagaaggcttcgaagaagaaccatcgtctttgtcgccgaaatcagcgacgggaatcagaagctctcgatctctttctcgattggccataacaattgtcgtgtaaagagagataaaaccctaaacctagaaactcaccgagagttcgaagattgtaaatcacaatctagaagctagttgcgaaacagaagaaccacctcgaagatcctgagatttgatgatgatgattgtgatgatgatgaatgacagatagagaagacgatgaaattgatttttgattcgatttccccaaatggcaaaagaaaagttccttacctgtaccgattgaccgtaccaactaccaaaccaacgaattgacttttacaaaacttaaaccgaaattaaagataattaaaccgagttattgaactaaaccagataatagcttaggttgaatcagttttaaaaaaatttgcgatacctaaggcccactaagtttttcacatcgtaaaaaggcctaaaataataagcccactttaatcatctcctcccgttatcagattaaaagatttgtttctccgagagcaagaaacctcagagagacgaagcacaatg

SEQ ID NO: 30839 - DNA, 3000 bp, Unknown; identical to SEQ ID NO: 21264
  misc_feature (1)..( 3000): 2750-1469P.txt file - cDNA_ID_3036063; gDNA_ID_2213644; Annot_ID_181390

SEQ ID NO: 30840 - DNA, 3003 bp, Unknown
  misc_feature (1)..( 3003): 2750-1469P.txt file - cDNA_ID_3036067; gDNA_ID_2213644; Annot_ID_181387
attctactccaagaattatttatattattatttttaattcatttttgcaaacgaaaaaaaaatccaccgtttcgccttctagtcgggattgaatgcgtcaccatgaaatcatgctttaatcatattctgcgtgagtgggaaaacaactatttataagtacatagtactactttttggattaaatatttccctccactttaaaccagaggtgcatactgcataatataggtaaccttcaaaaattgttagtattttttcttactctaacatgctcaaattacaagaaaaaattgcatatatgtatggtgatttaaagccgatcctttaaatgtttccacggttttcgttcatgagcctcattgtatatatataatatataattttagcacgttggaatgagaaagaaaattgataatggataagttttattaacataccaaaataataaacttgtttatgttacatgaagttcaaagaggtagcctctaaaatgaagaatacttaacagaataagcaaatatacatttttgttttccttatatttgattaatcccacaaagatacaaattactactattaattaagcaacttatcttagagggataagtgaaccatttgctttgaaatggaaaaactttgctttagttgatgtctatatatctatgaatttgtttccctaacatgttttttacgtcaatatttttaatctatatctgacacaatcaagtagacagttattatacctaacacattatcaggtagtctatagactctataccattttaaatgtttaacgcatgtaagttaatcacatactctatgatctggtggtttatttgttaaaagtgaatttttattctccaatgaattaatgatatcaagacagagcaacaactaattttaattagtttttttttggtataagaagagtcatataaacttttgagtcatttaaacgtaattagctttgttaaatgaaattcctttttaagtgggtacgtataaaaccctacgcaacgcatgttgatccatttaagtcaccatcaacaaaaagaattatataaatcattggttggatgaagaaattattatatgaacaaaaacaggacaaatatcttaacaaaattaaattctctgaacttatcgtataataaattagtaatttaaatcacatcaaactgaactaaatatatggaattaaaagggtttaaaatacatttgataatttgatgtaagaaatatgcatagatgcaaaatacttgttatatatgtgggaaatatcaaaaatttatattcgaatatgttatacaccgtacaaaaaagtcttcgaatatataacccgggtcaccttttctcttatggcaaaaaatataaccccttttctgtttctaattttaaaattttgcattcttgattctgagctcatagttcgatgaaatataatctagagaaaaaaaaaaaacataattcgattaaataacaaaagcacctttccctccctactttatgcataaagctaaagcatggacaaaaatgaagtatagaaaaatgaattactgattataacagtctttcttaattaatctagtaaatatttatacatagtactgtattacataaacttacacacttaggtttatctgtatcatggttagattatcgtaaagactaaagactataatattgtgttcatgaattagaaaacttattcctccgttcatccaaaattagttaatcgttatatcgaatatggtccatatgggcatccatattttcagaagaaaagaaaaaaagaaagtaaaagcatgttaggggaaaaaataaaaaataaaaacagagaaaaaaaatcgagagagggagagagaatggtgttaaatacataaaaaacccatcattgacatgtatcgattgctcaatttgtttgtctctctcttcttctttccttttctccaaaaactagagcctaaactaaagcatcgagaaacaacaaatcttaaaatcttttcatattctcggttagtagaaactaggaaaagagatgaatagaggagtgttggagagttcgccggttcaacatctcacggcggctggaaaccctaattggtggaataatgtcagccgcggcttgaggccaccaacgccgttgatgagtcacgagccgccgtctaccaccgcttttattccaagtctcttgccaaacttcttctcttctccgacttcctcttcatcttcttcaccttctttccctcctcctaatagtaaccctaacttctcttcttggcttgaaatgagtgatctgcctcttgatcagccatggagccttagtcaactcctcttgtaactccctttctctctctctctctctctctctctctctctctctctctctctctctctctctctatctatcgttcggatgttttctatgtataaacggttttgagttcttggatttgttttgtaatctaattcgatcttataaagtttctttctcttttttttttctttctcatgtatacataatctacttatattatttcatataaacaaacatgatctaatatggattgtctttgaatgaaggggtggattgatgatgggagaggaagagaaaatggagatgatgaaccatcatcatcatcaaaatcaacaccaaagttaccaagcgaagaggatacaaaattgggaagaacaagttttgaggcaccaagcttccatgaaacaagagagtagtaataataatagttatggaataatgtcctcaccaaactcacctccaaacaaatcttgtgctacaattatcaacaccaatgaagacaacaacaataacattcacagtggtcttaacttgtccgaggtgggtcaaaatagtgaattattcagatcaagatataatctttaccaaatattaattaacatctccatattttttctttatcaatgaatatatctgaattttgtttctgtctatgtgtgttcatgaagtgtaatagctcagagatg

SEQ ID NO: 30841 - DNA, 3003 bp, Unknown
  misc_feature (1)..( 3003): 2750-1469P.txt file - cDNA_ID_3036077; gDNA_ID_2213644; Annot_ID_181383
agaaaagatgtggcgaagagaagtgaaaagggcagccacgttaaggcatttaatttgaataataataagactaaaacaaaaaaaaacgtaaagccttttgaggttatgaatgcgaaaatggtccctcacgagtcacgacctaatctcattgaaatttatttagcattatattgcgtcgtgtctcattacccttttttgcttctcattattacttaattattattattctctatatatatttctccactaacctgtattagttaataacctttcattgcttttgtacggtagatcataatatgctaagatgtttcaatgattgaaaactcaacaaagaagacatagaaaaccaatataactaactagataaacatataatacaagtagttatttctaatatttgagtgactgcaaccgatatacagaagcgttctaaattttattaagacaatcatgtttgaaatgatgtcaataagaatcatgattcaaactttacaacgtaacaatattgcatgcaaaaaacaatttagttacgaatgaaccatatagtctcgaatattagtttatgttattataaattatttagaccaatattggttatatttattacataaattcactagaagtctgaaactgattatttatttttatagtgtgtttttatctaatttttatttttagtgttggttatatacaatataatttatatagagaaaaattggtaccggtggaaagtccaccatcgataaaaactgtctgatgtccatccaaaaactaagccgacatagagttgtatttggtcggtatattagacgtacatgtatatttatctttccataaggtttcttttgaatataaagttgtgtatccaaatgcagattcttttatgctttatcttaagtcatcttcgcattttattttggtcaaaagaaagttagaagataagagaaagtttttgggtcacacatacgaaagaaacgtaaatggcttctcatgcctaatagcgctttctacgcttgtggggtatttgattggatatacgtcacaactcataatacgtagttgtttactagcttatctgtacatggactccacttctatatgatatatatagaaatgccactaatatacgtacgtatccacaataagagaattataatgaatgtgagattggtaagtagtatcacataatttaagggtgtgaaggttaattaacggtaggttgttctatattatatatggttactcacgtaaagtttttaacaaaatatacaaattttaaaatgtattacttaaccaatctctgttctcatgagagtagtttcgcttattcaaactgctaccaaatattatctagtagccttttctaattggtatacaaatacaaattacacgatgtgatagacactttattgtttgtgcatactacctttagagtaggcactagccaatcatgataaaaatggcaaatctaaaaaatattaagcaacatggtaaatataaaagatttaggtgacaaaactgaaaacagaagaaaaaacttacgttttaacaagtgttattaaatgctggttttggactaaaagaggatatgggtttaatgaaaaaacttaatttttaggaaaaaaaaaaaggtggaatttgagtagaatacaacaaaaagtcttagagtttgattggtaacacaaaactttagctgttacggaataatgtaaaactgtacaaaagagctgtaaaaaaaaattgtatcaaaaagctgagagtaaagcttttcgtaacgcttttgataaagtttttgtaaatggtaattgtcaaagctgtacaaactgtactgttttgataatgggttaccattcaaagctttaaattttaaatcgcatgataacctgtaaataattattttgaatatatgttagactttattattattggttaactatgttctcttgattgaaaaaaaaatagatttgtaactcattgctgttttttttttttaagaaacaaatagagaactatataaaaatataagaaaacgttggttttgtccaagaaaaaaattgttgggttttggtgggtggcaatagaagatgccatgtacatagtgggaacaagtagccttacgcccataacatgtcggaacatcaccaataaatttctatgttcaaaaatatcattgtaacaaaaagtttttcgaatttcttctcccaacccaccataaaaacccaatcaaatgcatgtgaatgttcttgttcatttgatgaggtcaagatcaagaagccatgtaatctagaatacaacagtacacatgtgacttgttacagttttgaactctcgttcacagttttgcaagttcttaccaaagctatagatgcctctcatcccatgagccttcatcacctgatgggcttattaggtttacaggcttgactaaactctagagcctatacgtatagaagaggcctgactaaacgaagataatgaaataagcccacaaggcccaaataattaatatcttttattctttttggcaaaatgaaaaatctgacttatgggctttttaacatttacacatttaacttcatgacccaatgaagacccgacccgtctggtaatgacccgatccaacacatgagtaaaccttcactgaaacctcgaaactcctccagaagcctaaaaccttcaccaccaaatcggtgcctccttgaatagtcgccgccgtcgtctatcatcgccgcttgtgactccggtgagtattcttctgctctattgagtttattttggttgaagctctatgagatgtacgtgggtctggttttcatttctgtttcttaatcgctcgaattagcatttgatagctactgagattttgagttttctgatctgccgaataatcttcgccattgtagtgtagatgttgtgtgccttttgattagattacactgagaaattggattgttttcgtgtttgtagatgagaagctaggttattgaatcagagattatg

SEQ ID NO: 30842 - DNA, 3000 bp, Unknown; identical to SEQ ID NO: 10355
  misc_feature (1)..( 3000): 2750-1469P.txt file - cDNA_ID_3036081; gDNA_ID_2213644; Annot_ID_132345

SEQ ID NO: 30843 - DNA, 3000 bp, Unknown; identical to SEQ ID NO: 10361
  misc_feature (1)..( 3000): 2750-1469P.txt file - cDNA_ID_3036081; gDNA_ID_2213644; Annot_ID_181382

SEQ ID NO: 30844 - DNA, 3003 bp, Unknown; identical to SEQ ID NO: 25306
  misc_feature (1)..( 3003): 2750-1469P.txt file - cDNA_ID_3036085; gDNA_ID_2213644; Annot_ID_181380

SEQ ID NO: 30845 - DNA, 3000 bp, Unknown; identical to SEQ ID NO: 10352
  misc_feature (1)..( 3000): 2750-1469P.txt file - cDNA_ID_3036089; gDNA_ID_2213644; Annot_ID_132341

SEQ ID NO: 30846 - DNA, 1737 bp, Unknown; identical to SEQ ID NO: 484
  misc_feature (1)..( 1737): 2750-1469P.txt file - cDNA_ID_3036089; gDNA_ID_1591388; Annot_ID_150910

SEQ ID NO: 30847 - DNA, 3000 bp, Unknown; identical to SEQ ID NO: 10364
  misc_feature (1)..( 3000): 2750-1469P.txt file - cDNA_ID_3036089; gDNA_ID_2213644; Annot_ID_181378

SEQ ID NO: 30848 - DNA, 3000 bp, Unknown; identical to SEQ ID NO: 10350
  misc_feature (1)..( 3000): 2750-1469P.txt file - cDNA_ID_3036093; gDNA_ID_2213644; Annot_ID_181373

SEQ ID NO: 30849 - DNA, 3000 bp, Unknown
  misc_feature (1)..( 3000): 2750-1469P.txt file - cDNA_ID_3036118; gDNA_ID_2213645; Annot_ID_181418
ttttgggattttttaaaaaaacattattttattattaaatcattgccaacaacttcttttttcagtattgttttttattatttgaccatacttaccatgttttcatacacctggagtcgaggctaaaattttaaattttagaagtaattactctaaataattgaaaattattttaatgctcttgtcctaaataggcaattatcatttgccatgcattacaatgtcaattagtatcttattaccagctcgagtcgtggccgtcttctgattatagagtgccccatttattattttgtcggtccactacccttgtattatttttgctgccagaggctgcaggccttgcatttttaattctctcttgagaaagagacttatcgattggcaaaatgtcgtcactttaaattgtatgcaaagtaacctatcttgttagtaaaaaatgcaacaaatttttgtttatacatatgatagacgataatgttttggatttcacaaaatgaaagagaaaagaaatggaggcacacgacccccttagggtttctagattttgaagggattttttggagatgaatcgaagaaccggtgtttaaaattaaaatgaatgataaactcatgaacactagattttttttggtttctctttgttgaagtaaaaagtttgaagtttttagggaactttctttttatttttaacatgttacctagtggccaattagagtcacattgatcgagcttaaatttggtgggatgtcaacaaaggtaaaagcaccagtgcaccactagcctacttgttaaagcaccattagcctccttgtttcttccaagatttttagggaattcatttttcttcaatttgtttcatagagtcaaagtttgtgatagtcgacgaaaaaaatctttgtaaaaagatccaaaaaacgaatttggcgtatatttttgaagatgatatacaatcaaagactcaaagtaaggaaggtaaaaattgtagaaaaccaagatgataataatatcttagatgtgtagaggatcaaaatgatatcacgaagatgtaaatatttgttttgtatttatgtagtttaaaatgatataactatggattttatgaatttgggcttttaaagttttgaacccaacgattaaaatgaaaatccataaaatctaaaacacatacaaaaacaatatccgcaatgatgagaacacgtgtcaacgcactgacgaaacatagtcgctgagtccacgtcagcatcttcgccgtctcttccaaccccaacgacggtttaaaaaaaaaaaaaacatttcctctcaatttttttttcaatcaaacaaaaaaaaatcatcgctcccaattttacattcttcttctcgccaaaccctaattgtttcgatttctgctacattcttccggaaacttgttctatctctgacggatctcgaatcggtattctcagctgctgaaatctccggtgagcttttccatactgtggtcaacttctagggtttcgattatcgccatttaatgatcgttttatttcatttcgatccctttcttttgattgatttttaggctaaaaatgtcaaattgatttgggttttgtgtgttatgtggtcaagtttatagctttttttttcccggtatcgtttccaagaaaatagaggaatttgagctaaattactctgcaactttgtttcagttttcatgtgtgtttcgatattggttcgatattggttaagtagagatagtaaaggtgttgtctttagggaatgtttcggatctaatttgctagaaactagaaagtgttgttagattgtctaagaacttggaaaaatcttgatgattgctagcggaatgcagagaacgttgttgtgtttttgtatcagaaggttaagtagagatagtaaaggtgttgtctttgggaaatgtttccgatctaatttgcaacaaactagaaagtgttgttagattgtctaagaacttgggaatcttgatgattgctagcggaatgcagagaacgttgttgtgtttttgtatcagaaggttaagtagagatagtaaaggtgttgtctttggagaatgttttggatctaatttgcaacaaactagaaagtgttgttagattgtctaagaacttgggaatcttgatgattgctagcggaatgcagagaacgttgttgtgtttttgtatcagaaggttaagtagagatagtaaaggtgttgtctttggagaatgttttggatctaatttgcaacaaactagaaagtgttgttagattgtctaagaacttgggaatcttgatgattgctagcggaatgcagagaacgttgttgtgtttttgtatcagaaggttaagtagagatagtaaaggtgttgtctttggagaatgttttggatctaatttgcaacaaactcgaaactgttgttagattgtctaagaacttgggaatcttgatgattgctagcggaatgcagagaacgttgttgtgtttttgtattgtgttgtcaatttgattggtcaatcttgtagttttttccgatatgggttcgaagaaaagaagggaatttgagctaaattactgcaactctgtttaagttttcgatattgattcacaacggtcaagtagagagatagtaaaggtggtgtctttggggaatgtttcggatgtaatttgctaagaaaatcagaaggtgttgtttgattgtttaaaaacttgggattcttgatggttgccagcggaatgcagagaatgttgtcgtgttgttttttgttgtgtggtcaatttgattggtttttgtgttgtttggtcatgtttatagcttcctcctatatcgggaaaagaggagaatttgagctaaactactgcaacttgtgtcagttttcatgtgtgtttcgatattggttctgtatggttaagtagagattgtaaaggtggttgtttttggggaatttttcggatctaaattccaagaaaacttgggaatcttgatgattggtaggggaatg

SEQ ID NO: 30850 - DNA, 3003 bp, Unknown; identical to SEQ ID NO: 25310
  misc_feature (1)..( 3003): 2750-1469P.txt file - cDNA_ID_3036122; gDNA_ID_2213645; Annot_ID_181417

SEQ ID NO: 30851 - DNA, 3000 bp, Unknown; identical to SEQ ID NO: 10385
  misc_feature (1)..( 3000): 2750-1469P.txt file - cDNA_ID_3036175; gDNA_ID_2213646; Annot_ID_132388

SEQ ID NO: 30852 - DNA, 3003 bp, Unknown; identical to SEQ ID NO: 25314
  misc_feature (1)..( 3003): 2750-1469P.txt file - cDNA_ID_3036185; gDNA_ID_2213646; Annot_ID_181449

SEQ ID NO: 30853 - DNA, 3003 bp, Unknown
  misc_feature (1)..( 3003): 2750-1469P.txt file - cDNA_ID_3036189; gDNA_ID_2213646; Annot_ID_181448
tcggtttaagaagtgtttacgtggttatcaacattaacttttgaattgaattatacgaaacggcaaaaagattatcaaaagtgttgacttgtgagctaccgtttttgccccttaaaagtctcaaattccaaggcgataaatggtcaagcaccctccacgctcctcctgtcttttattgccacgtgtctaccaccgttcccgtctgaatttgtcagcatctgtatgccacgcggcggccagtttccccgacgttaatttctccggtaattatcacacgtgtcgtgtagtcaatggatattaacttcgagcttattttatggagtttttaattgttttcaattagcgtttttttctcattggtgggtccacagattaatggaactaacgaaatataattggtgaatgaaaatgtctgtttcattgaattcatgcgtttctattaaagaagtcacagtttttaaaatgggttcacgtggtcgagtacttagctcgtgagccggcttcagtgtccatagtgtattactcagctttgtaacaacattattagagagaataattcactttcattgtataaatgacaaaaacaattaataccaacttgttttgataattacaaagtaacaaaatagaagcattcagagttttgaagttatatattcatttgaaatgtcttgaaaaaagttatatgtctttctttgacaaaacaaaattcagtaaatttcaatcaattatatatttttaaaagtactatacgcacacaattctttatacaacgacaaaaagaaattttacatctaaaaatttcgtatatagataaattaacacgtttgtaaaatattgaataaatattattttgtcactatatacacagtaatcacatgtaataaattaaaatcaatcgatatgtttcgttagatctctcaatagataattattgatataaactagtacgaaaataacataacatacacagttacacatacataaacatataatatttgtaccaaaattattaagaaaaagaaatttaaagctctcaatcaagagattttgtatgatatgaaatattcttctgatttttgaaccattttgcattagagaaaagtaaataaaactaaagtggtcctggaaacataaaaaaataaaataaaaatagagaaagaaagagatgctattcctggagactgagagtacagtggaggtccatgacatctcgtaacacccaacaacactcaacaacttgccaaattagctttcactagctgttgttatacattcatttcttaatttaaattggaatatcataaataacaccttataacattataaccaaagcataaactacatgcatatattcttagaagacattaactttttaattaatttccgattatagtgtgattacgctccttgcaaatactctacaagctatgaaagtaaaaaggtattggctactttcaccgccgctactatatctcgtgagtcgtgagtgaagccaagccaggctattattaagttgtgtactactcattccgtaaaaaccaaactgaaacagaactattccttttatagttaaacaccgaatttaattctaaactcaatcgtattaaatgagaaacgtaccattactttaaaactcaaactgaaactaaactaaaaatccggtaaaagttcttttactcatatcattggaaatagtttttgaagcaaagtaaaaaacactagaatagtgtaactagaaggaactactaatataaattttggttgctggtgagattctttttcctccttccccagcggacgtctccgtctcttcttctgcttctaacttgctccaaattttcatttcaatttttttgataggacttaaaaattccaagctcgcttatgagagtaatggcgtagcaaaatctttatctaactcttggctcttgtctttttttgtttgtttctcaacctacgccggatcttgcttcttcgaacttctccgacgcatcttcttcagattccgcagaagtttgcgtcgttttcttgaatccactcaaaattttattggaagtttgtgttgtttttactagctctgaatctttagagggctcaaaaattcgtcgagaaaaccagtctttggaagtgtagcattttggattcgcttgtgacttgaatcttgaatattaggtgaaaccgccttggatcttctcgttgatctttgtcgtggacatttttttttgtaaagcttagtagattctctaatatttaattagagagtatctgttcgtgttattctttattgttagataatgattaatcactgcacacaatcttattgaattttcctgttgcttttctcggcttgaattctgaagaagtagttagagagatggctttgctatatactcttgctagatctgtttgatttcttagattcctgatttaacgatttccttctaatttgattatccaaaatctagaaatggtaaaagtttcttgagttaaggttcatttattttacatttgactgtagtttttttgtgtgatttagatgcagacaggaccatgttgtgttttggattacttgagagatttactatctcaatagttcatttcatcgtacataatttttttttgtgaacttgtttaataggaatgatgatgaactattcttgttttgtgtgtatagtttgaagatggtaactttatgaattaattatttattacttattagattctgcagttgcgtcttcttgattcctaataaacaatgttaaagaacacacttttcatgcttcctatcattagaagtgtcaaagatgctgctcttttttaatcatttttcttcttacctgctgtattaacaatttacgtatatccaggtttctatttggtcaacaacatcagaaacatgtgtgctcagatgttgagctctttagattcaattgttgtgaacattgtcaaggagaatagtgattattgaaggatgcaagatttttatattcagctctaatg

SEQ ID NO: 30854 - DNA, 3000 bp, Unknown; identical to SEQ ID NO: 10385
  misc_feature (1)..( 3000): 2750-1469P.txt file - cDNA_ID_3036193; gDNA_ID_2213646; Annot_ID_181446

SEQ ID NO: 30855 - DNA, 3000 bp, Unknown; identical to SEQ ID NO: 10382
  misc_feature (1)..( 3000): 2750-1469P.txt file - cDNA_ID_3036204; gDNA_ID_2213646; Annot_ID_181440

SEQ ID NO: 30856 - DNA, 3003 bp, Unknown
  misc_feature (1)..( 3003): 2750-1469P.txt file - cDNA_ID_3036229; gDNA_ID_2213647; Annot_ID_132399
tcactactttaggcccaataatccagaaccgtttatttattaggcccagtacagttgatgcgagaggacaaacaagaagaaacgtcgtttaatcagaggtcccctttgcatctttttttccggcgagttttcaattttgtaaagttctaagctttggtatgtttgtatcgatatcactattataattcgatgattgtagaatttatgatcggaatcttttattctgtggaattccggtgagtggtattggaacaggtttcctaggatcttaatgggcttgtttcaaaaggtgtgatattgaaacttggagatggttcttcgtatttctaggtttcttttcttctgctcagattcgaaattggagtcttaggttttcttaaaaaagttgaagttatctgatattatattcttaagcttcatttattcatatagatagatagagagagagagtgtgtgtgtgatcaagcgtagagctcaatgccccaaaacttggctgtttggtgcgtgcggtaattcctctccatgcttttgatcacttccatgtcctctttcgatagttggaagtcgaaaacctgaaaattctcttccaatctttcaggcttcgatgtctttggtatcaccaccgtgttcctctgaattccccacctcaggacaatctgtgccactgtctgtttgtacttctcggccacatcctatgaattcagacagacaaaaggtttaattatttaactgtttcagtccaaacttttaaggtttagaggatggggcttactttgagaactgggtcatccagacatgacacggtgccaaaccattcggcattggctgtggcacctcccagaggagtatgagcagtgacacagataccatgtttctggcagaatttgactagagaatcgcgttggaagtaaggatgtgtctcgatctgattcacagcaggtttgatcttggagtaagccaagcaatctctcgttagaaagacatcatagttactgcaaaaaacctaatggtcaaataattcatatattggcgactaaacaagagaacttgtaatgatagtgagagaagttgaacctgattccaatgctgcggactaaacccatagaaacaagcttttccatgtcgtgccatgtagtttccagagagattgttgtatctatgtccaataccccatcatcccccaaagcactatcggttgttcctattcctgcacaaggcttacatgttacagcttattactctgtgtgccaattgctagagacttgagaaaacttaattttccagccagtaacaaggctgaaatgcaatggtctctactcgaaactgataatattcatgaacaaggctgaagcctaacccgtgtgttttgtagctatgggtatatgaacgaggaaaaggtcgaggtaatcaagttgaagtttcttgagactgtctttgcatgcctcaataacatggccatggtctgaactccatagctgcaaaaccaagacagagagcattcgatctgaaatgaactgatatcaaaggtatgtagtagtttaacttaaagccgtttggaccttagtcgtaatgaagagatcctccctcttgacaagacctgtcgtgaatgcttctgtaagagcctcaccaacttcagcttcgttcttataattagctgaaccaagtaaccccaaaagatactcataaatcaggatacagaacaaagcaactcactcacatgcaaagaaacaaaaacaattgtctgtgatacagcaaagacttaagatcattctacgattccaaatttccaaatacttaaaaacccaaatcttaagacataatttccaagtaagattccaactttcaacaaattaaaacaaaacctaatattttattcacatatcctgacaaacccgaagcaacaaagatcagaaagaaaaggttttaagcagtgttaagttataccagcacagtcgagatgacgataaccgatcttgatggcatcgatgataaggtctcgaagctcttctttctccattctccaaactcctaagccgatgatcggcattttgaagccactgttcagtgtaatctccatttcttcttcttgcttctctcctcaatccgtgattgggtagatatctgctcagaattgagagtttcccagtatggtaagttggtaacgcacacgtcaatataaagtggtcatgattcctcactattcgaggcccaatgggctagtaccgttttttgtgaagcccaaactgttttacaaagacatgaatcaatacgcaccgtatgggtatatatatatacaagcaacgttatcacaggtcctcaaagtttgcatctttacttgggttgtgtctggaatcaattacttcctaaaggtaattttattggtcgggcagctcaatcggtggtttctgagttcttattcttctctgataatctcaagacgagcttttaattttgtaaagtttttagctttggtattgtttgtatcgatcccactctcaacttttgatcggaatcttctgttctggggatttccggtgaattgtttaggaataggtttccaaggatcttacttgggtttgtttcaaaaggtgggattttgcaagttgtagatggttcttcgattttgtaggtttctattcttctgctgagattcgaaattgaggtcttaggtttttgataatagcttgtttagttatctgttaaagtcactaactttgatgttccttccggtcggaattgttggccacaattgattattgaaacccttaaattaaagagtgccctctttttctcttttatgatttggatctcttgtaattgacttgtgtgaggtttctttttctgtaggttgccatttgttaacttactctgttagtctactaccaccaataactatggtaagtgtattcaaagctttcctttttaaccgttagtcttcactctagcttttatatctcgcacccttggtttgtttgtctaaacctttggaatttaaactcgatg

SEQ ID NO: 30857 - DNA, 3003 bp, Unknown; identical to SEQ ID NO: 26717
  misc_feature (1)..( 3003): 2750-1469P.txt file - cDNA_ID_3036249; gDNA_ID_2213647; Annot_ID_181501

SEQ ID NO: 30858 - DNA, 3003 bp, Unknown
  misc_feature (1)..( 3003): 2750-1469P.txt file - cDNA_ID_3036252; gDNA_ID_2213647; Annot_ID_181500
aaacgtactgatgatcgtgcagaaatgtaaatgggggcaacaatatctctcgattctacttcaggtttgttgttttatacgacgcgcaagagtttacggttttggtttttgataccagcatcacaacgaagtagatttgatagagatagtcgaaacgtgtgaccgtgtccgtgacgtacacatctctctatataattaatacacacgtgtccgagaatgttacgactcaaccgtgttcgagggaagaaaaaaaatatatatatctttttagggagcgagtccatggagtatcgaaccctgctcttcagagccaaaagaatagtgtctgaaccactaggctgtgagtaactttttgcaatttaaaaatcaactctttgcttagatctgatctcttcgaccatcggaagttgaaaccctagtttctttgcgagggtaaacccagaatacatctaagagccaaggaaggtaatgtattcatttttcaacttatcttgtttgtatttggaagaaaagtgagagttctagtcttctagatgttttatattgttcttcatttactcaattttttcacgcagtgcaaacattattctcaagatgacacagagaacttcgagtcagatgagtacagagaaaaccaagaaagtagcagagttaaaccagactcaccggttaactatcaaacctacttgcagtattgtttgtttgaaaagctgcatgcgatcattcatcttaattgttcggtttcttactcctctgcaaatcatacttattaccataacgtgatctagaagtttcaacaagaggctgatgcatagaaagctgatgaagaagctgaaactgcgggtaatgtaagaagtcactgctttgctcattttatcatatgctttagtgatgaacctcctttttgtaaaatcatatttgtttgtccggttctgtttgtgcatgtatattcagcaactacgatttgtcgatttaacctgaaaatttgattttttggcctggttttgtttcaaccaactggattagtttactcaaaattcatttcagaaaatgatcatttaaatgttgtggttcttgcaggcgaaatgcgaggaaacgcaggtgcgaggtgtgttgctcaagtagaaaccgagaacggtccaagatcagaccgtacagagttccaacggtggattatttagcaagacaaattctgggcttctttttgattatttagcaagacaaattctgattttcaagacttgatctagaatgtaattactattttttgtccaactggatgcattttgtgggttacattattgtattgaaataaaatatagtgtggttatgttgaaaaatgattagagcaatgattgattaaaaattctactaccagaacgaacgtactaaccaatcataacacaactgatcattacgaagtctaaaccgaaagtcaatatttcgtgctgttcagattcaattaatgaaacttgtctaattttcttttgtcaaaattcactatctgttgatttctgtaatataaaaatggatatatattgtgaaagtaaaacaaattaagtaataaatatattcgaactagaaatgggaaggcctaacgaccgttgaccctccctttaattgctccgtatttaattgatttttcttctaatcttgttatcatcctccgctatccgccacgtgttgtatgggtcccacggtacgggcaatgagagaaactacactttgctccctattttaattaataattcacattttgctacacaacatcttctaattgtcaaaactcaaaactaacaatcatggtcatttaaaacaagctatatacatttttcaaatctgtatttcaaaaaatcaaataaaaatcatcttaagtcactaacctatgtgattaatcaaagtggagtaaaattttccgaaataacatttgcaaaaaattgttgaaatctaaattgacaatagttataataaaatatccaaaattaagtggggtcatattgtaaagaatatttcattttccacctcctgttttgacgtttctcttcttttttttccaacaaaaaaaacaaaagcaattaaatagtgtttgtcgtttagttggcggaattctctcagttgaattttgttataaaaatcttacaggtatacaggtctactgtccatagatccgttaaaagttttacctacggccattaatgaccgtccgatcttcctttgttgatgatgacgaggaccaactatctctgcactttctcggtttctccttatttaactacttttaatattactccaaattcacaccccataattatgcttctttttgcatatttgatcaaaaactagttctagtgacagaattaacctcaatttccgtaaaccaagttttaatatatatcaaatgcaatactcgatatcacacattattcactaaatgtgggagactttcatattttttgttttgtcacacactataatatgaagaatgaaagtaacatgatatttttgttctaggtgtaatttaatttccaaaacattaaaaattcctgacacaaaatactgtaccaccgtcaatttggggggtagattgaaagaaaataaagtgtggggctcacagataaaaacgaatgtaacagttggggtctcattaaatagcggtgcaaatacaaacttctctataacaaaaatctactactattaaaaaataattaaattcgagaggcagtttaggtgagaagaaactgagaaagttcggtccgaattctaatcccacttttgtctctcaatttgtttcccctttctctctctctctctccttcaaatttttttagcgatttttctgggtttcatgtaaatgtgagaagtagatagattctcaacaagaaaaaaaggttttttttttttttttttttggattcgtggatcagccatcttctcgaaagatttgggaaagatccaaagaatcacaatattttttcgatatttagtcgaaaggaatttaacatg

SEQ ID NO: 30859 - DNA, 3000 bp, Unknown; identical to SEQ ID NO: 10426
  misc_feature (1)..( 3000): 2750-1469P.txt file - cDNA_ID_3036259; gDNA_ID_2213647; Annot_ID_132421

SEQ ID NO: 30860 - DNA, 3000 bp, Unknown; identical to SEQ ID NO: 10401
  misc_feature (1)..( 3000): 2750-1469P.txt file - cDNA_ID_3036259; gDNA_ID_2213647; Annot_ID_181497

SEQ ID NO: 30861 - DNA, 3000 bp, Unknown
  misc_feature (1)..( 3000): 2750-1469P.txt file - cDNA_ID_3036263; gDNA_ID_2213647; Annot_ID_132420
gtttctattttgggtaatctcgacttggtttgcaagtcccttggccataatatcggatctgtttaatgttagttatgtagatattgcccgattcaatttctatttttagtgcctttgagaagatttttcattttggattttcttagtgaagaatagtcatcacagttcactcacctacatgttagtcagcaatggattactggatttgattctctctttattttcattctactttgaacttcatttatcttggccatggccagtttaagttattgtgtagattaatggtaagctcttttttttagtgttattgttgaggttatagtcataattgattctgattgagttcttaaaattgtgtttttttttgttggaaggttttgaggtggttttatgcgccaaaacatctaaccggagtgtcgttgtacggtgcttagtagttttcaataacacgcttcagttatggggaatgcttgttgtgttgctactcgagacaaaatggttgtgcctaatacatcagcagtcgagaattttcaaagaaacaatgtgaggtattctcctaactggagcttccgatgggataatagaggaggacgcgtggcaggggaagagacctctgttagtttgttatctgatcggattagtcgtaacgatgtctctgatgtcaaatctgaaactgctcttgtatcatcacaaggttctcctttggacaattttcagacgcagtcatggcagaaatctcctgcttctggtaaattcctttattgctgcttacaggcaatacctctttgatttgtcaaaaaatgtagacttgatgggaaaatgtaggcaccttctttttgaccaacccgcttagaatttaggattacttttctacagagactgttaatgagtgaaaatgacattgatatgtttgttgacataaactgttctcttgtttgtttcttgacttgcttttattgttaaactatgacttttccatgttgtgatatcacgttattgttgtggcagatcaatcattttcaagaattgcctctattgactctgtctctgaacaggtaaatacttaaaagctttgtttcactgctagctatatatttgttatgtatctctgttaatatgactcctatgttactgttttagatcacccaaaaaacaaatgattcaaccgaccctacttattatccatctcctgcaaaactgtctctttcattggcttctcaaccatcatccttctcagtgtcaccactgtcaagtcagtcccacttgccaatgccacctgcaagttcatcccaattaaagctgacaccgccccctcgtctatcaaagcaagtctcatatggtcaaatctttggattcacctcaccgagcagaagctcagcaactgaagagaggctggggaatgaatctcagtctgatggttggtccatgcaagctttttctgaaatgatggcgtattctcgcagagagtcttgctcttacgataacgagtgctttgggcttcgtcgtgacaagatagacaatcttggaagtagaaagtccaatgatcagcaaaactgtggtgcttgctcgagatccttgtctgagaaatctttgttgagtagccaaaaaatctttgccactaacgagctctccgtagctgcgattctagcatgtgggcacgtctatcattcagagtgtttagagcagatgacacctgaaatcgacaaattcgatccttcttgtcccatctgcacactgggtgagaagaaaacattcaaactgtcggaaaaagcattaaaggcagatttggaaatgaaagctagacacaacaagagactaagaaaccgcgttgtggacagcgatgaatttgtcaagtttaataacaaccacgaagcggcagtaggatacaaaggtaaaaccccaaagctgatatcaagttcaagcttgagaagctattccccaaagcctttccttgctagacacttctctttcgggtccagaagtaatagtgttaaatccccaaaagagattcattccccgagctctcttagaaagaaaggcttcttttggaccaaatctagcaaaatttgaaactgtaagctcctctctctctcatgaatctgaactcaaaataacgagtcactctataattgttgaatcatgtttcagaatctggatgctgtgtctcttcttagttcgtaagctagggccgaagtcaacgtaacgttttacttatcaaaggtacacacttgtttgtgtatgtattacagaaaagtttctcactagtctcccattatttttttgtttgtgcattcccaattacacttgtaaatatataattataacaatataaggtaaaaatgatctggctgtgcaccagtaggtgtgaattgggttaatcagatcgagggatttatatttatatgttttggtttatttggtgtgggatcgtattatacgatttttatatacttctacaaaccatttctaaacaaatgtttcagttcaaaaccaatctaaacagatttgtattatgatccaacgttaacttccatggttcgtttgtttagtgctttatgaaattagttaccaacacaaacttgcacttaccaatcagaatacgtcaagaatttaaaactcggaacaccgaccttctttagcggttctaagccctgatcaaatccacatgtgtccatggaacatagaaagcaccgtacttaaaagataacgttatctaccgaatctatcaaaaaaggcaaaacgttattactatgtcggattcgtgacgtacacatttcaaagtacacacatgacacatggaactctaattctatccgtgcgtggcaaacatttcacattaaatacgccacgtatcatatccatgcagattaacatgtctaatatatatgcatgcctacttgaatcaatcccaaaccaagttttcttcaaagctgtatttgaaagggtatatatctcacacacaaaacagatcagaagctaaaaggtaataatataatg

SEQ ID NO: 30862 - DNA, 3000 bp, Unknown; identical to SEQ ID NO: 30861
  misc_feature (1)..( 3000): 2750-1469P.txt file - cDNA_ID_3036263; gDNA_ID_2213647; Annot_ID_181496

SEQ ID NO: 30863 - DNA, 3003 bp, Unknown; identical to SEQ ID NO: 26719
  misc_feature (1)..( 3003): 2750-1469P.txt file - cDNA_ID_3036266; gDNA_ID_2213647; Annot_ID_181494

SEQ ID NO: 30864 - DNA, 3000 bp, Unknown; identical to SEQ ID NO: 10403
  misc_feature (1)..( 3000): 2750-1469P.txt file - cDNA_ID_3036280; gDNA_ID_2213647; Annot_ID_181490

SEQ ID NO: 30865 - DNA, 3000 bp, Unknown; identical to SEQ ID NO: 10423
  misc_feature (1)..( 3000): 2750-1469P.txt file - cDNA_ID_3036284; gDNA_ID_2213647; Annot_ID_181489

SEQ ID NO: 30866 - DNA, 3003 bp, Unknown; identical to SEQ ID NO: 26722
  misc_feature (1)..( 3003): 2750-1469P.txt file - cDNA_ID_3036288; gDNA_ID_2213647; Annot_ID_181486

SEQ ID NO: 30867 - DNA, 3003 bp, Unknown; identical to SEQ ID NO: 26723
  misc_feature (1)..( 3003): 2750-1469P.txt file - cDNA_ID_3036303; gDNA_ID_2213647; Annot_ID_181482

SEQ ID NO: 30868 - DNA, 3003 bp, Unknown
  misc_feature (1)..( 3003): 2750-1469P.txt file - cDNA_ID_3036307; gDNA_ID_2213647; Annot_ID_181481
ttttgttgttttcagaaagttatgagattgatgacacaatgcaatgagaagagctttgagctggaggtaaaatgtctctctagaatgaaatgtcttcttctatagcgaatatggaagatttctcaagtcaatatatatatttaaatgtgttctacctatggatcagattatatcagcagataatcgtattctccaagaacaactacagacaaaggtcacttctaagtcacggactccttttattcttttattcttttttatttttcatatacagcattttcttgtggctattatctcagtcatccttacttatatacacatgctctaacaactgcagtgtaccgagaacaatgaattgcacgaaaaggtgcatcttctagagcaacgattatcgagtcagaaggccacactgtcttgttgtgatgttgtgactgaagagtatgtagatgagctgaaaaagaaagtacagtctcaggtaatttctcaaaatctcaaccaattttgtcaaatttgcgaccatgcattctcacaagtatgcctgaatcctgataaatatcttcactggttgcgaggagattgtgaaaacacatataatgatatatatgtttaatggacctctcattgtatttacatgagcgtttgatgttttcatacttcaggagattgagaacgaaaagttgaagctagagcatgtgcagagtgtggaggagaagagtggattacgagtgcaaaatcaaaaattagctgaagaagcttcatatgcaaaagaattggcctctgcagctgctattgagctgaagaatctagctgatgaagttacaaagctctcgcttcaaaacgcaaagctagaaaaagaattagtagctgcaagagacttggcagcggcagctcagaagcgtaacaacaactccatgaacagcgcagcgaaccgtaatggaacaaggccagggagaaaggcaaggatctcagactcatggaacctcaaccaagaaaatctcacaatggaattgcaggcaaggaaacagcgagaagcagtacttgaggctgcactagctgagaaagaatacatagaagaagagtttaggaaaaaagctgaagaagcaaagagaagagaagaggcccttgaaaacgatttagccaacatgtgggtgcttgttgccaagttgaagaaagccaatagtggcgccttgtcaatacaaaagagtgacgaagcagagcctgcaaaggaagatgaagtgacagagttagataataagaatgaacaaaatgcaatcttgaaagagaggcaactcgtgaatggacatgaagaagtaatagttgccaaggctgaagagacaccaaaggaggaacctcttgttgctcgtcttaaggtaaaccttttacaaatttgctttctattttctttcagcattcttagttttctataagcctactccacagtctagcggtaggcaaatctagatatccattacctgttcgctccatatcctttatgccatgaccttcggatcaggcaacatatattaaaaccttcaaaacacccagaatatatggttcaaaatatgtaaatagctttacctgatccaatatattctaatatcatgtcctcctatctataatacaagtgactgttacggataattaagtcaagctacttgtgggtattgaatatttatctggtttttcggggacatggaacttgtgtacccatgtgtgagcttctatcttgtacgggtaatgaaaatcatgaatcatcatctcacacgttcaaacaatatgagctttaataaataaaaaaactacttgttttcttgttctgcatttgatgctttatatacataacaggcaagaatgcaagagatgaaagagaaagagatgaaatctcaggcggctgcagcagctaatgctgatgcaaactcacatatatgtaaagtctgttttgagtcgccgaccgccacaattctcctcccttgccgtcatttctgccgtaagtctcactctcacattacctgaggatccttcattaagtactaagtaatcctaaaacgatcacaatctctccttttatgcagtctgtaaatcttgttcacttgcctgctctgagtgcccaatctgccgaaccaagatctctgatcgcctgttcgccttcccgtcttgacctgcggcaagtatagtcactctcctacacacagtataaggtaattccaatatttcccaccttcacaaaatctttaaaatccaaattctttagttcaaaaacattaggcaatctttttattgaaagacaattgtatgtgattttgcaggtataaagaactatatggaagtctgtttgtttgctaacattttccagaacggcaggctcgaattcttttattacaagttgttttttgttttcttgtatgtaatgtctttgttatatctttctgttcaaaatgtggtaaagaaagaggaaacataacatgctaacagaaaaataggaaacatatcatagccgtttcatagtaagttcaaaatttgaagtaagtaattaaaaattattttgctaattcatgaaatttgtgtacagttttttagaaaaaacatacagttgtacaatggagaatagtgtacgaatgcaacagtgatacacaagaacaccaaactacaccaattatcatcgatgaattactgcaaaccacacaaacctttgatctcttctaacttatattgtaatttttaattttaataataatttttacttagttatatctatgctaaattcttatttttttttaagaaatttaatacataccgaatttaatacaccaataacacatgtaaatatttttggatcagagtggttgttacggcccaatggatctagtgagcctaaatgatacgaccatatattgtttttttttcggttttcgccaacgaggatttggttaccgagagtttgtttgaacggtcctcagaaattcggagcttgtagcttctcggtgcggtgccttcactttaatg

SEQ ID NO: 30869 - DNA, 3003 bp, Unknown
  misc_feature (1)..( 3003): 2750-1469P.txt file - cDNA_ID_3036311; gDNA_ID_2213647; Annot_ID_181480
gccttgtaaagctttctttcagattgcctattgatgttccaggagcttgcaccttaggtaataactgagaataaggctgacctagcaaccatgatggatatgattcactctcaggatcatagcccacctgcactcaaatccaaaataggaaagcactttgatgagtcacatttccttgtttagcagcctattaatctacactttctgcctaaatgcagtaaatacttcatggtgtgttaccttcaaggcattgttgtaatctgacactccgagtctaccgtgaagtaaccacaacaaccagtctgcctgatgcagcaataccgctgattctctgtttggcacctcagtgttccaccatgagacaagtttgcacaaggtagaagtaccagagcagactgtatggtttgctggcgctatagacttgacctctggcagagcatcagggcagctctggttgtagagataaggttgacacagaacttctccactctcactgcaacacataattgaataagcaaaggagatttaaacaacacattactgaaacatcaaatcctctaatgtaaatggaatacagaaacagaaaagagaagtgatccggtgaattacatgcctgtttaagatgagagtagttgcagaagttccatcaagcgaaatggatgagacgagggagcgaactgtgacgggaatgtcctctagcaacgaaaaaagagttgctttccatgagcttgcccaacccatgctttcttctttctatctagatttcaaaacaaatgtctcagtccatagctttctcttgattttgttcataaagcagctcagaaattgtatatgatatatatacaaggatacttaatgcaaaagttttaccatgaaaggaggatattctcttttgccttgtgctttaatctctccttgctcatcaataactgtaaatcgacctccagaagtaccaaaatccatacccagataaagtttttcatagttcgttcctttattgccactcataactctgaaatcggagtaaaatctagttctgggtagaggaacactccttgaactagagtaaaaccctgagattaacattatcataaatgattcagctcctaaaacccctaataaacgccattatatcgaaaaatcttcatgtttacctgtttgttttggagattggaagagctcaaatgaagatatctgaaattgacgaagaatcagcatctctcttttccttctgaggctgctttcttctaaactccatagataagggagctagcaagttcgtgaccgttggatttctcgattttttcctcttgatttgaatttaccattttagccttccatattatttttatttattttactccactcaacaccaagcagttgggctgcacgttctctggtcatctaacggctcagattatgggtgcggatcttcatatttggacccttgtaggcccacgaccaataatgatgacaacaatccctctctcctggcaccatattttgttccacacaagttttctttaaaaaatttacatgtaaatgctatatataccaagcaatttttgtctaattaaaaatttacagaatattgaaatcatagcactaagacgcaaaactaaaaataacaacattccatttgcatatgaaccaaatgggtcgtggtctagtggtaattcatgaagatgaaggttggttttggtgtgtcccaagtactgttgatatccttattcattaaatcggaacgtctaaaaatctgtctttggatacttgggaaaactacaaatgattttttgctgaaaacatgacttggatttcattgtgaaaagcatgcacgtgtgagccagatgtgcggtggagctcaagaagtgggagatatgacaacttctttgccactgctactttaccttcgagaagcaatcacactctatatacgtaaactacttggtattagggaataaggacccacatattcaatgtgtgtgtaacataagtgtttaatattatagaagcaagatatacgtgctcgtaataactccattttattggattactttctattttatttttatttaggttataattttgtcttttgcaatttgcaggatttattagtacaccatctatttaaggataatgtttcctttcatttagccattattaaattcagtactgaatctattcgacatgttgcagttaagtagaatctaacataatgtcgcaaatcatgttccattggaattgacgttttttaacattttgagtgacccttaagagaaattactttaaatctgttcattatttttagatttggtgttggatacaattcctaatttattttttaactgattcggttaaaaacttaaaattgaacatatttcactaggatttcattttctttggtttaggttgaaccggaacaaaaacattgaacgaattaaagggcagaaaggacaaaaacattgaaatcctccatttttactaacccatcgttcttcccgctcgttcggttcattcaatttgtttcgaaaaccttttaacccggttcgcggttattttattttaatcctcaaccacgttcgaatctattagcgacacagtaaaaacaaatatattttattaatcaaaaattcaaaatctgaaaaaaagacgctttcaccaaaaaaaaatatctccaatcgatttctctctatctctctcttcaccaccgtcgcgtgaagaagacgaaacaatcgctctctccttgtgtggtctcactatctttttctcaccttcgcgtagcttaaccatggaaaagtagagaagaagaagaaagagagaagtgagagaaagacgaagaagatgaagagcatattgctttttctgtccccagccatgtgagtttccactgacacattctctccatcttcacatttggtgtttttttcttttgcttgattctttctatcttcattttcagatttttaccgagtccgtaaccgagtttgaacgagttagtggatg

SEQ ID NO: 30870 - DNA, 3000 bp, Unknown; identical to SEQ ID NO: 10408
  misc_feature (1)..( 3000): 2750-1469P.txt file - cDNA_ID_3036327; gDNA_ID_2213647; Annot_ID_181476

SEQ ID NO: 30871 - DNA, 3003 bp, Unknown
  misc_feature (1)..( 3003): 2750-1469P.txt file - cDNA_ID_3036331; gDNA_ID_2213647; Annot_ID_181475
tcaaaagatgaatcaaagatatggcacagcagattatgccatatgagtcagagaaatattgatgtgttgatcaagaaaggatgccttcaagctgaaaagataaatggtctcgagttttgtgaagactgtgtgtacgggaaaacacatagagttggttttgggtctgcaaaacatgtcacaagagagaaacttgagtacattcactcggatctttggggagcgccatcagtaccaaactcactaggtaattgtcagtactttatcacgtttattgatgaccttacaagaaaagtatggatttattttctgaagaagaaagaacatttcttctcttgtatgttgatgatatgttgatcatatcaaagaacaaggaaacagtcaaggaattaaaggaaagactgagttcagagtttgaaatgaaggatttggggcctgcaaggaaaattctgggaatggagataacaagaaaccgagaagaaaatattttggagttatctcagagaagttatctgcaaaaggtgttaaagacattcagaatggatgaatgcaagcctgttaaaacaccattggcaccacatatgaagtttgtagcagcaacagagactgaagcagaggagcaagctgatcaaatgaagtctataccttatgcaaatgcagtgggaagcataatgtattctatgatcgggtcaaggcctgaccttgctcatcctgttggagtcataagtaggtttatgagtaaaccattgatgaatcattggctaggtgtgaaatgggttctccgttacattaaggggtctattgattcaaggctgcagtacaagagagaaggtgattttgtggtgacagggtactgtgattcagatcactctggagatcgtgatcgaagtagatcgaccacagggtacacattcactgtaggagggaacatagtaagctggaggtcatgcttgcagccagttgttgcactgtcatcaacagaggctgagtatatagccttaacagaggctgcaaaagaagcatattggctaaaagacttgatgaatgagctgggatttaaacaaggagcggtagatatccattgtgattctcagagtgctatagctttagcaaagaatgcagttcatcatgaaaggacaaagcatatccagagaaggtttcattacatcagagatgcaatcactgatggagaagtgaaagtgctgaaaatatccacagttcataatccatcggatattttcacaaaggtggtaccggttaacaagttcctgagcgcgttgaagaagctcagggttacaagtgcctgataagggatcatggtccgagatggaaatcaagttacactagaagggaagcaaaggaaaggttgacactaaggcaaggtgaagttttgtggaagtattgcctaaagtgtcataaagactctaatccaaagagaaggtctcagcttgtgaaagaaacgaagtcacgagaggcgcacgtgctttgtcatacagctcatcaaggctagagacgtaattaacctcttgccaatggttcaaccattttgtctctttgtctctgcatttgaaacagagtacggaagaagagagaggagcgtggcggtgagtagagttgtataaaggagaagataagtgagacattagggttaagagagtaagtgcaagagaggcagctgaaagtttattcagtcttgtttctaagggtttgtgtaaccaaggctttctagtggatttccgggtaatctcggtccagacgtagcgttcatcactgaacgtgaactgggttaacatttgcttgtgtctgttttactttctttgtctaaacacacgagtgatcgaacaaagagagatttagtgagagcttccgcataaaacagttaaagattcaagctttttttttttacatcaacatttactaataaaaatgtatagttgaattttcaatattatatgctccaattgatacttcagaatgtgttaagattttcagcttagcaaaagtacacaaaaactatagtagaatagttcaaaaaaaattacaataacaattaatgataaattttgagaccatttttgacactgcaatttccttttaaaataattaataacaaattaacaatcaaaatggtgtatacactcacctaccattcaaacccataatttcatatagaacatattcctaaaaatgtgaaaaaattttaaaagattaaaaaatatttgacaaagagtcaaatacaaaaaaaaaaaaaaaaaatcctatctatgtttaattttggccatcagaagggaaatcaaataaaggggagatagagcgagtatacatatacaagctactcgcagcgtctgcaaattcatctatccatcatatttctctgctgctctctgctttcttcttcttcttcttcttcttcttcttcttcttcttcttcttcttagtttgattcaaaaaatctccttcctcttcttactttatctcgtattatccattaatcctaaaccctttagtctctccatcttccgcttcaacaatcagaatttgggtttggcgaaagatgctaactttgaaagtgagactaatcgtttgagtaaaaaacatgcgaattttgtgtgatgcttgtgagagcgccgccgctatcgtcttttgcgccgccgacgaagctgccctctgttgctcctgcgacgaaaaagtaaccacctttacctgaaaaaaatctcatttttcttaaagtaacacttttatctcaacaaatgcaaaaatttggaatttttgagacaatatctagttgaagtgctaaatttatagattttgaggttattataactcgaacatggccaaagtagtaccaaaagttgtgttttgattgttaaagaaacattctagtgattttagcttgtcataatttgaactttgcatatagcagttctctggtgatacactttatttacagttacagtcactctattgaagctggaagagctatgagactttttgttatctgcaatg

SEQ ID NO: 30872 - DNA, 3000 bp, Unknown; identical to SEQ ID NO: 10410
  misc_feature (1)..( 3000): 2750-1469P.txt file - cDNA_ID_3036346; gDNA_ID_2213647; Annot_ID_181469

SEQ ID NO: 30873 - DNA, 3000 bp, Unknown; identical to SEQ ID NO: 10411
  misc_feature (1)..( 3000): 2750-1469P.txt file - cDNA_ID_3036350; gDNA_ID_2213647; Annot_ID_181467

SEQ ID NO: 30874 - DNA, 3003 bp, Unknown
  misc_feature (1)..( 3003): 2750-1469P.txt file - cDNA_ID_3036354; gDNA_ID_2213647; Annot_ID_181466
tgcttctcttcctgaatccctgattgggtaaatatctgctcagattgagagtttctcagtgtgtgtttttagtaacgcacacgttatataaaggggccatgattcctcactactttaggcccaataatccagaaccgtttatttattaggcccagtacagttgatgcgagaggacaaacaagaagaaacgtcgtttaatcagaggtcccctttgcatctttttttccggcgagttttcaattttgtaaagttctaagctttggtatgtttgtatcgatatcactattataattcgatgattgtagaatttatgatcggaatcttttattctgtggaattccggtgagtggtattggaacaggtttcctaggatcttaatgggcttgtttcaaaaggtgtgatattgaaacttggagatggttcttcgtatttctaggtttcttttcttctgctcagattcgaaattggagtcttaggttttcttaaaaaagttgaagttatctgatattatattcttaagcttcatttattcatatagatagatagagagagagagtgtgtgtgtgatcaagcgtagagctcaatgccccaaaacttggctgtttggtgcgtgcggtaattcctctccatgcttttgatcacttccatgtcctctttcgatagttggaagtcgaaaacctgaaaattctcttccaatctttcaggcttcgatgtctttggtatcaccaccgtgttcctctgaattccccacctcaggacaatctgtgccactgtctgtttgtacttctcggccacatcctatgaattcagacagacaaaaggtttaattatttaactgtttcagtccaaacttttaaggtttagaggatggggcttactttgagaactgggtcatccagacatgacacggtgccaaaccattcggcattggctgtggcacctcccagaggagtatgagcagtgacacagataccatgtttctggcagaatttgactagagaatcgcgttggaagtaaggatgtgtctcgatctgattcacagcaggtttgatcttggagtaagccaagcaatctctcgttagaaagacatcatagttactgcaaaaaacctaatggtcaaataattcatatattggcgactaaacaagagaacttgtaatgatagtgagagaagttgaacctgattccaatgctgcggactaaacccatagaaacaagcttttccatgtcgtgccatgtagtttccagagagattgttgtatctatgtccaataccccatcatcccccaaagcactatcggttgttcctattcctgcacaaggcttacatgttacagcttattactctgtgtgccaattgctagagacttgagaaaacttaattttccagccagtaacaaggctgaaatgcaatggtctctactcgaaactgataatattcatgaacaaggctgaagcctaacccgtgtgttttgtagctatgggtatatgaacgaggaaaaggtcgaggtaatcaagttgaagtttcttgagactgtctttgcatgcctcaataacatggccatggtctgaactccatagctgcaaaaccaagacagagagcattcgatctgaaatgaactgatatcaaaggtatgtagtagtttaacttaaagccgtttggaccttagtcgtaatgaagagatcctccctcttgacaagacctgtcgtgaatgcttctgtaagagcctcaccaacttcagcttcgttcttataattagctgaaccaagtaaccccaaaagatactcataaatcaggatacagaacaaagcaactcactcacatgcaaagaaacaaaaacaattgtctgtgatacagcaaagacttaagatcattctacgattccaaatttccaaatacttaaaaacccaaatcttaagacataatttccaagtaagattccaactttcaacaaattaaaacaaaacctaatattttattcacatatcctgacaaacccgaagcaacaaagatcagaaagaaaaggttttaagcagtgttaagttataccagcacagtcgagatgacgataaccgatcttgatggcatcgatgataaggtctcgaagctcttctttctccattctccaaactcctaagccgatgatcggcattttgaagccactgttcagtgtaatctccatttcttcttcttgcttctctcctcaatccgtgattgggtagatatctgctcagaattgagagtttcccagtatggtaagttggtaacgcacacgtcaatataaagtggtcatgattcctcactattcgaggcccaatgggctagtaccgttttttgtgaagcccaaactgttttacaaagacatgaatcaatacgcaccgtatgggtatatatatatacaagcaacgttatcacaggtcctcaaagtttgcatctttacttgggttgtgtctggaatcaattacttcctaaaggtaattttattggtcgggcagctcaatcggtggtttctgagttcttattcttctctgataatctcaagacgagcttttaattttgtaaagtttttagctttggtattgtttgtatcgatcccactctcaacttttgatcggaatcttctgttctggggatttccggtgaattgtttaggaataggtttccaaggatcttacttgggtttgtttcaaaaggtgggattttgcaagttgtagatggttcttcgattttgtaggtttctattcttctgctgagattcgaaattgaggtcttaggtttttgataatagcttgtttagttatctgttaaagtcactaactttgatgttccttccggtcggaattgttggccacaattgattattgaaacccttaaattaaagagtgccctctttttctcttttatgatttggatctcttgtaattgacttgtgtgaggtttctttttctgtaggttgccatttgttaacttactctgttagtctactaccaccaataactatg

SEQ ID NO: 30875 - DNA, 3000 bp, Unknown; identical to SEQ ID NO: 10429
  misc_feature (1)..( 3000): 2750-1469P.txt file - cDNA_ID_3036445; gDNA_ID_2213648; Annot_ID_181520

SEQ ID NO: 30876 - DNA, 3000 bp, Unknown; identical to SEQ ID NO: 25325
  misc_feature (1)..( 3000): 2750-1469P.txt file - cDNA_ID_3036482; gDNA_ID_2213649; Annot_ID_181572

SEQ ID NO: 30877 - DNA, 3003 bp, Unknown
  misc_feature (1)..( 3003): 2750-1469P.txt file - cDNA_ID_3036486; gDNA_ID_2213649; Annot_ID_181571
cggtttgtactatcacaaacgacccggaatcttctaacactgatcagattgttccgtcgaatcctacttcgattccgcattctccggttagcgttagagaaccggaaattcacagtcatagagggattaaaccgggaataatcgctgcggttatcggtggttgcgtggcggttattgttttagtatcttttggttttgctttctgttgtggaagattagaccgtaacggcgaaagatcaaaatccggaagtgtagagactggtttcgtcggaggaggagaagggaagagacgaagcagttacggagaaggaggagagagtgatgcgacgtcggcgacagataggagcagacttgtgtttttcgagaggaggaaacagtttgagcttgatgatttgttgaaagcatctgcggagatgcttgggaaagggagtttagggacggtgtacaaggcggtgttagacgacggctcaacgactgtggcggtgaagcggcttaaagacgcgaatccatgtccgaggaaagagtttgagcagtatatggagattattggtaggcttaaacaccaaaacgttgttaagctaagagcttattactatgctaaagaagagaagctcttggtttatgagtatcttcctaatggaagcttgcactctcttcttcatggtaaaactctcttctctaagctttgattatcaaactgaaaatgctctgttttgcttagtgacaaaagtgttgatttttactacattatcggccaaagttatgatttttttattggtggttttagggaatcgaggaccaggacggattccattggattggacgacgaggattagtctaatgttaggagcagcgagaggattagcgaagattcacgacgagtatagcatctcaaagataccacacggcaatatcaaatcctctaatgttctattggacagaaacggcgtcgcgctaatagctgatttcggtttatcacttttgctaaacccggttcacgctatcgctcggttaggaggataccgtgcgccggaacagtcggagatcaaacgtctctctcagaaagctgacgtgtacagttttggtgtgttgcttctcgaggttttaacaggaaaagcaccctcgatattcccgtctccgtctagacctagatcagcggcgtcggtggctgtggaggaagaggaagaagcggtggttgatttaccgaagtgggttagatcggtggtgaaggaggaatggacggcagaggtttttgatccggagcttttgaggtataagaacatagaggaggagatggtggcaatgcttcatatcggtttagcttgcgttgtgcctcagccggagaagaggccgacgatggcggaagttgttaagatggttgaggagattagagttgagcaatctccggtcggtgaggattttgatgagtcacgaaactcaatgtctccgtcgttggctaccaccgacggctaagtttggtttctgtctgtcgatgttgtagaatacgtatcgtttggaccttgtcgatttttaaggttcttgcttagaatccctgatttgcgaacttgtcggagtttttttagccatgttttgtgttttcactgtttgtgatcgtaacggggttgtgtggttttgtggatttatgaagccgtttcaataataaaaccccatttgttactctttaaagcccattaggcccatatgttttagatgaattattttgcaattgctgctatttaattatagaacctaaaactcgaacgcccattgattagtgcttctagaacggtggatgcttctgtgtccactggtaattgtctttttggttgaagagtcagcccttcggatttgacctttcgtgtaccttttaagcccattgattatgattggcagattaagtaaattaacgaatggtcaagcacatgattagccaaatcatgacaaataaatggattcctttttcatttctggaagcggaatcttgtctaacaatttttttaattgatagtaatattttatgttatgggtttctgatagttgaagacttgaaatgttgaacttaaaagtgaaattacgctttcataatttcattaagccatgatggcaagttttttttttgggttgaggtcaacaagagcaagtttaatggtatcgaatagtgcgtaactgaaataaaacttgttgaaaaatcattcattcactattcctcggcgcgtgaggccaatttgaccccttcccccacgaaattaaacttggggagtactaaaagtctaaaccagcaacgtcgcttttcatgtgccttaatcacacccttttctgccacgtgtacgatctgggaccgtcgttgtgctcattgacatttgtagatccctttctagatgttcattaaaattacttaatttatatccagtccttctacttttagttttttgatactttaatccctgttgttttaatgatacttcattcagtatccatccaaaatcaaattaaatccatagattaagatgtacatttttgaaaataataaatggtttattataatatgttactaaatttatggtatttttcgctcttgtattgacttttacatggatacattaattttaatcttctttgatttctgttaattttctttgaattcattttatacatttattagtgaactattctaaaaattaacaaaatcatttaaaccgacaaaaaaaactttaaaagatcagcgtattataaaccaacgggggatagtttgcattaggtattggacatctggggggtaaatagagcgaaacaaaagttgaggcttgtttttcaacattttcattttattgtgtgctatttaaactgcgtcgtatttggaggcatattcgccggtcaagcgtatcaaatacccaatcacgcgaacttttctccgcctcttctccactccaaaattcttctccgtctttctcccgtcaccgtcgaataaagcctgagatctccgaattctgatcagcaactatg

SEQ ID NO: 30878 - DNA, 3003 bp, Unknown
  misc_feature (1)..( 3003): 2750-1469P.txt file - cDNA_ID_3036495; gDNA_ID_2213649; Annot_ID_181564
gaaaccttcaaagagacgtacatgagaaatgagtattgtaaatcatttatttcatggacttggttggaatcttagtgaatcgttgttgtcaatcttaacaacttgttggattggttatgagcctatgacttatgacttatgagtgagtcaatggtggtcataacctaatgattgggttatgagcaaagaaatttggaatttgtaaaaaaaaaaaaaaaaatcaagagcttttttgtgtggacatatctatcctagaaactgagacgaataatagtggataaaaagttgggaacggattattcgaatgtttaaaactattattgaaaacaatacaactaaatatggtacaaaagtaaacgaattcgtatagctaaacctaattcaaattacgaagctaatccatacttggatcctaaacgcttttacttttacttacggtttctttttcaaaaaagtttttacaaatttgggtttgtcttatgaagattatggcagaagagactgatcaaaagtgaatgcctaattcggtttaatccattcaagtttatcttaaacaatgaaactgaccatgaaagtgaattcaaagaccaaatcaaagaaaaattaaactgatttagttgtaatattggtattgaattaaactataaatagaaataaccaaacatataaccacaaaagaagactatttatataaatatatgagttggaagtcatttttggactattatataagatctaattatcacacgacgtgtggatgtatggttagcagagttgtgttcagagagttcgataaagccatcactccaaacatacaaaatatccatacattgatccaccaatataaccggctgtgtgccaagcaaagtgaagcttaggcctaactagggttctcaaaagttcaaaatataaaaaatattttggcgtcgaccttaaagtccttgcttcatcgactatagtctaaagccggcatgcctaaaaacctcatataaatcgtcgcttgttactcgatcatactctgtaactataaatatcctgatcttaattataacttgaaatactactaatctacgaatctatcatgtaacctgtttactagtttttatttaatataatcaaggagataggtcacttgaaaacaaagacgccacgcttgtatctcaatccatacttctattttttgtcttatgatatggtatcattcacgtagtttatatattaaaaaaaaaaaaatatcattcccatagttcttagttctttgttttattcataattttataatattggccttcccaaaaatttgggtaaggtcttggacattacaaagatccaacatatacaaaaataaataatcaaaaaaatctttgtatgactggagataatgatcggatcttgctgaagaccggaaacagagaatcagagcaatagtaccagcggatacaagacccacgacttcgctgatttgttttctcataacatgtttgtgattattttctgatttaagcgtcgaaagatttttttatcccataaggtcaatcctctcaagcggtggcaggagattcccgtttcacgcactgtgtgagacgtgtgaatgacatagctctcgcttaccatccacgtctcatgtatcagattcattcaactcttttactcattcaccatgcatgaaaagtataaattacattgaattttagcaaagcacttaattcttatcttattataatcctattttacatgcacacgttataatgttatgatattataatacattttgtatcgacatgatattatccatataaacaatggtgaaacttaactcaaagagacaaataccatattgtgatttcatgcaaactgagatagtgccaagtggaagccaagtgccatctttcgatcttaaacatgtcacatagaagaagactacaataacccacttaataagtataaactttatttattaatgcatgactttttcaactgttcctttccccatgcaatattgatctatcttttggatcattgtttataaaagttcacttagaacattcattctagaaagtatataagtcgattcttttgatgaacaaactccaacgagaaaggttctttatatatactcctaataatggtgataacgtagaatatacatattgtttacgccaattcgccaaacaattcactccttaaaatgacctctgataaataaaatcgactaatataaaccttatctactaatgacaccaactaataacacccatttagggtaatcctcatttattaaacatagcttactacctaacaacaataacagaattattgttctattaatcttcttttttaattttgggttgagtgatagaaaccaaccaccagacacgttgttaaggaggatgatgataacgatttttaaaaaaataaaacagaaaatagaaaaaaactcaaaaggagaaaaaaagaacagatagcgaaagaaaagtcttatttctggaatcaaatccttgtgagttttcttaagatcaaaacatataaatttgtgattttgattattgggttttgctcatagaagacgaaacagaaagaaacattcgtaaacaacaccaatacaccaacccatacaatctaaattacattaacatcagagaaagtttcaaacttttccaaatcttcaacgccattgaaatagcatctcacaggttagattctttcatttagatatgaatcagatttctgaaaatttgttggattcgtgaattctcattgtcttcatgtccattatcgataccctgaatttgtctgaatctccaatatctaagataagtaatgtatgtccttatcttactgaatttgcatgttctgtttttttgtttgatctgttttgttgtttgattatctcttttctgaagatgtaaagagattatggatcaaatgattgttcttcttgtgtttgcttaagaagtatatgtggttttgtagattgatgagtcattaaagaccgtcaatatg

SEQ ID NO: 30879 - DNA, 3000 bp, Unknown; identical to SEQ ID NO: 10441
  misc_feature (1)..( 3000): 2750-1469P.txt file - cDNA_ID_3036499; gDNA_ID_2213649; Annot_ID_181563

SEQ ID NO: 30880 - DNA, 3000 bp, Unknown; identical to SEQ ID NO: 10436
  misc_feature (1)..( 3000): 2750-1469P.txt file - cDNA_ID_3036503; gDNA_ID_2213649; Annot_ID_181562

SEQ ID NO: 30881 - DNA, 3003 bp, Unknown
  misc_feature (1)..( 3003): 2750-1469P.txt file - cDNA_ID_3036513; gDNA_ID_2213649; Annot_ID_181554
tataattttaataagtttcatattatctgatgaaaattaaacatcaaactttgttatttataattttagtaaatagattttttttcttttttatttcataagagattaagttatttaatgtaaagcttctcttgactgtataatatcttaactatattattcttataaaatttctcaaatttcaataaccgtattatgttagtctacaaaaaaaattatattacatcaatattcttacataccaaactaagatatatattgtccagttcttttcatggcatatgtattttacatgctctattttaaaaaattactacgtgtttcaatatcagtattgttgaaattatacaccctccaacgagtaaggagataacccattacaatgcattggcactgatctacatgaacatgactgaccagatttaaccattcgagcaaacaaaataataagtcaactatattttgaatagtcacaaaactatacatcgtaattacaaaactatttctgacatataagattaataggttaaaagaaccaccgtcgaatcgttgatgtacgtagtagtagtatcgtattaacgaggcaatgatataactatcaatatttttcgtaagaaaacacaagtttccttattcttttcttacgtcggcgataaaagttaatgtcgtactttgatttatgaaattgtgatggaaaattgttttaattaattaagaagagaaacgagttatttgtacaaacaaatctgaaaatatagaaatagagcaaaggacagagaataagaagaagaggcaaaggagggcgagagttcacatgttcaagagaagacaaatacgtttctctgacacaaatctgtcagaccaatatttttaaatattttattgtatagtttttattttgttttgttgtatgagaaagaaacgtatattatgtctttattaccaccacaaggggtcaggctccgtccacttggggtcccaattttttctttgttacgagtttttttttgtagtaaaaggcaagtcacgccggcacgcgagccctcacgtgatcccacgtgctttatttattctctccataccaaaatttcttttcctttgttgtttggtaaggttttttcttttttggccaaaatatgatattggcgagattgaaaacatgtatatttttaaaaaaaatgtaggcgtaaaaattatgttactaacacttcattaagcatatgccaagatttttaaattaaaatttatatatcactattggtcgtttttttttttgtgtgtgacagcagctcactattggttgtttatattaaccacatactaaataaggctagctactaccaaacttggaccagaacctaacacatgatgttatttttagtaatatgaaaaaaaagaaacgaaaaggaaaaaggaaagaatagatctttctggtgagagagcatacacaacacattggtgacacaaggtatctaagggcatgaccgcacgtgtcaacatgcatcaaacatgcgatctttcaatattagtattatatatttagcaaagacgcaaaagaatccaaggcaaagactacttcgcctgcatgtcatgccaatctctctctatatgttttctaatcaatatactagattactagacaagttgttttctaataagatctctcacatatgagccaatttgagccaaaacatgatatgatggataaagcttatttgggtattgaaagtatagagactgtcaatgagaaagtagtcatttgggcccaagtacagagatttaaaccttatcaggaaaagcccaatccagtacaaacttgaagaaaaagattgatctccttgtaagttgcaactggtaaagaataggacctttgttcaaggtctactgtattgagatactgaattagtataaacggccacttaaaactactttgtatttgtttaggcccaaaacattggactatcatgttgagaaaataaacacgaacgcaacagaagtttcctacttattatatagcccaacaaatattgatctctttgcttccaatgaatctttgttaaggcccaaaaaatacaaagccgaaactacttccatcttgtactatttttaagtttattttttggaaattttaccatgtatgattcagatcgttggtttaaatttttacaactagaaaatagtatatactctattagcctattatgatattaattaatgggcaatatttcgattagtttacgtgtagagtgtagtgataatgtatttaggttttgaccggcaataatgcatttgtaagaaaagtctttggacaataatagctttggtcaagtcaatgtagaacagaagactaatttctcttgacaaaatattaaaccttaaaaacaaatcctgtcagaccaaaaggtgatacgattgtaacttacaaatgatactatatatttttatagttaacagtctagtatttaaaattttgaaatattgatgatcattgattggttcatataagtaatccattaggttttcatgttggtcaatacagatgtacatgttttcaggattaatataggttccgtcctatgaatttatccgaccatgcataagagtaactctttaatctactattacaagttttcaggatttgaaagctctatacaagtttaactttatgtgtatattagttaacgtttgtaaccacagattcataatatttaccgtcgaactcttagccataaaattcggactaaaagactcgattcaaaaaggtatcgatgagatggaaagttgttgaacttattgtataaaagcttagagaggatattgataagtcgtcttttgcttttgtatctacagctatgacgtatattgtttaatccaaatcaaagtgttttaaagatattttggtttctggtggaggtggtatactaaagattcacatatagatagagatatttatgaatacattgatatgaaaatcatatacaatatgctaaagaacaataaatg

SEQ ID NO: 30882 - DNA, 3003 bp, Unknown; identical to SEQ ID NO: 28161
  misc_feature (1)..( 3003): 2750-1469P.txt file - cDNA_ID_3036519; gDNA_ID_2213649; Annot_ID_181551

SEQ ID NO: 30883 - DNA, 3003 bp, Unknown; identical to SEQ ID NO: 25327
  misc_feature (1)..( 3003): 2750-1469P.txt file - cDNA_ID_3036523; gDNA_ID_2213649; Annot_ID_181550

SEQ ID NO: 30884 - DNA, 3003 bp, Unknown
  misc_feature (1)..( 3003): 2750-1469P.txt file - cDNA_ID_3036543; gDNA_ID_2213650; Annot_ID_181588
acaagagactatggatgtaatgtactctcatcatataagcacatatataattagcatgagactttcagacctagttccgtgatactataatatccaattgatacatggaccctaacttgggcctgtctctaagcacaatcttgtgaaaatatccaggcattggctgatgatttaaaccaggtacaatcttctaaagctcacgagttcgagttttcacaatcttgaataaaactttcatagaaaagatagtttatgtccgacaactatatataccaaaaagttaggttttttttttaatgatatcttcagtttgtatcatgaactctagatgtatattatatacgcaaacatcagtgcttaactatataagatatacaatttaaaatgtaactgcatatatgcagttggattttgtctgtcaaattaaaggggaaaattaggttgagagtaggaaccggacacacatactataatgtcgtcggcttattttaatatcacacaattgcaaccaataatatttcttagtttattaagtgtgtattagaatattaatcaaactctaaaatttatttataaaaaaaaaaaaatcatttgcgagatgaaaataaaatgtgtttgttgcaatatttcaagtattttcatttcgataaaacaaatattttctggttttaacagtattcaaagttgtatatattctacaaattaatgttattgtaaaatcgattgtaatctacaacaaacctgttactgcaaaaacaatatcatcattcatcacaaatttaagatagattagtgataaatagcagtaataaagtataaccaaattgagaacaatattatagccatgtgatatcctcctatccttttaattgaatacatatgattatatttcaatactttagtttgtaattaacgaagagccaagacgacgttatttattaattattttcaataaatcatcatgctgatgtagatcattatatttgttggcatttccttttctcattcaactttttctttttggttattacttaatagtcaaatttaaataacacaaaagctgtataaacctaatcgacggtgatatcttaagacttaaaaagttaagattaagggaacccttaatttaatgtttttttttttgttataagttgtccattccttgttgcttttaaaaatatattaaactgttaaaaaggtgatctcgttgtcaatgtaaaaagttggctaagtactaagcatgtgacgatcttggctaatgcctgaaccgcttaattaaggtcacataattttatacgattgaataataacatatgacgtatgaatcataattaaatgaaatccaaatattcaaagtcttagtaatagaataaaaatcaacctacatgaacgaattcaaacgaattaatactataaatatcattgtctcaatcgtggacatttttgttccactttattccttaaccccttggggtgcaaattccataaacccaaaaactaaaattaaaagttagtagaaatcaccaatcattcaaaccttttttttttttttttttgttcaccggccatatacttactaattactatgtctcatattttgctagtaatactgtgtcgccgaaccttgctagtataattgaaactacgggtgataaaaacaagaaaagagagatggtatgatatcatattagctaaaaacatacaagaggtcaatatgggccatgcctttcccaccttcttacgtatctttatttatgactcctttgtttgtgaatgtctcgtcgcatatgtgtgtacgtttttgatcttcatgatcactttatgtttttttttttgcataaggattctgacactggtgtgcctctatgtgactgacttgtagatcaaatttcgactgtgtagaaaaggaagcattcggtacttgcataatcttttgctatttctagtaaattacgttaatgttaaagccttaaagtcatcatcataatagaaacacaaaaacagaagactttatcatagtacgttagatcagagctgctctgtggaaagtaaattagcagagaggtaagacataccgaatgtttgttgggcctttttcaatgcaatgatagctagctaggtcagtgactcaatgattaactgttttaatttttatatttttaattataaattcttctatttctgataatttattttcagaactaaatcctaattcttgtgtggatatatttagacaaaattaaacaattatgattagtatttgaaataaacaatgtctagctaaaattatcatgtaaggcctgcgtgtttgaatagtaaatagatgtagttagacaaacaataccaattctctaataatgtataattgacaaaagagtatattttgaatgtaatatacatatacagatatacttttctagtgggatattcaagtatccggaaatcgaatgcctctgaggtcatgcttttgctaaatattcttcccgtggacattttcttacataaaatctatcatttgtttttatttttttaaaatctataatttcgttctaaaattcatttatagtctcctcaatcatgaaagtttagtttccaaacaataaataaaatttgacaaaaaatctatatgataataactcaatcgaagacttgaagtacttaaaataaatgatgtcagtaatatcacatagatatttttaaaaaaagagtcgaaattttcttatttgtttatgtcactaatcttttcaactccgacataattgtctctattatattaagaaaatgacgttaagaaagaaaaaaaacaatgtatcaacttgccccagtttcggtagtggtattattgtaataaaaagtaaaaagatggaattttgtcaaacaaaaagactttgacgctcttatataaatacccttcactgattaaccaaaatatcattaactaaataatcactcccaattagtactaatcatcactcagggcaacgtgaacagagtctagagatg

SEQ ID NO: 30885 - DNA, 3000 bp, Unknown; identical to SEQ ID NO: 10452
  misc_feature (1)..( 3000): 2750-1469P.txt file - cDNA_ID_3036546; gDNA_ID_2213650; Annot_ID_181586

SEQ ID NO: 30886 - DNA, 3003 bp, Unknown
  misc_feature (1)..( 3003): 2750-1469P.txt file - cDNA_ID_3036603; gDNA_ID_2213651; Annot_ID_132465
ctgctctgctatgtttcatcaacgagagttgagattaggaagtggtagagttatggggatctctgtcacgagagtggattgacccggtttttgaatctatcgtcatgggtatctacctttcgcctattagccatttgatgaaccctagagttgcccttatcaatgaatccatcattagaacttctataagattgatttgtatcccctattgattacacttttatttacctgttatttgtatcctccatttacatcccctgttgattgcattttagttcttaattttgtcacatgttggttctactcgacccaatgatcgagtagggctgttaagttcttatttttacttgtttgaatcctgacctaggagtgttactagaaacccaccatctttataatctggcttgacttagttgtttttgtacacatcttgattgctagcaatacaatggactggattgacaccctctatgactgcatcgacatgtttgtgttttagaggaattgaactgaactcaaacagcattcagcatataagtaggcgtaaaaatctgcttatcagaagtacacaacaatttgcagcaacaaaatatctctactcgccactctcgttattctaaacctttcagatatctacaagttccataatattaagattatcaaaatctatgattaaacatcgctatggcaggtcgataccaaacaggcagagattcctaatcgacttctatgtcatctttcccatcccagtggcggttaagtcgctgcataaacattgttcccaagccgtggttaaggcagaggctattcaattgaaaaatatcgtttcaagagatttttgggatgggagagagagcgttgaacaggaatatcaaccaattcaaggatcatacctgactcggagattccgaatcgacttttcaaaataattccttggtcagaagaattaactgccatcaacatcgatattgtgagataatttcagtcggcgaaggtagctccctttctcatctgtaaatatcaactgtcgttttattagaaaccaaatcaaaacaaaactatgctaactggttaagcaattgatggtttagattgaaaaggatataattgtctatttattctccacgaaacaagaaaaagtgtctcatccctcagaagtgcctcaaaaggaataaaagtgcatagaaatgcctaaacgtgtcacattccctatattatattttggaacgtgattttgtggaagatgggtttgaatcaatatttataaaaaattaaaataatcttaacatgccactttaatacaagttaaattttcaatttattaacaattattttgtagactcgtgatatatcattatttaatttaataacaatcgtaaactattttttttttgtcgttaacaatcgtaaactataatagatacaattttaaaacttttatatatggtaactttaaaatataaattattccgcggtaaaatctagttttcaataattatttgccgactatcaatcattgtggtttgtggtctggttcaaccgccggtttgcttcgaatttacaaaaactattttcaatttgattttttgatatatatatattttttttttccattcccatcatctaacagagaaaacaacacgaactttcctgagacggaaaacaaaaaaacagaacacgaattttcaaagttttccacacgatgtcttccataagatcgttaccacgtccctaactcttctccttcagacaaaagtactttagttattcttctttcttttgccatacttctctgaaaacagaataaatcttttgtattcggtcaaactgattcaaatactgtacagtcaagtcaaagctacaagatcgtgttccaggttttggtcttctcttccttaactctcctgggttttctctaaattggtctcttctacaaaagttcgaatcaaaaaattttctgttttgatttcgcttaattgatttctcgttttctttcttttcttggaaaccttttaattccgaaattgagagttttttttagggtttaggaaatctcttactggatctttgctatagtattgaaatggaaccctaatgttggaagctttctaaagctgagtttttgtttctacaggtttagagaaaatcttctgaactcaaaagattctcataactgagtttataaatggataattgaagttgtgtattttgttgataaaaccaaaaccatgggtggagatgatttgagcttcacaagattggtgattactgctttgtttggtctgttaatgttgttacaaatcaaggaaacttctgcatcaacatcctttgtaagctcgagtgtttgtaagtctgatcacttgacctacacaaagccttatcaacaagggagtttgttcacaattaacggtaatccggtggagaaactccggttttgcgaagctttacggtttcacaaagccaatggttgtatctttgaggattcttttagtgatgacttctgcacaattcactctctactaggtttgctctatttaaagatttttttgtgctcctttgattatatatagtaaccgaatttggttaattgtgacattgtttaatgtagggagaaggtttttggaagaaaaaactgtaaaagattccaaaaatagtaagcctaaaactgaatatagccatgttaaagttagcatagcaggaagtgggtttcttctcttgtgttgcgctctttgttgtccttgctttcataaagagaggaaagcaaatagtcatgaagttctacctaaagaatctaactcaggtcacttagtgtctctcacatttatctttcttttgtagctatgaaataataacatttgacattgaagcttatatatttctatcacagtgcaccaagtttcttcttttgaaatgagcccttcttctgagaagattccacaaagtccattccgagcaccaccaagtccatcccgcgtaccgcagagtccatctagatatgctatg

SEQ ID NO: 30887 - DNA, 3003 bp, Unknown
  misc_feature (1)..( 3003): 2750-1469P.txt file - cDNA_ID_3036603; gDNA_ID_2213651; Annot_ID_181609
aaccctcctactcgatccactactcgattcatttactcgaccaagggtgaccatctttacaagacttgttgagctatcaaagcgtctttggatcctcctcattccccactcaaccagacatctgagcatacggataggagaggatgaagcttctacttgaccaattgatcactcggagcatagacacaaaggcgcagactttgcagcaccctctttactcaatccccaaggtcgagtattcgccaaaaccgcctcaagtctcttgtcttctaatgaatctagattttccaacattttagtataaatagatcactttgggatttgtccaaaggatctatgctttatctttcagtttttctttgtgtttatgaatcttgaaaccttaattactcttaatctatttcgtttttgcatttgattgtttaagtaaagttgtttagcttgtttagatctacattttggtatgattttagtaatttctgggtttgtgttcttgagaatgttgcttgagtagtgattagggttcttgaggatggattagattaggataatctctaggttagttagctggttagtgtttaggtttatacccttctggattcgcttggcccctatgcggttttcgctggctaatgtggagattcgatcatagacgtccagcgtccaaaagacgttcaaatggatgtctgacctacgaattccagagatatgtaaactcgaccaagggattggcttgtctgcctattggctttggtagattatttcttaaaccctgctctgctatgtttcatcaacgagagttgagattaggaagtggtagagttatggggatctctgtcacgagagtggattgacccggtttttgaatctatcgtcatgggtatctacctttcgcctattagccatttgatgaaccctagagttgcccttatcaatgaatccatcattagaacttctataagattgatttgtatcccctattgattacacttttatttacctgttatttgtatcctccatttacatcccctgttgattgcattttagttcttaattttgtcacatgttggttctactcgacccaatgatcgagtagggctgttaagttcttatttttacttgtttgaatcctgacctaggagtgttactagaaacccaccatctttataatctggcttgacttagttgtttttgtacacatcttgattgctagcaatacaatggactggattgacaccctctatgactgcatcgacatgtttgtgttttagaggaattgaactgaactcaaacagcattcagcatataagtaggcgtaaaaatctgcttatcagaagtacacaacaatttgcagcaacaaaatatctctactcgccactctcgttattctaaacctttcagatatctacaagttccataatattaagattatcaaaatctatgattaaacatcgctatggcaggtcgataccaaacaggcagagattcctaatcgacttctatgtcatctttcccatcccagtggcggttaagtcgctgcataaacattgttcccaagccgtggttaaggcagaggctattcaattgaaaaatatcgtttcaagagatttttgggatgggagagagagcgttgaacaggaatatcaaccaattcaaggatcatacctgactcggagattccgaatcgacttttcaaaataattccttggtcagaagaattaactgccatcaacatcgatattgtgagataatttcagtcggcgaaggtagctccctttctcatctgtaaatatcaactgtcgttttattagaaaccaaatcaaaacaaaactatgctaactggttaagcaattgatggtttagattgaaaaggatataattgtctatttattctccacgaaacaagaaaaagtgtctcatccctcagaagtgcctcaaaaggaataaaagtgcatagaaatgcctaaacgtgtcacattccctatattatattttggaacgtgattttgtggaagatgggtttgaatcaatatttataaaaaattaaaataatcttaacatgccactttaatacaagttaaattttcaatttattaacaattattttgtagactcgtgatatatcattatttaatttaataacaatcgtaaactattttttttttgtcgttaacaatcgtaaactataatagatacaattttaaaacttttatatatggtaactttaaaatataaattattccgcggtaaaatctagttttcaataattatttgccgactatcaatcattgtggtttgtggtctggttcaaccgccggtttgcttcgaatttacaaaaactattttcaatttgattttttgatatatatatattttttttttccattcccatcatctaacagagaaaacaacacgaactttcctgagacggaaaacaaaaaaacagaacacgaattttcaaagttttccacacgatgtcttccataagatcgttaccacgtccctaactcttctccttcagacaaaagtactttagttattcttctttcttttgccatacttctctgaaaacagaataaatcttttgtattcggtcaaactgattcaaatactgtacagtcaagtcaaagctacaagatcgtgttccaggttttggtcttctcttccttaactctcctgggttttctctaaattggtctcttctacaaaagttcgaatcaaaaaattttctgttttgatttcgcttaattgatttctcgttttctttcttttcttggaaaccttttaattccgaaattgagagttttttttagggtttaggaaatctcttactggatctttgctatagtattgaaatggaaccctaatgttggaagctttctaaagctgagtttttgtttctacaggtttagagaaaatcttctgaactcaaaagattctcataactgagtttataaatggataattgaagttgtgtattttgttgataaaaccaaaaccatg

SEQ ID NO: 30888 - DNA, 3003 bp, Unknown
  misc_feature (1)..( 3003): 2750-1469P.txt file - cDNA_ID_3036613; gDNA_ID_2213651; Annot_ID_181606
tgtatcatattatttgtttattccatccataaccccaattttttaagggcatctaacagttgatatcggttaacaatgcgaacaaaaaaaatactttagagtattttgaactattgttgatttggtaaatcattcgaactaattatgtttacaaatacgtgaaaaaattaatataaatgtcatccaatgataataatttatccaatcatacaaacgaattaatacagttatattgtggatggattcatatggatacattaacaattatctttctcttttaccttgaaagacaaatctgaatttttttctaccgagaatattgagatactgttgtatagcaagaatattcccaccttcacgtttaaaactaggattattatggttagagcataaaccagaaacattatggttagagcaatattcgtttaataaaagttttaattatcacgtttattatgaggaggtgagcataattatatacggttactaaacacccacgatttatttaagtttcttccattccccattccatctgtttcaacttgaaaacaaataagttatgctcaagttagaaaaagtcgacaagaatgaataaccatctggtgtcaaaaaggttgttcagcataaactaaactacttagttttctacgttttacattcatcgtaaacaaaacataatcgtctgcatatgttttttttttatctcaggttgctgctatcccaaaaatttacatcccggcaccaatacttgtttaaattattagctacgttgccgaagatgtcgtggatgctttgaaacccttggttatggctggtccaacatttaaggatgcaatgtattccaaggaaacactaagttgtgtccgcatagacaaatatcgttatttcatgtggtggttcatgccgcattccatctattatcattttttcacacaatgtcttgaagccaacaatccacatgctttgaaagctgtattgtacaaaccaatagcatatgagaattttgttgccgaatgctatagatctaccttatgggcaaagctatacggagagcattaaggataggaatcaaagaaaggaacaaatagtcccaaattttgaaagacaatgaaaagtctgtttttgatgttcatttctgatgttctgcctttcatttcagaaaatagttgcttattaatttctgatgttctgcctttgtttttataaaatacataatttatactctgtttactcctatgaaaagtcagatcccatcaaaatttgttcgttgccatgaatgaggtttgcatatttatgtttaagctaagtccgcaaaaatgatttccaattgataaccctttaaggccatatacgtgtgctcacgtcgttataataaattccaaacggacatatatctttggacatgttctcttggatagaacatatatttagcatttaattacaaataaataactcgactataaacgacaccagacgaattatctatctaatattacaaccacccccaactcaatacgtaatattctcaaaaataaatatgtcatatagtgtaacgacaacggatcgttcaagtaaccaacccttcgatgttaaaagttacatctttttctcgcagacgaagttacaccgttttggcttcaatcaaaggaaccttttcacttgctataaatacctctcctatacttgactctaccaagacaaccccatcacaaaagaaaaacattgtcctctgttttcgtttccataatcctctgtttttcgttactcttcaattctgccgcttttcaccatgattcagttccaccgtctgtatgagttgtctccgttggtaactggttgggcgatatgtgtcatggtagtgagagtttacaaaaaaatactcaaccatgatgcattcgaactaagacttctcttggttgataaattggtatacaattttctcgtattccttttcgcaatttgcagatttttttctaatccctcacccctataatgttgttttcatagggcacccaaatagaggcaacaatcgggcctcgtttttctgccttctattatgacagaatcaaagagaatcaatggaaaacgattactacttttattgttcgaccaaactgcgaagcaataagaacaactcctcatgaatttcggattttgttcatggagcaaactgtcgtgactccctcaaccaccaaagaaaccgttgtgcttaacaacttcactccatttgactacatcatcgaagacactgttcgcaaatatactttggttggtaagtaataacttcacaaatttaattttctttccaaacacatagatttaactactgtcatcttcatcatatttcgaccagatttgcttggtgcactcgttgattatggatttctgaccaataacgcgaggaatggtaccgatttggacggattcaagctacccttcaagatcatggatagatagtacatctctttaccaacactacaagaaaacaggtaaacgacgactacaatcagcgacaacaaacgtagtcgtaacattatacgactatttggccacggatttacgactcgcatgcgacaacacgaaaaattgtagttacatagtcgttgttttacgactatcgtatgcagtcggcaaagagtcggcaagtaacgactatttgatgattaaattattgaagggataatgttgtcgttgcttagtcgctaattaacgactattctaccgtctattttatttagtcgctaatttgacgactacaggacgactagacgtcttagtcggcctgtagtcgtagaaacgtcgcaccatagtcgtataaagtagatggaaaacgtgtttcgcattggtaagtaggtacagctaactatttagttgtagtcgtaaattagtcacaaaaattggcctatataataaacgttcacgcaactcttctttcaccaacaaatcaaaacaacaacaacatcaaagagaaaaaaaaaaaattagttactttattgtataatg

SEQ ID NO: 30889 - DNA, 3000 bp, Unknown
  misc_feature (1)..( 3000): 2750-1469P.txt file - cDNA_ID_3036716; gDNA_ID_2936563; Annot_ID_194509
aaaaacacattgataattctttatatattttattaagctctcacttttggattcaaatcatttgtttagactatcacttcatttcacttggatcacggtaatttagatatggtttgatttgattttgtaactaaatatatttctaatacaatatggaatatttttgttgggtaaagaattgtggtatggatttgaataaccattggtgttcttgatttggttaatacaatgtcagatttcttttctgcatattttgtttttgtctttttgcaaccacttatagatcaaaaggtcaaatgcaataactcaccgaatactttgttgcatacttgcataagtaaaactttatatttttcttaccgatgcaaaagtttcttttaatatcgttttttcatattatttttcttgataaaatatgtataaatgttgcgtatatttttgttttgcattaattaaagagcgaagaaattgcagtcttacattgataattctttatagctgaatctcagatttgtatacaaattaaatgttaaaataaactagagtagaatttcgttatattatctaggatcacgatatttaaatttatgggattttgaataattattggtctttcttgatttggtctgcaatgtcagattttgttataatatattcaattaaaaaatatttgtttgcttaccctgtttcggcggtcagatacagagcggtgactagcgcctactacagaggtgcgttaggtgcgatggtggtttacgacattaccaaacgcctctcattcgaccacgttgcacgttgggtcgaggaattacgtgctcacgccgatgattccgccgtgatcatgctcgtcggaaacaaagccgatctctccgttggtaaacgtgccgttcctacggaggatgcagtcgaattcgccgagactcaacggctttttttctcggaagtctcggctctaagcggcggaaacgtcgacgaagcttttttccgtttactcgaggagattttcagccgcgttgttgtttcgagaaaagctatggaatccgacggtggagccaccgtgaaacttgacggttcgagaattgatgtcatctctggttcggatcttgagactagtaatatcaaggaacaagcttcgtgctcgtgttgaaattttgagtgataggccataaaatcaaaagccaattattgggcctttctttaagcccatatatgactcggatctttgtttgggtttttcatgtttagagaattagaggtggtgcttatagtaaaatcaaaaagctattcatgtgtcactcgtaatctctttgacattcttgtatatgtaaagaaaaaacaattcttttattctgtcaagttccaaggagtttcttctattcaatcaaaatgttaagtaaaaactagagttttatcaatatttctagcaaggaattttttaaaaaaaaagtctaaactatatggtagtgaaatgatggagatttgttttcaaagattaggatagtgaaatgatcagaaccacaataagttcattaagtagatatttcgtgacatcaattgtgagtgtcacgttagaatctggaatataatccaaatctaatggaagatatgattctatttatttttgcatgcaaccgaatcatttgaagtgctccaatcacaaactcgcttttcctcttatgacctaaaaaggagagtatattatataatcagatatataaaacatcacacattaatatttacattgtatctaagcacatatgattaatcggccaccaagtgctttgtgactacttagttttctatgctgatacctctgtattatgtgtaaagttactaattagtttatgtatattagcaaaagaaagattcttatataagaacaatgtaaattactcctttgaacttttatatattttcaataaacgataggatcgagttaagataagtatatgtattaactgaattaaacaaatactataagaagaaatttggattcagggccacaatgttatgataaattttgctggtgtcttaaacacttcgacgatctatatattttactaaagaggtgacaatttttgcaggagatagctataaaaattatatttagccttgatagttacagattagtagctatctgttatttacaacgaaatttacatgttataaattttcttctaattaatctatttatattgtttggaatgaaaaagcgcatacatatgtaagttggaaagtatataaaaaagtagatgattaaaaggaaaggtcgttgactaacaatagaaaaagtcaaatggtaagcaagcaggagaatagtcgtacgttcactgttcccaacttgcaatgagactcatcagaaaattggcatctttgaaaataatagtaattacgtatacatgttattttatattgtttttgttaattaagcactacgtttagatacgcaaattactttattaagatgcatatatactcacttttacttcacattatgataataaaaaaatcatgatttataaaccgtactattttatacgtaaattgtatacgtatgcgtttccttagaaaaaaacttgtagaaatagaatactcatgaatgtataagaaatagttaaaataaattaaaaaggggacgatagcagacaattattcagaactgacgtatatatcggacatatgcaagtataatcttcaatacttgtgtttatttagattaaaattctatgtaggggatatagtaatttgagtgtaccaaacatgtcataacttattagcatatacccatgagcaccaacagatgactttgaaataaagtatttataatttcaagtattctctgttttgcaattggctaagaccttcatagttcgtacgcctatttaaagcctcacaaagacccaaacataaatcacaacctataaacggaaaaacaaaatcacaaacaaaaaaagaagaagaagaacatttatcctatccataatgttctctttgaacatg

SEQ ID NO: 30890 - DNA, 1870 bp, Unknown
  misc_feature (1)..( 1870): 2750-1469P.txt file - cDNA_ID_3036716; gDNA_ID_2213653; Annot_ID_181663
cttcgtgctcgtgttgaaattttgagtgataggccataaaatcaaaagccaattattgggcctttctttaagcccatatatgactcggatctttgtttgggtttttcatgtttagagaattagaggtggtgcttatagtaaaatcaaaaagctattcatgtgtcactcgtaatctctttgacattcttgtatatgtaaagaaaaaacaattcttttattctgtcaagttccaaggagtttcttctattcaatcaaaatgttaagtaaaaactagagttttatcaatatttctagcaaggaattttttaaaaaaaaagtctaaactatatggtagtgaaatgatggagatttgttttcaaagattaggatagtgaaatgatcagaaccacaataagttcattaagtagatatttcgtgacatcaattgtgagtgtcacgttagaatctggaatataatccaaatctaatggaagatatgattctatttatttttgcatgcaaccgaatcatttgaagtgctccaatcacaaactcgcttttcctcttatgacctaaaaaggagagtatattatataatcagatatataaaacatcacacattaatatttacattgtatctaagcacatatgattaatcggccaccaagtgctttgtgactacttagttttctatgctgatacctctgtattatgtgtaaagttactaattagtttatgtatattagcaaaagaaagattcttatataagaacaatgtaaattactcctttgaacttttatatattttcaataaacgataggatcgagttaagataagtatatgtattaactgaattaaacaaatactataagaagaaatttggattcagggccacaatgttatgataaattttgctggtgtcttaaacacttcgacgatctatatattttactaaagaggtgacaatttttgcaggagatagctataaaaattatatttagccttgatagttacagattagtagctatctgttatttacaacgaaatttacatgttataaattttcttctaattaatctatttatattgtttggaatgaaaaagcgcatacatatgtaagttggaaagtatataaaaaagtagatgattaaaaggaaaggtcgttgactaacaatagaaaaagtcaaatggtaagcaagcaggagaatagtcgtacgttcactgttcccaacttgcaatgagactcatcagaaaattggcatctttgaaaataatagtaattacgtatacatgttattttatattgtttttgttaattaagcactacgtttagatacgcaaattactttattaagatgcatatatactcacttttacttcacattatgataataaaaaaatcatgatttataaaccgtactattttatacgtaaattgtatacgtatgcgtttccttagaaaaaaacttgtagaaatagaatactcatgaatgtataagaaatagttaaaataaattaaaaaggggacgatagcagacaattattcagaactgacgtatatatcggacatatgcaagtataatcttcaatacttgtgtttatttagattaaaattctatgtaggggatatagtaatttgagtgtaccaaacatgtcataacttattagcatatacccatgagcaccaacagatgactttgaaataaagtatttataatttcaagtattctctgttttgcaattggctaagaccttcatagttcgtacgcctatttaaagcctcacaaagacccaaacataaatcacaacctataaacggaaaaacaaaatcacaaacaaaaaaagaagaagaagaacatttatcctatccataatgttctctttgaacatg

SEQ ID NO: 30891 - DNA, 3000 bp, Unknown; identical to SEQ ID NO: 10474
  misc_feature (1)..( 3000): 2750-1469P.txt file - cDNA_ID_3036734; gDNA_ID_2213653; Annot_ID_181651

SEQ ID NO: 30892 - DNA, 3000 bp, Unknown; identical to SEQ ID NO: 10483
  misc_feature (1)..( 3000): 2750-1469P.txt file - cDNA_ID_3036738; gDNA_ID_2213653; Annot_ID_181650

SEQ ID NO: 30893 - DNA, 3000 bp, Unknown; identical to SEQ ID NO: 10473
  misc_feature (1)..( 3000): 2750-1469P.txt file - cDNA_ID_3036742; gDNA_ID_2213653; Annot_ID_181649

SEQ ID NO: 30894 - DNA, 3000 bp, Unknown; identical to SEQ ID NO: 10470
  misc_feature (1)..( 3000): 2750-1469P.txt file - cDNA_ID_3036750; gDNA_ID_2213653; Annot_ID_181647

SEQ ID NO: 30895 - DNA, 3003 bp, Unknown
  misc_feature (1)..( 3003): 2750-1469P.txt file - cDNA_ID_3036752; gDNA_ID_2213653; Annot_ID_181646
tatatattttttaagtatagaaaatagaaatatgacgtgctaaattgagctatggacaaaatcatatatgagaaaatgaatgtagatggatagagtcgtcccacacttaaggttggtccacaatgaataccgttggaggcttcgcaggcttttgttctgtccttgtctctctctcccctaaaaaaaatttgttacgaaaaattcatttgaattaattttggtcggtatgtgtataatattatacaattataatatatttctaggtttagacatttttttattttatttttcatgaagtaaagaacacaaacaaaaacccataaaataatgtaagatagataaaacaagaggatgtcgtcataaataaattggaatttggcatttaatgaaaaagggtgaaaggtgcttgacatacacgcgccgtagtttcttacccggaaagggattggtattgatgttaactagaccgggcccggtttaggctggggcggcggccgaaccgaccacctggctactattcttgtttgtattcgctgattctgcaaatctaaactcggatcttttatggacttggattttcgggtgggtggggttctgctaaagagacggcgctcttgtcattttaagtcggtcactgcaaaacgtgaaccctgtgactgtatttagagtctcgttacgttggatctctctccatgaaccgtccaaagtaggtcaatttttgtgggttcactcacgtatacaacgaagtacggcgctatttaattttccgaaaattttgaaagagacttttataccagaaaagtttgtaatccaaatttttaatatattgcagatttggttcgttttgggcttaaagagcttttattggtgtggtggctcaaatcgtttttgtaggcgtcaggtcaggcccattttcaatgtcgcttgctcatttgatacgctaatatagggctttgcttaagatttgaatgggccgtacccccattttgcttcatgagaatgggatggtaataaagaaaaaaatgacaggaaacaatgaattggtcacgaaaaaatgttgtattactttttccaaaatgcacctttgagaatcttaagattcaatcatacagtgaggtccatgtccacaataagaaatcaaataccaaacaaagtataaacgtgaattgtaagctaggcagtgtatgaagatgcatttgtcttaaagttacgaatctgataaataatattattcgatcgactttagatcgctttccatgcagatttatgcaattatctggaagaagaacaaaacaatatcttagtttcttcggcctcactattcgacttctatcttcaatatattttcgcgtatttttttatttgaattatttggtttttggttagttaactaaacgagcaacagaaccaagatcgaattgcgtttgccgtttggattcaattattgtagaaaattcgacttttcagacatttgttacgttctttctagtagttatattagttattatatgtggagtggaaagagatgaaagtagatgtaaaacataagtgatttcttcatagtgattttaaaactttttgttgattttcaaaattatataatatccataaaaaatagcctatgcgtgttggatgcttacaaagaagaatttgttttcggcgttagccaaaagtcgatggcatttgctaaaggtgttatttgagtggaaatgatctagaacaaaaacgcattgatataccaccactataatgatttggagacgtatctagttctcatcaacttttcaatagtaaacgcattatcaaggtaaacgaagagttttgctttatcagtgtaccatacacacattaatagattgatggacgttagtgactttggtattgactttaacgccaaatggacatcaattctgcaaggcaatgcctagtttcaaagcagcgttacttaacatttaactaaaggtagtgcaaactggttaatactttttaacggctttgcaggaagagtctcgactaaaaggagaggaagagatgagatcgacgaagattttcatatcataaaaagtaatataggtttttgaaaatagttagaataattatttttatttttatttttatgggaaagaagttgcacgagtcggtccacagaatgacagaacaaaagcattttagaagtttagaaccaaccaatcactatagttttccacttgtccgtatctcattggttcatcgaatattaacttacatggaaacagtaaaaagcgtggaataagtcgtaaaactgaaatctaaaaatgaaaagatttcgatttcgatataaatacttaatctttataaaataatatcgaaatcttttcatttttagttttcagttttacacttttacttgataaatttaatacatctgttaattttttttcttctaaaattaacatatgatatctattcgggagataaccctaagaaaactgataaaataaataagttactttttacaaagtcgaataaattatttacccttctgctttaatggcaattatcttaatattgcaaaaaaaaaaagagagaaatattactacaaaacagaagcaagcaagtggaaaacagaccagaagagagaggaagacgaagagagaaacagaacagagtagggatcgatagaccgtggaatctcagaatcacaaacactttgcaaaagggttttcaattcctatttatttacaaagaaatcatcaatagtagtggtctctagggttttgcttgctcttcttcgtgacccctttttacctgcaaacaacaacttcaaaattggcgtgtttcgtacggtctatctaaccctaatctgtcacaaaacactcttcttctctcacccctttttctgggtttattcaattctcgtgcttttggttctgttttcttctctggggatttggttttcttgagtgagtttttctcctctttcttatgttcttgatttgattattatatagaattatggtaatg

SEQ ID NO: 30896 - DNA, 3000 bp, Unknown; identical to SEQ ID NO: 10492
  misc_feature (1)..( 3000): 2750-1469P.txt file - cDNA_ID_3036827; gDNA_ID_2213654; Annot_ID_181694

SEQ ID NO: 30897 - DNA, 3003 bp, Unknown
  misc_feature (1)..( 3003): 2750-1469P.txt file - cDNA_ID_3036831; gDNA_ID_2213654; Annot_ID_181693
acgacagatggagaatatcaaatcacatatcctaacaaacgggcaagtttctttattagatcacacataggtttttatcattcctgtatatgtatattatacgatgttattaattattgtaaaggaaagtgtaataatccagccaaatatacgagagaacatgtagaaacgggaagtttttttgaaaggtatgtatgtttttgatataaaactcgtatgaaccggttttggccttataaactttcttcttttctaaaatagaattaatcatgaattgtcagggctgtagcattgttctcgttggctcgtagaaacattgagaatagaatgaaatctggagcagagatgaagaattcctcagaaatcgtagcatgtgtatcctccaaggagatacataaagagatggagaatattaagtcccatatcattacaaatagcaaccatataaaggttaagcttgagaaagacttttagtatgttatgttacaccctgaccttttatgtattgatttcttgggtcttgtccatacctatgtttttttttaatatcaaattaaaactgagtttatcatttattgcctaaaaagccgagtaaaagaacttgggatcgtcgatctcttccttcaaaatttggatgagtcggtccatggtctgaaaacactttctaatgtcgaattctaaaaacaatcgagaggttccccactcttccttgatccgtcgtaggaacgagtgggaggcctgactaatgctaatatgtatcgcttgtccaaagccacaaacttattaaccaattagcaaactgggtgttggtcattttggaacatgattatcatcctttattgatcttaaaatatgtaaaacatttcattttgttaacataaaacattttaaaataaaagtaaaatattattaaaaattaaaaaggaatataaatgaaaatgaattacaggaaaatgtaaaattaataaaagagtagtcttgaaagagaattcatagcaatttctatagaataaaacgtagaactcatatttaactggagtgaaatatagaaaaacaaaaactaataaatccaaaaatatttttgtgaaaccttataaagatgaaacattagtaaaatctagcaccagaatttaaattgatgagtgaaatgaaaattaataaaaaatatagaaattgtctttgaggttttaaaaaaataactttagataaaaattcatatgattttttagaaaaataaatataatctgtcacttacaaaataaaataattttgaactattatgtatgagtttatatcaataatttattttgtaatttaccttattgtaaaagtaatatatcttatttttattaatataagatatcaaatcataaaagcttttaaaatattttttagtcatctacatatattaaaacaaaaaatactttataaaaaataaataaaaattgagccacgtaactcggactattatctagtaaccaatggaaaaaggcaaatatattgaacgtatcaaaactttatatcatcgattgagataatagatctgttttattattcttgggatacgtagtatttaagaattgcacaaatacgatcctttgatttacaaagcaacccctagaaattattttattcgataaagtggagtttttctttactttattccacaacagacccaaccctaattcgtttcattctctcgtttcttccccaaaattctcaacttctcgcgctcctaaccctagccttcccaatttcctcatcttctagatccgcttttgtgatttggtaaatctcttctctccctcacttctaatttcgttacagggcaatgttttttacttttgatcagccaatttcaaaatcctcgtttgtttttcagaaatttctagggtttttttttggtgtgtgttttatggattgttgctatgatttagctgaattttgttgaattaaactgttttcttttgctgtttagttctattcaaagttttgtactttgtggtgaagacccaattttgttgtttctgagtcctaattcaaagactggaactttaactctttagtaaatgtctctttgtgagtaaggcatttagctttctctcctctatatataaaggtgagattttgatgagttcttgagtgaaggaagagttaaaaatgtagggtattatctagagtgtgctaatctggtatcagagtttgtgtgggattgatttgtacagactattgcttttgaaattccaagatactcagtttgttttccctctcttagtgtgtatggaattgttgctatgattttagaggattacagaagttacttggtttggtagctgacttttgtgagattcaactatttccttgtgttcttttgctcttttgttttgcttagttctaccaaagttttatcctttatggtgcagctagcctattcaaagactaaaacttaaaccctttagtaaatgagcaactctttgtgattaaaacattcaagcttctctaatctactaaaaaggagagattttgatgaaattttggttaatgaagagcaaaaatatgcattttagttgcggccattgtgcttatctggtgtcagaactcagaatttgtgtgggtttgattatatgctagctacatttggcttttgcggtgatttgctattctacgtgtgttctctatacgttatcaagtctcagtttagttcaaactgattgtgaattcttacagttatatgcgctttttgtttatatttaaacatttgcacgcttgacatttactaaaatgaacttattgtcctatcccggtttgctagactgacccttttaccggctatggttgtagtttaggcgtattacttaagacgatacaatttgcttgtgtatctgatgtaacttttttcttccgtttcgagttcctcaggtttctgtgggtatgggaaaaggtaagcttatattgatttgtcaatctggcggaaaatttgtgactgatgatgatgggacaatg

SEQ ID NO: 30898 - DNA, 3003 bp, Unknown
  misc_feature (1)..( 3003): 2750-1469P.txt file - cDNA_ID_3036893; gDNA_ID_2213655; Annot_ID_181733
gtcaatcgtacactaataatacctcgatcacaaaaacttttaggttgtcccggagactctggagcctagtctacagttggcagctgctgttcttgctcaggtaaaacataaatgtttccttatttagttgaagtagtaatcctaaacagtgtatgatcattttttgggttgaaacatgtcaggcaaaattaccgacatcggaaattgcaaacacgattaacgagttcagaacccgtcacttgtctgaactgaccgaggtgtgtttcattgtcgatatatccatctatatttatcagaatctggtttggtctgattgatgtgtattgggaaatggtgtaatgataatggcagctatgtgaagcaagcggaagctctctaggctatgggtactctaggacgagtaagcctaaacctcaaccatcggatgcatctggcgataaccagataatcgaaggaggcacagtcgtaatctgatgacgttctccattctggtgagaaaaagaagagtatttctcctttggtgttcttcttaaaccaccatcaccaacttgggttgcagtgcgtggtgaagtgatggatccatcagatgatgtgtagtgtgactaatatattcattatatgttcagtacatatctctcatttaagtctttgatctcagaacaattagatttgaacaaatgcgtagcaatcgattctcggcggcagtaataacaaatgaaactacatcccgttcttgtactacagatgtgaacaccttgcagttgttggtaaaagactgaatgggccttcttttctttgacttcgactgaatgggccttaaatacagttggttttatggtccaaacaagatttacgtaattgtttgaccatcgatcattacaaaacaaaatagataccaagccataaattaaaccaaagattgggttaatgtcatgttccagaagcgagaatgataaaggcatgtaatatgaaaaatgtccaaaacacaagtgatgccccaacggaaaaaaaaaaaaaaaagaataagaaggaaaactactgatacaggaaaagccccaatagacgatgagaaaaaaacagttgctctcttttggccatttctatttgtagcttcatcagagcaactgtttttttttttgttaataatatatattgatatatttgaaacgttatttaggtcaaaagagagatttttaacaaaggaaagggccaaaagagagatttttaacaagaataacgctgaccaaaaagggaccaccaaatcacatttgccgaaaccacaagtacctcaacattataaaaacatccaaacatatatccaatgtactgtgcatgtcattattatatttgaggtcaaatatttaactaatgttttttttatgattaacatgcgagtttacataaagagttagtatatgataaactgttggaaaaaaaaagtagtagggtacatgttacgagaaaactaaaaaaaaaaattattacattgtactgacatatatgttaagaaaaaaactatatgtagcataaacgaaggcaaacgaaaatacagctcgaaaaaactaaaaaattccgattttggtgttaaaagagccaccagaaccgataacacaatcagcggcgactaagtttctttaagagagaagcatgagggtttttgaagagagaaagggtttggtttttgtacagtatttgttcgtttattcgcagaaaaaaaaacaaaacatagcagtcatggattctctttcaacgcctccgtcgactatgcaaaattccaccagaggctctcaatccttatcgtccctgctaacgtcaaatctccctccaccgtcgtttcagccaccaacgacaaatctcagtctgaattctctttcaacgccttcgtcgactatgcaaaatctctcactatacctcgggattctctagctcttgcacacttacaccatccatgctaacgtcaaatctccctctgctgtctaatctctctccactgtcgtctcactcaccaacgacgaatctcagtctgaattccctttcaacgatgtcgactatgcaaactttcaccggagactctcagtccgtaccgtctctgctaacgttaaattttcctctgctgtctaatttagggcttttattgtgctctatccaatagtgccaattctagctatggttgggttctccgtgtgcgagtgtattgtttgtctactcttctggtttcatttaggacaaaatgatgttgcagagcctgaagaagacatgtgatttggtctacttccgaagattttgatgattataattactcctttttattatatgagaattatatgttatgcacttctttctattctatgagaattatatgttatgaactcaaattaattctatactatgttttagaaacgaatgtttgctggatatttcttattaatattatattttgtgttgaaaagtgtttctagatgcgcatacaaattagttgagtttgagtagcaaatatgtatgctgcttttttcctacatttttcggtttgttatgttttcacatattcccttgggaatcgatccaagcggaaagcctaaaaagaagaatgcatcaattcgtgttgatttgtgggcttaagcccaatagctttggaccctccacactgatagcattttcttagggctatcaatgctaaaggctaaaacgagactgataattaaataagttgcattaattaagcaagtgtcacgcttcttcttgttaaaacgtttagtctgtgactaaataaatatagtatgacactgaaaaaactcctttcactttttttaatatatactataatgatgatccattctcctttgatgctaatttggaaatattggtcttatcaaaaaatataagaaatatagcggtgtctaatcttccatgtgcacacacttgtttatccctatttttttgtatatacttttttagttaacagcatgaggcttgacttttctctgtcctttcaacaattcaatg

SEQ ID NO: 30899 - DNA, 3003 bp, Unknown
  misc_feature (1)..( 3003): 2750-1469P.txt file - cDNA_ID_3036897; gDNA_ID_2213655; Annot_ID_181732
accttacaatgagaggctatcaatctggatttcatcactctcctgctccatctggccaaaagatcccactctactctgttgcacatagccgggctggcgataaaggaaacgacataaacttctcaataatcccgcattattccccagatgtcgagcgtctgaaactcataattactcctcaatgggtaaagcatgtgatgtcagttctgttatcaacctcttcgtttctggaattggatgcaaaaccaatggatgaaaatgtgtcagtagagatatatgacgttgaaggcattcatgctatgaatgttgtcgtacggaacatattagatggtggagtcaactgttccaggaggatcgaccgacacggaaagacaatctcagatctcatcttgtgtcaacaagttgtgttgtaagactactttaactttgcatatcagatttttctattcaaattctgtggtaatatgttaataaaaagggagacttgaactacactatagttctaaaagataatagaaaaagaaggaatcgacttagtggtgcttcactttcttttacttctatacattaaaattactttaatttacaactggatatcttgatagatacgcatacagataagtattaaaagcattgttttgattgagagagaatgatattatatatttgtgtaatgttaggttgttgttatattcttttgcaggatctgactgacatgggttgcaccacctcagagacagttggcttaaagtaacaatcccttattggattgaaattgtcagaaaccacaacccttcttttgctcaactccaatcactttgccacccaattttatctcattcattttgcaaaaaagatcaaagagagagagagagagagagagaaagaaaaaaaggaaaaaaccttcctccgttacaacctcacaattgcaacaaagtttcatataaaagaggacagaaatttcgcaggttcctccgttgtctgaggtaaaggtttccttctttaactaattcctcagatgacctcttgatttgttggaaaaaaaattaaaaaatctgtttcatacaggatcttggagaaggaaggaaacaacaacaaccaaaaaaaaaccaaaaaaaaaaaagataaaacaaaaaaaatgtctttcacaggaactctcgacaaatgcaatgtttgtgataagacagtctatgtggtggacatgttgtccattgaaggaatgccttaccacaagtcttgcttcaggtgtacccattgcaaaggaacccttcaggtgcactcattactcattttcttgttagatcttctatgatcatattatatcaacaatttatctatgtgttgatggcagatgagcaactattcctccatggacggagttttgtactgcaagactcattttgagcaactcttcaaggaatctggcaatttcagcaaaaactttcaaccaggttcgtattataaaatctctgacatcgaatctctctatctttcaaatcatcatgatcataacaagtctctttcttttctcaggaaaaactgagaagccagagctggtaggttcatcattacatgtccttgtatatgattagcgtgtcaatatttcattttctttcttttatgatcgactaataggatctgtgtactgatttaaacattacagactaggactcccagcaagatatcttccatcttctgtggaacacaagacaagtgtgccgcttgcgaaaaaactgtttaccctcttgaaaaggttagtggtatacgcatctgcaaatgttctcatggcctaaaataccaacgaactagtctcgtagagaaatttatttgctctagaatttgttttttgttttttcatttccgtagaatttttctgttcggataaaatcattactagatcaaatggaaataaaattttgattttggtttggtttagtatacttttggttcgatttgagaacgtgatgttggttggtccaagcaaatgtggaatcaattttggcttggttctaatcgggttatttggtaacagatacaaatggaaggagaatgcttccacaagacatgtttccggtgcgctcacggtgggtgtacgctgactcactcctcctacgcctccttagatagcgttctctattgccgacatcactttaaccaactcttcatggagaaaggaaactacgctcacgtcctccaagccgccaatcaccgtcgcacagcctcaggcaacactcttccaccggaacctaccgaagacgtcgccgtggaggccaaggaagagaatggcgtttcagagtcttgaatatctcttacatgagtgtttttgagtgaatgattgaatgaatgttgttgcgggggaaagatttgatttcatttgtaatgagttgtttccatatgaagacatgattttttttgttatttttttaattcattcgttatacatttattattacacacgaaaaaaaggcaagaattgatgttttttcactctatgtgtgctgcttatgatatgctttccgatggtgatgatgatattcgatgtaatatctgttcggttcaaagataccaaactacttatataccggatcaaaccaagtggttatcgggtgatgtgaatcattcattatttcgttaggtgagagagggtgttttcgtaaaagtatctaaaaacggccttagcaatgatgtctggttggcgagaaactcaaaaaggaggagacagagaaagttgtttgactgggaaaatttgaagagacgagccaaaattatctgtttgaaacgaacggaattgaagacgagagccactcctttccgtttccacctttcttccattcttactcaactttccatgattggttagcctctctatctgtccgtggcttgtcgttgattttttttatcttggtcgtctgaatgtgtggaatttcgttttgcttcacaggagttgtatataaggttcgaggaataaagtaaggctactttttttatttgatttccgatatg

SEQ ID NO: 30900 - DNA, 3003 bp, Unknown
  misc_feature (1)..( 3003): 2750-1469P.txt file - cDNA_ID_3036901; gDNA_ID_2213655; Annot_ID_181731
ttcttgtcgtttcctgtttcgtgattaaatctgatcattcttgttgtgtcatcaggtctatgaactaggttggaattggaatgacttggagctgctagctcagggaactctcgctggccaccttctggagtgcggttgccagctcactggtggatacttcatgcatccaggtgcgttttacgcttattggctcagggaagatatgatgaactactgttttccattatcagtatggtcatttcgttcctcaatgttctttaggtgatcagtatagagacatggctttccctcttctccaggatttgtcacttccttatgcagagattggctatgatggtaaagtatgtgtatcaaaggttgaaggtagtggtggaattttaaataccagtacttgcgccgagcaacttctgtatgaaattgctgaccctagtgcctacattacacctgatgtggtaagttagctgtacaaaatctagaagaaataactgtaaaaacggcggaaatatttgatttgaaaaccttctttgcaggtaatcgatattcgaggtgtttctttccttcccctgtcagactgcaaagtacaatgcagtggagcaaaaccatcttctaacacttctgtgcctgagaaactcttgcggttaattccaaaggttgttatccatagaaaatgctggtggtatttgattgatgctaaagagcaacctatgtttggttctataattcgtattttctttgcaggagtgtggttggaaagggtggggagagatatcttatggaggaaatggttctatacaacgtgctaaagcttcagagtttctggtgcgcctatgattaatatgtctatgatgtagtagcattttttggccccatcgtcgcttgaaatgactccttatggtgccttaaattggagttcatttcttatcaagtgtatgtacgtattttacttgtgttttttccttctttctttcaggttcgatcttggatggaagaaaccattcctggtgttaaccattgtattctttcttatgtgattggggttgatagcttgaaggcgacaagcaacggcactgaatcttggcagtcatgtggagatattagattacgtatggatggtctttttaaactgaaggaacatgcggtccagttaacaaaagagtttactgctctatatacaaacggaccagctggtggtggtggaattaggtaatttcttcacgttgatgttcgctccatatatcaatccaatgctaattgtagctttacagtagtaccaaatcctgttgagttgagacatcttatgactagggacaatgtattgaaactagttatttgttatgagattcggggtggtctttttggtttgacaaaactgcttgtaaattatatgcagtaccggacacaagatggaaattgttcttgaaaagcgtttggtaggtcgtctccatcaaaaaatttaaactaatatagccttgcatcaatcaattttacggattctgatgttatatgtttggttatccaggtcagccgtgaatctgtaatgtggaaaactggacttcagcacaccaacacttcagagccagagacctctgaacatcattctccagagaaaatgccaaaggttagctcgagagttcttactaaactaattgtgatgactgatagataatggaaataaacatgacctgaattcaaattccttggtgaatcaatcctagtgtgttcgaacatcaaactaactctgatgactgatagatatgttttactatttgaaagctgaaaatgtgaaagaactctaacatgtgcatttgtattaacaccttgttattacttccatttgtagttacctaaggaaaatccaaagaaccttacaatgagaggctatcaatctggatttcatcactctcctgctccatctggccaaaagatcccactctactctgttgcacatagccgggctggcgataaaggaaacgacataaacttctcaataatcccgcattattccccagatgtcgagcgtctgaaactcataattactcctcaatgggtaaagcatgtgatgtcagttctgttatcaacctcttcgtttctggaattggatgcaaaaccaatggatgaaaatgtgtcagtagagatatatgacgttgaaggcattcatgctatgaatgttgtcgtacggaacatattagatggtggagtcaactgttccaggaggatcgaccgacacggaaagacaatctcagatctcatcttgtgtcaacaagttgtgttgtaagactactttaactttgcatatcagatttttctattcaaattctgtggtaatatgttaataaaaagggagacttgaactacactatagttctaaaagataatagaaaaagaaggaatcgacttagtggtgcttcactttcttttacttctatacattaaaattactttaatttacaactggatatcttgatagatacgcatacagataagtattaaaagcattgttttgattgagagagaatgatattatatatttgtgtaatgttaggttgttgttatattcttttgcaggatctgactgacatgggttgcaccacctcagagacagttggcttaaagtaacaatcccttattggattgaaattgtcagaaaccacaacccttcttttgctcaactccaatcactttgccacccaattttatctcattcattttgcaaaaaagatcaaagagagagagagagagagagagaaagaaaaaaaggaaaaaaccttcctccgttacaacctcacaattgcaacaaagtttcatataaaagaggacagaaatttcgcaggttcctccgttgtctgaggtaaaggtttccttctttaactaattcctcagatgacctcttgatttgttggaaaaaaaattaaaaaatctgtttcatacaggatcttggagaaggaaggaaacaacaacaaccaaaaaaaaaccaaaaaaaaaaaagataaaacaaaaaaaatg

SEQ ID NO: 30901 - DNA, 3003 bp, Unknown
  misc_feature (1)..( 3003): 2750-1469P.txt file - cDNA_ID_3036905; gDNA_ID_2213655; Annot_ID_181730
acaagcttgggaatccagaagaaacttacgaagatttcaccagatctattcccgaggatgagtgccgatatgctgtctatgactatgatttcaccacccctgagaactgccagaagagcaaaatctttttcatcgcatggtacaactccctgcccttgtatttttaatgatttgaaaaattagatgttataattgagacatcaacttgcttcaggtcacctgatacatcaagagtgaggagtaagatgttgtatgcaagctcaaaggacaggttcaagagggaattggatgggattcaagttgaattgcaagcaacagatcctagcgagatgagcctcgacatcatcaagggacgagtcaatctctgaatggaacttaccgcatcttaattcgtttcagtcaaaattcatattttctgctttcgttttcttgggtatttttcatttaacttctttactatttgtatcttctgtgattcaagatctcacctctttcttttttccttttcggtacgcaataatcatcccaatagataattactttgcttccctgaacaaagctggcaatttcaagcaacttgttgatgctaatgaactaatgatgcaaagaacatacgctaaaagagagagtaaataggatgacatacctcacgtctaatttatcagaaaatcctcgcaattcaagggttttcttagccaattgttgaatggatactttcctttaaaaatctttgacatcaaataatattccgtagctttgttctgcatacaattaaaacaaaaaagaaacgtaaatcatctcagaattaaccagagaacaatatcacaaaatcacaatcttgcagcatacatgtcaaaaactcactatgagatttatacactttagcatgttagttgttccagtggaagcatgttaaagctgcagaaaagaatcagcatcgcacacaccttcagttctcggtacgatttttttgacttggaagattcccttttgtgtccatgagtttctttcaagaatagctccagtaaccgctgtctagaaaaatatatgaatatgatatcaactacaaataatgaaggtcatgcttggataacaaggctcatccccttacttgcatatagatgattgagtagacggatacagagctcctttagctgatgtgccttgctttctaccggttgttccaagaataacttcgtgtaagccagaatagttccaacacaaggaatatctaagagccaacaaatagatcacaccaccttttaagaaacaaagaaaggacacacatgtcatgtgaggaagagtattgaaaactaacccgcatgttaaagtagcttgcgcagtttctgaatgctgaaactctgatggtggtactggagctacaaaaaacagtggctggaaaggaattagcacgatatatgctagtaactactgcaatttccatgatacattggtataaagcagctagtgaaccttgttcaaacggaaggaagtcagaagttcatccgataatgggaggatcctctcatacaaagatcttcgcaagtgatcagctaaagaaaaattgtcaggactgtgcagagattgtccaacggtgatggtagaaatatacacaggctggaggacttggtaaagcaatgcccctgaagtaagaacacacaaagagagaaaatcccaataagcaaatcttaaattacacaacaaattatctgtcaaaattcagggtacagaaaccttgaactccaagaacattccatcgagctatcttatccgaacagctaacagagagtgttgtttcaccgcgaccaggctttctttgcaccatatctgctacttgtgagccattacctgaaatagagacatccaaagtaaattgataccaacatgagcctaatccgctttctcccagcttctaaataagaggaaggcaagctgagagaaaactcttgcagcattacctttgttgctattactacctatctctggaacatcagaatgccgagacgagcaaatatcagaagcttgaactaacaatgagtcatctacttgtgttgatggaatctttttcagggcatacaagggtgaactagtagaagcataaccacctacatatgacaaacacgtcaatgccaagtatattcttgaaacagataaagaaacgtaatgaggcaaattgaaggtaaattacatggcaattgagaaatgtacaaatgcaagaggcacccagatttgagcttatatttgacttctccaggacagcttgaatctgctgactctagtattgagcttgtttcgctatcaattctctgacgcttggcttcattactcttacctgaagtcaattgcatccgctgaatctcggaatagaagaacctgatgagagctcttctggcgacaacttcggcatgagaatcgttcacaatgtccccacggggactcagcagcgacccactaacgcacttggtccccgtccctaacgctatcactttcgggtctgcacaaaatcctaattagctctaaatcgaaaaccaaaaataaagcaaagagtgacagagaccttgggaaggagaagagacgaggaaagcggagaggacggtgacttcacgtccctgaggttttcccttcttcgggagagacatgtaagccgaaataaccttctctgatactgtctttccccaatcctcctccattgctacgattcccacaaacaagtccgttgattcattcatgctactcaaaaaaagcagattcaaggacccgcatgaaaatagttataagtttagggatcgttttagtatatatactacaaaattattaaagtaatcaaaatcccaatgggataagcatctttaactcacttccgtcactcgcttccttcacgtctctctcccaaaattcaaattcctcaggcctaaccaatcctgtgatcgacgtcgtcaaatattcaaaagcagtccgtgatccattgcatgatcctcttcctgtgggattcttactctcatg

SEQ ID NO: 30902 - DNA, 3000 bp, Unknown; identical to SEQ ID NO: 10496
  misc_feature (1)..( 3000): 2750-1469P.txt file - cDNA_ID_3036913; gDNA_ID_2213655; Annot_ID_181727

SEQ ID NO: 30903 - DNA, 3003 bp, Unknown
  misc_feature (1)..( 3003): 2750-1469P.txt file - cDNA_ID_3036917; gDNA_ID_2213655; Annot_ID_181726
aaatataaacggaggaactaggcagtgggaccggagatccaccgaccggaaacgaagaatccatagtaagatagagcccaggggttcggtcgtatcggaccggtcggatttggattctaacgacaagtgagtggacccccagaaacgacagacgtaagcaatgacaacatcaaactcatcgccacgtcagcaacggagttctacttgcgaaacgtgtcccggcagcgtcatccacccacgtgtgttctagaagctcttctcctcctccgtatctcgacacgtgtccactccctctccttatataattgacttttctctcattctttccaagtttcaaaaacgccaagtttcagaggtagagagagagatactacaattgattaggataggatcaggatcatcctcaacaacctcctcctaattcctcctccattcatagtaacaataatattaagaaagagggtaaactatgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtgacatactagctctctttctctttaatctttgccggattctaaatctgagattgttctctgctgactcaaattcaattttacaggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcagggtatggaatcagatctgattcacatctttgtttcaatctcttgttctgtttctggtaaattgaatcaacggtgttgatttttgcccagctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactagaagggaattcctttcctgccgccgaaacgcaacgcaaaacgaccctcgtttttgcgtttatggcaacacgagaccgttttatatggtcaatgagtgtgccgattcggccattagatttctgttcagtcttcgtttattctatagaccgtccgatttcagatcatccctaatcggacggtggtcgttggatgtatcagtagtgtattactgtgttaggtagaagaaaatccacttgttcttaaattggcataaaagtcagaagctaatatttatatgtgccgcaatcaatttaatattttctgtctacttaggagtaatggatacaaactagcgtattggttctatatttatttatcagctttcacagttgatctgacttacatttattgtgaacatatctaacaagtgtagaggagtaatggatacaagctagagtacagtgtgttagcagaaacgctataagatgaagtctgatgttgagctacatgttactgtccattgtcacttgtcggacttctttgatggaaagatgaactctttcacggaatcttgcgctgaaagtatcctctgtctgatctgcatatgcaaaatgtcatagataatatagagttaattggctacaaaaccccatcgaaccataagaaattgatttggtgttcaagagtaaatgagtaatcagtactctcaacatagagagagtaacaacagactaaaaactcagcaaaacaaagtagtcactactcattcgttgaagatccaggcaaacgcaacaaagctgagcatagaagtcaggaacattcatatctcattcaaagttttctaagatcaaaattcaaccctagcaactaacaactaataaagagatctaaccaatatcaattgaaaccaagtgattgtaggctgtagcaaatatctgcgattcgaagcgatgatgatcgagaaggttgacggttcgatttattaaacacaaacaaaaaaaaaagagagagagagagagagagagagagagagagagagagagagagagagagagagagagagagagagagagagagagagagagagagagagagagagagagagagagagagagagagagaaactcacaggatcaagagcgttgggctctggaccgtaatcagcggttaagaggaagtacgatacaacagcagtcgccaccacactggttaccttcaccaccttttcaatttggggattcatcgatgttttcgttcccagaaagaacaattccggtgattttggtttttttcaagtgacacaatgatgatgttatacgtttttttattggtaaaacgacacacaatccgatttgtgtaagaaaattcatgccgttttcgttcacttcaaatatgggcccagaaaggcccaaacatctcatcaagtcctcacggcgtcgtttttaagatccccgctgcgttgatttatggcgatctctttcggcggttgaaaacctttgaaaattgaaaatg

SEQ ID NO: 30904 - DNA, 3003 bp, Unknown
  misc_feature (1)..( 3003): 2750-1469P.txt file - cDNA_ID_3036921; gDNA_ID_2213655; Annot_ID_181724
ttttgtgtgtctgggttaaattttttaattacattgaggcattattccagtagggatcttccagataagtaactattacgagttactattcctcatttggtttgcaggatgtggtttcaccgacctctaagagccgacgagtggttgctctatgtggtagttttttctatccttgtttcttatgaacatttcagatcaaatgtttgttcagaataaatgaaaatgatttttggtatagagttgttttataaacttgtttgctgtaagaggttcacccacttacaacacaaaggatgctgcttgcagattgtgagtccaactgcgcatgagacccgtggttttgtgactggtcaaatgttcaacaggaaaggagaggtactctttctctattcttttgaaccctattatacatacatatctggaaatgataagtgataaaagaattccttttggtatgtgtttttgaatatgagaacaacagctggttgtatcattaacgcaagaggccctattaagagaggctagacctccaaaaccctccggcacgtcgaagctctgaatggctctcaacgtaagttaaataagatacattattacgagtacaaggcgacgaataaaaagatcaaaaaccaatctgggtgggtactaaataaaagattttattagacaaactcataatgtcaatgtagcacgctgtatgtacattgtttgattccggccttctcacctctatcatcatctatctataaattctcttgttttttttttttgttttaaaattctttctcacaagaacacctttagatcgattcgtgggccagaaaattatgggcccaagtatcaaattagttttcgtacgacccattttggatccgcgggggtatctttgatggaaccggtacacctgcttaaccggccggtttatagttttgtatccatttgtgatttgcgggtttctgttgccacctccccactctcctcgcttttgttggtcttggaaaaaccctgggattttgggtatctctgagcacgaattctacattctcatggctttcgaacacagaaatgaagacctaaattccttggattcggaagaagatctggagaaaatggagtcagaggtggagcaaatgtcgcgcaaggtttccgagtacaggaaaagcctaccgagtaatctgagcaattctgtgatttcttctcgtagatccaattttcccaacatcgattctttgggctttcgcacaactagcacaggttcgtacgtttctttgcttatatttagttagataccttccttctcctttggtttcagctggaattttagtctctttttctttctagatgatgtaataatagattgatcctctacattattcgtggatcattcttgtgaagaccaagttgtttagcagcagcagacttgccttttgattgtgatgtcgttttttgcatttaggtttgtgtcatgccatgcgtgtagaatattgtgatacttgctactataccctctggatgattatgttcatgagttattacgcttaattctgaggtgatgatacatatacaaggcttttccattacaataaatcatgtatttttgtggcttagaatcgacaagcatgagactatgtgatgatatgtttagctaagctgagagaaaatgattgtttagccaatttttgtttacagataccatgagataagtggccacattaggtgacactaagatttcatagcattgtaatatacacaagtctctagtgaactgctgttgtgataaccaactcatcagttattttgttccttgcaagtttggaagaacctctagtgtcaagagatggagcacatataggtggaatcgaacaagaatctcgagatagcctgattcagctcaaagaaagagtgtacgagaacattgccacagtgcctctagttgtagagagaatgcgagagagtaaagagagaatcgacaagtccatttctttcaatggaactactatgcacccggctttcacaaggcggaaagctagctaactgatcagtttctacttctccctattggctttaccactcaaagaaagctaatgcataggaggagatatggctggtatttctttctactatattagtatcaaccaacatctctcgcatttagaataagagtataccataacctctgttttgattgtgttctacattgaaacaggtctttctctgattttaatatggactcttatagaatcttgggctgattctacaccctgtatgtatatgtaagaatcacataatcagatggttgcacaattgtcaagaacacccaaatccaagcttgcgatttagcaatctcacccgtgtaagaaacttaaaaccataaaaccaattgatataagagcttttctagcaaaaacttaaaaatataattaacaccgtcgaaaatggtggaggctactagagcgagatataaactttatcaccgtttaatcgtgtgggattttgaaatgatatgaacctattgcaaaaagacaaaaaaaaaatataaacggaggaactaggcagtgggaccggagatccaccgaccggaaacgaagaatccatagtaagatagagcccaggggttcggtcgtatcggaccggtcggatttggattctaacgacaagtgagtggacccccagaaacgacagacgtaagcaatgacaacatcaaactcatcgccacgtcagcaacggagttctacttgcgaaacgtgtcccggcagcgtcatccacccacgtgtgttctagaagctcttctcctcctccgtatctcgacacgtgtccactccctctccttatataattgacttttctctcattctttccaagtttcaaaaacgccaagtttcagaggtagagagagagatactacaattgattaggataggatcaggatcatcctcaacaacctcctcctaattcctcctccattcatagtaacaataatattaagaaagagggtaaactatg

SEQ ID NO: 30905 - DNA, 3003 bp, Unknown
  misc_feature (1)..( 3003): 2750-1469P.txt file - cDNA_ID_3036925; gDNA_ID_2213655; Annot_ID_181723
ctgacttttgatatatattccaacgacaagcgtgtccaagtttcttccctcacttgtcattgcagcttacgtgtttggtgttgccgcgtgatcactgtcatttgcttgagactaattccatctggcaatcggatacgtcacttgacaaatgctctttagtggaacgcattttgcaactcgaccctttagaagtacgtacggacggtgttcttctttatcacatttctttctgcttctggcaactgaatctctttttctctgtgcttctttcttctagttgaatatcttcagggggatcacactacctgatgctcctatatttggaaaggtttttggaggacaatttgtcggacaggtatcgcattttctctaggaaggttacattattatgtctctgtaaaccttgctgatctgattcatgtgcatatatatattgcttgttaacagtgataaccgtaaccactactaagtcacttttaccaacattttacaggctcttgctgcggcgtcaaaaactgttgattttctcaaggtcgtccacagtttacactcctattttcttctcgttggagatattgacagtatgtacataatctcactggggcactttctagccaccaatgatgcctttcttccctattgaaacccaccctgctgttggattcatctgattatcatagtttgttgctcttgcttgcagtccccattatttatcaagttcaccgcatacgtgatgggaacaactttgccacccgaagagttgatgcagtacagaaaggaaatatcatattcatcttgctggcatcatttcaggtttcccattttattctttacaagatagcttatgaatctctacgtccacctgccaccaagagagaatagcctttcacaaaactgggaaaattgttttcttaaattttctcttttattactttcatagaaagaacaacaaggatttgagcaccaggagtcaaccatgccctctgtaccagatcctgatacggtaaatcatttctccagatttaagggttccaataaattgttgtgtgttttatttttcaccattatctgctacagcttctatcactggaggagttgcgtgaaagccgtataactgatcctcatttaccgaggtaagtggtagtgttttccaatgtatgataacttatatcaaaagctcaagttggaccaatcttccaattgtttctttctttcaggagttatcggaacaaagttgcaactagaaactttgttccatggcctatagagattcgattttgtgagcccagcaattcaacaaatcagacaaagtctcctccgaggttaacaactcgctgaaataaatcaattatatcatagagtactcttgagtgtatactcataaattccattaagtatttcttaaaaaaaaaatcaagaaactcacaatgccttcttgcagattgaactattggtttagagcaaagggaaggctttctgatgatcaagctttgcaccggtaagtaactccatctatgtatatcaaggtaaccatctaaaaattggtattattcatctggtaacaatcctttaaactttaaaggcaagaatgattgtagacaagtgaatcaatggtgttttagtatcccaagttgataggttgagacttgtaaaaggccaaactttcttaatagcattgaaaaactgacggtatattgaaattcaatttatcattcttagcaaactaatcatttggcaaagccatgttgatatgcagatgtgtcgttgcatttgcctcggatttaatattttgtggtgttggtttgaaccctcaccggagaaaaggggtgaaatccgccgcacttagcctggaccatgcgtaggtttttattttctcttggtgatgtatgagttttgtgtgtctgggttaaattttttaattacattgaggcattattccagtagggatcttccagataagtaactattacgagttactattcctcatttggtttgcaggatgtggtttcaccgacctctaagagccgacgagtggttgctctatgtggtagttttttctatccttgtttcttatgaacatttcagatcaaatgtttgttcagaataaatgaaaatgatttttggtatagagttgttttataaacttgtttgctgtaagaggttcacccacttacaacacaaaggatgctgcttgcagattgtgagtccaactgcgcatgagacccgtggttttgtgactggtcaaatgttcaacaggaaaggagaggtactctttctctattcttttgaaccctattatacatacatatctggaaatgataagtgataaaagaattccttttggtatgtgtttttgaatatgagaacaacagctggttgtatcattaacgcaagaggccctattaagagaggctagacctccaaaaccctccggcacgtcgaagctctgaatggctctcaacgtaagttaaataagatacattattacgagtacaaggcgacgaataaaaagatcaaaaaccaatctgggtgggtactaaataaaagattttattagacaaactcataatgtcaatgtagcacgctgtatgtacattgtttgattccggccttctcacctctatcatcatctatctataaattctcttgttttttttttttgttttaaaattctttctcacaagaacacctttagatcgattcgtgggccagaaaattatgggcccaagtatcaaattagttttcgtacgacccattttggatccgcgggggtatctttgatggaaccggtacacctgcttaaccggccggtttatagttttgtatccatttgtgatttgcgggtttctgttgccacctccccactctcctcgcttttgttggtcttggaaaaaccctgggattttgggtatctctgagcacgaattctacattctcatggctttcgaacacagaaatgaagacctaaattccttggattcggaagaagatctggagaaaatg

SEQ ID NO: 30906 - DNA, 3003 bp, Unknown
  misc_feature (1)..( 3003): 2750-1469P.txt file - cDNA_ID_3036928; gDNA_ID_2213655; Annot_ID_181722
gaagatctcctcatcaacgatcaggtttgctacttaatctaaaagacttaagagttatcttctgtagatcgtctcttcttcttcttctgaagaaaagttaattaagctatgattgatttcatatttggtgctgacttaagacttaagagatgttatacgtttaatatgggtttacacataatttaaaattttagcacttgtttttagtatattaataaatatttaaaaatatacttttatttaactcttaacacttgttttaaaacataactaaatgttaaattctccccactaatattattcccggtatctaataatctatatacagcgttcgtctttcttacataaggaaaacaattcttaatatgattttacttcaatttgaatcttactaggtagaagaaattaaaagtaattatactcatcattcttctcctctcattgttttgtctacataaagaacatcatcaatccaagcaactatgttaaaagctaaaccttcaagaactcttgaataactctctaacacagcttttccaacatcctgcaaaccacaaaccataaattgttataatattcaataaaacatgattcaggtcactgtttgtttcttaattaccttgttgcaatgaatcttgcaaatatctaacgatgtctgagacaattctgggtaccgttgtttcaaacagaagagcaaagactctgctctctcagccaaaacatagttcttgtcacttctctctgtaattgacattaaatctttcaccatattccatgaagacttggaattgttaagacaagctttgcgtctccatgtgtacattgaagcttctactctatctgccagctgaagcgcttcatgttctgatacaatcttgagacgatctagaagtttttctggtgaaaaccgccctgaactcgtcatgtgtcgatagattgcatctcctgtgctcgcttttccgctctgcaaatgcataatattgtaagcaagaaaatgacaccaaaaatagaaaaccaaaacttcaaaatcatcttaagtgtggttacctttggaagagttgccatgtaagaatcaggaatatccatttcaccgagtatgctgctattgatggccatagcagctttatggatttgattagtgctctctcgcttgctcttaagttgtttccttgccttctctgataaaccttgtaatggaaccagaggaatcggtaaccaccatttctcttctttcctctgcacaatcactttcctgaatgatccagttgcggaacgcgttgacttcatcgacaagcttccttcttctgcataccaaaactctgtcttttgaaaactatccaatgcctcctgcagaaaacaaagagaatgacttttatgaggaatattaaccgagtcaatcttattgatgatagcttcttgttctggtgtagtaactaccataagcatggaatctagttttctgagtgcaggcagattgatgtagatatctgctcttggtctactctccatgacctgacaaaaaaaccgcaacagctatttttaaactattgatgtttatttcagtttttggacttatatctataagcaaatcttgtttacctcaacagtggctccattgcttagattctgtgactttgggataaactcgaaaatatagtcacacacagagagaaggcaattcatttctctcttccacgtcgtcttctgctctatctccaatggttctaatcttagattctgtccaaaaacagtagctgcaaatctcaaaatcaaaagacattaactacagtttctctagatggcttagtttgaaagtcacaaaactgtgaggcgtattagtgtttagttaccataaagattggttatagcgtttgagattgtcactgcggtgcaaacgcctttgccgcttcctgacatatcttccccaagcagaagcttcgagaatctttccttcatcgtctccagctctgctacgaaaccgataacagtttcatgattataatgacaaagaggaaatacagacacagagaaagagagagagacggagaaacacaaaacctggctctgaaatttcttggaccgcaaggtgctcatcagtctcaatctgattatgtttcaagtcgaagacagttggaaaatttgagctcgcagagttgttggattcggttaagacaggccaatcactaggagaagcctcagtgcagaaactgctggtttcatctatttggtctgaaaagcctcctccagaggtttcagaacatgttcgatgataagcaaaagaatctgtgctcattgttgagtaaaccggagtttcagatgctgaatgatcatttggatcgatgggaccaggtgactgatgatagcccacatcgtcgttttcttcgtgatttggcaaattctccatcttctcaatgttctgtttttgaaaattcctctgcttttgttgatctcttgttttaataaaagaaataaagcttagaactttcgttgtgatgtatcaggaaaactttagaatatgaatctaaatccgacaattagaatcgggaattatttttgattcttggatagtgaaattttgaggaccagatagcagtaaagtagaagaattgttttgtttttttttggccaaaagcagagaccgttaggcgtgccaaaatcaaaaagcaaaacaaaacataaagaaacgaaaagaaagaaatgaagtaatcacaacattatttatcgaaactttcacgaagatttattttattactataacaaacatttcgcttatgtcgatcaagatacatgaaagtctgaaacttgaaattttgaaaaacgatattaaggaagaagaaaaaagcaacggtctttattttatttacctttaaggctttaaagcttctgcaaatttgtctttgaatttgaaacgcttgaatcttttataacgtttataaaacactctcttttccgcattaagctttctacacaatttatcggtgcccggaaaaaacttgaacaatg

SEQ ID NO: 30907 - DNA, 3000 bp, Unknown; identical to SEQ ID NO: 10500
  misc_feature (1)..( 3000): 2750-1469P.txt file - cDNA_ID_3036932; gDNA_ID_2213655; Annot_ID_181721

SEQ ID NO: 30908 - DNA, 3000 bp, Unknown; identical to SEQ ID NO: 10502
  misc_feature (1)..( 3000): 2750-1469P.txt file - cDNA_ID_3036948; gDNA_ID_2213655; Annot_ID_181717

SEQ ID NO: 30909 - DNA, 3000 bp, Unknown; identical to SEQ ID NO: 10508
  misc_feature (1)..( 3000): 2750-1469P.txt file - cDNA_ID_3036956; gDNA_ID_2213655; Annot_ID_181715

SEQ ID NO: 30910 - DNA, 3000 bp, Unknown; identical to SEQ ID NO: 10494
  misc_feature (1)..( 3000): 2750-1469P.txt file - cDNA_ID_3036960; gDNA_ID_2213655; Annot_ID_181714

SEQ ID NO: 30911 - DNA, 3003 bp, Unknown
  misc_feature (1)..( 3003): 2750-1469P.txt file - cDNA_ID_3036983; gDNA_ID_2214454; Annot_ID_182618
atggctcatagccatcaacttcaccttcgtacccgccttcacttgccaaatattcctccaatctcagagcaagaacaagatcatcgcctacgtgtctgctgtaaccttagggctccatgttttcttctcgtggctcctagtggttcatttcaatttcgggatcactggtgcaatgacctctacgctagttgcgttctggatgcctaacattgtgcagctcttgtatgtcacatccggtgggtgtaaggatacatggagaggattcactatgttggccttcaaagatttatggcccgtcttcaaactatctttgtcttccggtggaatggtttggtaaggtttcctaaaagcttatggaatctaaaagctctgcaaacaatataaatatcaattagtgatacttttacactgagaatctgatccgaccgttacagttacgcatatatattatacactgaatattttattataattcatgttacttttcttttgttatatgtttgattttttcttgttaatttactttactttttttaatttatgattattacttggtggtcgttattttttacagcttggagttatggtacaactcgatattagtattgctcactgggaatttgaaaaacgcagaggtggcgattgatgcactagcaatctggtaaataaacaagaattgaccttatatctcttctggtttccatactacacattttctttatactaactcgactcttaagttaaaatatggtatgagtataaatagagtaacatacaaattataatattttacaaatcgactaatcttttccatttcttttttgcagcatcaacgtaaatgcactgcagatgatgatagcacttgggtttttggcagcagtaaggtgcattgatatatatactatacacagatacacttcacttcactgatactaattatatcttatctttttttttcttggtatgatcttaatattatttatatatcactcttctatgtaattatctctatatatagtgtaagagtgtccaacgagctcggtaggggaaaccccgaaggcgccaaatttgcaacaatcgtagcggttttcacgtcactctctataggattagttctattcttcgtcttcttgtttctaaggggaagaatttcgtacattttcactacaagtgaagctgtggcagccgaagtcgctgatctttctccacttttagcattttccatcctcttgaacagtgttcaacccgttctctcaggtatatacattagctagttcaagcgtgatggttatcatcgtatcgaattcgaactgatatttgaaacgtagtatatgcctttaattggtttcaaaccttatcaggagtggcagtgggagcgggatggcaaggatatgtggcttacattaaccttgcttgctattaccttctcggaattcctgttggtcttgtccttggttacgttgttggtttgcaagtcaaagtaagtttttctctttatatattttttcttcataatgaacaaaagtaataaaattaacaattgaaaacaacataaaactttacttatctttttttgaagggtgtatggataggaatgctttttggaatatttgttcagacttgtgtgcttaccatcatgactctcagaacagattgggatcaacaggtttaaataaacaaaattgtagtttccccttccaaaataattagtttgttcaagcaagctatgttattggtttggagcttaattatattgtttgttgccacttttttctgtaggtatctacgtcgttgaaaaatataaaccggtgggttgtaccagaatctagagatgcaaatcaaatttcatcagaggaataattcgtttggattatgatatgaacaaagatattatataattatgatgttattttgggcaatagttctttctaactcagattttcaatatgaaataaattttgatggtaatttattaggctttttgttgttgttgttgttgttgtggtacaatgaaaaaagagagtacaatctatataatttattataatcaaagaagaggataactaaaatttattaatgagctatttaaaagataaaatcccttttagttctttaatttcaccaacatgttaactcatagtaaaattaaactttggtagaattttgagatatactagttattgaaatagtgcgaattagggtatgaccaataaaaagaagagagtacctttggaattttggggaaatttgtgtgcttactactatgatgacactaaaagagattaaaataatcatgttttataaactgattaccatttaaaaaaaatgaaatttcttcgtttatcataggaaaagtacaaacatgtttaaagaaattatattggtaattatttttaaaagatcttcgtggctaaaacgttaaattgattgattcattttgacaaagaaaaataaacgtttgattctggaaatcctcataataaatatatacgacaatcttaattcactaaaaattgtaattgcttacgttgcttagaacaagaatttgactattgtagtttgatatgctcgtttcttgattttttttttatatttttattttttttaaatgggtttattatgcaacacatagacacgagactcacgaccaagaaatatgtatatgaataattatatttttgataaaaatattttgttttattccaatatactttccaaacacacactttttaagcatatataaagataaagtttagatatgaattatagataattgcatttaaacaaatgatcgatgaatgcacgatcttaggtgatcttaaaatgcatctatttcttagagtattttcatcacttagtcactcactgctacaaaaggcgttgacgaccttttgtttcccagctgaaatataaaaaaaattgcttcttaaactcaaactctctgctctctctttcttctatttatttcctcctatcagataaaaacacatagactccacgatg

SEQ ID NO: 30912 - DNA, 3003 bp, Unknown; identical to SEQ ID NO: 30911
  misc_feature (1)..( 3003): 2750-1469P.txt file - cDNA_ID_3036983; gDNA_ID_2213656; Annot_ID_181781

SEQ ID NO: 30913 - DNA, 3003 bp, Unknown
  misc_feature (1)..( 3003): 2750-1469P.txt file - cDNA_ID_3036991; gDNA_ID_2214454; Annot_ID_182616
taggcttcatcggacaaactcgagtaacaaattcgaaaattgaaaagcttgactatacataactcaaacttagagacacaagctgcagtaaacttcataggagatcaagagaagtgtcgaaactaactaacacaagcatgcccatgaggaaggaagggataacgaagaaactttatgagttggcaactctctgcgacatcaaagcatgtgcggtaatctatagtccgtacgagaatccagtggtgtggccgtcaatcaccaacttctgtagataacaataattcaacgttagagaaaaaagaagaagttaccatcaaaacaattaactaaaagtgttttgaaagatttacaagggattttaaaagggttttataagatttacaagagatttttaaagggttttaaaagatgtacaagggtttttaaaagatttttttaaagaatttacaagaaaaccctttaaaaactcttgtaaatttttttaaaaccttttaaaatctcttgtaaatcatttaaaacctttttaaaatttttttgatggaaaatagatttactagggattttaaaagagttttaaaatatttacaaagaatttttaaagggttttaaaagatttacaatggattttaaaagggttttaaaagatttataagggattttaaaagagttttaatattgataaatatatatttatatttatgacgagagaaataaaaagaagaaaaaagtaaacgtacgtcattttagaagaaaactttttcttttgctatatgtagaggaattaaatcttctactttactctgctttttgacttttcaaaaagaaaaagattttttatttacaatagaaaagtatattacattacataatacacaatcaaatttcatatttcaaataataattcagtaaattttgtaatttattacaatatctttatttaataattattttgtttccagcacataaagtatctacaatactattatttaataaaataacacaaaatattatgaatatttctgatttataagaaataaggttgaattttgatgaaattcaaagttattatatttcacatataatcaggttacctaaaacacgaatataacatatgttcttaagttaataacattatctaaaaactcttaaaatgatccaaaatgtcaactgtaactcataaaacgttaatgtagattttagtacaaatttaaattaatatatttaaaagttttatcaatcataattattatatattttggtgatttttaacaaaacttaactaatctttctttttttttgtaatcaaaacgcaaactaacgaaaccaattgtgaaaattttgatttacaatattaaagtatacataatttattaaaaacataacaaaaataacatcattgaaaacctttataaaaaatatataactaaatgctgtgactactttcctaagtttctctcaagtttttttcaagttttgctcaattatttatttggtaaattatatgcagaaaaacaaaacaattccacaactttttctcaaggttttttttttgtgtgctcataatttataaattgaaattagaaagatacatgaagattaggcttcatcggagaaatccgagtaacaagttcgaaaattgaaaagcttaaccatacataactcaaacatagagacacgaactgcagtaagcttgataggggaagaagtgtcgaaactaactaacacaagcatgcccatgaggaagggacggataacgaagaaactccatgagttgacaactctctgcgaagtcaaagcatgtgtggtaacctacagtccgtacgagaatccagtggtgtggtcgtcaaccgaaggtgtttaagaggcggttttaatgtttattaaaaggccggcgatagaacggtccaagctgatgatgagtcatgagacctacttgtagaaccaaattaccaaagaaacaaagaaactggagcgtctacgtcttgaaaaccgagaaactcagcttacacattttatgtttgattgtgttgagggtaagataagtgagcatcagtatggtgcaagggaccttcaagatttaagttttcatattgatcactatatcaatcagcttaattccagggtcaagatccttacaaacaatggtgagtcttcttcttccgttcctcctctacttcatacttcagttgcgggtgcgggtgcagctcctcttcctgttgcgggtgccgatcttccgatggatcagaatcagtatgagccgattcagctctatatccctattggtcttagttatcatattcaataccaacatgaaatctatgataatttcagtttggatccaaatcattagtatccgtttcaacatgatccactcatgaatatgttgatggaatatccttatcaacaagtgggttatgttggagagcatgcgcacatccttttcatgaacggaaactactacaactaccaccaaacaccaaccgttggtcttactaccaccggtcacatgccttccaacaacaacaccacccccaccaccgatgtgtgatgtgtttcaatagtttgcatttttgttttgttcgtttcaaaaaaccttaaactcttacaacaattaattggatttggtttggttataaaagatgtgtctattcaaacaccaacttttggtaaaatatttgtagaggccatacctcgctgtgatatatatttcgactatctcatcccattttttgggtgatttgttcaaaactagctatgtctttttcggtatgcaatgtataaatgtaaatgtaattttgacaaattttaaattttatttaaaatttatttatgaaaagtattcattttgcatataaaataccaatttggcaaattaaagaatcttaaaaagaggtgtaggccggcttttcatttcctccgtacgtaaataaacaacccaccaaacaaaaatctctcctcgctccatgccttctctactctctcttcattctctcctaagctatg

SEQ ID NO: 30914 - DNA, 3003 bp, Unknown; identical to SEQ ID NO: 30913
  misc_feature (1)..( 3003): 2750-1469P.txt file - cDNA_ID_3036991; gDNA_ID_2213656; Annot_ID_181779

SEQ ID NO: 30915 - DNA, 3000 bp, Unknown; identical to SEQ ID NO: 10514
  misc_feature (1)..( 3000): 2750-1469P.txt file - cDNA_ID_3036999; gDNA_ID_2214454; Annot_ID_182614

SEQ ID NO: 30916 - DNA, 3000 bp, Unknown; identical to SEQ ID NO: 10514
  misc_feature (1)..( 3000): 2750-1469P.txt file - cDNA_ID_3036999; gDNA_ID_2213656; Annot_ID_181777

SEQ ID NO: 30917 - DNA, 3000 bp, Unknown; identical to SEQ ID NO: 10516
  misc_feature (1)..( 3000): 2750-1469P.txt file - cDNA_ID_3037003; gDNA_ID_2213656; Annot_ID_181773

SEQ ID NO: 30918 - DNA, 3003 bp, Unknown
  misc_feature (1)..( 3003): 2750-1469P.txt file - cDNA_ID_3037026; gDNA_ID_2213656; Annot_ID_181765
caaattgcaacaggaagttgataggagccaagtactttatcaacggttttcttgctgaaaaccaattcaacgccacagaatcccctgactatatatccgctagagactttgacggccatggcacgcatgtcgcctccattgcgggtggttcatttgttcctaatgtaagctacaaaggccttggtagaggaaccttgagaggtggtgcacctcgtgctcgcatagcaatgtacaaggcttgttggtatataaacgagctagacggagtgacatgttcattttctgacatcatgaaagcaattgacgaagctattcatgatggtgttgacgttttgtcaatctctctcggtggtcgagttcctctgaattctgaaaccgatctacgtgatgggattgctaccggagcattccatgcagtcgcaaagggcattgtagttgtttgtgctggtggtaatgctggcccatcatctcagactgtggtaaacacggctccttggatcttaacagtggctgcaaccactctagaccggtcctttgccacacctattatacttgggaacaatcaagtgatattggtaaaacagagtagctcttctacaaatgtcgtttcttcttttctttaataaaaaaaacaagttaggccttcgaactctctgattatgggtattgttactgcagggtcaagcaatgtacataggtccggagcttggcttcactagtttggtttacccagaggatccagggaacagtattgacacctttagcgggtaattaatgataacaaatctattggtgcttgcttagaaatttgttcagtttccctaaagaacattattctctgatatccttctgaatacgtaacatttttcagtgtctgtgagtcccttaatctcaactctaaccgtacaatggccgggaaagttgtattgtgtttcacaacagcaagagatttcactgttgtatccacagctgcgtctattgtgaaggcagccggtggtcttggcctgatcattgcaagaaacccggggtataatctcgctccatgtagtgatgattttccttgtgtagccattgacaatgagcttgggaccgatatacttttctacatacgttatactgggtatgaaactatgaattatgatcttcacttcttatattagcacatgctcagttgtttcattcccttcaagaaacacataatcataagaaaaaaaatacagatcacctgttgtgaagatacaaccttctagaacactcgtcggagaacctgttgggacaaaggtagcaactttctcatcaagagggcctaactcgatttccccagcgattctgaaagtatgtctggatccttattttctgacttatcagtttttctgcaatatctctaattttttacacaatgcagcctgatatagcagcacccggtgtgagcattttagctgctacatctcccaatgacaccctcaatgccggtggatttgttatgcgttcaggaacatcaatggcggctccagttatttcaggagttattgcacttctcaagtctttgcatcctgattggtctcctgctgcttttagatcagccattgtcactacaggttctttatcttcttgcaactagaaaagcaagagaaacttgaatcccccttcaactcaataatcttctttattttgtagcttggagaacagatccattcggagagcagatagctgcggaaagttcatccctcaaagtacctgatccgtttgattatggtggaggcctcgtgaacccagagaaagctgcagaaccaggtctcatactcgacatggactcacaagactatgttctctacctgtgttccgctggttacaacgactcatcaatctctcggcttgtcggtaaagtaacagtctgttcaaaccccaaaccttctgtcctggatatcaacttaccttcaatcaccatcccaaacctcaaagacgaagtcactctcaccagaaccgtcactaacgttggaccagtcgactcggtctacaaggtcttggttgagcctccgcttgggattcaagtggttgttacaccagagacactagtgtttaactccaaaaccaaaagtgtctccttcacggttattgtctcgaccacacacaaaataaacactggattctactttggtagcttgacttggactgattctatccataatgtggtcattcctgtttccgtgagaacgcagattctgcaaaactattacgatgagaactgaatgattcgtaatagttatttattacccccaaacatttgtttcttacacttcagcctcgtttaataaaccactaatctctgtgttgacaatgaactagaatttagttgaccatgtatgtagtgagtgtaaaacattctttagtttctgagtgatccaattccaagaaaatgtaaacattctttgaaggagacatcagacctctatgtataaaatgttcgtgcttccacaaccaaacctttttttttttgcttggaatgagaaattttgtcatcaattcttgtggtgctatgtccgataatagcttcgctttgcttgtgttgtgataatctcaagtaggtttaggttcatatacagtgtatatggattggccgagaagcagcatgatgatatatagtgcatgctcgtactactcacaagctagctagctttattatgtataaatagtataatcttccgccaagggattggcatggaacatagtaaggaaagtgctgcagatactttgaaattattatatcttgttcatctagaatacattagaccccacaaagaaaacaaaacattcttggccacacaaagaccaagacatttccgtttattttgaattttcgtctcagtctcccacaagtcgtacgtagtataattgcatacaaactaaaacacgtttctatatatatataaatgctggtgcttctttaaaaatattcaagtagattgaaagaaagtgaaggaacactatttcttttctggaatg

SEQ ID NO: 30919 - DNA, 3000 bp, Unknown
  misc_feature (1)..( 3000): 2750-1469P.txt file - cDNA_ID_3037034; gDNA_ID_2213656; Annot_ID_181763
aagtattgaattcaaagtatctgcagtgatttacttagtgtgttccttccatgccaatcctttctacataatcgtttaatcttttcgcagcaggaacgaaatcgccgtcgccgaccgtcacgacggagactcgtttttgtaatttgtaaaagataagtttcttctgcaaactcatgttcgtgaaatcaaaatttgtgagcatctgaaattttccgatgaaaggaaaaaaaagaaaagaaggatgtgatactatcggagaagatgattcgaagctttattgggcttttgattcggatttaaggcccatttaaaatataagctcttcaagagtcaatattagccattgacttaggttgattgattgaatgcggaagataattttaattgttaagataaaatcttaattttaaatgttacatgaaacagaaatcatttgattaaaaatatattttatgctagaatatttttgttgaataaattaagttactcaacaaaaaccaattatttgtggtttgatagtttacttttcttcttgtgacttgtgagagataaggataatttagaaaattttgctcaaaaaaatatgaaaggataacataaattttgaagtatgtacagtatagagagtattattgctaataatgatattcttacaaaaaacttaaaaatatggtattctgaagaatttagaattgtcttagaacagattataatcatatgattattcaattgttctttcttccggttaccaattggtccaattttgtcatcactcgaccaaagccggttcaagaacatgcaacccacttttttgaatttcgaattgtgcagcactgcatgattccccacaccttcgtcttcttgcgaaactgactataatatccttgtctcccgtccaagagcttggtgagaattttttatttttgttattttcgaaatttgagaattttaattactatttttttttttattttttttttgagaatccatattattagtttaaaaaaaatttagtttatttgtgcttttattgaaatttaagtacgataaatgggtgagagttgaagtatgaaggagacttacaagattgatttgcttcaaaaaacatttgcgtcaaaagacacacaatgaagaatgatttattttgtttctatatttaaaaacaatttgtattaatttatatatacgttgatttatttcttttaaatataatttaatattagcttaaaaaaaaatagtgttacttccttactggcaaaagaattagtcccttacaattatgacttttacaaaacatgaatatctattagatcatttaagttgtattaactgaccgtttataatacacaaaactgtctaaaatgttaattaattttccaggttttaaaagcaacaatctttatctaaatccaacatttttttacaattacatacagaaacgatattttgttttcaatggctagttacttttattgttaacatataacacattataaatttataatatatcgacatttatctagctttaaagataaaaatatatatctaaaaatacataaaatgcataaattctagattattagtttcgattcataaactatattattgtcataggccttaatagaaggagtaccatgacaaagttgagcattaaaaaacttccctgtcccttaatagttcatgataatcatttaatcaatgttcaagacaattctgatcatgtcgatgaataacgtagcatatcatatttaagagaatttaaaatcaaccgtctttctttagatgtttctttggttcaaagtaatgtgccttggccgaaataagtatggaactttataatatagtattaacgtgcttatctgtagattcaacccataattccgttaaattgatgggaaatggtactaatcattatacagaataagatatatatttaatgaagtttggtggccaccctggtctaaatataatgattaaaaagtcgaagatacataaattattatattaatctttgcatcaaaacattgatctattttatgaagattaataacgtcgagccccttaaactaatctcacgcttagattttgtctcatagtacaatgtaatttagctagaaaaagtggtttagatccacaacactaagcaaagttatggacattttatttgtatatgtaacaaacataaagtatctagtatggttagaatttgtacgaatataagaggaaacaaaaatgaaaattagttaacatagatgagaaaaaaaaaagacaatcgtcacctaattagagatcacataaatctattacgttcgagattctacctagtatcacaaaataaaagaaaaaagaatatgtataacgagaaaaattataatatatagtaaaagctatgtgtagtatttatttattttgaaattttgacatataatttatatttagaataatttcgtgaagagcagatctagtgaagagtatctaaaattccaaaaacaaaacaaattggtggtgttgtagattatagagaatataggggcaaaattggaaattcgcaattttttgtcttgggacggacagaacagtgaagctgcgaatcacgcgactcctttcgccagcaataatgacttttgattgagcaaccaaaaaaccacatattcgaaattaaagacaaaagcattctgcataaaaagatttaactcaaaagagaaagataaacaaaaaaaaatctccttttcttgttaagaatttagtccactgcaaaattcagagtgcagtgaaaaaaagatttttaaaaaagaaagaaagaaagaaaaggaggaatcaattacggacataatttgagtttttttttgttttctttttgctcatccaagaagacgacgatgatgtcgttttgatgagttcagctgttgttttcgctaagacaaccttaaaaataaagaaactagctttcctcttctctcattaaagagttttttttcgaaaagagttaaagaaaaaatg

SEQ ID NO: 30920 - DNA, 3003 bp, Unknown
  misc_feature (1)..( 3003): 2750-1469P.txt file - cDNA_ID_3037046; gDNA_ID_2213656; Annot_ID_181760
agaagtacttgctgctgttcaggttcagaacctgtggtgcctcaagagcagcctaccaacgatcaaagtaaatcaagttattgctcatgcttgtacgctattcaaacacagattctgcattatttatgaatttaatctctgtaggctacatgtttcaatcaaatgagaacccacgattcagaaacaacacaactgtaactacagaagtaagaggaaagagtgttacctgacacaacaaactgaaccggagttggttgtcattgtagtctactccagttataggaccatagattttggatcctgttttgcccacaacctgcattattaccattcctcattagctcaaagtacaatacacccttgtgattatctaaccaatataaacagaccttagcaagaaagattggatggtcaacaaagacacgatcaactcctcgtttgtagcaatggaagaaacgaacattctcaactttatccccaactttgatctgcatcaaataacattccaagatgacttacctaagcatccaaaattcatcaaggtccatacagagcaaaagaaacttgagagaattatacctgaaccacaacacaagtgtcccaagcatctttatattggtcataccgaggacaaattgtcatcacacggtggcctctagcctaacaaaagtcataacatgtaggttcatcaaaaaacaagtaaagacctcaaatcaagctaatgtttatatgaacttacagcaagagctggaggtagaccaccgagaacatcaccaagaccaccagttttactccatggaccaacttcagctccaataaaaatcacagacattcctttctcacacacaatcttaccagcagtcttaactttagaagatctctttgaggatttagcagaaacaggtttagcttgagatctcctctgaaggttatccaccatgttgaatgaccttaacccacaatgagtcaaggattggccttttaaggtaatctgagcgacatcagagcatgaagaagcaccatgattgttgaaaagtgaagttcttgacacaaagttagaagaagcagtcacagttgccattatgaactacccgtttacctggattcaacagatgaacaatcaaaatcgatactttaaatagaaagatacaatctttgacaaattttacattaaacagaagaaaaagctcacagattttcacggcaactgaggaaataagagccaatggaggagatgagaaagtgaagagagcagaggagaagaatggtcagttatgtagagaagaagaagagtggaggcttggactgacacgagtgacacgtggcgttgttatagttgttgagtggcgattttcaatcacatgatgagggtcaatactcaaatactcaatggcattgcctgagaatatgtgagaatcttgaggttatactttgggaggacgatattttgatgcgtacgttttggtccgagtggctaagaatcgacggctgagatttgttggttttgggaaactgggactcttttagtgggtcctatgcttacacaagtgtttctgttgtcgtcgtgcatcctcatgaacgtaccgttggacgacatttttcttggcccatttgttaaaattcacggtcgagaatttttgtcatgttttatttatttagttttgtgtaagcttaaccactgattattactaaatagcaatttttaagtttaaattgataatgtcaatgtgattgcataattttcaagtttcttgcgtatatatgtataatttagattcacatatatcagaggctagccaaataaattatttcaagaattttttcatgcaccatcatttttccttccctttcaattactttaagttatttaatttccattagtcacatcttaagtagtaatttgtttaacaaatcttggaatgttagaaaggagttaatgtcatgattatattttttggttattgtggacggttaggagtgatttgtcgcaacataggagatcgtgtgatgatgttgcaatctctccaagacagtttcacgcatccacaagaacatagtctttggcccattttgacgttaacttttatttcttaaattcggacacaaaattatgattcgtgaaatgaacattttatattttcatattataatctcatgatcatccgtccaaattcttcattttaacataaatttaaaactaagtctttattttttaacagaaattccatcatattattttttaaaaccatgtttattcatgtctcacaagtctataatattaaaaaccataatcatactgacaatctaataaatccatagtcagaagaaaaaatgtcaccataaaaaaaataaattcggatatgaaaaaaaaataaactcggaactaattattatccgaattcgatgctctcttataataccatattgaagtaaaccttaccggaacaataaattattgttaagatttggacatgtagccgagaggataccacttgagctagccaaaaccaaaggagtcaaggaatcatcaaggatctgatgatgttgttgtggtgattatcatctctatgattccaaccaaacattggaacataactccaatcatttccataatttagttatttttttaaaatgagatataagatcaattacttaaatgaaaatgtgtgacaattcagaaatagtactagatatgtgggaatagtgtattacacaaaatctgcagtttccaagtagccttgcaagttgcaacgtttaagtcattttcttcattggtgggtattcgccgaaattaaaaggtactatcacacagtactactatacagtaaccggccactagtggctaaaaggaaaaaaaaaatatccaagtaaaatggaaatagtcacgtaatttctctcctacacatttacatcttttataaattctctgactcacacagtagctttccaacacaccacagtctttttctttttatcttctctacaaaacaacatcctaccatg

SEQ ID NO: 30921 - DNA, 1345 bp, Unknown; identical to SEQ ID NO: 10509
  misc_feature (1)..( 1345): 2750-1469P.txt file - cDNA_ID_3037074; gDNA_ID_2213656; Annot_ID_181751

SEQ ID NO: 30922 - DNA, 3000 bp, Unknown; identical to SEQ ID NO: 10721
  misc_feature (1)..( 3000): 2750-1469P.txt file - cDNA_ID_3037097; gDNA_ID_2213670; Annot_ID_182269

SEQ ID NO: 30923 - DNA, 3000 bp, Unknown; identical to SEQ ID NO: 10525
  misc_feature (1)..( 3000): 2750-1469P.txt file - cDNA_ID_3037136; gDNA_ID_2213659; Annot_ID_181814

SEQ ID NO: 30924 - DNA, 3000 bp, Unknown; identical to SEQ ID NO: 10523
  misc_feature (1)..( 3000): 2750-1469P.txt file - cDNA_ID_3037140; gDNA_ID_2213659; Annot_ID_132512

SEQ ID NO: 30925 - DNA, 3000 bp, Unknown; identical to SEQ ID NO: 10527
  misc_feature (1)..( 3000): 2750-1469P.txt file - cDNA_ID_3037140; gDNA_ID_2213659; Annot_ID_181813

SEQ ID NO: 30926 - DNA, 3000 bp, Unknown; identical to SEQ ID NO: 10521
  misc_feature (1)..( 3000): 2750-1469P.txt file - cDNA_ID_3037148; gDNA_ID_2213659; Annot_ID_181810

SEQ ID NO: 30927 - DNA, 3000 bp, Unknown; identical to SEQ ID NO: 10535
  misc_feature (1)..( 3000): 2750-1469P.txt file - cDNA_ID_3037195; gDNA_ID_2213660; Annot_ID_181835

SEQ ID NO: 30928 - DNA, 3003 bp, Unknown
  misc_feature (1)..( 3003): 2750-1469P.txt file - cDNA_ID_3037207; gDNA_ID_2213660; Annot_ID_181830
aaattgtcacagccgttttcgatgcacatgatccgacaaccattttggttgtaatgatcctgaaaaccttcacactctcattacataacgtcgcaaatttactatacaaccatttcttgacaaacaaatcggtcactagctattcttctgttttttttatttttcttgtaatatttatatatataacgagtgtgacttgggctttgacaatgttagtatagctttaaaacgggggaaaaaaaaatactagaacattaagttttgagggtgcaaatatgtaacatatgtgttgtagaaatactttttaaaatttcaataataaccttggtttagtttccattgtttgaattggtattcatatctgactaccgtagaattcaatttgttagtgcagaatctgaaacagaaattgtgttgtctgtatattctttttttgggctctcaaatatttcgtgtatttttgtggaattttatataaagttggtgtcttttttaggacttttcgttgcattcaattatgttgaatgtgtaaaagtagtggctttccttggtcacatttatcaaacgtgttttcgcctttctttaattttccgtgttcaagtgaattctagctaacttttcggttttacgttgtatgaaaataattggctgtcgtcggtcacatgatcacatagagtttatttgattcaaatccatttaatatatgctgtatctttaatgcatacatagagatatattattatacgttatcttttaataggacattatattttgtttatatgaaagaaaagaatgtactgtatatgcagttatattatgctggtttatgtcaaagatagaagttaacgcaaattaatttctttatttcaattgtgttttgcgttacgatctgttttttttttttttggacaaatgacttaagattttattacttcatttgatattaataaattagtatgggtgatgcaaacgacttgaaggctagggttggtaccacggctgctaaagtctacttttggttggatctgtggtcggaagatcttgacgtgatcacttctataattgaggattgtgtgttgctgctactctcctctcacgataactcacgtggcctttttcttgtttttctttcttcatattttcacaaaacaaaatagtcagagatcttgagagattttttcagaagcatattgggcccaaatgtggacaatttcatgtggttgaattgttaaatttcagatagattagacaactaatcttgttgacgtgcatgcggtgaggatattaagtcgctatacgtcatatacgtgtatacttaaaatctcgtttgatatttctttcttttgtttttatcttcaacgacaattattgcctcaggcatgtcagcagaaaacgacaccgttcatattcgatctcgttattaatatgtttttgaagcaaaatatcattattagctatggagtttctgcagtagcctaaccggaagtctcaaaaagataacgtttatgccggttataattaaatccgataaggcgataaataagtgaacccgtaaagtctaaaattttcacatatatatgaacaaagaaatagtctatagatctccatgcattcttgtacaaacatatttaattttttattttattttctttatataagagttggtgtatgaaactttacattttgtaaatactaacattacatcataatgtcagaaccaataattctagtggaatgatataatctccactttaaattcttatgtctttatccaaagagatcatgaggaacttgagcaaaggaagagggcaccgtttagtagtataggtgaataacgtggcggacacgaggctggtctcattttcaaataaagagagatagagagaaaatggaaggaaaaaaaagctattggcgatgttgatatttgttcgtcttttagtggagacgaccaagagattttgaaaggtcgtcgaggagttagtttattatcttacaattattatggatttcttctgactaaagttttagtgcaatagttttctgagttattatatatttttcgaaattcatccaaaggctaaaactttgtaaggtattctgagtctattacgctagaaatagacacgcttacgtttttaagtcattttaatctgatatatatatatatatatatatactacaattttataaccaattatctttgtttcagacaatttatataaattcatataaactatcagaaataaagagacaattggctgtaaaattgtattattttgcatctatgaaatttttatttctctttatcaaaattgaagacgagttgaaattctatttcttttttaaaaaaatttatatatgggagtgtcaaaaaataattttcctttgtaagagaatattcgtatttggacgagtcttgatttgtgttttccgttagcgttccacattagttgtaaagagcgagaaagatttaagtgataattaaaaagacaagatatgcattttgaatatactctagatattaatcttaagcatttttcatattggttatattttatggtcgaattttgacatccgaaaaatacatcccttattcttcaatttatattgaatacttaagtttttgatagtaaatatgtataaataaattttaaacaattgtcaaaaagacattataacttatacggttatagttgttaaaaaaaaaacttatacggttataccaatagataaactgacattttagatttgagttttttttttttttactttccatgtagatagcgtggaataatacctcatttatatgtatcgttagttgaaataattgacaaaaggaaactattcgtttgctgttctagataaaagcctttaattgagaaaaagaaaatgcctccagctttgacccgttttgcctataaaaggattctctaagatatggactttcctcatcttctcgggtaaacagaatcaactagttttgtttttcctctttcaaaaatg

SEQ ID NO: 30929 - DNA, 3003 bp, Unknown
  misc_feature (1)..( 3003): 2750-1469P.txt file - cDNA_ID_3037219; gDNA_ID_2213660; Annot_ID_132525
gtataaagaaaaaatggtgatatgtgaggatatttaactaatcactagtataatgaagcatatccatatcaacatataatactactatactagatcaaatccttaatagaaaaatcgtagtcgataaaaaagcaagtttagatcaaggtgaagtcatggttaatttatatgggaggatattgaactaatcactaatgtataattaatctttaaaagaaatatgaaattaggtcgcgataaagtgaggagccaaaaaacacaaacactttggtgatgggtttcgattgatgacaaagcatcaacttcttatgtactaaaattccatgtacagaattattgaataagcacagaaacagtatcatatatatggataataatgatattgattatcaatttaaaatatagaatttaattaagagattttactctattttatatataatcaatcgtgtttgctagttatactcttaaatactaaaaattgtatcaaaaataacaagttaaaaaaaaaacaggagcgtgcgcctagcccgcaaaatccacaatcttagaacaaggtggataataaggtttggtttttctaaaaccacggttcataacgagtgtccactagaatccaaaaaaaaaaaaaaactaatttcgtcgtagaacaaaaaaaaatagtgagacaagaccgatttgaaacatgtaatgatgtaatacatatgatgattttatatctatagaatgaagaattttaagctttagtttattctagaagacgtttattttgttaatggttgcttcagatgtaaatttatataagatcattttggtaggtatttactctatagtctatagtaatatacactctacaaactggcccttttggcactcatgtataaacacgagtatttaattttcacattagtagacacggtcctgcttcaataaatctattttgacattagttcttaacctcattgttgtaattatttacaaacgagattaaaacaaaacacatggacatttttggataataatatttctcaacatattgttctagctttgatcgttgccaatagatcaacatatttgttactctcgataatcacttaagcccaactcatgtggttttaatgtaatggtgaagtgtttcctttcaaggtgtagtgtagcttcaaattgcacatactagaatcccaaagattaatgcactaaattcaacctcttctgcatcaactccatttgaagtctgtataatccatccaaaacaatcatatcttgcgctgtccatatccaaaattatgtgaagcgtcataattacacttcatccacccttctgtcggcatcctccatggcattgatctggagcttcataaacacatttggtttgtattaaatatttatgaaaatccatagtcagtcacacggatagtgaggtagaaatttagagagatcatcttatgaatctttttatttaagcaacaagcttttatccgtgttagtgttactttttatcatttcttttggaacaacctatagtatttaatttattcagagcgttcttaagaatttgtttgataaatatattcacgtagtttcgactacgtatagaaactttatagcaaaatgaatgttgtgcgtacgtacattgtttctatggtagataagtataattccagaaagagttaatgaggaagaattttattactgtggcataggatgaattaaattgatctatataaattttatgttacaacttacaaacaattttcacatggatttataaagaagccgctataaataaaaacgattgtagtttagttttggggtattcgaataaataagaaacttactccttaagttagcaactttttaatactaaaagagaaaagagatacagaactttccaaaaaattattgaacatgttctgatacttcactaaccatattgaaacagatggcataatcactttaattatacaacacacacatcttatctatatatgttacatctattataataattaaaccagatttaatataaatccagctatttaaaattatgccacagtttgaaaagaaaaaataaacaacgtgagatgtctatgtaattagaaacaatgggggtcttttctagtcgcattctggcattcgttgagtcgattttttttctttgttaggttgatgttggaacaacagatagatttatttattataaaaaaaaaaatacaatgtatgatttaattaattgctgtgaactgtttaagtgtttctaactattacggaatagtcttaaaagaataatgcgactagtttatatagagttttcctatcatttcatcaagtttaatctttggttggtaagtgccagctcatgttctttaatagccacattgcacacatataaattgaaacagtttctagatttctacgtaaatgttttaaatatgacaaaaatttactatatgtttcgaatcgaaataatctagcgtagtagtattcataactaccatctaccaccaacattattttgatactgtaatgtttgcttttaataaactgtcgaaatagaaaggcgcaattagttgtatgtagagtaacttaatagtctactcatctctaaacaaatgtgaaaagacttttttctcgatcaagtcgacgaataacaaacaaatacgatagattttttaaaaattaaacttttcgaaatcataatacgtgtatttttagggaattttctcttctttttttctttctaattcatgtcgacgaataacaaaagctcaccatcaaacgaagaataataacacaaacaattagaactagaacaaaagaaaatgataaagcaattttattctcatgtaaaaatgacataattcaatgacgcgtgtcccaccaattatcaccactcactctccatatatacttcacatacaatctttcactcatatatataccacacagtcacacattctttataatgtaaatcaaaagagaactaaaccaagaaacaaaatg

SEQ ID NO: 30930 - DNA, 3003 bp, Unknown; identical to SEQ ID NO: 30929
  misc_feature (1)..( 3003): 2750-1469P.txt file - cDNA_ID_3037219; gDNA_ID_2213660; Annot_ID_181841

SEQ ID NO: 30931 - DNA, 3000 bp, Unknown; identical to SEQ ID NO: 10553
  misc_feature (1)..( 3000): 2750-1469P.txt file - cDNA_ID_3037235; gDNA_ID_2213660; Annot_ID_181853

SEQ ID NO: 30932 - DNA, 3003 bp, Unknown
  misc_feature (1)..( 3003): 2750-1469P.txt file - cDNA_ID_3037283; gDNA_ID_2213663; Annot_ID_181915
tataaataattcataaaggaggagagagaataacataactaaaaataattaaaaaaacgtttatgtagagagaaattttgtagtaatcattgagaaactatttgcataagtgactgtttataattagataattgaaaaaataaaaaaataatttaattagaaaattaagttataataaaatattacaatttaactcgccaaaaatatacgaatttaatacaaatatataaatggagaaacttcggctacataaaaataagaacagtgtacttttaaattctataatctccacaacttgcggtccacattatttttttgtaatatcaatttttatttttatacagttttctattgatggacatatacaataataaaggtgatattggaacttgtttaggaagtcgatcggtaagaaaataaaaagtcggtcaataatatgaatagaccaaatcgtgattgcattagaaagcaggagttaattgtttttgaaaatgatgaattaagtcggtgagttgctgcaaatactattattgactgactttttctataatatcggaaatagtacaatttaggagtttaattgttaaaatacgtacatatgaataattaattatgttaatcttcttgcagaccaccagctcgaaccatatgtgagttttgaacatgatattagttcaaataataagggattcagtaactaaattaaattgaattttgattacgattatcagtgcgttcatctagtaaatcaaataatatgatattttggaaattactatccattattttttatatgtaaatacccagacaattggaatgtaatggacaatatagacaaatagacagttaagttagttggagtttaggcgtcatatcgttgaaactttttatatatagcacccagagaattttattctaattttttttaataattaccaactatctttattggcacaaaccccaactagtagtcatcatatccagaaaacccaacgtgtattttcgctcattaaatccccaacttttaatatactcccttcgataaatactgaatttatatttatcgtattgtttgttcagtttcataggcaatgagccaatgactcgaaagtcagataatttatgaattgtagaaattgttgataataggactaaatttttaaaaatctacagcggcagtttataattgacaatcatgtttttcatttgaaatatggacagtcatctgagaatatttttgtgttcaatcagcacaaatatacaaattttaatctataatttcaaaaattaaattaggacgctttgatttggtattttttcctagttaatctttgcaggcggtggtttctttgacctttttattaaacacatgattatgccgacattaataaaaaaaagagagaatatgttcttattacggtgaatttactcattgaaactatgacttcaaaaatataatattataataagttatagtatatatgttcttattacttatggtatatataaaagttaacattgatatttaactctgtttaaatataagtataatttgatcattgtgttttgacataatatttttctccattgatatgaattctaaaataataaacatatatttatttatataccaataataaaattgaagattacgtcacactaccaccaattggttgataatttacactattttattccttcagcttaactggtaaggttaagaaacacaccacaaatggttgctaaactcttagggtcgtttgataaatgtctaatcaagctacaaagtacgatcacatatataatttagattatatatattatccattaaaccacatccaaataaatatccgaactgagaactcattgaaccacacccataggcatagctatatgtactgcatatcaattttatgtgatcgattttatcatttactctcgtatataaaccttcatagaaacttaaaatttcaagtttaacaaaatgaacattaacatacaaattcttttgaggttttcattagggattcctttcagtaggataataaaattaaatagtaataaaattttaaaagggacatattttcaacaatatgggtccacataacacgaagaggagccaaaccttttaacacttttgagtggtatattttccttcaaacgttttttctgccatacgactctttattttctttccaaaagaggttattttcaaaaggtagatgaaggtcatgtggctatcgaacccatttttttctggtggttggctaaggaaccccataagatgactatactgacatagtcctatgtaatgtacaaggaaaaaataaactaaccctcatatggaacataaaattattcgacagacgtgtcaccctatggatctaaaatttaatggtaggatctaaaatctaaaatatgaaaatttgtggaaaattccataaccatcccaataaattaattgttacatatagcaatattttattaattaaaatacagtttttatttgacactaagaagaaaaataatatttagcttatcttgaattatatatataaattgcttattaccctgaatttcatacagatatgagatatcatttaagatatttttgagtgttttctaattgtggggctttttcaacaagtaaggaagttgcttagagcttacgtgtctcttctacatcaccaaaaaaataagaaaaaaacaaaacataaagaaaagaaacattattgttttttttagctcttatcttcctctatataaagacattttttttctaccttcacatacttttattttcatttcctttaactgcatagttcttcctcaaattgctcatacctttgcttctctttctttctttattcaacctcttatttcttcttcagcaccaacgtgtatctgcagtaaacacatatccatcgatcgatctcctcaaaaagttattgttttcttgaaggatttttcttgttcttgatcaagcatacatatatatagatg

SEQ ID NO: 30933 - DNA, 3000 bp, Unknown; identical to SEQ ID NO: 9384
  misc_feature (1)..( 3000): 2750-1469P.txt file - cDNA_ID_3037283; gDNA_ID_1972110; Annot_ID_178755

SEQ ID NO: 30934 - DNA, 3003 bp, Unknown
  misc_feature (1)..( 3003): 2750-1469P.txt file - cDNA_ID_3037287; gDNA_ID_2213663; Annot_ID_181913
taaaataacaataacttaagggatgcaatttatacttataaatttccaaatttatataacatgaaacacatgaaaaatatttcctctcataggctacagctagctaatataaaataaaatccacgctttttatatgcttaatttaaactctaattattaactctaataaaacctagtttaagtccacgtataatttcaactgatattcaataactaataatttatatatttgttgcaatctctgtaagactatcggttaggttaatcattcaaagatatcttcgtttcataaaacaagaaaaaaacaaaaaaaaacaaattttcaaaaagaaaaaaatctatttgaggagaaaaatagctgtgagagagaaagctaaagaggcgacgtaccacccacctaaccacaaccagatccccaaaagacagagaactttctcgatacgaacgccaaagagaagaagacgaagacgaagatgatgggtgtgttgaagtcggcgattggggatatgttgatgaccttctcttgggttgtcctctccgctacctttggaattcagacggcggcgattatctccgccggtgattttcaggcaatcacttgggctccgttggtgattttgacgtcgttgattttcgtctacgtctcgatcttcaccgttatcttcggtagcgctagcttcaatcctaccggaagcgctgccttttatgtcgccggtgtccccggagatactcttttctccttggcgattagattacctgctcaggttttctaaagatccaaacttttttctgaatttttaaacttttttcagcttactgttttgggtttacttggtttctatcaatatttgtgatctgtgatagtttctttcaaatgggtataggcttgtgtttgtctgcgaattagaatctagttttgtctgcgaattagaatctagttttgcatgaatcattgaatccaaagctatgtagtatatgcttttcccgtgatttgtccccacttgtatgccccattttagattagttgagtagaattcgacttttttggtacatatgagtctgatcttctgtttttcgtatattctcacctttgatctgtttagtatagttatactcaggtttgatatttcttggaaagaagaacacacagaatcagattctcttttgtttttgatgtttgtttttttgttgatgtatgtgtttcccacttaatttaaagtaggaaaacgaaaccttatctttctcgtcgatatgtctttgtgttttctttagccttttctagagtttcttgcgtgtccatgtgtttctgtgtactacaataacataaatagatagaaagactgttaaatttggtaacctgatttagcaaggagtaatttgtactctttttgagagttgaatcaagccagatgactttattgcctttggtaggaatagtcttcatgatcccttttttgccactgtttcttgatttcgacgggataatgtttgaaaggagatgtgatatattatatctgttattccaggcaattggtgctgcaggaggtgcattggcgatcatggagttcataccagagaaatacaagcatatgattggaggtccttctcttcaggttgatgtgcacactggagctattgctgaaacgatcttaagttttggtattacctttgcggttttgctaattatcctcaggggtccacggagattgcttgctaagacgttcttgcttgctcttgcaaccatctcatttgttgtcgccggatctaaatacactggaccagccatgaatcctgccattgtaagtatacatttcttgcttgctctttcagatgttctatactaagaagagattgaccccgaataagtcacctgataaattacagaagcaactttatgtttttgggccatatattcacatcattccaacactcttaaacccgagaattatgattgtatcttcaaagatagatgattaatcaatatctctcttgtgtttgcaatgcaggcgtttggatgggcatacatgtacagctcccacaacacatgggaccatatctacgtctactggatcagttctttcgtaggagcattatctgctgcattgcttttccgttctatcttcccgccacctcggccccagaagaagaaacaaaagaaagcctgaggaaaataaaacaattgggagaataccggtcagattcttcaccggtttgggctgtagaaagattcacaaagctgttccattctaaaataaggagaccaacaacaacaaaaagtcaaaagtctccttgtcattgtttagatccacacgcttattttacagatttgtgcgacgtaacttttctcttttatgttcataaatcattcagactctcttccggtttagaaacatttatgattacatggctggtttagtttggtttattatcggttcactctctattctggttctgatttctgacaacaaatcaaaggcaaaagttgtggatttccatccacaaaatttgggaattgggcctcaaaatttctttccaagggtggaagaaatctcaagcgagatctttcgacatttggtagtgttactgcgaaaaggaattgggcctggctaaggcccaactgtatactcttgctgaggcctgaccataaaagaagaagttatttacaaattaaatcagccaaacatgttggaccaggactcaccaactgtatataaagcctaacaacattttctccaaactgtaaatagatcaagactctgctgtgttgcaattttgttcccagtttcggtctacagttaaaaactactgattccctttgccataagagtgatcctaattaaactgattgagtaactcttaaaatggtggtggtgtgttttcagggatgtgaagacaactgatagtggaaatgcttcaagctgcgaagtctgttgtttccaactaagattaagaaaatggttccattctcaaataaggagaacaaaaaaggaataaaaaataatg

SEQ ID NO: 30935 - DNA, 3000 bp, Unknown
  misc_feature (1)..( 3000): 2750-1469P.txt file - cDNA_ID_3037291; gDNA_ID_2213663; Annot_ID_132619
aatattggttgagaattttcaagataaaggaatctatatcgctcgttctgcttcttttgcagtctcatcatcaggagaaaatcatatgatgaatcagctaaggaagcttaaggtctcaagagcatcggtttttgtggtgcatatgtccgagattcttgtttctcgtctcttccaatgtgtagagaagttaggtttgatggaagaagcgttcgcttggatcctcactgcaagaaccatgaactacttggaacattttgcaataactaggtcgatgcaaggggtcattggtttcaaatcttacatccctgtatctgaagaagttaagaattttacttcaagattgaggaaacgtatgggagatgatacagaaacagagcattctagtgtaatcatcggtttacgcgcacacgatatcgcttgtattctagcaaatgcagtagagaagttcagtgtaagtggtaaagttgaagcatcttcgaatgtatcagctgatcttctggatacaattagacatagtagattcaagggtttgagtggtgacatccaaatctctgacaacaaatttatctcagagacatttgaaatcgtgaatattggaagagaaaaacagagaaggataggattatggagtggtggtagttttagccaaagaagacagattgtttggcctggcaggtctcgtaagatcccaagacaccgtgttttggcagagaaaggtgaaaagaaggtgcttagggtcttagttaccgcaggaaacaaggtcccgcatctagtgtcggtgcgtcctgatcctgaaacaggtgttaatactgtctctggattctgcgtagaggttttcaagacttgcattgctccttttaactacgagcttgaattcataccttaccgtggaaacaatgacaatcttgcttatctactttctactcaggtgtgaaaatgcaaacagtttaaaaacatttttctagtcaaaaatgattatgtatgtttctaataatgtgtgtttgcaattttgacagagagacaagtatgatgcagcagttggtgatatcaccatcacttccaacagatctttgtatgttgattttactttgccgtacactgacattggtattggaatcttgacagtgaaaaagaaaagccaagggatgtggaccttctttgatcctttcgaaaaatccttgtggctagcaagtggagctttctttgtcttaactgggattgttgtttggttagttgaacggtccgttaatccggaatttcagggctcttggggacaacaacttagtatgatgctctggtttggtttctcaaccattgtatttgctcacagtaagtgtttatgttagagtactactcttcatgaaatcccatccttttgtatattttgatctataacaaattacgcacattcttggcaggagagaagctacagaaaatgtcatcaagattcttagtcatagtttgggtttttgtggtgttaatattgacttcaagttacagcgcaaacttgacatcaaccaagaccatttctcgcatgcaattaaatcatcagatggttttcgggggatctacgacgtcaatgactgcgaagctcggatccattaatgcagttgaggcctatgcacaacttttgcgagatggaactcttaatcatgtcatcaatgaaataccttatctcagtatccttatcggaaattatccgaatgatttcgtaatgacagatagagtgactaataccaatggctttggctttgtatgtacccttctcctcaaacctctcattttctctccattatttggttacttattcttgttacgtactaatttatgtttacctctcagatgttccagaaaggttcggatttggttcctaaagtatcgcgagaaatcgcgaagctaagatcattgggaatgttgaaagacatggagaaaaaatggtttcaaaaactggattcactaaatgtacattccaacaccgaggaagttgcatctaccaacgacgatgatgaggcatctaagcgattcaccttccgtgagttgcgcggtttgttcatcattgcgggagctgctcatgttctcgtactagccctacatctctttcatacgcgtcaagaggtatcacgactatgcaccaaacttcaaagcttctataagtaaaaagtgatccatcgttcataagctctactatagcaattgacgggacaggactcataagtaacaacaaagtacacttcgaaacaaatttcacatgtaatacttgtttttttttcccgtttaaattcacatgtaataatttaattcacgtaaatactaaagtgattcacccatcacgaagtattttttgaattaaatacatcaactaatcgagtttttgatagggacttttgcttttttgaatattgcttatcaaatcaaaattttcaaattcttgtccatatacgcctatcaaatatcttcttttaaagaaagtctcctaaagagttgaaaacttgaaatatatacttttctaaaatataattttatttgggcgttacgttctagaaaatggaacccgtctactaaaatgggccgctcgtgaactcgtggcagtcaaacactggtcggcgcataaaagcatatccaaatacgctgcgtttcatgcttacccgacccgtcttaaatatttaaagaatattccagattagcgcgtgagatgcagttgccatgtctcgcctcaggaatgacgacatttgccaaaataacagagctacaacggtaaataaggaaaatgattaagggcaatttggtcttttaggttaagaaaagtattgaatcagatctgactttttggccaagaaaaactctcagccactagatcattccgacccctcctccacgttcttctctcttttaaataacctcttcacggaacccttctcactcacctatctcactctaaaatctctctctgccaatctcatcttcaacctctctctaactctcgttttcgattctacaatg

SEQ ID NO: 30936 - DNA, 3000 bp, Unknown
  misc_feature (1)..( 3000): 2750-1469P.txt file - cDNA_ID_3037291; gDNA_ID_2213663; Annot_ID_181910
ttaagcatataaaaagcgtggattttattttatattagctagctgtagcctatgagaggaaatatttttcatgtgtttcatgttatataaatttggaaatttataagtataaattgcatcccttaagttattgttattttagagaaaatagattaaagttattttaacctaaaattaaatttttaaattttttttttatgtttatatattgacttcaattctattagctttaactagctttccaacggtagtaatttcaagtcaaacggaatattatagcaattctattagtttcaattagctttccaacgatagtgatttcaagtcaaacaaaatattatagcaaaagttatgactaatcaaatgaacggacttatactaatacaaaaaagttttattttttaaatgaaatttgatagaaaaataagataaatttggattttgaagttttttaaaaaaattatatgactaatctacaaaaaaataagaatattatggacaaattttgtagtagatatcttttatatcaaatttttcctattttttttgtaacaaaagaattttggatctgaggtatgttccctgtaagggatacacaaactcgtaattacctaaaagaacattcctccttgaatggtcaattagcctttacaccagctattacaccaattgggttaccataatagtttcttgactgattaatgaagatgttaaagtggttgccaaatgtgtttagtcaacattttttttttttttttgtaaattagtcaatacactttcttcataactaagatttaaatttaatgtctccaaactttgtaatcctatctctttctttggtctataaatagattgtgttttgcgcatggttttatcattacatacaaaataacaaacctacaagaaatcaaacactagttctggtttctgcaaacatgtcatctacgaagcaagcaaagggaagaaaaacaaaggggaagcaaaagatcgagatgaagaaggtggagaactatggagataggatgattacgttctcaaaacgtaaaaccggaatttttaagaaaatgaacgagctcgtagcaatgtgtgacgttgaagtggctttcttgattttctctcaacccaagaagccctatacattcgcacatccgtctatgaagaaagtggctgaccggttaaagaacccttcgagacaagaaccattagagagagacgataccagacccctcgtcgaagcttataagaaacgaaggctccacgacctcgtaaaaaaaatggaggcgctcgaagaggagcttgcgatggatctagagaagttgaaactgttgaaggaatcgagaaatgaaaagaagttagataaaatgtggtggaactttccttcggaaggtttgagcgcgaaggagctgcagcaaaggtaccaagcgatgctcgagttacgtgataacttatgcgacaatatggctcacttacgattgggaaaagactgtggtggttcatcttctgttcgtgtgggacgtcgagtttctggtggtgttcgtctgttcgatcgtgaagcatgatcatacatattcatacttgatgatttaaatttctttgtatttgaactgctgattttaatactgcatgtatccatttgacgaagctcaatcgtctcgagtatatctctattatctaacagtattgagaaaaaaggagtttcagttttcaaaagttgaaagactgagccaagtgatgacaaattcgagcgttagggtcttcacaaattggatattttgcgaaaaatcatgttagttttttatttgatgtattattaataagaaatgagggtttccttttttgaagtaatcaaaagaattttccatttttgcgtccaatcatgtaaaacttaaccattccttttgtttccttttaaagataaaattccttttaaaagtaatttttcattttcttcagaaacctttcggtcataaccttctcttataaaataataatctcttcttacgaatcaaaggtctcttattcgaagggcaataacatttgaccataaaaaaaaccccatatatatatacagtgtatatatatatttttgcccctttgtgaagaaaataaaacaatcagagatgagccctaaattttccaaccatgcgaccgtttatgtgatccatcgttgcgcgggtatatcgaagatcgtattatgagtctttttatgatcgtattatcctttgtgcgaagtacaactattgaacaagacgagaaaaagttttcattgcgcaggtaagtcgcgagggagatgtattccataagtattctataagccaagtctcctaatctccctggtaacgttatctcattccacatgtactctataagtattcgcgagcgtgtggtttcgatagagtaataatttaatgattgtagaaggagatgactgtgggatcatcctagactagagttttaatctcttgatttgatttttcctcgacgagttgaactaaccagcttgtgattttttttagcttctcgggttgtggtagattttattatatatcacttggttgtcctatcacttgaactcgaatatttacttctacgaattgactttgcgaaataagctaatatatctagtattatggtttcccctgcatatgtattttacattgtatttaacctggattttgaaatcagttttaaaagtaactgttgaaaacataaattaaataaaactttttttaaggctcaactatactttagaaggaaataaatgtgtttcctagtcaatttgtgtcgatgaacagtacacattgactttgattgtgtgcgatatcgcgttagtttgatttaaaatgattgtgaccatacacttcagaaaatcaaaatgcaatttgaccggaaaaaaaaaatggtccagtataattattattccatggcacaagtagatatggaaacaccattgtttataacccaaagcgaacgttacagagctatacaagaaattatatg

SEQ ID NO: 30937 - DNA, 3003 bp, Unknown; identical to SEQ ID NO: 28235
  misc_feature (1)..( 3003): 2750-1469P.txt file - cDNA_ID_3037295; gDNA_ID_2213663; Annot_ID_181905

SEQ ID NO: 30938 - DNA, 3003 bp, Unknown
  misc_feature (1)..( 3003): 2750-1469P.txt file - cDNA_ID_3037308; gDNA_ID_2213663; Annot_ID_132610
atgattggctaggtcctgggagtcggattatcatcacaacccaagaccgaggaattttgagggcgcatgggatcgaacatatttacgaggtggattatcccaactatgaagaggcccttcaaatcttttgcatgcatgcttttggtcaaaagtccccatatgatggttttgaggagcttgctcaacaagttacaacactttcgggtagacttcctttgggacttaaggttatgggatcctatttccggggaatgaccaagcaggagtggacaatggcactaccaagggtaaggactcaccttgacggaaaaattgagagcattctaaaactcagttacgatgccttatgtgatgtagataaaagtttgttccttcatctagcttgctctttccacaatgatgataccgagttagtagaacagcagcttggaaagaagttctcggatttgaggcaagggcttcacgtcttagctgagaaatcgcttatacatatggatttaagactgatacgtatgcatgttctgctggcacaacttggtagagaaattgttcgtaaacaatccattcatgagcctggacaacgtcaatttttggttgatgcaacagatattcgtgaagtactcactgatgatacagtaagttttgacatatattttttcttcctttattgttcttatcatttgacaactaaactatataatttcttcagggcagtagaagtgtaataggcatagatttcgacttcaatacgatggagaaagaattagatataagtgagaaagccttccgaggaatgtctaatcttcagttcataagaatttatggtgacctttttagccgtcacggagtatactattttggcggtcgcggtcaccgcgtgtctctggattatgatagtaaattgcacttcccgcgaggtctggactatttacctggaaaacttaggttattacattggcaacaatttccgatgacaagtttgccctctgagtttcatgcggagttccttgttaaactatgcatgccctacagcaagcttgagaagttgtgggaaggaattcaagtaactgtttgttctctttatttacttctctccaactttcatttttttttctttttcgaatggattatttgatgtatacgaacggctttgaaacgctttcacacttctaaacttctagttgtggtttttgtactgcagccgcttagaaatctcgagtggctggatttgacttgttccagaaatctgaaggagcttcctgatctttcaacagccactaatctccaaagactgtccattgagcgttgctcaagtttggtgaagctcccttcctctattggggaagccactaatctcaagaaaataaacttgagagagtgcttatctctggtggaattaccctcctcatttgggaatcttactaatctccaagaattggatcttagagaatgctcaagtctagtggagctcccaacctcgtttgggaatcttgctaatgttgaaagcctggaattttatgaatgctcaagtttggtgaagctcccatcaacttttgggaatcttactaatctcagagtgttgggtcttagagaatgctcaagtatggtggagctcccatcctcgtttgggaatcttactaatctccaagtattgaatcttagaaaatgctcaactctggtggaactcccctcctcatttgtgaatcttactaatctcgaaaatttggatcttagagattgctcaagtctactcccctcctcgtttgggaatgtcacttatctcaagagattgaagttttataaatgctaaagtctggtggagctcccctttttctaatatatatatatatatatccgttggtatagttctctgggattctagttcttcgcatgcggtcttaataatttgttcaacctcttctcatggtatgtgtgatttgaatgttatttttcccattttcttgcatgcagatgattttattgcaaatagaaacgtattttgtagttttcctttgttattgcttgtccgatatttttcgatgcgaaaacattcagtgtagttttcgatggagttaagaagacaactttatcattggtccatccatgtcttaatctattagctgtgaaatttcatgttttgacggagacatagatttaattaatgtatccttgtactttattccttgctaattccttcttagagatagattgctccaaattacttgtcatatagataaaacgattctgattattctcaaatttgtttaatacgaaaatgtataaagaaatgcaacaaatgtatttacattacaattataattactagatgatttttcgtttttttctgattgctaaaagttattctatttatgcgactaagaaatatgtatatgttacttgtatgatagagatccgtttgagcctactcaagacttaaaatcgaactagcatatttcttcctcgtagattttggatgagtctgaagattagtagagcccctcacgaattttccatgaagagataaataacaacaaattaagcttcctctcttgccatcttatcattctagatcgctgaatatttttacgccacacaattttgtgcgaaaaagacttttgcaagttggcttatataatagagatccgtttgactgtttgagtacaagaaagacttaatagagatccctcatttttctgctaagaggacattttatatagactcacgtggtggagccacagagaattagccgcccctcacgaatattcttcccatgtttgcgttgctagtcttcttattctaagtcaatggagttagtgtactaatctaatatatatacaacaaacccttttatctgttttgaataccattgcttcatatagctctctaaaaaagctctttgttcgtctctatatcatacgaataatggattcttattttttccttggcactgttgttgttgttgctcttgcaatctacacgcttttgggaacaatatcttttatg

SEQ ID NO: 30939 - DNA, 3003 bp, Unknown
  misc_feature (1)..( 3003): 2750-1469P.txt file - cDNA_ID_3037308; gDNA_ID_2213663; Annot_ID_181897
ggttgaacgacaagaaagttcttgttgttattgatgatgtgaatcagtcagtacaagtagatgccttggcgaaagaaaatgattggctaggtcctgggagtcggattatcatcacaacccaagaccgaggaattttgagggcgcatgggatcgaacatatttacgaggtggattatcccaactatgaagaggcccttcaaatcttttgcatgcatgcttttggtcaaaagtccccatatgatggttttgaggagcttgctcaacaagttacaacactttcgggtagacttcctttgggacttaaggttatgggatcctatttccggggaatgaccaagcaggagtggacaatggcactaccaagggtaaggactcaccttgacggaaaaattgagagcattctaaaactcagttacgatgccttatgtgatgtagataaaagtttgttccttcatctagcttgctctttccacaatgatgataccgagttagtagaacagcagcttggaaagaagttctcggatttgaggcaagggcttcacgtcttagctgagaaatcgcttatacatatggatttaagactgatacgtatgcatgttctgctggcacaacttggtagagaaattgttcgtaaacaatccattcatgagcctggacaacgtcaatttttggttgatgcaacagatattcgtgaagtactcactgatgatacagtaagttttgacatatattttttcttcctttattgttcttatcatttgacaactaaactatataatttcttcagggcagtagaagtgtaataggcatagatttcgacttcaatacgatggagaaagaattagatataagtgagaaagccttccgaggaatgtctaatcttcagttcataagaatttatggtgacctttttagccgtcacggagtatactattttggcggtcgcggtcaccgcgtgtctctggattatgatagtaaattgcacttcccgcgaggtctggactatttacctggaaaacttaggttattacattggcaacaatttccgatgacaagtttgccctctgagtttcatgcggagttccttgttaaactatgcatgccctacagcaagcttgagaagttgtgggaaggaattcaagtaactgtttgttctctttatttacttctctccaactttcatttttttttctttttcgaatggattatttgatgtatacgaacggctttgaaacgctttcacacttctaaacttctagttgtggtttttgtactgcagccgcttagaaatctcgagtggctggatttgacttgttccagaaatctgaaggagcttcctgatctttcaacagccactaatctccaaagactgtccattgagcgttgctcaagtttggtgaagctcccttcctctattggggaagccactaatctcaagaaaataaacttgagagagtgcttatctctggtggaattaccctcctcatttgggaatcttactaatctccaagaattggatcttagagaatgctcaagtctagtggagctcccaacctcgtttgggaatcttgctaatgttgaaagcctggaattttatgaatgctcaagtttggtgaagctcccatcaacttttgggaatcttactaatctcagagtgttgggtcttagagaatgctcaagtatggtggagctcccatcctcgtttgggaatcttactaatctccaagtattgaatcttagaaaatgctcaactctggtggaactcccctcctcatttgtgaatcttactaatctcgaaaatttggatcttagagattgctcaagtctactcccctcctcgtttgggaatgtcacttatctcaagagattgaagttttataaatgctaaagtctggtggagctcccctttttctaatatatatatatatatatccgttggtatagttctctgggattctagttcttcgcatgcggtcttaataatttgttcaacctcttctcatggtatgtgtgatttgaatgttatttttcccattttcttgcatgcagatgattttattgcaaatagaaacgtattttgtagttttcctttgttattgcttgtccgatatttttcgatgcgaaaacattcagtgtagttttcgatggagttaagaagacaactttatcattggtccatccatgtcttaatctattagctgtgaaatttcatgttttgacggagacatagatttaattaatgtatccttgtactttattccttgctaattccttcttagagatagattgctccaaattacttgtcatatagataaaacgattctgattattctcaaatttgtttaatacgaaaatgtataaagaaatgcaacaaatgtatttacattacaattataattactagatgatttttcgtttttttctgattgctaaaagttattctatttatgcgactaagaaatatgtatatgttacttgtatgatagagatccgtttgagcctactcaagacttaaaatcgaactagcatatttcttcctcgtagattttggatgagtctgaagattagtagagcccctcacgaattttccatgaagagataaataacaacaaattaagcttcctctcttgccatcttatcattctagatcgctgaatatttttacgccacacaattttgtgcgaaaaagacttttgcaagttggcttatataatagagatccgtttgactgtttgagtacaagaaagacttaatagagatccctcatttttctgctaagaggacattttatatagactcacgtggtggagccacagagaattagccgcccctcacgaatattcttcccatgtttgcgttgctagtcttcttattctaagtcaatggagttagtgtactaatctaatatatatacaacaaacccttttatctgttttgaataccattgcttcatatagctctctaaaaaagctctttgttcgtctctatatcatacgaataatg

SEQ ID NO: 30940 - DNA, 3003 bp, Unknown; identical to SEQ ID NO: 26771
  misc_feature (1)..( 3003): 2750-1469P.txt file - cDNA_ID_3037312; gDNA_ID_2213663; Annot_ID_181894

SEQ ID NO: 30941 - DNA, 3003 bp, Unknown; identical to SEQ ID NO: 16025
  misc_feature (1)..( 3003): 2750-1469P.txt file - cDNA_ID_3037319; gDNA_ID_2213663; Annot_ID_181892

SEQ ID NO: 30942 - DNA, 3003 bp, Unknown; identical to SEQ ID NO: 26773
  misc_feature (1)..( 3003): 2750-1469P.txt file - cDNA_ID_3037323; gDNA_ID_2213663; Annot_ID_181885

SEQ ID NO: 30943 - DNA, 2507 bp, Unknown
  misc_feature (1)..( 2507): 2750-1469P.txt file - cDNA_ID_3037327; gDNA_ID_2213663; Annot_ID_181883
aagctttttaggaacataaaaaagatagcaacaaagaccaatgccgctactcctcctacaacaatcgccaacgacttccccgtgtttacttttgaaccttcttctgtcaaaagaaacaattcgcaacttaagtacataatcaactgatatttgttttggttcagttttctttaataactgtacgtaccgtggtatgaatcattgggaagttcatgtgggtgatatgtataaccgacgtggcacccttctaagtatatttgtccggctatggaccaccgacactcttctgctgctgctgccgcggctgaacttatgcactcgccgcaatcgcaagcttcaacgtggccgtcgcattgagccacaacgtggaggagcttgtagctatcctcatagaatccgtgaccgtcaacaactcctgtttcggctgcagtgagtgcctccgtcctcatctcttcgaatccggggaaagtctccgcggtagctccatcgcatatcttgtggatgagaccgtgttccggggtctcaaataacttgtacttgtgatgattattaacttcttccaaaaataacaagaatcatatttattttacgtaatgaatcgtttactttaatgtgaattcaacttaatttgtttatcactatccttcaatttttctcgcgagtggaaaatttatatacctaagaaataatatattttttgataaaagtataagaaattttactataagaccaaataagtaagaaattttccaaccatttttttctgtacacgattttatgattttttgtcaacaacaaagatgaatacttacgagcgccaggggtatcaatacgttcgaatttgtatatcaaatgacatcctcgaagatgaatacgagctgacgtggcatttccacacgatctagacgaaatttcacgaagatcaccaacacatttatggcagatctcactcggataatcttctctgcattggaaccatccagagacagcgtgtttttcgttaccaactagagtcttcaagaatttagatcgagaggattctgattcgagtttgcgtaagaaagaagaaagggcttgtgcacgaagaaagagattctgattcgagtaatttggagattttgttgttgctttttggaggatgtttgcgtccaatggatcgcattgtttgaaaacaagagtgtcgtaatcaagttgagaagtgttgatgatagagggaagagacagaatgattagggctagggtttgtgtgaggagagagatcaagtggacaaccatgtttgagtcaaaactacagggaagagagatatatttttaattcattgaatatatacattggtgaatggagagggaagttgtggtagattagattttgtctacgtatgtctaccacttgtctacatatgttaaagatttagttgtgacttaggaggtcgtcaagcgcacgtgctaagcacaccaacgatttcttgatcttttcttcttgttggtatgaatatgatcctagaggttagtttaacaattttctaatgattttatgtatagtgaaacagtaatattattcacaatttgtggaactggctgatccaaaatatgttaaaaatgacattcggctactagcggaggtctgattcttagcctaacccttattcaattcttttaatactactagtgttggtttgaagtaagagaataataatgtacgtaaatgtatgtaatttgaaagtaagaaaagctttcgatgaagtcttagacagtaacaaactaacaaacatatccgctcaactaaatttacctaacaaatttccatagttttcaaccaagatttaaattaaaaatacactggaaattctaaacaaccctaaattatgttttttttttgttgtgtgagagcgaaatagtcggaattagagtaagaccaatcaaattttaaatatttatcgtaacttttatttcaagttgctttatatgatgtcttgaatctcaattgccttgccaagaaaaacaagcgctgacatatataaaaagcctaaaattacagaagaaaaatacaaagagctagaagaaaaagaaattcccctgttcttccgtaaatatcgttaattcgttatgacagagtttcattctctttgactagatctttatttttttctttacaccgatacaagtcaaaactcttaacaaacaaatatttagatcaacatagaccaaagagtcaaagaaataatgtctgtctccataaagtctccaacttttataacaaattttccgttgaatatgacagtaaataaaccaacggtctagttcttatcatgtctaaaaaccacaagctccttcctcatcttacgctcccctctttacctctccttttattctccttctcattctcctctcaacaactgatcgtataatcattctcacggagacgagtgaccaaaacaaggtctcccgcttcttgcgaagattaaacgaatccatttagattttaaaaaccacacaaaaaaaatatg

SEQ ID NO: 30944 - DNA, 3000 bp, Unknown; identical to SEQ ID NO: 10593
  misc_feature (1)..( 3000): 2750-1469P.txt file - cDNA_ID_3037338; gDNA_ID_2213664; Annot_ID_132637

SEQ ID NO: 30945 - DNA, 3000 bp, Unknown; identical to SEQ ID NO: 10593
  misc_feature (1)..( 3000): 2750-1469P.txt file - cDNA_ID_3037338; gDNA_ID_2213664; Annot_ID_182021

SEQ ID NO: 30946 - DNA, 3000 bp, Unknown; identical to SEQ ID NO: 10586
  misc_feature (1)..( 3000): 2750-1469P.txt file - cDNA_ID_3037363; gDNA_ID_2213664; Annot_ID_182042

SEQ ID NO: 30947 - DNA, 3000 bp, Unknown
  misc_feature (1)..( 3000): 2750-1469P.txt file - cDNA_ID_3037371; gDNA_ID_2213664; Annot_ID_182039
ccttgcacttgaaagttcatctcctaaagtggagaaaacattaaaataggaaactagcaaaatgattggacaaacttgtaccaatatatttaacatgtttagaaaatattcaactcacttagtttgattctttgaatcaagttttcagttattagttccaacttgtaaaaatggttgcagaacaaaatgatgaggaagttttttagtatcacataagtccagattcaagtttttttcaattgtatctaaaacacacacaactttcagattgaataaaatctgaatttcattctcagcagaggctaatataaaaatgacaaaagaagaggaggaggataggagctatatgtctactatttttatttttttagccaatgagagagctccacttcataccccacttttaccaatcgagcgatttcacaaccagtctcacccatgtcgcgttgagcgcgtgtctacgatttctaaaggggtttgtccacagaaatcatgccttttttgatccacgcaactcactctcaaaaatccatcgcgtgtcttattttttttggttttcttctctaaaccaaattaaaccgaaccgagatcaatttgaatttcaaaaccaatgtaaacccatcaaacccatcgctgtgaaaacaaaaagctcggccactgtaacaacaaaaatggagacgacacagaggtacaacttggaagagaacttaacggtcaagtactcgattctactagagtggaaagcaaatttctattacaaaatacaaattaagtgtttagcttcggaattgtggtgaatgaattcgagatgggtgattcagaaactgacctctcaccttccttcttgcttatctaccgttttgtccccttcgaaaatcctaatccggcagagcccaaattaccaagtctcgacctttctcctcaaccatgtcgatatgagccttctcttatccatctgcggcagagaaggctggtttcctcatctgggtccttgtctccacgcctccattatcaaaaatcctgaatttttcgagcctgtagatgctgatatccatcgaaacgctctggttgtttggaactctttgctttctctgtatgcgaaatgtgggaagttagttgatgccattaagttgttcgacgaaatgcccatgagagacgttatttcgcagaatatagtgttttatgggtttctgagaaacagagagactgagtctggttttgtattgcttaaacgaatgcttgggtcaggtgggtttgatcatgcgactttgacgattgttttatcagtgtgtgatacgccagagttctgtttggtgacaaagatgattcacgctttagcaattttaagcggttatgacaaggaaatttccgtggggaacaaactgatcacatcttatttcaaatgtggatgttcagtttctgggagaggggtttttgatgggatgtcacatcgaaatgtcatcactttgacagctgtgatttcgggtctgatagagaatgagttacacgaagatggtctaagattgtttagtttgatgcgtagaggattggtccatcctaactcagtaacttatttgagtgctctagctgcttgttctggttcacagcggatagtggaggggcaacagattcatgcccttttgtggaaatatgggattgaatcagaattgtgcattgagagtgcgctaatggatatgtactctaaatgtggaagcattgaagatgcgtggacgattttcgagtccacgacggaagttgatgaagtttccatgactgtgatattagttggtttagcacaaaatgggtcagaggaagaagctatacagttcttcattagaatgcttcaagctggagtagagattgatgcaaatgtagtctcagctgttcttggagtttcgtttatcgataattctttgggtctaggcaagcaactgcattctttggttatcaaacgaaaattctccggtaacacctttgtcaacaatggactcattaacatgtactcaaaatgtggagatctgaccgactcacaaactgtctttagacgaatgccgaagaggaactatgtttcatggaactcgatgattgcagcatttgctcgccatggtcatggattagctgccttgaaactatacgaagaaatgactacgctagaagtgaagcctacagatgttacctttctatcactacttcatgcttgtagccatgtagggttgattgataaaggccgagaactcttaaacgagatgaaagaggtccatggaatcgagcccaggacagagcattatacctgtattattgacatgttgggtcgagctggtcttttgaaagaagcaaagagctttatagactcattgcctttgaaacctgactgtaaaatttggcaagcgttgcttggagcttgtagtttccatggtgatacagaagtaggggaatatgcagctgaacagttgtttcaaactgcacctgatagctcatctgctcatatcttgatcgctaacatatattcatccagaggaaaatggaaggagagggcgaagacgatcaagagaatgaaagcaatgggagtgactaaagaaacaggcataagttcgattgaaattgagcataaaacacacagctttgtggttgaggacaaattgcatccacaagcagaggctatatatgatgttctgtctggattgtttccggttatggtagatgaaggttacagacctgataagaggtttattctgtgttatacaggagatgacaggaacggcacggtatcatagttccttaacgccttctctctacatgaatgtgtacatacaagagtagagaatatccatggcgttttgtaaagtttgattttggtagttgaagaccccctctagctgaaacagaggctctactgttttgtctctttatcttaattcttaatatatggacatctgtctggtcaccagttaacgcctcaaagggacaaacttagggaaagagaaggtaagagatacaatg

SEQ ID NO: 30948 - DNA, 3000 bp, Unknown; identical to SEQ ID NO: 10607
  misc_feature (1)..( 3000): 2750-1469P.txt file - cDNA_ID_3037391; gDNA_ID_2213664; Annot_ID_182031

SEQ ID NO: 30949 - DNA, 3003 bp, Unknown; identical to SEQ ID NO: 26782
  misc_feature (1)..( 3003): 2750-1469P.txt file - cDNA_ID_3037408; gDNA_ID_2213664; Annot_ID_182022

SEQ ID NO: 30950 - DNA, 3000 bp, Unknown; identical to SEQ ID NO: 10595
  misc_feature (1)..( 3000): 2750-1469P.txt file - cDNA_ID_3037413; gDNA_ID_2213664; Annot_ID_182017

SEQ ID NO: 30951 - DNA, 3003 bp, Unknown; identical to SEQ ID NO: 26784
  misc_feature (1)..( 3003): 2750-1469P.txt file - cDNA_ID_3037421; gDNA_ID_2213664; Annot_ID_182015

SEQ ID NO: 30952 - DNA, 3000 bp, Unknown; identical to SEQ ID NO: 10584
  misc_feature (1)..( 3000): 2750-1469P.txt file - cDNA_ID_3037425; gDNA_ID_2213664; Annot_ID_182014

SEQ ID NO: 30953 - DNA, 3000 bp, Unknown; identical to SEQ ID NO: 10583
  misc_feature (1)..( 3000): 2750-1469P.txt file - cDNA_ID_3037429; gDNA_ID_2213664; Annot_ID_182011

SEQ ID NO: 30954 - DNA, 3000 bp, Unknown; identical to SEQ ID NO: 10581
  misc_feature (1)..( 3000): 2750-1469P.txt file - cDNA_ID_3037433; gDNA_ID_2213664; Annot_ID_182009

SEQ ID NO: 30955 - DNA, 3000 bp, Unknown; identical to SEQ ID NO: 10579
  misc_feature (1)..( 3000): 2750-1469P.txt file - cDNA_ID_3037437; gDNA_ID_2213664; Annot_ID_182005

SEQ ID NO: 30956 - DNA, 331 bp, Unknown; identical to SEQ ID NO: 10615
  misc_feature (1)..( 331): 2750-1469P.txt file - cDNA_ID_3037448; gDNA_ID_2213665; Annot_ID_182082

SEQ ID NO: 30957 - DNA, 3003 bp, Unknown; identical to SEQ ID NO: 26791
  misc_feature (1)..( 3003): 2750-1469P.txt file - cDNA_ID_3037452; gDNA_ID_2213665; Annot_ID_182081

SEQ ID NO: 30958 - DNA, 3000 bp, Unknown; identical to SEQ ID NO: 10617
  misc_feature (1)..( 3000): 2750-1469P.txt file - cDNA_ID_3037460; gDNA_ID_2213665; Annot_ID_182078

SEQ ID NO: 30959 - DNA, 3000 bp, Unknown; identical to SEQ ID NO: 10628
  misc_feature (1)..( 3000): 2750-1469P.txt file - cDNA_ID_3037464; gDNA_ID_2213665; Annot_ID_132671

SEQ ID NO: 30960 - DNA, 3000 bp, Unknown; identical to SEQ ID NO: 10620
  misc_feature (1)..( 3000): 2750-1469P.txt file - cDNA_ID_3037464; gDNA_ID_2213665; Annot_ID_182075

SEQ ID NO: 30961 - DNA, 3000 bp, Unknown; identical to SEQ ID NO: 10621
  misc_feature (1)..( 3000): 2750-1469P.txt file - cDNA_ID_3037483; gDNA_ID_2213665; Annot_ID_182069

SEQ ID NO: 30962 - DNA, 3003 bp, Unknown
  misc_feature (1)..( 3003): 2750-1469P.txt file - cDNA_ID_3037503; gDNA_ID_2213665; Annot_ID_182062
tctcgccttcttttagcttttcatctttacctgtctctgcccttaacctcacacagatatcgagtctcggcgattgaagtgaactctcatccttataatttcatccgaaaggtaaaattttgacagctctagtcgctaaaccattgttgtttaggtctccttggaactcttctgaatttgcttttagattagtttactctttttgagcctttgtttgtgtaatcttcgaatggattcatggttttgcgttaatgggttctgtttgttattacagattttggataaagttttgatttttttggttcgcaatgacgctgctcgaagctatctccaacgccgtagcgaatcaggacaaggtcgactcgcaatccgattatccaatccctcttagccacgatggtatctttgcgaatctgaaaccaaagctagaaaaccctaatcttggtacccttgtcaatccaatttccgggtggggaatctctgaaagtgatgttgaagtcatcgatttgggtaaaaagttttcatctaagctgaaaaggaagcttaaggatactaacgggtttgtcaaagatgagtttgtcaagatgttaaagcagtttcttgagaaaattggtgagaaagttgggatttcagaggctgagtctgagatggttttgggagatcaagctggttctgagatacagatactggtggagaaaaatgggtttttgatgggtagagatgtatctggtttagtgttgaaaggttgtattagtctagagatgtgggagctagtggaaattttgatttcaaactccttggttgatcattcttcatactcttatttagttagcaatcttgttgagaagcaaaggtcagatttgctttgcgtagtgatcaaagaagcttcagatcttggggcaactgagctactttcaatcttgaagtattttttatgcccatcaaaggaagcaattagcactatggctaaggtaagagaagaatgggagagtcaggctatgttggctattgaaaaggtgagcaacacagagctatcaaagaagtctaaagttgcagaagaggcttctatcttgttaatggttgctcatgacgggttttcaacctcagagctttgcctgcattacttgttagcttcacggaatgttgacgaagtcatgtttgcatctgcagtcagtaagttgaatggcaatgagatgggtagctttattcgatacctctctaaatggatgaagaagtatgagatgttcccacaagctggtccatgccctaaagccgcctccaagcttggtttgaaactatgcaactgggttcctgaactcacagacattaccaaatgtttgggacttcttatcgatgagaacttctccactctggttctgtactcggatttgcatgaagagctaaagtctattgcaagagtagccgatgggttagcttcagaatcaaaactttcctgttttgtggctaatgtggttgaaagtttgaagcttggagctgcccgaaactagattttcacaattgttggagcttaatgcaaccctgttttcactttttattatggtctccagtgacatttgtattttctagtttcagttcatctcttaactaaagtataattttgttcgctatctttgagagtttgtctccaacctctgcacattgccaatctcatttaggatgcaccacatggtttaaaattgttttcttttccaagaattctttatcagttacaacaggaagagtaaaaggtttatctttgcaatacaacagcttactttgttgaagaatgagcacaagttgttgctcaacgaagtgtctcacagagccggataataaaaaccgttcctttatgaacactcacgagaccttgccgcaaaatcaaacggctaatgtatcatcaccacgaaagtgaggtactctcgctgaggttgaagaagaagaaggggcaagaatgtaattacatccagaaatgcttcatagttacgcagctgagttattacacttgttcacaaagtaagctgcagtctggggactacccaactcctaactttcttcaccttcttaaattacctatctgtcaattatcatcatttcccaattgtgttgatacttaattggtagtagcaattttttccattaaagttttcatttttttggttttttgttgatggaaaaagtattgatccaacggctgtagaagaacggtgcaacaagattttgaattcggagatgcgtttgttttagttttaaaatagaaataaataaagttgttctctctctctcttcgtggacactggaactaacaccaccgatgcactacactctgtagagactgcaaatggaaagcatcttttggtaatcacgggtactgttgtcttcgtcttagtttttgtcggaaatcagacattagatccgaccagattctctatttggagacagacattactcggatctttatttcattttgtatgattctttattgtagattttgagatcaggtagtgtggatttgagatcaggtacatttacttgcaaggtgagttccagatctggttttggttatttcatttctggagttttatacgtttttgcaattttggagattttgttgattttagattaggatgatcattgcattttctttctctttcttgtttgatttcattggttaatgattgtggattactactatttaatctttttataaaaaaatccaaatccttagctcatgtacttataaaagaatgattttatgtttgatagtgatctatacatagttataaacaaatggctgatccattgaacttagtatgatgaatcctgttacaaagagcttatgtatctctttaatgtctaaaagctctagatagaaccaaaatatgaaaattgcaatctttagtaatgaaagtgttgtgttatagtcttgtgttattgcttgaccataatattttgtgattgttcggactaatgcaggtgttttgaattttggttgtggacataatg

SEQ ID NO: 30963 - DNA, 3000 bp, Unknown; identical to SEQ ID NO: 10623
  misc_feature (1)..( 3000): 2750-1469P.txt file - cDNA_ID_3037507; gDNA_ID_2213665; Annot_ID_182060

SEQ ID NO: 30964 - DNA, 3000 bp, Unknown
  misc_feature (1)..( 3000): 2750-1469P.txt file - cDNA_ID_3037511; gDNA_ID_2213665; Annot_ID_182059
tccaaaaatatcatgtacaataatacatttgattatcattattctctttccaaacaaaaagcaaatagtcataatctaaaagtggtccatcctctcccagtttgtatattactgattcaattatgtaaatatcatgtgtatcgtagaggaactaagaaaaaacagtggtccactccatccagtgtaacgtgtcattgtgatagtagaggagagaagagtttaaaatattgactggaacgctatttgttctcatgtggtttcctatacctttagccacagcaacctaaattcatccttaatgtacaaacaaatttctgaatagtagttgacctctgatttggtcacaggtcaccaaaaagagaaagaaattagaaatgaatgtttcctttctagataatacatgtttcatgtgaatcatttggattttctgacaagaagatatagaagattcccccacttctttgtgttcattaatccgacactcagttttgtttaaagtctcaaacaattgaatttttcttcgttcagtttacttttctgataatataacctttaaatcgtcggaaaaagaaaaaattaaccaactaaagaagaagaaaaacttttttaaaaaaacgaaaagagaaaaagaagacgaaaaacaaacttatgagtaacgtcaatgattagtggttgtgatcgaaacatcacaagccataccattaacacgatatactcgtgtttcaacaacacgatatacttgggttttcgtgttgaatgtcgtgtttcttccagctcacttgtttctttaacacaatattgtcttgttaacaaaaataaatcaaatcttctcttaactttatctttttttaaactggcaaacaaaaattcaaaatgaaatattgaacaaacctatacgaatctacgatacgcaattaataacatctccgtcaaatgttggtcatagacgtactctttctttttgctctgtatatagtaaagtagatgacaaagacaacagaactattaaaaaggaaaaaaagcagtgcaggctcatacgaattcagatacgaaacgcctctgtaacgtaaatgattaatttgatatggacgtatcgttacctccccacacgtggcctgaaggggattgatttgttatcaattgttttgtttgaccatcaaagcttcgacatttattgttattttcaatagttaatataacttgacttttaaaggtttatagaaactgaatatgtaaaagtttgtaagagacagatatttgtttaagaatatataagaagagtctaactctcttccaaatctcaagggtttttcttttcactaatctctagagtttggagcagattaattccacatttccactactaagtggctaagtgctaacagaaaatatattatttacaaagataggacaattttaccttaattgttacgagacgattagttttttatttatttatcccgagcatattttataccgtatatgtcgatctattttattaaataaagattagggtttaaatttagattttatggtttgttaaaaataataatatagatttatggtttagtttaattttgctgaacatccattagataaattaaaagctattttgattcattcatttgataaacgtctatttaaatgtccatagaaatctatgatacatggctaactgtgtttaacctaattaatcagatgtgccattatattaacgaagaacatgatctaaatgttaagaacggtattctataactacatatgatttgcccgctaaggctattttggtaacgaaatggtggtgtactgtagaggcgcaacgttcgaatggtacatgaacatgggacaagaatgctaaattttagataaatatttgaaaaattagtctgagattcgtttcatgatagatcctgattaccaaataaaatcttcattttgttaattattaaacaatcacacagtcgatattaaattacattacaaatctatctatatatacatttttgcagccattttagcaaataaatcttagagttgaacttatttacaatccaatgccattagcattaaatctttttttcaaaataattaattttactttaaattcttaatttaaattgtcaattacattatcaataaaatttaatccagacaaacttcacatcaatcccttaaaattagcataaacgtattttgttaacaatattttaaaataaagttttttgtttaaataaatattgttcttactaaacgttttttgtttaaataaacaaatcatgtatttgaacttatttacaatgtcatgctactgacattaattatttaggcatgaaaatatttaattaaagatttaaatcttctaaattcttgcttttagagttattatatcattatttaaagaggcaaaaaatattaattttttaaatattattatatatatatttaaacttcataaaacattattaatatttaaatttataaaaagtttattatatcaaaaaaattaacatcattatataacatatagagtttaaaaaatctcaaaacaatttcgtcctattttgtgattcgaaattttaagaatgaacatatattaaccaataggcgaaaaatgtgtgggttcaatgtcccgtaacgactaaaatattttgacaatgattcataaagatattataaataagatcaatattaataaaataaatagtttttattgtagacgggtttggcaggacgttacttagtaacaattgcaaactataaaataatttacaaatttttatatatattaattgttaaaaatgagttgtcgggttaaaatctagttatagaccgaatttcttgagcagttttcatgaaactcaaaacgaaatttaacataatgtgggaccaatttcaggatcacatctatatatatgtatatatattcaggcaagacatatcgtacaagttgaagtctcagtgccatacaataatatcaacatcttcgtagtctctctaatg

SEQ ID NO: 30965 - DNA, 3003 bp, Unknown
  misc_feature (1)..( 3003): 2750-1469P.txt file - cDNA_ID_3037528; gDNA_ID_2213666; Annot_ID_182117
tgtatattttatagtttaaatcaaataaaatgaagataacggaatttgagttagtatgggcaaaaacggttaatggttgtgtcttgtatttaaagatggagactttggaccaattgggacaagttgatggatgtcatatccaagttcattttctcctgatatttttctggtcaggtttagtaatttagcattcgaattccagtcaacaacagattatatatctaaacatagacggtaaaatatactaccgaatatcgaattaggcctttcgactaatactgattttagattttggatgttgttttgacatgttactctgttttctatctaatgctatagagtatacacttactagtgcgcacaacaaaaaacagaataaaattaatctatcatttgttcgtttaagaataatgaaaaaacttaaaacctacacataaaagactgtactttttgaatggaccttctgaatctataatttagatcacaccctttctttttctcatatactaaaatattaatcggaccacacacacccttttgctttgtaaaaatttaaatcgatctcctaattccaaacaacagaacttgttttttttttttttggttttattataaacaacagaacttgttctttttttttggttttattataaacaacagaactttgtggcaacttgtatactaaagtgatgaatatatgtatactacacatacacgacggcaaaatattattatatgaagaacgcaaaactacaaagatgtttccttcgcattatgtggtacataatccaagcacataatagcgtttaaagattaatttatgttttattaaaatgaaatccaaatccagctcaaagactaatgccttggagtctttcctctaaaatccttctagataatttctctaatttcacttgtagaatttcccttttttttgacaaaaatttatttgattcttatttggcttgttgttgtctgtatgtgtgtgtctatctttggtcggccatatttaaatctgtattgatactcgacatctttaaactattaccgatgaccaaagttatatgtttttataaatatagctacaatatatacagatatttgtcgtaattatatatgatctttattaaacttcttaacgcgtgtgacataaagaaacgaaatgttgtctccgtactcaaaagcgtatactcgttaatcaaagcatttttgcttactaatttaatctgtaacgtatggacatttatgtacaatactctatttttcgtagctgtacaaaattgaatacggaataatacaatatttagggaattagtagcatgttccatgcaggttggactagttctagtgtccgccatatgtataaagctgtaaacatctttaacgcatatatttggtttattaaaacaatagttttgtgattactatgacccattcatgtatttgcatataaatgtagtaacttggagttttggttaattagacaaaagatactccgatctaatattttttaaaataagctaattgaaacttcaacgtgggataaaacgggctgacaaaaaaaggttcaacatgaagaaaataactctaactgataaaacggcacggcgtctgaatgactataactctataaggtgacaaaacgacacggtgtcaacatccttaaaggggggaagaagagtcgtcgtgattcgtcgggtggctggctctttgataaatctaaacaataaacgacggaagcaatccgattcttcgtagataggaatagcccgaatagactggtactgggagtgttggacccacttcatcaatgttcgtgtcgatattttcaattctcatactcttctttggtcgcgttcaattattcaaatctcttaacaagtattttcttcacaagaaaattcgccaagcaaattggaaaaaaacgaagaacacacgaaataactagccaaaagagtttaattacttctttatatatgtgatcgttatttatttgcattttactcgtttttttttccaattatgtcgacacttgattaaattagaagcacaaagcctcgaagcaaaccggcaaagataataacatctgccagagctaagtaataaggtttacagttagatgatcgagagaatatgagctttggcaccgcagaaaacgctggccaattacataggaaaatgttcatttgaaaagatatatagctaaacagtatatatgtctcaaaagatagtttgactcgccgcatctttctattaggcactcgacgtcttcatcatatatgcattattattttgcatattaattaatggtagggatcaaattgttacgaagacatgcaatagatcatttggatattcatgcggtcgacatcaaataaaacagctctcgtacatacagacaggataagctcatgaagtttcctttggtatttatttttacgtccttttccatatccattatgatagttatccggtagctgatgtggacttcgtatcttctactgccagtaattgtatttctttttttataagtgcgcggaatatctattttcattcatcctcatcatcatatactaacatcaacttatctacctttttttttttaagggtttgctcgaggtttcatgtcattttttggaaataaattttgacaacatgatttaatgttgaatggtaatgaaataagaaaatcaagatgattcaatactcttcgatatatataaagtgagcgagagggaaagcacagagtatgataaatcaactgaatttagctaataaaacacatttttttatattgatagcgtcgaacagaccaacgacaacacaacggtcaaattaacatggcttaagtcaagcgaggacagaacgtgccaaagccattgaatatattgaatccttttataagcatatcttatttagtaaccacgtgagtcgtgacgatggcttattattagtacgtactacgtaactttgaagaaaagaagccctgaaatttcggaaatg

SEQ ID NO: 30966 - DNA, 3003 bp, Unknown
  misc_feature (1)..( 3003): 2750-1469P.txt file - cDNA_ID_3037536; gDNA_ID_2213666; Annot_ID_132697
tcgtaaaacaatttaatattttatatacaaaatcaactaaatcttaatcacataaaattagcacaaaaaaaagtattcaacaattaaaaaattatcaaatctctatataagttttgatactatattcgaataaagtgtaatattccttttcaatttgtattctttaactaatttaagcgaactaatatatttgctaatcttatacctatcaaaaccgactatcgtttcttatctttatagtatatttgcaagatcttttttggtggatttggataaaagtgcatatcgtcctactatattatttgggaagtacattttaaatgtaaccttaatttttgtaattaattacatgacaatgccattagaaaaatttaatcaaaaacaaaatcttttaatgacatcattaagattaccaaaatcatttaacgacaatattcatctcttaattatagggtttattggatttaaagacgggtcatcaaagatttcctaaactgaagcaaaatatattgaatattaaaatatctatctgttaccaaattataaacaaataagttcgtaaaacaatttaatattttatatacgaaatcaattaaatcttaatcacataaaaattagcacaaaaaaatgtggtacattcgggtctatagtagttttgcaagacttttttggtggatttgggtaaaagtgcattcgggtcatgtagtacattcccctattaaataaatatggtgcactcctatgttattagctaaaatatttagattataatttagagtcatatcataaataaaattaatattaataaaataaatggctttttggcaagacggatttggagggacgtgtttttgaatcaacattaataaaaagtaaaatataattaatccactgtttcaatacgggttaaattattaatttattattttttaataacaattaatatatataaatacttaataataattataaactgtaaaaatataaatattttataaaaataaaatttacaagttttaatatatattacttttaaaaaataaatcatcccgcggtataccgcgggttaaaatctagtttcatttaaacttgttaagatttaaaagtatttgattatttattttgaaatatatgaaaagaaaataaaatataattccttacagtccagacatggaaacaaataaactttgataatctcttcaaattataaattataaatagaaacgttttcatcataactcattcagaaaataaaaaataaaaaataaagaaaagataggggtgaaggaattagcatgattttgattatgatgatacattaagttaattacccaattagatttgaaagtataattttcttgaagcttcaaaatgggtgagtaatataataaaattatgaagcctcgggaaaatgtaaatgaaattaagtagatatgggccagaccaacgatattaactgaataataattgtggactaaatattggactccgtaaaagcccaaaacaaaatataaaacgaacccacacgacacgagttattatcagaaacattactgttacaatgcaaacgcgcaccagtagagcgtatagcgcgtgtgtcgaaaatgcctagtctatatacccaccaaaaacgctgtttttagcctaaatactttattttaaaagaaatcagcgcgtgggagaacccatgaacatttgggtttgtttatccattgttttgatatttatttatttcggttaattccaaaacaaaggattgcttcttcttggtatttttgactaacaaatacttttttttggcgacacacttatgtatagcaaaactaaaaagtatgaattcaaacaaacaaacaccggtataatatgtttacactaaactaaactaggagaagatgtttaatttatgaatgaaaccaaaattggaattattcactaaatgacgatttcgtaaactcagcttaacatttattgacgataacatcataaagagctcaaaatgatattgtactacataaaagaaaattctcttccatactagctataaaagatatttcaaatgaaacaatagtattattggttacaagtaaatcatagtgtacctcttaacaagtcaaataacttaaaaagatcaaaatatgcacaatcattttattaacaatccatatatataactgggaaaattaaagtggcgtaaatttgatcaatttatgtagctagccggtgattataattgaatatacgatgatgttccgagacaagttagttgatcaaaatattaattcatacatatccatccaacatatgttgctattacaatttacatatgataatcttagggcaggcctcataatatatacattaattggtaaaatctggtcaccaaatttacgagcagtagtaatcaatattagtagtagataacccagtttttgtttttttggtctgaagtagataaccccatttctatccataatatctttgtatttaagatacgttttcacgagggccagccgtaaaattgaattaaaatcccatttgtttataagtttatagtaaaatatagtagcttcagacaagtagtactaggaaaataaatcaacttaatagaagaaccagatctgtgaacggagaaagggacatatgagtttgtcaaagtcaacgatagaaacggttacaagaatatccaatgaaagagagccacgtgggagatgcagctgaatttaagtaagaatgatctcataatcttgaccatccaccaataaaaagcttaattaatacatcatcatccaatccggtggagtaaatgcgtagatggatagagaacggtgaagtttccaacaaaatctctgactctgattcagctttctatattcaatcgttcccattatctcattttgtagtttagttttatcctcaacaaccatcttcttcgttatattccttgagataacaacaaagcatcgttcttcacctttaccaaaaagataaaaaaaaagaaaaatg

SEQ ID NO: 30967 - DNA, 3003 bp, Unknown; identical to SEQ ID NO: 30966
  misc_feature (1)..( 3003): 2750-1469P.txt file - cDNA_ID_3037536; gDNA_ID_2213666; Annot_ID_182114

SEQ ID NO: 30968 - DNA, 3000 bp, Unknown; identical to SEQ ID NO: 10714
  misc_feature (1)..( 3000): 2750-1469P.txt file - cDNA_ID_3037536; gDNA_ID_2213669; Annot_ID_182230

SEQ ID NO: 30969 - DNA, 3003 bp, Unknown; identical to SEQ ID NO: 26813
  misc_feature (1)..( 3003): 2750-1469P.txt file - cDNA_ID_3037540; gDNA_ID_2213666; Annot_ID_182111

SEQ ID NO: 30970 - DNA, 3000 bp, Unknown
  misc_feature (1)..( 3000): 2750-1469P.txt file - cDNA_ID_3037540; gDNA_ID_2213669; Annot_ID_182233
attattagaaaaatcaatgccttctttggaaaaaaaaaatcggtatgtggctctattaattgaaaacatattttatatttgactttgttttttttattgaaagtgatttgatagcatcgttgaatgatttagtaatatctcccgtaagaatttaattatcccgttagactttttaacagaccagccagatgggaccaacgtgcactgttttttggccggagaatgtataaaaaatattgaagatgcagtgaacactgaccaccattcacttctccacaacttttaatgaccggtttacaaaataaaacatagtactatataattttcaacgtgttagtctgatttttatatttctaaagagaagtactcatctatttttgagctattaatctattacaatttgtgttctgatctggagagtggagagttatttcaaagtaaagtatgtagattgtagaggatctatcgagaatctactcatttaaaatagtttgacgttgtagcaaacaatttttttgtcattgatgatttgtattgtttgtaaatattatttagaaaccaaatcgaatttttagttgaaaattataatctgtttaataagtgataattacatcatgcacatgtacctagtgactcataatgaaacgtatcataatggattgacgagtagttgtctgatattgacatcttaatttataacttcccttttcattgttaatgttccttactgtcttctgattgataataaagacgttgacatgtcaaaccacataattatttgaaaaatatatattatttcttcagattttcatcatttgttataagtctcgataagacagtttttgtttttttaacaattttttacaaaaaacttacgaccataatttagttcaggcgaaaatcagtgaatcattaatcatatttattagtttggatttttatgtgtttttctttttatgtatttgaggatttttcagtttgtgaaaacaaatctaatatgcttatttgatttcttctttatttgctgtattcttaatatatcttgcagagctaaggtaatactcaaattttttttttccacacgtaaaaactcatatttatcagtttggaattactgtattctttttagtagtcctctcactcgccatggcaagaagaaggtttttttttcctttttcttgcattccatgttaatcagtatttgaataaaaaagcaagctaaatcggcaaatgaacttatatccaaataatcaagatatcaatctgtgtaagcattactagaaaagtagagatactcgtgttaccgtgtaaattaaaagaataaaaatgtgcttttcaaaagttatatacttttcttgtgcacccataactttagcaaaagcaaccatcatcattcttgagcaattaaaacaaataatattgatcttcatttggtgccaaaatactttacggtaatgacgtcaaactcgatgtttcttgtcaaagtctgaaagaccaatataaaataacactagacacattataaaattaacatattggttcattgtaattaaaccgtcgaatatatataacgaaaataccaattacgctgtgaataaacaaacaaaatcattttattagtcatcgagtaaataaattcgattataatcctcaatagtcaatatatatatagctcacatcacattatgcgattaacaaaaacaatccaaaacagttaaatgattagaaattaaacgagtctcactaaattattaacgactccaaatcacgagaaggcttaagagttatcatgtcgggagaatttaactgataacctcttccattatctctcaatcacgtgatttttgttcaacgagtaccgcatctcaagaataaaaatggcaatttaggtaaatatttgtcattttcaagggcaatggaacttaaagatgcatttcagaaggaaaagctttgtcgtgttatgagggaaatgtggggacgcagctacttcgctttcaaaccgttggatgaatatcctttaaggttcatcgtacaagatcgacggcactcaccgagggtgtactcatgttgtgacacagaggatcatgtctacttggagtacagctagcagctagagattctgagccgataacgtcgagaattgtagccggctaagtcgtatatgctggtttaaactttaatctgtacttatatataagtcaacgtgcttatcaaaatcagctcccttatcgtgtgataggtgcattgtcttattagactccgttatccgtcaccttcgcatattaaaatcactttttattttttggttttaaattaaagtctccatttctgcaagattttaatgttcgtataaataagcctgaagagagagagagagagagagagaaaacttgttttttttttttccattagtttttttcttactttctggtcgagagaggagagtccaaaaaacccaaatccttggcctctttcaatatcaggagagagaaactgaagctctggcctttgtttctgaaatcgatcgtcttcttcttcttcatggcaagtaacgtatctaggtctttcatttttggtttaatatctaaatcgtagcttttctgggtttttgatttttgtttttgtctcatggaagtgaaaaagatggccattttaagctttatatttaattcggtggacaataataatactaggaagacctaatttttgtgtagcccaattaaacactaattaaatccgccggaatagagacttttggagaattttccggaggatagttgtaaagatctagttatatactgtgtaattaagaggctgtgtctattttcattttttaaaaataataattaaatggaggaatatctgaaacccagtaaattgggatgatttgatggttttgtaaggttatcatcgtcgccattatattgatatgcagatctggtgggtttttctgcatctgacttgatagctttatcggactgagtggcaaaatcaatcatg

SEQ ID NO: 30971 - DNA, 3000 bp, Unknown
  misc_feature (1)..( 3000): 2750-1469P.txt file - cDNA_ID_3037544; gDNA_ID_2213666; Annot_ID_182104
tttcttaaatttttatcagaagccattttttaatcaaatttgtataattgtatccaaaagaaaaaaggggtttctctggtttaaaagaaacaaaacttttaccttgaaatgaggtagaggatggacgatgatgacaagaagacgaaactgcatgagaaaaagaaaccaaactcgacgtgatcagaagcccaacggtgatcaggaggagacgccggcgactatgatatgacggcgtttcgctattaaccattattctccctatttttcttgtctaattctctctctttttttgtttttttgggggaggtttggtttctaatttctgaaactctaaaaaagggtttatcaatcaaacgtatgaataagaatcttttacttcttcaggaaatcaaggacaaagaagatgaaacgaaactgttccctttatttagattttcaccatccattgttgttattctgttttgttttaagttttcacctcattttcttagtttttaaaatccttaattaattactcttttaactcttattggctgtgtgacctaaaacttaaattaatgaatcacatttttttctataaaaccgattatacaataaaattgaaatgaaattggtaaaaatactttatactcagggtcgactcggagattagaaaaagaaacggagaatggcattaattaccaccaatactgacatgagagctactctaattttgtaacggaaaattgcatttatgatcatctggtaccaacttttcctgcttttgctctgtcatggcattttctaaagaaaaatgttgtaactaagattttttttagaaaattgttacgtcatgtctgcataatctttacaaaagtaagctaagattaaaagtcgtattctttagttgaatttttttcaaattacaataataacgccatattctccaatggttttaagaatgtgatccatgatggatcatccatcgtttctgtagggtgttttattgagcttaacgatcttacaaaatagccacaaaatgcctgtggttgtcacagagtggaacaacaacaaaaaaaaattaagttagagagtgaattacaaatggtacgtatatgtagtagaacacatataggaggcgacaaaccatctttcaaaaccaaatcttcggaatttggcttaagacacacaactcaaccagatttctcaatgaacctcagtgttttctcctcggttttgagttgaaacaaagccactttatggcaaagatgatataccttggggagatttctccatccaaaaggacgcttctctattgcttcatgtctgttttgaacacataaccaaagagtttcttcatatctagttatctattctctacagacaagcgtttcgtccaaggacttttctaccaactcaggccttctccttggagatagccctctttcgatcatttcctcctcatattccctagccatatccaacattcctttctgaatcaacgcatcaatcacagcattatacgccgctgaatcaggagtatccccagactctttcattgtcttccacacatataataccggctgaagaaatccccatctctcaaacttcctcattagcatcacataagtatccatctttggcctcactccactccttatcatcctaccaaacagacttaggatctcactcggtttctccaaacgggaaaagagacacatgtaagtaatcgaatcgggttgacaacctctcttaggcatctcatcaagcatccgatacgcgtctctcatcctcccgtcttcacatagaagcttaatgattgtgttatgagtcgcaacattaggttcacaacctctttccctcatctcccgaaataccctgataccgaattcaacaccttgcgacgctccaatggctcgaatcacagtgttataagcaaccacatcgagtttcatccttctactcttcatttccttatacaacttcacagctttccacggtttcccgctcttgcacatgatatccatgtaaatggaatacgaaaaaagatccttagtaacaccttcagtatccatcttcttccaatactccttgcatttaccccaccatcccaatttcgaccacccacgaagaatcagattatgaatcttagtattactcacactaaaaccattaccaatgacattcttcccaaaacaaagctcttcagcttcaaccacatgtttatgctcgcaaagcgcatcgaccagattataaaatgatgtttcatctctcaaattgaaatcatccaatttatcatacgcatcaatagcctcctgaacaagatgagccgtcacataacgcttaaagactatacgaaacgtgacgtgattcggcacagattccgtgtttccgatcatgcggttaatcaaagcccaagaaatttcaaactcgaaatacttacccagaatatcgatcacccgattgaatgtctcggtggtatgtctgaatccggattctctctcgacccagttgaaaaactccaacgccttttgccaatcgttgctgtaacatgtgagagcttcgcatactgttttctgatcgtaactggactgatcttcttcttcctgagatcgaaacttcgcatcatcgacatttgaaataggttttactgacagaagccgaacggagtaaggggaagcaatccgaactcgattgagtcgccgcaacaagagcattctcttgtttcccctctccgctccctgtacacacgaaattagggttcatcatctaacgggcgaattttgacccgaatacccattttaaaatctgacccgaataccatttatgggcccaaagcccgctggacttgtgttaatatttggaacatttgggccgatctatcttctacgaatctttcttaggcccatcataattgagccatccagaggtgaaaataaataatcgaacggttaatattggtttgattataaacacaaaagttctttccaggtctccttgtagtctttgttgtagtaaatg

SEQ ID NO: 30972 - DNA, 3003 bp, Unknown
  misc_feature (1)..( 3003): 2750-1469P.txt file - cDNA_ID_3037544; gDNA_ID_2213669; Annot_ID_182240
cattttcttaaatttttatcagaagccattttttaatcaaatttgtataattgtatccaaaagaaaaaaggggtttctctggtttaaaagaaacaaaacttttaccttgaaatgaggtagaggatggacgatgatgacaagaagacgaaactgcatgagaaaaagaaaccaaactcgacgtgatcagaagcccaacggtgatcaggaggagacgccggcgactatgatatgacggcgtttcgctattaaccattattctccctatttttcttgtctaattctctctctttttttgtttttttgggggaggtttggtttctaatttctgaaactctaaaaaagggtttatcaatcaaacgtatgaataagaatcttttacttcttcaggaaatcaaggacaaagaagatgaaacgaaactgttccctttatttagattttcaccatccattgttgttattctgttttgttttaagttttcacctcattttcttagtttttaaaatccttaattaattactcttttaactcttattggctgtgtgacctaaaacttaaattaatgaatcacatttttttctataaaaccgattatacaataaaattgaaatgaaattggtaaaaatactttatactcagggtcgactcggagattagaaaaagaaacggagaatggcattaattaccaccaatactgacatgagagctactctaattttgtaacggaaaattgcatttatgatcatctggtaccaacttttcctgcttttgctctgtcatggcattttctaaagaaaaatgttgtaactaagattttttttagaaaattgttacgtcatgtctgcataatctttacaaaagtaagctaagattaaaagtcgtattctttagttgaatttttttcaaattacaataataacgccatattctccaatggttttaagaatgtgatccatgatggatcatccatcgtttctgtagggtgttttattgagcttaacgatcttacaaaatagccacaaaatgcctgtggttgtcacagagtggaacaacaacaaaaaaaaattaagttagagagtgaattacaaatggtacgtatatgtagtagaacacatataggaggcgacaaaccatctttcaaaaccaaatcttcggaatttggcttaagacacacaactcaaccagatttctcaatgaacctcagtgttttctcctcggttttgagttgaaacaaagccactttatggcaaagatgatataccttggggagatttctccatccaaaaggacgcttctctattgcttcatgtctgttttgaacacataaccaaagagtttcttcatatctagttatctattctctacagacaagcgtttcgtccaaggacttttctaccaactcaggccttctccttggagatagccctctttcgatcatttcctcctcatattccctagccatatccaacattcctttctgaatcaacgcatcaatcacagcattatacgccgctgaatcaggagtatccccagactctttcattgtcttccacacatataataccggctgaagaaatccccatctctcaaacttcctcattagcatcacataagtatccatctttggcctcactccactccttatcatcctaccaaacagacttaggatctcactcggtttctccaaacgggaaaagagacacatgtaagtaatcgaatcgggttgacaacctctcttaggcatctcatcaagcatccgatacgcgtctctcatcctcccgtcttcacatagaagcttaatgattgtgttatgagtcgcaacattaggttcacaacctctttccctcatctcccgaaataccctgataccgaattcaacaccttgcgacgctccaatggctcgaatcacagtgttataagcaaccacatcgagtttcatccttctactcttcatttccttatacaacttcacagctttccacggtttcccgctcttgcacatgatatccatgtaaatggaatacgaaaaaagatccttagtaacaccttcagtatccatcttcttccaatactccttgcatttaccccaccatcccaatttcgaccacccacgaagaatcagattatgaatcttagtattactcacactaaaaccattaccaatgacattcttcccaaaacaaagctcttcagcttcaaccacatgtttatgctcgcaaagcgcatcgaccagattataaaatgatgtttcatctctcaaattgaaatcatccaatttatcatacgcatcaatagcctcctgaacaagatgagccgtcacataacgcttaaagactatacgaaacgtgacgtgattcggcacagattccgtgtttccgatcatgcggttaatcaaagcccaagaaatttcaaactcgaaatacttacccagaatatcgatcacccgattgaatgtctcggtggtatgtctgaatccggattctctctcgacccagttgaaaaactccaacgccttttgccaatcgttgctgtaacatgtgagagcttcgcatactgttttctgatcgtaactggactgatcttcttcttcctgagatcgaaacttcgcatcatcgacatttgaaataggttttactgacagaagccgaacggagtaaggggaagcaatccgaactcgattgagtcgccgcaacaagagcattctcttgtttcccctctccgctccctgtacacacgaaattagggttcatcatctaacgggcgaattttgacccgaatacccattttaaaatctgacccgaataccatttatgggcccaaagcccgctggacttgtgttaatatttggaacatttgggccgatctatcttctacgaatctttcttaggcccatcataattgagccatccagaggtgaaaataaataatcgaacggttaatattggtttgattataaacacaaaagttctttccaggtctccttgtagtctttgttgtagtaaatg

SEQ ID NO: 30973 - DNA, 3000 bp, Unknown; identical to SEQ ID NO: 10646
  misc_feature (1)..( 3000): 2750-1469P.txt file - cDNA_ID_3037547; gDNA_ID_2213666; Annot_ID_182102

SEQ ID NO: 30974 - DNA, 3000 bp, Unknown
  misc_feature (1)..( 3000): 2750-1469P.txt file - cDNA_ID_3037585; gDNA_ID_2213667; Annot_ID_182148
tcagagcagccagaggttagactcagttacctccaccagatgactgaatgaattatccttcatcgactctaaaatttctttggcaacattagtctctatatgaaacccttctacttttttattagtagagttgcagcgcagaataagcggaatgatttcaagcaactgctcatcttgtttcagcattagtctgagagccgtctgtcaagagaagattagttagaatcaccgtgaatcagggagagagactaaataacagtcaatactaaagaaattgcttgaaaatgacataaacgattagacagggacataaaacctacctgtaagaccaaactgctatactgatcgacttgaagatacttcatgtcctctctgctacaacttaatagcccagataaaaggtacgtgagcatacctggaaacccttgatgagggatttctaaattattgtcatctagctgagacatcttcagattcaaacgtttggccagagcttttgatgattttgcgccataaagctcaggggaatctaaagagactcctttgcaaagacaaagaagccttcgtagtacatgcgaaccatagcagttgcacatcatatcaagaggattatccacaatcacctgaccaggggaaatatttcaccatcaaaattgaggtcaattactagactagaagcaataatctggataccttaatatgattgtcaaagccagtaaaaattgtataaagtaccttgcatatagaatgcaaagcctcctcaataacagaataggcgtctggattttctagatgtgtggccaaggatttgagagcagactctgcgacatgagaaccagatctatccattgcaatggctgggaacacactagcagaatttcgtatgaaactgcagagttggtcaagttcacatccctcaagtagagtttgcaagacatgacttatgatatagtctgtagcaatttcatactccctccctcttgtttcttcaagggcatttccacatattactgaacgttcctctaattcaacttcattactatcaaagagattggcaatctcagagaaatactttgaagtctctggatcaatctctttcctgaaaaagatacacccaaatcactaccacttctcacaacaacaaaatttcgactataaattagagcaaaggcccttggttaaaaatctcctttacctgacaaattgattctgatgttcgaattcggagtgtttctttgatgctggctttacattgggggcaccaccggattggttcttcttgctgctatctacatcaaatccacggttacccttatggtccttcctacgcattcccttattcctttcactgtgattgttactagactttcctcgttcacccatcaagctatcttcctcaatggtcctgtgcctcctagatggcaatgatttagaaccaacagaaaccatgaaaattcctagccccaactatgttaaaccctacaaaatttacacacaaaaaaactcagcttcgaagaactattagtcccaaattacacaatataacaaaaaagggaaaggttcaattttttctccaaatttacagaccccaaaaattagggtttctacctctacttcaaaacgataccataactgggttgaataacctaaaacataacaataaattccgagtcccaattctaagactttacactaatccatgtgaagcttgtacaaaagaacagaaacaataaggtgtatcacaaacctttgaggatgcaaaaacacagttgacgttagaggagaaacgaacaagcgtgagctcagactaagaacgcggcgcagagacaaaacgacgtcgtctccgaaactcttggtatacgttggatcaaaatcttcgatgttttgacgttgtacaaattttctaattcctagggttttattctcgtccaacctaatacgatatcgttttgttgacgtggatataaacaaataatgggctttaaatcacgattttaccgacctttttagggcccaattatgtagcccaaaaaaaacctcatcgttagcaatgtgctgctacatgttgttgtgatttatttaaatttagagatttctaaaaatttataactttcaaattagctgtaggttttataagtatctatttatccccaaattagattacgactgtgattggattattcaattttggtccttttggataattaagtcaacggaagatagacttcagacatctttttttgataaaagacatgtctttttttgggattagtcgtgtgtttaacagataaatcaacaaaattagccgcctaaaaaaaacccctacaaatatcttcatcaattagattttcgaaaagaaaaaacgaaaaagcaatttctgagcgtggaggacaaggcaaaattcggtgtgcaaggcactggatattgggacccttgtttcctcgtgagagaattttcaatcctagggcttaaagagcacgttcctagtataaagctgattcacagatgcggagattcttgattaaccaagctaaaggtctcgtcgaccattctcgtcgtcaacatcaccacaaaagtccaagctttctctctcctcaacctcgtccccttgcttcttctcctcctgctctgtctcgtttcttctcttctacttcggagatgtctgcttctgattccacttcttctcttcccgttactcttgactccatcaatcccaaggtcggtttctaattctctagctggtttattgcgtttttgaattgtgggtttcagggttgatctggatttgtttctaatttagtaaaaaagtttcaattttttactgtggttgtctgatttaacgccaaaggtttatcctttgcttctcgttgtgattcccaacgatgaaatcgacaagctttgcataacttctttgtactttatattacagagaagttggttttattgttaactaagagttttttttcttttccggggaacaggttctgaaatgtgagtatg

SEQ ID NO: 30975 - DNA, 3000 bp, Unknown; identical to SEQ ID NO: 10661
  misc_feature (1)..( 3000): 2750-1469P.txt file - cDNA_ID_3037589; gDNA_ID_2213667; Annot_ID_182143

SEQ ID NO: 30976 - DNA, 3003 bp, Unknown
  misc_feature (1)..( 3003): 2750-1469P.txt file - cDNA_ID_3037593; gDNA_ID_2213667; Annot_ID_182142
actattgttgtataagttctagtaaggtatttagttttatactctttctgcttgattttttttccttttcttataacttctttgtggttctatatatgtatataacaaaaataaacttttgaaatgaaaatgtatgttgtagaatttaattcagaattatcatgaaaccgatgttgaccattgatgttttaataaaaggtaggtggtccatcgacgagattccaagctggcaatagaagatctaagaagtagagcttaaaaagtttttaacattttttgtattttttttttttgtggaacttcatgttgtaaaagttgtcgtggtgaagaaaatatggtggtatgtactattttgtatacaatgtgatcaaacgtctaggtcatttgaatctcatttttgagttatgcacattcttgttaaagtacaaatgcacacaaaaaattagaatattgatattgtatcttccaaataatatatttactattcatatttgacatgatgatcaaatgaaacttcacaaattctcgtatttgattcagttttacataaatatttaatactccacaaatatcaaatgaaactccacaaattctagtatatatatattcctctgtcgtgcaaaaataggatattttggaaacgctgggaagtaggagtagccgagtaggaccaaagagacaaagctagtcacaagttgtcatattttttagttcgtgaagtccaaatcaccactattttcgcagacctgcgacttcgagacttttcttcctttttttaatatatatatatatatatatatatttcctttgacaaaatataatattgttaacttatacaaaataaaataaaatcatgttatccactacatttacttgatatggtaaacaaaattagaagttggatgaaatcagaaataaatgtgtatgtatcaccaagttgataataattagtggcctttacaccgaatctggtccattacttttttttctaatttgacatatagtaggtttctccaacttgtataaacgccgcttattttcaatttaattcgtaattaaacaaatatgttcagtatataattatgataacatttttctatcattcttttctgattctgttttttcttaaactattaaagcattaattatgctgggaattagtgatacacatatatacagaaaaaaaaaatccgtggaagaaaaaataaataaattacgttcttcgttatgaacattttttgtgtgcgaccgaaaagaaaaaacatttttgtagattaagaaaaatataggctaaattgagggcgggaggtctaatatgtccaatctaaagtgggccgttaaggcccattagtgtttctcatgttttatcttcttaaattctttattgctcaatggctgctgattaccggttcgaatcgtacggaatctagttttagttaagaagatgtgctgatctaattactctatgatcaaaatcataaaattggagccaacaaaaatatcataccaaacacatgacgtggccatgtggaattgttggcaaccccaaaacatccaaacattggtttgttgcaaaactaatcagataattaatgagattaggtacagtatttcatatacatttaaggacatttaatgaaaattaatgctacattagaatgttagggttgtttgattggtgaaaattacaattgccagcaattatgttactgtaaaattgccattcacattttcacccaattgatcaataaaacttttcatcgtcattcttttttttttccatttgaaaatctgttttttttttctgtgttggatgtaattttttttctttgaaatatttttattacaaatatttaaccgtaataaaataaaatacagtctactatttttagaacgtttattgcaaagttctaaaattgctaataaagtcttccaagtgaaaaatattttaccgttgaaattatgtttatttattactactagctagagagcctaggcttcgaccaatttttagttacgatattaccctcatcgttataggctttattaggaaagtaaaccggtgttgttaaaaggttttgagggtattatggtaaaacgtagtactgcggctgtatcttttttttctttcctaatcgaagacgacattcgtcggaaaagaagttgtctgaataaggaaactctctctctctctaaacagtctccgcatattttctctctctaaagactctgtcttttttactacggagagagagagagagagagagagtgtgcgtgtgctggtttcgagcgtggatattaagggacagagcaaaatcttctttggtgggagaaataaagaaagattttgcattttgagcaaaaccagtagtgaagtgacaacattaactcctgacattgttagggtttcatcttcttttctctctttctcaacctctcttgccgattgagaacttggattaagtttggaaatactgagaattggaaagttcccagctcaatgctggatcggcaacaggaggatcttggtatgttctttatggattttgcatgattttgagttctgagctttggttttttttttccggattatattaaagttgggatttttatggttgggtctttacttagagtagtggaatcagatctgagaagcatcgtgttccgatgaattagatcctcgatttctatgtctggccatttatatggttcatgacctgtttttgtcttccttttcatttcccgagattctttgtttctcatcaaagttatattccgtgattgtcctacttatttcgtgagaatgactctggtttcattcatcttttgctttcaacattgttagcaagttggcttttttttttgtaatctctgagtaacagtttctattattgttttctcaggtttcttggcattaatttgagtttgttcagttgaattctgttaatctcagtgatacttctgctggttggttagcattagcaatctggtcttgtgagaatg

SEQ ID NO: 30977 - DNA, 3003 bp, Unknown
  misc_feature (1)..( 3003): 2750-1469P.txt file - cDNA_ID_3037597; gDNA_ID_2213667; Annot_ID_182141
catgttcaacactttcttgtaacttagtgaatttcttgctataggtgtgctatacttattcttgtttgtaatcataatcaagtgcgtttgattggaaagtaacgattttgtttcaagactaatctctatggggatgaaattttctcacctttctactttgcatactttttagctagtctctaacatattttcacaatgtacatactgtatatagctctaacgtgggaactcgaagaatgggtaccccctgtagagaagtgtatattcaagttcaattcaaaagaagaccttaagacatggcacctatactctgattctgaatatggaggtacttaaatcacacaagttcaggcatctgcccataatcatgttacagaacctattattgcctgtttacatagtttcttttactttcattccttgttggttcatgttatgaaataatatttctgatatgcagtgcataacaattcttcatgtgatatgctcattatagtgtggatattttactttataggattatcttcggcttcgttggaaattaaagatggaggaaatcgatcagattgcaatggttagtatattgtggaacaagtgtgccttgctttttctttctgttactttttcgcttgggtctgatacaattagtttgtgcaagccagattttcgaattaggctgggaaagttaggccatcgatgcttctttgacttaaatatactgtgatgattttctcatatctagaggcatagaaacgttattgagcatgctctaacgtctaagccaataaattataaaatgatttctcttgaaatttctggaactacagttttcctggtttagctgtttaggctctcttaatcgagcctcaggcgaaagtatgaagtttcttgcttctcataccatttacctctcttcatcatgtttttttctgcaattgggtggtgaccgttttcaccttatgtctcctttaggtgttttctctgggaacctctctacggatatgagggaaggttcaaaatggaatatcaatcggagtggtttctgtggaatgcggtcaaagaaggttaaaatcataggttttgtttttctttactaatcatcacatcatcaatcaaaaccaaagatttgcatgagtttatgcacaacttacttaactaaaaccccctcccatttttgtagtttgatggctttattgatctcgaagggtatgattccatagccctgaggctcaaaggagatggaaggtgctatatttctactgtgagtctcatgctcaacattcatgtctttttgctccagatgaaacacaaggttcaaggagcataacttttttactaaaaactaaaccgcagttccaattcagatatatactgagaactgggtgaactcgccaggacaagcagaagacaactcatggcaggcttttgtttttgctccaaagggaaactggtatacagctaaggcaagtctcgtacttctacaaagcaactagtgttaaaaggggttttgctgtaacttgttaactcaagtgtgacatctttcttcttcaggttcctcttactcgctacttaccaacatggaaaggaaacgtgatagatgcagaaatggagatgaatccaggtcatgttgttggtatgtctctatccgttaacgcacaaggaggtggtttcattggagctaaatcaggcgcaggcgatttccaagtcgaaattgactggatcaaagcagtgaggatgccatgaacgatgatgaaaaaagctttctgatgaacaaattgagaaccataaaaaagattgttgttctctgggtttaattgtaaaaccgggatttgggttaaccggatccaagttgatgaacaaaaacgcttatgaattgacttaaagcaagttgatggacagcaacttgaaaagaaaaatgggccagaatggcaagttgctcaatttatttaccttaaagtgaccataaagtaaaattatctaattcttgaaaaggtaatattacaagttttttgcttttgaaaaaaaagttttcaagataataaccttattaagtttcgttatacaaatcctttatttgaatttcagcaagactaggttataaaattctgctaaagtagaagcacatataaaaatatgtaaattctatggaaattgacataaatagctctaaaattctacaacgttcctacattatatatcaaaaatgtctatgctgacaaaacaagaagaatgcatccagactattacaaaataaatttgatgctctagagtcgttgctcaaatatttattttttgtattcctgccaaactattttttttcttctaaaacatgagtactcgatcggattttgctatactcgactaattttagggtttagtagatttgttacatatacattttgtaacctacatagaaatcaaatgaccaaaattacaaaaaaattcacggttttgatcttaccagtatacggatcattatttttactcagtaaaaaaataattgataaatgatttcttaacctttttctagaaaagtgagtttaatcttccattcatttaagtcttaaaaagctaaaacatttacaaataaaagatgtagccttgttcaaaattggttgcgtatactcacaattcataaactagaaagaaaaaaaacactaaaattaaagtagtaaaataatacactacttttagttttaaaagatgttgtctaaaaaacgaggataaacataaacaactagttcaagtggctagtttctcgatcattctttgttaccccagtctcgtatatataaatagtattatatacaatacaaaagcacgatacccaaaatatcaaactcttcttcttttcccttctcttctcttcttctcttcttccacgtttacgcgtatacacatctctatacatacattaatcttgatccttctttatctctttgcttccaataaactccaaagaacagctctttctttttctcattcttactatcatcattaatg

SEQ ID NO: 30978 - DNA, 3003 bp, Unknown; identical to SEQ ID NO: 26833
  misc_feature (1)..( 3003): 2750-1469P.txt file - cDNA_ID_3037601; gDNA_ID_2213667; Annot_ID_182138

SEQ ID NO: 30979 - DNA, 3003 bp, Unknown
  misc_feature (1)..( 3003): 2750-1469P.txt file - cDNA_ID_3037605; gDNA_ID_2213667; Annot_ID_182133
atgactggttaagtggtccataatccatctcttgtccttattttcctccctttttataccaaccatttatgtatatcttaattacgctgaaagcatgcgtcttagagtcaagtcgccacgaacactctgatatattaatgcttaaaactaattaatctcgattttgccatagatactgttgataactaattcaatcaaaggagatcaacgaaaggaaggcgatagaagaagttaacgtaagaacaaagttccatggggaccaataagatatgcatgtttcctccaatgatgttagttcatttggtaacatgaatcgctattggactttcataactcccttagattatcttaattgatatattttatatgttgtataattgttttagaaccaacattaatggatgcatatactagaatgtatttattctaattatattaatatatcacacctatatatctaattatatatctatctatctataaatattataataataatatatttgattaacatacgttgttttttaaagtattttatacgtatagcttgtgcataaactatgatatgtacctagacggctagacccgttcagcaccgcgtccattcgaatttggactagacaatcgacccaccctatacataataatttgttggttcaaaaaatctcttggattttggtgcttaatttgctcaaaatagtactttggctacactggctagtgcatgtggaaactgatagtagccgttgaaagtcaacctgacccctttgggaaaaggattacaaacttagacccaccaaacctaacctttttaccttagaatacgtgtctttctcaccataattagtttgtttatctctagtaagaattggaactacaaaagtagtttatgtaattaacaaaaacaatgctcgtttgtttaagcaaagcgggggatgggaaaaatgacgtggagaatgtcgattggacctgagttcacgtgattgggagtggtgcggtgggctcaactctccgatgataaagcgaaactgctttttgttgctttccttttgtctcctttttttttcttccagttctctcaccctattttgttcctcatccttatttatgaattttaagataaaaaaatatatatttaagtaattaaaatgtcgattttttttataagttcatttgaattttttaggtttataagtaaaaatcaattggtcatgaatagattgatttaaaacgaaaagaaaagaaactaaaacgtattaacccttgtttaaatacctagttatatacaagcaaatcttcaaacgatattattaaagggatgatgcattagataaaacaaattactagcactctagcagtatcatcaatagtttatggtaataacccaaaccgttcaaccattaaaaaacgatattggtatatagatgtgcacaaacttggtcaacaaaagttcatgtagtcaattataaatcggggattagtataaattttcatacggctttgtattctatcgtggcaccgtggtgtgtaatgtaaagatgattagataagaaatgtgttacacgcccacaacatatgattcaattatttgatggaaaatatagataaaatgtatagagaaaaagtactagaagatgcgaaatccagaaggtaaggggacaatggcatgagttccttcgtgggatttgctttcttaatttcactctttctttctgtctctttccctcttagatttttctgaaattctctagaattttatattagctttagtgctttacataatttacatattatttagttcttttgtcaattagaattacttgtggatcaaactttaatgagcaaatatttctggtcaataaaacgcttcgcagtaagaggtcacaaattaaacccattttttcatatttatattttttgacgtttgatgtgtacggtaagttgaaacttgaaagctatattacaaacttgatttcccatattccttttcatgcatctactattactaacctagctagcaaataaaatgacatgtagcatattggttggtttataatgcatttgttgttactctcgagatttaaactcatatatacatttgttgacaaaaaagtaactttaaatagattttttagattagcgcttctaagttataactatacactgatttctagtgtaatttatgcattctagttctatatacttaatagtaacttttatacagtatttgtgtaagtagttttcaagtgaatttttttctcaacatatacaatgtatattacatataatttacgtgcaccttttaaaaatgaaaaattcgacgaaaatcacacacaacaaaatgtgtggaagcctctatatcttcgtgtcagcatagtaaccattcaaggacgatacaatttttctagggattcaatataatttccctctcctcttatagatagtcgaaaaatggtagaaaaaggaatatttgagactgtttgatgaaacgaagtgccaatatatgaattgtgatcaaagccgtgacgttatctccaatacaaaaactaatattcttattgtactccattaattaattgagctataatacaaattaaatacgtacagaagaatgtttctttgggcctcgatcgtttgcatggggataggtgcgttaatatgagtgctacgttgtgagctgtataaaagaagagtgtgggaataggttttatctgaacagaacttaaccaaaacccaaacaaattgaaagaaaaaaaaaacttttttccttcttccttgatcctttatctttttcgaagaagtgaatctggacgaagaactaaggccgccaattttggaatttgaaccatcaaattcatcaacaacaaaaaataaagatcttaatctttgaatttctacttgtatttaagcttcttgattcaccttaaacccgagttatttcatttctttttccacctctttctttgtcttcttcttcttcttcttccgggtcactaagacatg

SEQ ID NO: 30980 - DNA, 3003 bp, Unknown; identical to SEQ ID NO: 26841
  misc_feature (1)..( 3003): 2750-1469P.txt file - cDNA_ID_3037608; gDNA_ID_2213667; Annot_ID_182132

SEQ ID NO: 30981 - DNA, 3000 bp, Unknown
  misc_feature (1)..( 3000): 2750-1469P.txt file - cDNA_ID_3037617; gDNA_ID_2213668; Annot_ID_132730
tgatcaacagatccagacacaactttaccagcacagctcgaacaagaaccagcacggcaagagtaaggcaaatcgattccagcttcctcagcagcatcaagaacgtagacgtcgtcgtcacactcaacctctagctcaccttctggtgtgatgaacttgaccttgtatgtagccatggctgtgacacgtccaccacgagcggtgcctgatttgagaccgaagagggattgtgtgttggctgatggaagggaacggagactgattggagctggggaacgacggatgaatgaagttccgacgatggcgcttgagagagcagtggaagccatttttttttgttttgtgttttgggagataaagttgagatttttgaggattatggcttgtggaaatggcgtggagaaagattaaaaggtgagaactttttagtgagaatcctatctaccacgtggcgtctattctgtggatcgatggattatcgtctttgtgttttatgatttgtgtgtgtgtgattgtgtttgacacactttaagaacactatcttgttgaggtgagtattacgtggtcttacttgggacagctcacacttattcggaccttgtttgtatcgtctaaataactcttcgtttgttccactaaaatcataaaagatgtggactggttgtaacatcatatctaggccgggtttaacttccaaaccgtatcaacctgaccgaatcaaaccattttaacccaattactgtaaattactccattataattatataacgtaaataattgaaccttacatagaatgtataccaaatcaacaagtgaatacataatctccaccttcacacttcagtcaacttctaatggcctttcagtacatgaataaattgttgggagaagaggtcatacttgcttgaattgggtggaagtagttttctagtgaagaccagcctcttggcataacgtcggaaagtagaaaaatcctcagaaacttaaacacaatcaacaaagtagagtatgagaccatctacatcggttgattctcaaaaaagagtttctcatgaataaaatattgcttattttaattgaatttagataaagtattaaattttaataaaaagaataaaatcaatcatttctggaaaaacacgtggccataaacatttttcagagtttctgaaaacagagacgattctcacttctctcttcttttcaccactttgtattattttaataataaatatctcttttaaatactgttgatggaagtgtcctgataggtttaaaactttttagttatttttaataaaaagtgactaaattttttattttagttaaagaaaagtggttgagatctcttttaaaaacaatctatctatcatatcgaaatgacaaattagataatcgtattatcaaaagctagatctaactaggaattgcaagagcatattttgcagccccatttcaatctactacatgttgcaaatagacaaatagataatcatatagataaaactcatcaaggagattgacttattgttaacgaaaccaaacccatgacataatttagtaatgatgtaagtgtttttgtacatgaaacagtttgccacaagcaacaactggacttatgccactgaaatcaacgaaattagaaaccatattaaaacctaatccatagtgccacgaacacaagaaacctacaacgcagtcgataaacacttgctagaattacgtttcttaaagttgtgcattagccttacttcatctattgggccttaaaatcataaagcccattacgagaatgcaatcgtaaatgtttttttttctttcttactcaacatctatatgatatatccgttatctgttggggtagcttaagcaaagtcacaactcacaaatctatccatcattcaatgtaacaaatctattgcttttttagttaagaagagaatttatttagtttgcatctcctattattttaacaaaactaataattttttgcaaattttaaaattatatctcaactttatacatataatcaaaatgtgatttcacatagccacattcggaaagtataaaccaaccattctacaaacaaccaacaagtcaatgtttaattacgtttttcaggttaattcagaagttgttccaaatcgaatctttccgtaaaaggcaaaaacatatctagacaatccaacaagataactaagtcatattcagattcgttatataacttatatagctttctactgaccgttagttgcaattatagtttatctaatattaaactaactttcttttttgtaactaaatactctcgggtaaaaaaagtcctaacaatctcattttttgataactggatactttaagataaaatccaaactaatctccagctcttataaagatccactagagaattatagtaaacattcttgagtacaagttgttttcgtattctcttgattctttaaaaaaagcatatccaataaacaaatgatgttctcgtagaatcggcaaattgcaaaaagatgaaaaaataagaaatagacgcaattctgtgacaactaaaatatccttttcacatatagcgacgtctcagtcactaaagaaccgatagaattggaatttgtaggtcccacatttattaatatacctcttaaattaaccaaaaataattcaataagtaaactattacttaaataataaaaaaataagagccatcgtgacttcgagagaagaagccagcaaggaacgatggagattattacggcatcatcatcatcatcatcatcattgtaattcgtaatcatatcttcttttggaatttcttcacggataagaaaaaaggatatcgacaatttcgcttttgctttcaaaatctcattctatcactttgtgccttttttagccatcgcgaaaaacctctgaatcgcatcccttgattttctgggtttgtgactttgtgtagtggaaattaggcttgttgtttgatttcgctacgagaaaatg

SEQ ID NO: 30982 - DNA, 3000 bp, Unknown; identical to SEQ ID NO: 30981
  misc_feature (1)..( 3000): 2750-1469P.txt file - cDNA_ID_3037617; gDNA_ID_2213668; Annot_ID_182171

SEQ ID NO: 30983 - DNA, 3000 bp, Unknown; identical to SEQ ID NO: 10683
  misc_feature (1)..( 3000): 2750-1469P.txt file - cDNA_ID_3037642; gDNA_ID_2213668; Annot_ID_132732

SEQ ID NO: 30984 - DNA, 3000 bp, Unknown; identical to SEQ ID NO: 10686
  misc_feature (1)..( 3000): 2750-1469P.txt file - cDNA_ID_3037671; gDNA_ID_2213668; Annot_ID_182189

SEQ ID NO: 30985 - DNA, 3000 bp, Unknown; identical to SEQ ID NO: 10688
  misc_feature (1)..( 3000): 2750-1469P.txt file - cDNA_ID_3037686; gDNA_ID_2213668; Annot_ID_182181

SEQ ID NO: 30986 - DNA, 3000 bp, Unknown; identical to SEQ ID NO: 10690
  misc_feature (1)..( 3000): 2750-1469P.txt file - cDNA_ID_3037708; gDNA_ID_2213668; Annot_ID_182173

SEQ ID NO: 30987 - DNA, 3003 bp, Unknown
  misc_feature (1)..( 3003): 2750-1469P.txt file - cDNA_ID_3037716; gDNA_ID_2213668; Annot_ID_182168
aatatctatcttcataattcacactccacatgaatctattcctagtaaccctaagtgttttaataataggatctagagatgttcgaagatataattgcattttacttttcgtcgtacttatgacgaagcaagccttggacatctccgttttaaaacagggatctcatgatcttgaaaaggattcttcaagaagcacagaaaaagacaaattcgtatgaattattgactcatatcaaagttatttcatataaacaaaatcctatgaattattgacactagtcaaaactcaatgaacagattgattggccgtgaatgctacggtccatgaagggatcgagtgtggaccagtctctgcaatatatgttgttaggttgacttgttttcactagaatcgtatgtttttccaatccatcagtacgtttaacttcaaaccaccgtcaaatgaaagctaatttaaacttcttctttttttgtaatattttgtgtcaacaattgaatttgatccatggtgagagaaacctctaaacgccggagatatttgtgatgttttaacgtggtctttcatcttcaattgctagttacgcctagaaacatatgtgactttaaactatcagataaagacttataaaacacacttttaaaaagtcataaacaaagacatctaataataatcaacccttaattacacaaaaaataataatgtaaaacaatattagaatgatcaatttttaaaatatttagtttttttttttttttggtgatagaaactaaaaatttagactataagccgataaagctgataagcccattaagtataatgagaccctagttttcaaatttggactagacaagcccatttacggttttggtgtaacaccaaaaaatactgttcaatttacaataatacccatatatcacttcatcttcctcgaagaatcttcataatttttaattcatcctccattagaatccctagggttttcttccatacacaatcagactcaacgataagtaccaatcggagaagagatcacaagtggatgatgagttacgaaggcaacggagatggtgtcgctatctccaccgaaaaccacaacgagaactacatatctctagagagctcgccttttcatgaagactccaagtctcgagtatgttacactttcttctttacatatcttgcgttcgattctgtagcttttaggtttctctcgtgaattagactggtaatcataatttgttctccacttgtattgtaatttggtacaattctcggattctgcttgttgaatttatgtttttgatagtttgatttgaaggattcactggatttagagtatatattatcatgttaagttcatatgttctctttagaaatctggggatagtatatgagagaagccttttgacatttgtttcctgcaggaatctcatgatcttaaaaaggattcttcgaaaatcagtgagaaagacaatgaaaatggacgtgataaagacggaaacaaagatcgtgatcgtgagaaggatcgtgatagggagaagagcagagacagagatagggagaaaagcagagatagagatagggatagggagagaagtaaggataggcaacgagaccgtcatcatagagatcgtcatagggaccgtagcagagaacgtagtgagaaaagagatgatttggatgatgatcatcatcgcagaagtcgagaccgtgataggtactcattagtgtgttgcaattgtttttgtagttttagattgttttattcttaaaattgaaggtgtagtcatttctcgacaggaggaggtctcgcgatcgagacagagaggtgagacacaggcgacggtcacgctctcggtcaaggagccgctctgaacgtaggtcaaggtcagaacatagacataagtctgaacatagatcacgctcacggtcgcgatcaaggtcaaagaggtacctgggctctcctgctatttttatcttttctaactagttctttccgtggccacattgcaatgtgttatgatattgatgtcaaatcaaataaaaccattattgtttagtatttgatgtctttgttttgttgacacaatatgattatcatggtcttctactgggttgaacggtccctccttatatgattaccaatattttagtctgatctgggtcattgatgtttatgtgtgtttcatacgtttacttggcattattttttcgaactcgtctctactgatgtctaaccaattatattttgctctttcagcaagaggagaagtggatttgatatggcgcctcctgatatgttagctgctactgctgttgctgcagcaggtatttgcttcatcatctactcagggttattatatttcttaactgcttgttgtttttgattttacgtagtttggaaagatcatagtcaattacacggtgtgactttggtaagctgcaattttattgtttactcgtgaacaaagaggactttgaagtcttgctttcttcataggatgtcttgttatttttgtttgactggtggttctggaactgagaaattttttgtttgtgtttttttggtggtgtttgtttgtttctgtgtcttgtctttttgtagtaagaaggctatgttgggttagttgccccactgtgctgacaatgagccgacctctctagctttaattgtacaaggaggaatcagtgcaacggttgtcatgggtatttttcatcttcgactggcaactatatgcctgttttcgagccttacaatctctgacaactaaaacgaatattacatcacaacttttcattttaatattcataagttgttggtatactttctacttgtgggttttgtaagtagcaaggtgttatctgtagctttgtacttgttggtaggtctgctcctccgggaaacataataatgtatctaacaaacatttttatgacgcatactactttacctagcaggccaggttcctagtgtgccaactactgctactattccagggatg

SEQ ID NO: 30988 - DNA, 3003 bp, Unknown
  misc_feature (1)..( 3003): 2750-1469P.txt file - cDNA_ID_3037739; gDNA_ID_2213669; Annot_ID_182223
tacagttttcaagtttttgtcaacaagtaaattgtaattcacaaagacttgttctttcaacttgaatctgacttgaaactttggaacttgattcgacgaacttaaacaacaagtacgtgttgcaattatttgtctagtcatgaatgatcagataaacaatcctcgtttagaataaacaatttctccaaacatcttatatgcattggactctgcatagataaatatatatctctctgttttgtttaatcttcatgccattgatcttcgatttctcttgacttcaaattcacagatcgagagttaatgtggtgctaagtcccaaacgttagaaaagggttggatcgtgtcaaagggtttcaatcatggggaaggagaatgctgtttctggaaactctataccaatccatggtcgccctgtaactcgtgctcttgcctctgctctgcgtgcttcttctaagctgataacatcttctgaagtggctgctacaacacagaaccagggacgggttcttagagcaaagagtaaaagaacagccttggatgagaagaaagccaatgcacctaagaagcgagctgttcttaaggatatcactaatgttacctgcgagaattcttacacaagttgcttcagtgttgcggttgttaactacacaatgcagcattttagaattgctaagtttatatgacaagaagtatgtttttgctgacaattgttgcttcttctttttacttaggtggagaatatcaagcagataaagaagggacgacagagttcttcttcttccaaggtggcatcttcttcggctacttcacaagttacagatgcaaaggtagaagttgtgtcaaattcagcaggagcaagcttgtctgtttttacagatacaagcttaggcacaaacgaaacatcctatagcattatcgcaaagccaagctccagatcgcctccaagaccctttgggacaggtgaattttataaatggtcatttactgaagcttgagtgggcaatgtataacatttctgatgcatctttattcttgcaaatggtttacagttgagagaagttgtggtggagcaagtagcccgaaattcgttgacattgattcagatgacaaagatcctctactctgtagcctttatgcacctgacatctactacaacctgcgtgttgctgaggtatttatcccttggattttgatatcttacgatgatgcatttgaggcatttgaatccttacgacttgtctacttatcagcttaaacgaagaccatttcctgattttatggagaaaacacaaagagatgtgactgagacaatgcggggaattcttgttgattggcttgtagaggttagttctctacttccagtttgtttgttgcttacttatgaagtctttttgtgtagcttctcacaactcaaaatttcaggtctcagaggaatacacacttgtacctgacactctttacctcacagtgtatctcatagactggtttctccatggaaactatgtggaaagacagagacttcaattgcttggcatcacttgtatgctcattgcttcgtaagttcctcatccacctaaaatcaaataatgctctggtctgaacacaacatctaaaagagttcttgcaggaagtatgaggaaatccatgcgccacgcattgaggagttctgcttcatcacggataacacttatacaagagatcaggtcctggaaatggagagccaagtactcaagcattttagctttcaaatttacacccccacttcaaaaacattcctcaggtaatcttaccagacagtgcaaatgctttatcatgtgttgttgctttttagtctttggtgattcagagtattcattcatttttgcaggagatttcttcgagcagctcaagtttctttcccggtaatgtgcttttcttttatcagatcagatatatctattgctcataaaacatgtagcagaaagattgaaactttgttggtaatttgtctgcagaatcaaagtctggaaatggagtttctggcgaattacctaacggaattgacgttaatggactaccctttcttgaagttccttccttcgatcatcgctgcttcggctgtttttcttgccaagtggacattaaaccaatcaagccacccttgggtctgtaattgaccaactatcttcttcattaagaaacacagcgaatcttgaatctcactcttgtttactttattttatgaacagaatccaactcttgagcattacacaacgtacaaagcctccgatctcaaagcatctgtccacgccttgcaagatttacagcttaacaccaaaggatgttccttaaactctatacgcatgaagtatagacaggacaaggtattaaaaaattattaatcttagtttggttttcttaaaccgaatgaagaaatctggtctgtttcggtttaacagtttttttttttttttttggcaatttacagttcaaatccgtggcggtattcagttctggagagctaccggacaagctattcatctcctaaccgatatgacacacgaatctgtagtaacatttttctgatggtccacattcatctgtctgtcaaataaaacagtgtcttcccacggtctctcatcattaccaagtaaccggattcggtgttagttcggtttagttgtagacaggtttggttctttcaaaccggacttgttcttgtcggtaacacgagttaattgtagtggaatgtacatttttcccccggtttattcaaggcaatatctggtctgcttcgaatattttatctttttattacagttgacagagagacaaagcattaattacacattatccaacggagaaattgtgactcacatagtatgtggcaagaattgctttttcgttttacgaaaaaccaataataaaaaattatcaagttggtcttcttcttcctcgttgctgatgtgtcgctctgcttgagagagtcagagagtcaagagagaaaaggggtcgagaatg

SEQ ID NO: 30989 - DNA, 3003 bp, Unknown
  misc_feature (1)..( 3003): 2750-1469P.txt file - cDNA_ID_3037762; gDNA_ID_2213669; Annot_ID_182242
ctgaaatggcggcggctctgcagacgaatatccggacggtcaaggttccggctacgttcagagctgtaagtaaacagtcattggcaccctttagagtaagatgtgctgttgcttcccctggtaaaaaacgatacaccatcactctccttcccggagacggcatcggtccggaggttgtctccattgccaaaaatgtgcttcagcaagctggatctttggaaggttctctctctctctcttgttccctttcttatttaatttagttgctgtttcatttcaattggggactactgttttctgcttggaattgaaagatgtgagcattagaaattggcgagattttgaatgggatttacaatcgtgggttgggctcaaaggccacggagattgcctaatacattgcgtctgtgctctgtatcaggagtggaatttaacttccgtgagatgcccattggaggagctgctttggatttggtcggagtgcccttgccggaggagactatctcagctgcaaaagaatcagatgcagtgcttcttggagccattggagggtctgtcttctctcttttcccactaatcttgttggctcttaattattgttttgggaaatacagtttctcatttagtcattttctcatgttggtataataataacttaaggtacaaatgggataacaatgaaaaacatctgaggcctgagaaggggttacttcagattcgtgcagctctcaaagtctttgcaaatctgagacctgctacagtcctcccacaggtgaccatcctcagagatttcttggttgcctgaactttgtttcttgtgtgaaactctaattttgttgtttttatacagttagtggatgcttccaccttaaagagagaggtagcagaaggtgttgatctaatggttgtaagggagcttacaggaggtcagttttattacttattaaaaattgatcgtaattcttgtctttctcgtgtgacaatatcttataaaatgtcatgtctcatggtaacaggtatttactttggagagccaaggggcataaagaccaatgaaaatggcgaggaagttgggtttaatactgaggtttatgctgctcacgaggtactctattgaaaatctcagatgcagatttccgtggactgattgttaagtactagggtcaaatctaataaagcattttgtatgttcgtcagattgatagaattgctcgtgttgccttcgagactgctcggaaacggcgtggcaagctgtgttctgttgacaaagctaatgttttggaagtgcggttgataattatgttttctttgacttgttttcctctctcttgtttcctgtggaacgaacataacactgaatttttttatatgcaggcctcaatcttatggaggaaacgagtaacagcattagcctctgaatatcctgatgttgagctgtcacatatgtatgttgacaatgccgcgatgcagcttgttcgtgacccaaaacaggtacgtgtactttgtatttgccaaactagtcagctttgatgtgcgacaggtgtaaatccttgcaattatttgattgtttgataaatgcagtttgacaccatcgtcacaaacaacatttttggtgatatattatccgatgaagcttcaatgatcacaggaagcataggaatgctgccatctgctagtctcagtgattcggtatgatataaaataatatgatcttttagtatgcaagcagtatgatctagtctgaacataaacccgccatgtgtaatacagggacctggactctttgaacctatacatggttctgcacctgatattgctggacaggttctaactctatccttcaaacaaacacggtttttgttccctgatatcaaaactagtttaatgccaaaatcaaagagcacaacttgttgattctttgaattttcaggataaggcaaacccattggcaaccattctaagcgctgcaatgcttctgaaatacggacttggagaagaaaaggcagccaagagaattgaagacgcagtgttggttgctctgaacaacggattcagaactggagacatatactccgcgggaacagtatgtttcttgaaccactcttataacatgtttccttttccttaaaaacgtcccgagttagtgtttgagaaacgtttaaacaagcaggcaacaacaaacagtagtaatatttttttgtctttttgtatggggtatgatcagaaactggtgggctgcaaggagatgggagaggaggttctgaagtcagtggactcccaagttccagcttctgtttaatatttgtagaaactttgaagagttcatttccaacaacaaatgttgtaccttgtactcaaagagtctcggttttattagcgatttttataatgtgagattattagagggacttatttgatcgaactgaaacgttgatgtttttttctgagaaataaatatccttgtggagataatgacgtgtcagagtatcactcaaaaagccaaaaattagagagacaaaaaagattcaatctcccccgtagtccttatccggcgccgagtgtggtcaaacgtcgcaagagttttcgctctttccggtgagatctttttcctctgatttctgtttcatggcaagcctacttttagagctgagtttaatcgatgaatcaaggatgtgaatttttgttatttcttgattattcattattatgttcaagaaatctaaatctctgcttgggaactaattcacaatttagacatctctgatgagtttttcctctgttttttatttctatcttatcaattttgtttctggaaattttcatggctttttgaatgttcattgggattgcgtatcttggtggtggtaagtaaaaagtcaaacgccttcgtttttctgcataatctctgagttccatcaaagctctgttttgtgttttcaaggtggacttttcacttgacatgttaggctttgatccttttttgttcacacagatagacaaatg

SEQ ID NO: 30990 - DNA, 3003 bp, Unknown; identical to SEQ ID NO: 26817
  misc_feature (1)..( 3003): 2750-1469P.txt file - cDNA_ID_3037765; gDNA_ID_2213666; Annot_ID_182106

SEQ ID NO: 30991 - DNA, 3000 bp, Unknown
  misc_feature (1)..( 3000): 2750-1469P.txt file - cDNA_ID_3037765; gDNA_ID_2213669; Annot_ID_182238
atcaaattaaattaggcaacaggatgagaaagaaggaaccttcaagagacccagctaaacaaagaacgtcaacagcgactgggatcacttcgttaccgacgccatcgccgggaagaaccgcgatggtgtaccgtttctttggagtgttggcggcacatctgatcacagaagctctcctaaagctctgtttggttgcggacataaacgcaaccggaatctgggtactgctgacgtggatgactcccgccatttactacaacaaagactacaaggagacctggaaagaacttttgtgtttataatcaaaccaatattaaccgttcgattatttattttcacctctggatggctcaattatgatgggcctaagaaagattcgtagaagatagatcggcccaaatgttccaaatattaacacaagtccagcgggctttgggcccataaatggtattcgggtcagattttaaaatgggtattcgggtcaaaattcgcccgttagatgatgaaccctaatttcgtgtgtacagggagcggagaggggaaacaagagaatgctcttgttgcggcgactcaatcgagttcggattgcttccccttactccgttcggcttctgtcagtaaaacctatttcaaatgtcgatgatgcgaagtttcgatctcaggaagaagaagatcagtccagttacgatcagaaaacagtatgcgaagctctcacatgttacagcaacgattggcaaaaggcgttggagtttttcaactgggtcgagagagaatccggattcagacataccaccgagacattcaatcgggtgatcgatattctgggtaagtatttcgagtttgaaatttcttgggctttgattaaccgcatgatcggaaacacggaatctgtgccgaatcacgtcacgtttcgtatagtctttaagcgttatgtgacggctcatcttgttcaggaggctattgatgcgtatgataaattggatgatttcaatttgagagatgaaacatcattttataatctggtcgatgcgctttgcgagcataaacatgtggttgaagctgaagagctttgttttgggaagaatgtcattggtaatggttttagtgtgagtaatactaagattcataatctgattcttcgtgggtggtcgaaattgggatggtggggtaaatgcaaggagtattggaagaagatggatactgaaggtgttactaaggatcttttttcgtattccatttacatggatatcatgtgcaagagcgggaaaccgtggaaagctgtgaagttgtataaggaaatgaagagtagaaggatgaaactcgatgtggttgcttataacactgtgattcgagccattggagcgtcgcaaggtgttgaattcggtatcagggtatttcgggagatgagggaaagaggttgtgaacctaatgttgcgactcataacacaatcattaagcttctatgtgaagacgggaggatgagagacgcgtatcggatgcttgatgagatgcctaagagaggttgtcaacccgattcgattacttacatgtgtctcttttcccgtttggagaaaccgagtgagatcctaagtctgtttggtaggatgataaggagtggagtgaggccaaagatggatacttatgtgatgctaatgaggaagtttgagagatggggatttcttcagccggtattatatgtgtggaagacaatgaaagagtctggggatactcctgattcagcggcgtataatgctgtgattgatgcgttgattcagaaaggaatgttggatatggctagggaatatgaggaggaaatgatcgaaagagggctatctccaaggagaaggcctgagttggtagaaaagtccttggacgaaacgcttgtctgtagagaatagataactagatatgaagaaactctttggttatgtgttcaaaacagacatgaagcaatagagaagcgtccttttggatggagaaatctccccaaggtatatcatctttgccataaagtggctttgtttcaactcaaaaccgaggagaaaacactgaggttcattgagaaatctggttgagttgtgtgtcttaagccaaattccgaagatttggttttgaaagatggtttgtcgcctcctatatgtgttctactacatatacgtaccatttgtaattcactctctaacttaatttttttttgttgttgttccactctgtgacaaccacaggcattttgtggctattttgtaagatcgttaagctcaataaaacaccctacagaaacgatggatgatccatcatggatcacattcttaaaaccattggagaatatggcgttattattgtaatttgaaaaaaattcaactaaagaatacgacttttaatcttagcttacttttgtaaagattatgcagacatgacgtaacaattttctaaaaaaaatcttagttacaacatttttctttagaaaatgccatgacagagcaaaagcaggaaaagttggtaccagatgatcataaatgcaattttccgttacaaaattagagtagctctcatgtcagtattggtggtaattaatgccattctccgtttctttttctaatctccgagtcgaccctgagtataaagtatttttaccaatttcatttcaattttattgtataatcggttttatagaaaaaaatgtgattcattaatttaagttttaggtcacacagccaataagagttaaaagagtaattaattaaggattttaaaaactaagaaaatgaggtgaaaacttaaaacaaaacagaataacaacaatggatggtgaaaatctaaataaagggaacagtttcgtttcatcttctttgtccttgatttcctgaagaagtaaaagattcttattcatacgtttgattgataaacccttttttagagtttcagaaattagaaaccaaacctcccccaaaaaaacaaaaaaagagagagaattagacaagaaaaatagggagaataatg

SEQ ID NO: 30992 - DNA, 3000 bp, Unknown; identical to SEQ ID NO: 10643
  misc_feature (1)..( 3000): 2750-1469P.txt file - cDNA_ID_3037769; gDNA_ID_2213666; Annot_ID_182109

SEQ ID NO: 30993 - DNA, 3003 bp, Unknown
  misc_feature (1)..( 3003): 2750-1469P.txt file - cDNA_ID_3037769; gDNA_ID_2213669; Annot_ID_182235
tatttggatataagttcatttgccgatttagcttgcttttttattcaaatactgattaacatggaatgcaagaaaaaggaaaaaaaaaccttcttcttgccatggcgagtgagaggactactaaaaagaatacagtaattccaaactgataaatatgagtttttacgtgtggaaaaaaaaaatttgagtattaccttagctctgcaagatatattaagaatacagcaaataaagaagaaatcaaataagcatattagatttgttttcacaaactgaaaaatcctcaaatacataaaaagaaaaacacataaaaatccaaactaataaatatgattaatgattcactgattttcgcctgaactaaattatggtcgtaagttttttgtaaaaaattgttaaaaaaacaaaaactgtcttatcgagacttataacaaatgatgaaaatctgaagaaataatatatatttttcaaataattatgtggtttgacatgtcaacgtctttattatcaatcagaagacagtaaggaacattaacaatgaaaagggaagttataaattaagatgtcaatatcagacaactactcgtcaatccattatgatacgtttcattatgagtcactaggtacatgtgcatgatgtaattatcacttattaaacagattataattttcaactaaaaattcgatttggtttctaaataatatttacaaacaatacaaatcatcaatgacaaaaaaattgtttgctacaacgtcaaactattttaaatgagtagattctcgatagatcctctacaatctacatactttactttgaaataactctccactctccagatcagaacacaaattgtaatagattaatagctcaaaaatagatgagtacttctctttagaaatataaaaatcagactaacacgttgaaaattatatagtactatgttttattttgtaaaccggtcattaaaagttgtggagaagtgaatggtggtcagtgttcactgcatcttcaatattttttatacattctccggccaaaaaacagtgcacgttggtcccatctggctggtctgttaaaaagtctaacgggataattaaattcttacgggagatattactaaatcattcaacgatgctatcaaatcactttcaataaaaaaaacaaagtcaaatataaaatatgttttcaattaatagagccacataccgattttttttttccaaagaaggcattgatttttctaataattgtatttattttaaatattggaatctacaaaacattattttaggtcagttggtcaatgcaattggttagaaaatctgtaaccaatgaaaggaaaatagtgtcaaattatactagtgagtatgttcataagttactaaagtccactaagtattaataaagcgcactatgtgaaactactacaattattattggctatttttgtttgtactacttgttttgtttaatcatggttagttttttaaattttaaaaccaaactttaagttgattaataaataaataaaaacgtagatgagaagggtgttggctaatggctattggttactttccacttatgtatgtcctctcttcttctcttaaaaagcttaattgctttgctattttgatactagtacagtctattcttcaatttatcagcttcttctcttctctcatatcgcggtaattaaaggcgatatactgattgctttctggggagaagttgtcggttgtcttttgccattataattataatgtgaatttttgtaagccataattatttgcactatttatttatttagcccaaataagcacgtatgtatatatagatagactaatttccacgtatccaagacattgccgctaactattttttgttgggaaaatttgatttttgttatatgacgacgacagcgacaccatcaaatttgtttatttatttcggttctcttgttatcccaacgccgcttggattgatatttgtctactatcaaacttcattatacttttgagcgaattaaccaaaagatttgtaatgacacctttttatttcaaaacgtacggataatattttgtcatagaccaaactatttttttcataaaaattagtctatgtactacatatcaaacttgttggtaattcgttggggttggtttctagtcgtcttcccatctcgttgggactaaaacaacattcttttagccactttcactattatataatggaacgaaatgacaagcccgttaaagacccaatagcccaatattgaatcaaaccgcagatcccctttcttcctccaaaattcaggtcacaaacccaaacttctcacccgtatctaaaaagttctcgtggtgtatagtcctaaactagtacacgacagaatcaaacctgtttgaagtatttagcacggatccaaacacgagagacatcccaaggaatctgattctccaatgtttgtctagacataagatgcgttgatggtaaagaagaaacgatacgcacatcagattcacagggttttacttctttttttggtaagattggatttttctctcacccccatttcttattccatgcttcttagatcgttaattgaatctgcatcccgcagtgatcattctttaatttacgaatttgtttttgttgtcttgttgtcgatttttgtcaattttattgtgtaatttaccaagtgtaaattgtgattgaatcgattgggagggcattgcgaggtaaatccatattgtgattttttgtttagtgtctaactagctgtatcgtactccgcataaatcacaggatttttttggtgagaatttggtaacaagaggaaattgttccattgatgacgaagctcctagtgttccattgagaatttttggtttccgattggattattaaagaatagaagaaaaatgttgaaatctggggtttgattttggtatttcaggagacacaagatctaggatttcctttatttagagacgagggattctatg

SEQ ID NO: 30994 - DNA, 3000 bp, Unknown; identical to SEQ ID NO: 10701
  misc_feature (1)..( 3000): 2750-1469P.txt file - cDNA_ID_3037775; gDNA_ID_2213669; Annot_ID_182227

SEQ ID NO: 30995 - DNA, 3003 bp, Unknown
  misc_feature (1)..( 3003): 2750-1469P.txt file - cDNA_ID_3037779; gDNA_ID_2213669; Annot_ID_132758
ctacctataatgacacgttttcctgtaactggcggtttttatatctccacgaaagcaagtgaacagtttggtgattagcttctacttcgtgtggtgtgggctcatttatagttatagccacttagcatcttctaaactgtcattagtggatgtaattgcatgtgtacggatatcttttcagttttaatttctattagcctggtatcaaaagaagaagaagaagaagaaatcactgtcaactaaaaaagaagaaagaagaagaagaaatcagccctgatctttaagctcccacgtcacgactgatgggttcgattaaggagaaaaatatataatttgattatattatccactagcattcacaaaacgagaaaaatatatattctaaataccattatttactttctaaatagagttgaaaatatcattttaatcgcattcatgttacctttgcttataatcgttggaaaatataataaactttattcccatatatatttgtttgtgtttgtcaacttcagtccaataatttaacattagaccaaaaaaaaaaaacttcagtccaatatattcttcgggagagatcttcaatagtgttccttttgtctacactttgttgtcgctttactcctttaaattatcattccaactaactttttcttggtaaaaaagtttcaccattatatatgtacatcaactttcactgtcgtcggtcgaaaacaaatcatggtctaacaatatattcctaattatctatcatcgtacactacacactaattaggtacaatacttcttcattagtttaatctttcaccgaatatcagaagaaatcccaactaatatgcgtgtggatcttgtaaacaatgaaaagaatgttcccaccaaaaaaacaatgtgaacagaactaaatgttgaaacttctacttcaaaattgaaataaaatctaaaataaaatatataatgaacatcaatcattgtataaaagcgattaaaagtttcatgatttgggataaaaaaagttagagatagataactatcccttttttagtgaacaagtataaagtttttactgaaaagtttttcagtgtccggtattaatttcatattagtcatattatttacatgcaatatgaaatgagatgtcaaaaaagtttagacaaaggaaaagagcagaacattaattacagcagcgtagggtcacatgcgtaagtcacgtgactctgtttttcgttggggaacatagaatcataaatgattttttcgatggttcacgacactattcttagaccaataagggcaataagagttaaaccaggggctaataggtcctactggcgacacatagacgaatttaccggtttcgattacaaacccgtgaccggtaattccggtcagccattgttttctaagtttgttttctttcgttataatgcgcatggaatgaaacagtcgtataattcatttaactcgactcgtaacaaaatatgtgagataataataagaagtacataaatttggtagctagtatttaatgttaattgatactttttgtctcaaataatcgaaactgcttttaggctctagaaaactgatattgatgtcttggacatttacttgggtataataaattgcgataacataatagagcggtccgagacttagagaattacgaaaccagtaaattctatacagattgtttatccaattaagcccaaaccaatccaggtttcctacagtgggtcaagaatacatcatggcagatttgatacatcataatgccattatggtatcaagcccaaaataagcccagttattttttctttcttttgttgtcattccataaaaatctacataacggaatccagaatttgattaagatcttattccgttatgttccagataattagagtgtcatatctctataatgaacttcatattaaatttctttgtcttaacatgcattagaaaaaagggtttaaaactctattaagaactaaatatatcaataacatttacagtataattttaaaatttagaatgacaaaagaaacattatagaattttaagaaatgatttgggaatagacaaatcaataaacctcagactattatgagatttgtttttgtctggaaggaaattgcttaatcaggtaataaactcaacaaagcaccttctaaacaaggagtcatccacgaccgtccgatcagattagtacatagaaacccttaagatccaacggttaaagatttaagacagaaggacgaaatctgtaatcatgagtttagtaaaaaactaataaatcaatcagtcttctccctatttactgcaactctgcgaaagctgcaaaaataaaatcagccgattcctatttttttatttgtcttcctgtgaagaatgaaaaagaagaagagtacaacaagtactaagaagacgaagaaggtttcaacaatagcttattcgcagcttttccaattctggtaaaaaggcttcattaccattttatcgtctactcttcttcttcttcctgttttcgatcttctgtctttttcggtaatttccgaatttgtgtttcaagaccgtatcatcttatgctacgattgaatttgttggaattccagttttgggttcttcaccaagctcagaatttcaaactgtcagaattgtttgaaagagtcaaacttgaactgggattttttttgacttagggttcgtcagatgttggatttgttaatccttgcagagtcgtttaaggggtttacaaaatgctttatttataatcctaaaagctatctactttctgatttttttcccccagttcttggtttgaattctaaagctgtttcctgtgctataacaggtgagtgtttcgcactacattgctcttgctctactggagattgcggttgtgtgttacgagagctagagttgaatttgctttggtcaacacaatggggacttgtggttgctgacttttgtgattttcagttttctacttggatttagatg

SEQ ID NO: 30996 - DNA, 3003 bp, Unknown
  misc_feature (1)..( 3003): 2750-1469P.txt file - cDNA_ID_3037779; gDNA_ID_2213669; Annot_ID_182226
ttattgataatagatgtttccgccatgtaatcaataacaataagatatatacagagtgctagagaaaaatgttacaagaaagaaatccgcttttatattacgatctctaggataatttaatgtcaatctcaagtattcaattccatttttagttcttcgtttattgatattcctgcatgtaatcaataacagtaaggtctacgagtgctagagaaaaatgttacaagacctagcattcttacaaaaaaaaaaatccgcttttatattacgatctctaggatcatttaatgcacaaattcgaatgcataaaaatgaaacgtgtaatttttttaaaaaaaacatattaaaactttgagcatcccgtcttgtcgagtgtcgatgtcgtcatgcccggatcgtggtggtcggcactgatgcttaaaagtggtttgtaattattgaattaaaaaaaaaaaaagtaaaatcatttaaacaatagtagtacattacatacaaaatccacggccaaaaaaggtttgaaattacatatatagcatattgcaattcaaaaatgcaattgtatacatctctacagtatttaatgcatttgtgatcataatcttatatagcctttcgaagatccgatgcgtttacgttgtgggaagcagaatagagacctataatccaatagcatctccggttttcattaacctcatacgtttgcaagattccacaaacatcctacacaaattaaatatcatcaatcccaagaaaatttagtttccttcacagcagaataatacagtaattctagttttgatatgaatgtaagtaacaaaatagtacagaaattctagttttgaataaaaaaggaaaagtacgtaaaagcaacacaaagggtaattccgagaactcacatccacggcacatctccgactaacatcaagtcaccgtccttatcctcgtaagtagcaacaaactctcccttcctctccaactctgtcactctacctaccaccatccaaaaccccaagtgtaagtaaatttaccataatatccttcacttcgtcagtccatccaaacacatcaaaatctttattttttcctacttatctcgatcacttacatattgttattatcccctgaaacatgttttctagagcggtgaaaagctgtccatagcaatcgtacatcccaagatcaacctttctgagataggccgcaccatccaacgccactttcacgtatttccgcctcactgttttcctcgctgtcgctaccggcggccagcccaccaactggtcactaaaaccacaataaattaagaagatcaatcaaacatgcatatgacctatatgaacgataaatgaaattaatataatatatatatgccgtacttagtgaccatgcttgagatataattgttctcgtgtgcttccccgagttttaaatcaacggtctcgaggaatctacgtttgttcccgaacttttttggaccttccgatgcatttgtcggagtgccaggcaaagctagggtcagctcagttcctccaagatcaccggaatccggccaaaccctaacgtattcctccggtgacattaatatcttaatctatttatgaaagttagttaacaacaaaagtgcggaaagtgatgagacaatgtggcactaacttttggcttgagtgtgtgagactctcgaggtttccaactttgtatttatagtcgatctatacttgtcagctaaaaaactagtgaaccctacctataatgacacgttttcctgtaactggcggtttttatatctccacgaaagcaagtgaacagtttggtgattagcttctacttcgtgtggtgtgggctcatttatagttatagccacttagcatcttctaaactgtcattagtggatgtaattgcatgtgtacggatatcttttcagttttaatttctattagcctggtatcaaaagaagaagaagaagaagaaatcactgtcaactaaaaaagaagaaagaagaagaagaaatcagccctgatctttaagctcccacgtcacgactgatgggttcgattaaggagaaaaatatataatttgattatattatccactagcattcacaaaacgagaaaaatatatattctaaataccattatttactttctaaatagagttgaaaatatcattttaatcgcattcatgttacctttgcttataatcgttggaaaatataataaactttattcccatatatatttgtttgtgtttgtcaacttcagtccaataatttaacattagaccaaaaaaaaaaaacttcagtccaatatattcttcgggagagatcttcaatagtgttccttttgtctacactttgttgtcgctttactcctttaaattatcattccaactaactttttcttggtaaaaaagtttcaccattatatatgtacatcaactttcactgtcgtcggtcgaaaacaaatcatggtctaacaatatattcctaattatctatcatcgtacactacacactaattaggtacaatacttcttcattagtttaatctttcaccgaatatcagaagaaatcccaactaatatgcgtgtggatcttgtaaacaatgaaaagaatgttcccaccaaaaaaacaatgtgaacagaactaaatgttgaaacttctacttcaaaattgaaataaaatctaaaataaaatatataatgaacatcaatcattgtataaaagcgattaaaagtttcatgatttgggataaaaaaagttagagatagataactatcccttttttagtgaacaagtataaagtttttactgaaaagtttttcagtgtccggtattaatttcatattagtcatattatttacatgcaatatgaaatgagatgtcaaaaaagtttagacaaaggaaaagagcagaacattaattacagcagcgtagggtcacatgcgtaagtcacgtgactctgtttttcgttggggaacatagaatcataaatgattttttcgatg

SEQ ID NO: 30997 - DNA, 3003 bp, Unknown
  misc_feature (1)..( 3003): 2750-1469P.txt file - cDNA_ID_3037797; gDNA_ID_2213669; Annot_ID_132745
gctccatctgtcagaattcttacctttccaaaagaatagtacacttccttcaagagttctcagctggttgctaaaggcagagccaatggatactcgacttcccgttgtaattatgcaggaatgcttcacaatttacataaggaggcaggtagggtgatgtaatcttcaacattgctgcttgtgcctatggcatgcatactcttgttaccttctgaaagttgtgtatgttttaggtggactacattggcaaagtgattttgtcaaaactaatgaatgactggaaattgatgcacgaacttgctgtattgcgcgccatttacttgctaggttcaggtgcgttttatgtgctcaactgttttggcaatatggttgtatctgaaatcttaataaccccttaaaactttcaggggacctgctgcagcattttctgactgtcattttcgataggctgggcaagggagagtcatcaaatgatgattttgagttgaacataatacttcaggtaaccaggtttggtgtatttttaagagacactgctctcatctttatagttgttatcacttctaaaatgattccgcttgttaattgtttgcttatgtatccgtgttctgttgccgtatatgtgttcatacaccaaacttatttctaaagtgtaatggtcttctacaggaatcaattagaaattcagctgatgccatgctgttaagcagtcctgattcattggtggtatctatttccagagaagacagagacaaagatgataagggtgacataatacccctttcttcaactcgtaaaagccgcgttaacagctttggaatagattgtctcgagtctctcaaattcacatacaaggtctagagaaacaacttagtcttccatccaatccgtactggtatatctcataggccacatctatgtgtatttgaagagctgaactgttttcttttttaaggtgccatggccacttgagcttattgccaatagtgaggccattaagaagtataaccaggtaaccctttctcatccagctatttttgtggtaaacagtttgttgttcctctatgtggtaattatttaattgaaaacaggtgatgggatttttgttgaaggtcaagcgagcaaaatatgtgcttgataaagcacgaaggtggatgtggaaggtctttgatatctctcaaactcatttctttcttcttagactgtatcccgtgacttccaaatccagtttgaaagagcctaatcagtcttttgatctatacatataaatataaagggaatcataagaatgtggttcagtttgataaacttgatgactttggtgtttgtgtatgatagggtaaaggctctgcaacaaaaatccgcaagcaccactggttactagaacaaaagctcctcaactttgtggatgcttttcatcaatacgtaatggacagggtattgtccaatgctaaatgattggttataattacagtatcatttttcgttggagtaatataagtttgtgctagagttgtggcaaaatcgaaagctgatcacatggcttgagtaagatgaaaagcttgccatgcttaactgtattttgtaagcaggtatatcacactgcgtggcgtgaactgtgtgaagcgatggtaaaagcagggtctctggatgaggtcatatatgtacatgaaacctacttgttatcgattcagcggcaatgctttgtggttcaagaaaagctggtaatggaccatgaaggcattaagcgacctcttaaaatgcatagtatatatttgaagttgtaggcttctaaaaacctagtgtttggtggtttttgtatagtgggcaatcatcgcaagtcggatcaacatgattctcggtttagctctagaattctactcaatacaacagacactgagcagcggtggagcagtttcagccatcaaggctagatgcgaaatggaaatagaccgtatagagaaacaatttgaggactgtattgctttccttctcagagtaagtaaatcgaaaactgtgtacttgttgtattgtgaagctatatataattgattaatgcttaatgggggatggaacttgcaggtattatcttcgaagctgaatgtgggacacttccctcatttggctgatttggtgaccagaatcaattacaattatcactacatgtcagatactggaagcttgatgactacttctggagcagagaccaactcatccagaccttggactgccaaatctgatgtatgaatggaccgggaaattatcgcaatgttggattgtcgcaacactatcacacgtaattgttcaagcctcatgcttttcttgtgtctggtatctaatttcctgattatgtattttctgtttataaaagttcactgttttgaattagacattgtacaaaactgctatcaaggtttaaaaaaaaaaaaacattgttaacattcttaacaagaaatcatcaaagtttaaaatctaatcgtgaccctactatgcatagtacatatattaagcattaaccaatacgacaaaagaaaaaaaaaagcattaaccaaaaacaaaaagacgataattaaggttataggttatgagtttattacgaaaagcccatttatggatgcaattaagcaaaccttgttggaggacaaaatggtcaaaagaaagaaaacgtaaaaccctaaaacatttctttaacactcgacttgtctcataaaccctttgtgtttgtagtctctctactctctagatcccatcccatttcttgatcagcctcgcgcattgtgtgcttacacgtaatcctctagcttctttcctcggtattccttgtctaattcgaacttctctctttttttttctgggtccgatcgtttcagtgaaaggcgtaacctttccttcgaatctgatagcattgcaaaatgataatgttagtctgatttttgttgggtgtgtgtcttttgattgaaagagcaggtaatttccagagagattttcaacagaggaagcatg

SEQ ID NO: 30998 - DNA, 2070 bp, Unknown; identical to SEQ ID NO: 10715
  misc_feature (1)..( 2070): 2750-1469P.txt file - cDNA_ID_3037797; gDNA_ID_2213669; Annot_ID_182211

SEQ ID NO: 30999 - DNA, 3003 bp, Unknown
  misc_feature (1)..( 3003): 2750-1469P.txt file - cDNA_ID_3037840; gDNA_ID_2213671; Annot_ID_132799
tcattgcaagaaagttaatatatagttcatatatacacatatgttacgattgatatatgcatttgatatatatatatatatataaacaacctctacggacttgctgatgtaattatctccgagaagaattctctcgccgaaaagagtaacagcctctttaacagaacggaaaggagctccggtttcgatctcggcccgaaccatgatcaagagatgtttgttgctttagttatatgagttggtccatgtcatgacgaaccctcagctttttataaagaaagaacacatatgtttcatgaaagattgcaactgttggttgttgtcacttaaacggatggtgactagattactgactaagatgaaactaaccacgttatgatgattaaatcaatttcaacatatacattgcttagatttttttgctattttttaaacaaacttcattttcatataaataaaacatttataaattggtcttacaaaactaatagtataaatcataatcaagaagatctagttccatagttgatacattactatgtgatggttccaccatattatataatcatttattttaaaatgtaacacattgccgacggaaaattccactaaatgacaaaaatgatgagaagttgttaagtttttcgtggtgcttgttttttagtattgcaaaattagaatttaggaacaagatatagttgaaaatgtcttggcgtttacttcacactaaagaacaagtttgggtaaatatagaacaagtagaaaggttcgttggaacgtccttttgttttctcatgtgttctgttagttttaccaccaaattttattagacaacgacctctctcctatttaaatgggcctttttaggcctgaaaaacacagatcactatctcgtgaccaatattacaaagcaaagcccaataaagattcttattcttcttgagtagcaaacctaaaatgctttcctctcggagttggaatccctttcaaatgcaacacttctttagcctctacgatctcatcgtcttcactgttgtaaagaaatctgttatgtttccctgcaaattcagcttgattcgtctctacattcatcttcttcattccttcacacaacccatcaacctcctcttcttcttcttcttcttcttcttcttcctcataaagctgacttgtcggtgaagtcaaacagtaaagaacgagttatgctcatactcttgtcttctttctcttcagatatctgagaggttctcaagtttccagcaacaatcggagatgcgatcttaatcttgacatcatcatctgaaaagtttggaaattggggagtatttgctggagttggagcgagaagtctcattggagaagtgaccagatggataaaaggacgagtctttattgaatggataagctctgttccttcttcaaccttgtgtaaaagggttttgacttgtcctctcaaaagggcttcaccagatccaggcgtgatcttgattctgctgctttttctcttaaccatgaaccctgaaggaggtgtctgcatcgttagacccacgatcggtgagtcgttggttatgtcgattagtgcagacctgtcttcttcttttctttggtcgatgctcgaatcctctgttttgtctgagccaaaaagcaaagaaaaggattaggttcagaaagatcgagtctatctatgttacttataaataactaattactctgcagatgctttaaggctaaagaaactacaagaacctaaaaaagaagatgggaaagacaaacatacttgatgatgaaaagggaactttgaagtcagaatcagagtcgttgattgcagagatagcctgtgatctagtgacccttttggctgatgatggagtctccatttgaatttcgagttcttgtaaacaacaacgaaaactgaactgaaagagaatttgggaaaaaacaaagtgtgaatgaagctcgtttaggtcgcagtcttataacgttttataactaaactagccgttgtggctcctctcttgcaaagtggaagatgagccgttgccgttaccgttccgttagtaaacccacgaattatttttcttccaaaactagccgttggatccgttctctcatggaaaaagtagacgtctttgttctgtatgggcctttgactaactaaatggcccagcccgttcataacattaatcatttaaaaaatcacattgatggtataacactaattttttttttcacaggtgtataaccaactaatataaatatgcacattcacttaaaattaactaatatcataaagagtattatggcgtctgttttattgtttatccataactacatcaatcaaatccaagttgatatactagttagaacctaatactttacaaatccgatcattaatttatcttgtctgcttaagattttttttttgtgaataaggtttaattatctcatcaatacgatttagtaaaaagtctgtgcaaaaattaatgacgattgggatttttgtaacgcaagcccgtaccagaacatgtctccgccacgtgatttctccacagaccacaagcatttttaagacgtggctttctatcaaccgttaaaaacgtaaatcatattaaccatgtgtctactacctacggtgtaaacgaaactgtataacgtccctatcatataatagtaatgtgatacgttggaatgtagccaaaaagcataaaaaataaatagataattaagtttataatgttttcctacaaaatattattataccgtatgtattttttattttattttctgaagttaaaaacagatgtagttagttgagtaaattgtgttctagaaagagaagagagagcagtagtaccgtggtaggtagctagcgacctcttcgttcgtcagtcatcacaagctttgaaagattttcagctaccactctctcctttatatattcattacacatctcttctttctatatctctcttaatttagtcttttgtcttcgtaattacaatg

SEQ ID NO: 31000 - DNA, 3003 bp, Unknown; identical to SEQ ID NO: 30999
  misc_feature (1)..( 3003): 2750-1469P.txt file - cDNA_ID_3037840; gDNA_ID_2213671; Annot_ID_182312

SEQ ID NO: 31001 - DNA, 3000 bp, Unknown; identical to SEQ ID NO: 10753
  misc_feature (1)..( 3000): 2750-1469P.txt file - cDNA_ID_3037848; gDNA_ID_2684236; Annot_ID_192400

SEQ ID NO: 31002 - DNA, 3000 bp, Unknown; identical to SEQ ID NO: 10753
  misc_feature (1)..( 3000): 2750-1469P.txt file - cDNA_ID_3037848; gDNA_ID_2213671; Annot_ID_182321

SEQ ID NO: 31003 - DNA, 3000 bp, Unknown; identical to SEQ ID NO: 10754
  misc_feature (1)..( 3000): 2750-1469P.txt file - cDNA_ID_3037856; gDNA_ID_2213671; Annot_ID_182319

SEQ ID NO: 31004 - DNA, 3003 bp, Unknown; identical to SEQ ID NO: 26853
  misc_feature (1)..( 3003): 2750-1469P.txt file - cDNA_ID_3037860; gDNA_ID_2213671; Annot_ID_182317

SEQ ID NO: 31005 - DNA, 3003 bp, Unknown; identical to SEQ ID NO: 26854
  misc_feature (1)..( 3003): 2750-1469P.txt file - cDNA_ID_3037864; gDNA_ID_2213671; Annot_ID_182315

SEQ ID NO: 31006 - DNA, 3003 bp, Unknown
  misc_feature (1)..( 3003): 2750-1469P.txt file - cDNA_ID_3037872; gDNA_ID_2213671; Annot_ID_182306
aaacatctccgaagatccggcttggtaatacttgacggtacggccactgtcgatggtgtgagatctgacggcttcaaggagacggagagcaccggttgcgactacatcggctgtgtaatcagggatctcgaaggagacagcgacgtgagattgagcagctaggttataaacttcgtcaggtttgatcacatcgatccaacgacggagagaggaagcgtcggtgagatcggcgtagtggagtttcatcagagctttgttgacattgtgtggatcgatgtagatatggttgattcgctgggtgttgaaattcgatgatcgacggatcagaccatgaacttcgtagccttttccgagaaggaactccgtcaggtatgatccgtcctggccggtgattccggtgatcagagctatcttcctcggttcaacgacggtggaatcagctttgggagcggtgatggattcggaatcggatctggatccgttgttctctgacgccattgttgggttttcggatctgggatttcagagacaaatgctaacgtcagctctgtgttgaaaatccgtgttgaattgggctgttagagttttagctgatttaaatagggtcagagaggttgaagacggaggggtattttagtcaatttcaggataagggtagtttggtaatctttgttggtctttaagttttttttaattgactattgattggatattttccttgtttatgtataacacgttaatgatttacttattttgtggtcaaactcatcaatggtgtactatagaattttcttagatcatttgcaaactttccacaaaaacaaacatattaagattttcaaatcattttatgaactgtccaaacaaaaatagtgaaaagtatttgaaagtttataagacaataattgcaaaaacaattagagtgaaaagtagtcaaacaaagcatttaatatacatttagtgtagtcaaaaattaattaaaaagttacaaatttgatacattaaaaatattagtaattttttgtagaagcaattactattttgtactcaactgaaaaaattgagagaattggattgaaaaaaaagacagaaatgaaactcaccatttactaaaaaaatgaagcaaatgataagagtataacttggctcaatgccgaaacatactaacatatatatttagtctcttgagttgtgttcgagtggtggacaatatgtaatctccacgatttgttttaggaatcttatgcttcaaatcacctttgttgttttccttttacaaatcttcaatcattttcatttatttttcttctttctgtcacaaataattgattggtttgtcaagatatgcttttatatattatttatctttgcctgttattctttcgacaaccaagcaaagtgatcatttgaccacaacaaaaaagcgttgagacttgagacaagtgaaaattataaaccatgcgttggaccatcttatgcatccggaacttaggtataccaacttagtcttaccaagaattatattcgatcagacactaattaaagaagttaattatttcatatgttcgacaagcatcaaaatgtggcccgtattactatccatcgaacgaatattctagcattagtggatttctccaagctaaactacaatctcaatctagaggatgcaacacggaaaccaaaactgaattgctcaacaaccatgattttcaacgttaattatggtgtttggtcacttgactcactttggctacaacttgtgttgaggttgataaacctttgttgtcatctcttataatattggactaatgaacttgaagacagaaagaaaactttagaccaccgtgataaagaggaaaaaacattcctagggtttttttatctatacaaaaaacccgatcaagtggctgatctttttactaaagcattgggtagttccagttttagagtatcttttctccaagttgggtgttttaaatttacacacaccaacttgaggggagtgttatcgagatagatgtgaatatgtcgagctagatagatatgaattttgtttagatgtgtttagtatctctaaagataaggtttagagaatattgatgtacacacataggtatatacatgtatataagggaaacgtatcccaagtaaataacacaactcaattaaaccaaagtctcttcttaagtttacaaaacttgacgaattgtggtgtaaaggcaaagaagattataaaggtcgttcgaagagatgggaatgtgatagttcttcaacttgttcaagtactaggaagagtctattcgggcaatggtgcaataggcaattgagaaaacaattgagggtgtgaaacaaagggttgcaatttggttatacatgctcaagcctcacggtgagcgcaatttgtttttggcaattatcttatttgttggctattctctgaaggaaagaacattaaaaaattgggcttacaaaggtttgaattcaacttagattgcaaagacttagtgatgggccttatggatgagattacttgggcgtccttgagaattgtggcccacgaagttcaagagatactgataggatacattcgacgtattccccatttcgttttacattttaagatgatgatgtgtgaaactagttaagaagggttcttcttagtcctaaaagagttattaaagtttttttaaaactctataaagtttcgggcttcttaataataaacacagaaatgataatggcacttaaaaaaaaaaatcataattctcttaagattttctgaccaattgtccaataatcattgtccaataatggtattatttgcttatttttttactacataatctaaagttaatcaatatcctttaatccaataataatgacaacaaaactgtgtcacttttctagtggggtataaaatatataataatatggctcttctcctaaagtactgcaaagagaagaagatctcgttgacgccccaaaaaataaccagaggtaatg

SEQ ID NO: 31007 - DNA, 3003 bp, Unknown; identical to SEQ ID NO: 26857
  misc_feature (1)..( 3003): 2750-1469P.txt file - cDNA_ID_3037880; gDNA_ID_2213671; Annot_ID_182304

SEQ ID NO: 31008 - DNA, 3003 bp, Unknown
  misc_feature (1)..( 3003): 2750-1469P.txt file - cDNA_ID_3037884; gDNA_ID_2213671; Annot_ID_182303
atttttttggctttggtgtgtagtttactgttgtaacaactgtcttttgcttttacttcaggggtccatcaactctggcaacgtttgtggctgtttatgcactttttggaccaacctttcctgggatttatgataaagaaagagggatttattctctgttctacccggtgagcaagaaatagacagatggtcacattgttttaccattaatgtttgaatttgttctatcaatgtttaatctttttaactattgcaggggctatccttcgagtttccaattccaaaccagtacacggactgctgccatgatggagaaggtttgttcttctccggactccagtgaaattttgtttatattttttgtcttgtccgatatctaacttctcagatttttttttctcctttacaaagcggcactaccgttagagtttccagatggcaccacaccagtaacatgccgggtctctatatatgacaactcaagtgacaaaaaagttggtgtcggaaaattgatggatagagcttctgttcctcctctacctcctggcagtctgtatatggaagaagttcatgtcaaggtttggcttatcttcatttacactcgttcctctttgtgtattttaatatctcgtagcctaacttaattagcagttaaccggttccttactcttcgcatgacttaatttaatatttatgcagcctggcaaggaactatactttactgttggaggccagcatatgccttttggtgcatcaccacaggtaaagtctgtaccttgtcttattttgcttcttctttgatctttggaactaatcatttcgtgcttcgagcaggatgtatggactgaattaggtcgaccttgtgggatccacccaaagcaggtgatctataccgtatctctaaacttgtttgtatatcacgatcagatgcttccattagcttctcttactatgttacctgcgttatctgttacagttcaatactcaactggacatttgtatttctgcttctgaattgtcctttgctttccaggtagatcaaatggttattcattctgcgtcagatcctcgaccaaaaacaactatctgtggtgattacttttacaactattttactcgtggtttggacatcctgtttgatggcgaggtaggaaactcatcaactagagttatatgttccattcgtacgttttctttattcacaactctaccttttctgcagactcacaaagttaaaaagtttgttcttcacaccaactatccgggtcatgctgatttcaactcatacataaagtgcaactttgtgatttcgggtacgtaatacttatgaagcagctcatgtcagtcaatatattcaatactcgatatatgttgtctatttttccaacaaacctacgctttcatgtcacttttcagctggagcggatgcggcagaagcaaacagaagtggaaacaagatcactccaagcactaactgggatcaggtcaaggtaaatcttcagaccaatgtgataaaagcagaacagaaaattgaatgaaaaactagtctatgttagggcttgaccaattgttcgtgagagtttttactgacgtaaaatctctttaccatcccatcattgatggctctaattgcgtaatgggaagaaacttgggatgaagcattaggaaattgatctgaatagttaaatctgggatcagaacagattgaatgagtcatttctcatggaaatgtctttatgcttaggaaatactcggggaatgtgggccagcagctattcagacgcaaggctcaacgagcaacccttttggatctacatatgtgtatggctatcagaatgttgcttttgaggtaatgcatttttgtaataaccctagattcagtaactttgatccttgttatatacttgcagactgttaagtgaaactttatgttgggttaaaatatttgcaggtgatgaagaacggtcatatagccactataaccttgttccagtcatgatgcgtatccaccgctgaggtatatgcccgttactaattcttcgtttatgttgaatttggtcgtaatgaatattcactgtttggttttgtagaaaaaatggctcagattaatgtcttgtgttatatgctacttaacaaagcttcttacatcaatcaatgtctttgtaggggctcaagatgctatcttcaaccagactctgtaaatctaacgtcacaagaagctacgaaaactatcgatgataccaaaaacgacaaatgttgtacagttatacatttgtctagttactatcacccgggttataataacagttattctggttataattcttttcagactttattatgactaattatatatcatttatctgttaaaagttcataaaatagcctcatcatttgagttttttgcggtatcgataaattttaaggttttaaaaaaagaaattgaaaaaacaaaaaaaagctccgtcgccgggactcgaacccgggtctctcgggtgagagccgagtatcctaaccagctagactacgacggaatgttgcctactgatgacttaaattttatatagcacactactggtatagtcgagaaggttgtgcggtatctcttctatccgttgcgtagcaaggttttgtctttcgtgtatggttccgggaaggaaaaggggaagtggattgttttcatcggcgataagtctcttctcctctggtacttcttctttcgattctcttctcttttgtttcgggttccacttagatactctgtagctgctttcatttcagaattggcttttggttcaatccattggtagtgcgagaacttgaattccgaaatagttccgatttctcttcagattttggatgttatcttgctaattgagtttagaatccatagtaatagtgcgattattgatttagcggttgtttagggtttaagcctgtttttcatttgattttagggattgaggttggtggtgtgaggtaaagcttcggtagttagagatg

SEQ ID NO: 31009 - DNA, 3003 bp, Unknown; identical to SEQ ID NO: 26859
  misc_feature (1)..( 3003): 2750-1469P.txt file - cDNA_ID_3037888; gDNA_ID_2213671; Annot_ID_182302

SEQ ID NO: 31010 - DNA, 3000 bp, Unknown; identical to SEQ ID NO: 10738
  misc_feature (1)..( 3000): 2750-1469P.txt file - cDNA_ID_3037892; gDNA_ID_2213671; Annot_ID_182301

SEQ ID NO: 31011 - DNA, 3000 bp, Unknown; identical to SEQ ID NO: 10737
  misc_feature (1)..( 3000): 2750-1469P.txt file - cDNA_ID_3037896; gDNA_ID_2213671; Annot_ID_182298

SEQ ID NO: 31012 - DNA, 3003 bp, Unknown; identical to SEQ ID NO: 26861
  misc_feature (1)..( 3003): 2750-1469P.txt file - cDNA_ID_3037899; gDNA_ID_2213671; Annot_ID_182295

SEQ ID NO: 31013 - DNA, 3003 bp, Unknown; identical to SEQ ID NO: 26862
  misc_feature (1)..( 3003): 2750-1469P.txt file - cDNA_ID_3037903; gDNA_ID_2213671; Annot_ID_182294

SEQ ID NO: 31014 - DNA, 3000 bp, Unknown; identical to SEQ ID NO: 10769
  misc_feature (1)..( 3000): 2750-1469P.txt file - cDNA_ID_3037925; gDNA_ID_2213672; Annot_ID_182380

SEQ ID NO: 31015 - DNA, 3000 bp, Unknown; identical to SEQ ID NO: 10774
  misc_feature (1)..( 3000): 2750-1469P.txt file - cDNA_ID_3037951; gDNA_ID_2213672; Annot_ID_182364

SEQ ID NO: 31016 - DNA, 3003 bp, Unknown; identical to SEQ ID NO: 26872
  misc_feature (1)..( 3003): 2750-1469P.txt file - cDNA_ID_3037955; gDNA_ID_2213672; Annot_ID_182363

SEQ ID NO: 31017 - DNA, 3000 bp, Unknown; identical to SEQ ID NO: 10767
  misc_feature (1)..( 3000): 2750-1469P.txt file - cDNA_ID_3037960; gDNA_ID_2213672; Annot_ID_182356

SEQ ID NO: 31018 - DNA, 3000 bp, Unknown; identical to SEQ ID NO: 10784
  misc_feature (1)..( 3000): 2750-1469P.txt file - cDNA_ID_3037967; gDNA_ID_2213672; Annot_ID_182350

SEQ ID NO: 31019 - DNA, 3000 bp, Unknown; identical to SEQ ID NO: 10764
  misc_feature (1)..( 3000): 2750-1469P.txt file - cDNA_ID_3037971; gDNA_ID_2213672; Annot_ID_182348

SEQ ID NO: 31020 - DNA, 3003 bp, Unknown
  misc_feature (1)..( 3003): 2750-1469P.txt file - cDNA_ID_3037975; gDNA_ID_2213672; Annot_ID_182345
tacttgaacttttatcggaacatctcttactatctcattgacaaaaggttcagtagtctcgacctgagcagtggcaagattggcgttatgtaaagtatctctttcttgatgatttgaatgattgaggaagctttgttgacccgtaaacttatccgtttgttggattctcatgatatcatctggacgagaagcatagaaagctgagctcacatatggcacatacattgtagaaccatcatttccctcccgcataatcggatcagaatgcatatgaggaaaagatgtctggcacatatgacaatcatttaccctttgaaaactttcagccatagttacttgttgatagaaacttccatcggggagaacaacatggttagatggtggaacttgagacccgccataaccatcaaatggtataccaggagaaatcgtaccttgatatgcagtgtttcttggctctgtaggaagcggtactaacttttgagcagcatgatagttccccaacagattttcttgggtttgcattaccgggttaatcaaaactggtgtggaactaatctgagaattcaagggagccattgacatgtgagcagcaggaaggaactggtgggatgagacacttaaaggactatcttgaaaaggttgttgggagaacaaagaagtactacttggcaaaagctggataggtgaatgaacaatatctggttgtcttaaagcttcttggcgagattcaacataggccggtggatgatgttcagatggtgtagtatacccctgttgttgctgctgcatcttaccaactattggtttctctgaaacagtctcaagctgaaaagaatgaggcggatcggcgtggacagtcattggcacaacataagcagaagagcgtggatcaggaggaacaagtcttgatacattactatgataagtctgaggtgaaaaattactcgaggtccaagtagttgcgacaaaatcactctgaccaacgcccaagctatcaacaacatccacgccactaaaatcagaattcggattagaactaccactagctacactttccttactcacaacaacaccattcacagcctctacatatctctgcccaatatcaactccatcaccatactccaatattccgaaagaatcatccacctcagacgaagaagcatcaaacaaaaaaactctcaacttccctgacccatcagaagatctctctaccaacttctcaaactcctccatcatattatcaatatcttcactagatgaaacagaaaccaaagcatcaagatcctcatcaggaagctgatacttaacaacaacagggtgaccataaacctgaatcatcttttgctcaaattcatcaaatctcacattctttttaacactaacgatccttgtttgaccaccaacgtaacgtaacatgccatcacttggtctagggattatctttccattgtagctacataaaaacttcaccttttccaattcttcatcatccatatcacttcttttattgcctaaatttggattgtttctattcgtagcatcaatacttacctgctcactcccaaacccagaaataattccatcagagacacgcttattactcaaatcagagctataatctaacccagaagctgaaagattggccggattagaaacaagattcgaacttgggctactgggttcatgtgccattgtttggagcagggagagggatagggtttatgattactcacctggtcagtatcgtggtcgtcgtattcgaggaagaaacgaagaatcctattttgtagagagaagaagaaaggagaggcaaagcgagtcgttggaactgatacaacgacgacgtttcattgggagtatcaaaacctcaatttggattttctctgtagtctttttagaatttttctaaaagggaaacacgtgagagatgggaagaggcacgtggtcgagcctcatgcaaaagaatggttgcgtttgttttccaaactgcgagagaatcgtgtgtgtaaatgctcccagttccaacactcgacatgttttttttgttttaggttattactgattattcttgaacttttagcaaaataatgaaacaattttgacttttataacacacaaaaaaagcaatacaatttcaaataataaatcgattaagagataaaaattgtgataatttggatattttaattagtttgtgcaatattcttttctcgttgatctctataaattagagaggcaaatgcgactgctaggagtagaaccttaccattggactacaaacgcttttgtgtttaagttgactattaaatttagatatctgattgtttaggatagtttaaaacgctaccgttttggaatctttatacgctaccgtgttattcttctttgaccaaaattctggagaatttgtcttcccttcgtatttctggcaacttttttaatactaaaattctctctaaagccgtcaaagaccaaaaaaaaaaaaaaaatacgaactcgaaatctctctcgtcttgttgttgcttaccattgaagctatcaatttctccgtttgatttctctcttctcaaaacctatttcgacggattattccgattcctgtttccccgaccttcacgcttcgtacttttgttttttgaaaaattcgtgtttcaggtacgttctcgatttctatttcgtttttttctgattcatcaatgaaacaaaatcgtttcttaatatacttgttgttctttgattcgattgatttttgttaggaagagcgcatgtgtagagttggtggtgtaattcagaaaactttccggagattttttggtgatgtgttgttcgtaggtaaattttgaaattttggatttaatggttgaggaagatagatggtgtttcttcaatggatctgtgaagacgagattgttggagattgatacttatcttattcgtctttatggctttgcttgattaagaaattgtgtgattgttttggggaggggtttaaacatg

SEQ ID NO: 31021 - DNA, 3000 bp, Unknown; identical to SEQ ID NO: 10793
  misc_feature (1)..( 3000): 2750-1469P.txt file - cDNA_ID_3037991; gDNA_ID_2214449; Annot_ID_182400

SEQ ID NO: 31022 - DNA, 3003 bp, Unknown
  misc_feature (1)..( 3003): 2750-1469P.txt file - cDNA_ID_3038020; gDNA_ID_2214449; Annot_ID_182404
ttatatgtctacttgtttatatgtttacttgttgttaatattataaactcctggaattttaaaattactatgacaaatagttacaatttaaatacataactaaaaataacttcaaatacaacttttaggttttacaacaattatcaaaagaacattttttggttcataactctctctttagctttagatatttaggataacgacgtctttttacgtatgaaataaattgttgtatggagaataacttcgacgactttcttattttggtacccgtaaatttactattgtttttcgtttatcttcactgcattggttagtctatatagaagtatattcataagcttatctacattttcttttttaatttagaacgagtaacgcatgcatacgtgttttggggaaaagtcgttttggtcttttgatttgaccatttactgtgtatttttgcggtaaattaatattatttaattactttgactaacattaattactaaaatgtgttctattgatcacaagaacaacgagatgtagtattttccagtggtgaagacgccggagataatgtttatccggtgaaaatgaaggtgtttattaacgaggtgcctgtcaaaattgtgaccgtatatttatttttctgaatttgaacttttagtatatatccttatttttaaaagaaatttgagtttgtttacgtttttttaatctaggatctaatttaatttcttgttgataaaaaaaactgaattcatttaaattatattaagggaccaattggttacaattatggttttggttgtagatattctagatgtagaaatattgactgtaaaagttatgaaagttaatttagatatttataagagttttattcgcgatatagttgtatctattatactattaaaaatctagacttctttattggtgaataatatgcattatgtgatatttaaaatcaagttatggtataatgacagatatcgaacaaattactaaactacacgttttgtaaaaattaaatttttaataaactttaaatagtgcaaaaaatatatactaattattttataaataaatattcaaattacttgtttagattttgagttggcaacaattactattatctgatttttatgtcataactcaaaagtaacaatgattattttcattaaaatgctatagatttctctctttattttggaacattaaactcattaataaaaacgggaaattctgtcaaatggccaatacataatatgtcatgtaataacaattggatgacttgtgtttaatttgaaagtaggtaaaacaactttggtaaaacgatatactgtatggattaaaatagagaatttaactattcgtttctataatacaatataaatcttgtaatacgatatgagtgtgttcttgttaggtttagactcactaaatcaagctcaaggtagattgctggccttaactggagaagcaagaaaccgcataagaaggcttacttgagacacacgaaaccatctaatgcttttgtgtgtttgatcttgtgacggaaacaggcggagtttcttgagaagatacctagtagaagcacattcgcacacaagtgaaaggcattgtattctcatctgtccacatggaaaccataaggatactacaaaatcaagaactttagcgaccagaaacgccgtggacaagcttatctacgagtggagaggttttaagcacaccattgactggaaacaaacggtaggctctttagaaatatttatctcccatgagacactatgagcttcaattcacttccccactccactctcctgactatgttattgcatccacaagattgagcttggattctggtactccgttttcgaaaataaagtttgttgagaaaagcaaaaccgattcaacaaaaacatatacagagcaagatatataaattactgagcagccctttttaaaaaaaagtttcatagacaaacaaaaacttatcatcattatcaatttatcatcatcatcatcatcaattcatcataatcatttgttggctttgagccattccagaatccgtttttcagattcactgagctctgcttctgtctttccctttatagatccttcaacaaactcaaagtagtctttataattcctcttgtaaaaactgtccaatctctgtttcattttcccaatatgaacgaaaaaaagatcataagaaaatttcctacaaaagacataaactatgtgcgttatggtatataaatgtcattctctttacctccttatcattcttggctttgttttcctcagtcttcttcaaatactctgaaacaattcttccccaaagaacgacatagtttaggcaaaagaaacattctaaatgtaaagaagaaaaacacaactaagaatttctaattactttggagaagctggtcgctgctggtcaaagcagcggcgatgaaagacgtggaggagaagagaatgtttctgcgtcctaaatcagcgggtggagcagttaaagaatggcgtttggtatcgtttctgcgtacagcttgaacattggaagaagcatatttgttaacagttactgttaaagccatgagaatgctttggcttatggagctcatctctctcttgaccagaagataagattcttgttttatgtctcttatctacattacagagaagaaacaaacatctttttatttattaacaaagagtccctaactatgtaatttacaagaacaaaccctcaaatctattaaaaatagattccaaacccagatagaaatttgtagagacaaaaccggtttaatagacaaatattctcaaagcgattctggttcggtcgggattttgactgtactcagtacttacatcttcttcatctgacgatagcaaaaatgacaagcaatccctaatttcgcctcaaaaaatcccaaaaagcttcgttcttttttagtcatcatcatcttcttcttttcttcttcttcggttgctaaatcgaagatg

SEQ ID NO: 31023 - DNA, 3000 bp, Unknown; identical to SEQ ID NO: 10797
  misc_feature (1)..( 3000): 2750-1469P.txt file - cDNA_ID_3038027; gDNA_ID_2214449; Annot_ID_182402

SEQ ID NO: 31024 - DNA, 3003 bp, Unknown
  misc_feature (1)..( 3003): 2750-1469P.txt file - cDNA_ID_3038031; gDNA_ID_2214449; Annot_ID_182401
gatgaaaatattatcagaaacaaacgaactagaacaaatggctaccgccacaagcaagagatagaaatatggtttttgaaaacacaagtacgactcgtaagagtttcgagcctattcacacaaacacgagataatagaaatcccacataaaaccgacaaccttcttagtactcctctccttcatcatcctcatcgtcaccaccttcagcaccaacctcttcgtaatccttctccaatgctgcaagatcctcacgagcctctgaaaattctccttcttccataccctcacccacataccagtgaacgaaagcacgttttgcgtacataagatcaaacttgtgatcaatacgggagaacacctcagcaacactggtggagtttgagatcatacacacagctctctggactttagcaagatcacctcctggaacaacagttggtggctggtagttgattccacacttgaatccagtaggacaccagtccacaaactgaatagtacgcttggtcttgatggtgccaacagctgcgttcacatccttggggacgacatcaccacggtacatcaaacagcaagccatgtactttccgtgacgagggtcacactttgccatcatggatgctggctcaaaagcactgtttgtgatctcagcaaccgagagctgctcatggaaggccttctctgcggagatgactggggcataggaggaaagcatgaagtggattcttgggtatgggaccaagttggtttggaactcagtcacatcaacattcaaggcaccatcgaacctcagagaagcagtcaaggatgagataacctgaaaccatcaagagagagttaaacataagaaacgaaacagcaaaaagactgactgatgtaaatgattgaagctggctctatacctgagagacgagacggttgaggttggtgtaggtgggtctctcaatgcttagggaacgtctgcagatgtcatagatagcttcattgtcgaggaggatagagacatcagtgtgttccaagagtgagtgagtggagaggacactgttgtaaggctcaacaacagaggtggagacctgtggagatgggtaaactgtgaaacccaacttggactttttcccgtagtcaacagaaagtctctcaaggaggagagatccaagaccagatccagtccctccaccaacagcgttgaagacgaggaatccttggagaccagtacagttatcagcgagctttctgatacggtccaagcacagatcaacaatctctttcccaactgaaataagatttcaaaagtaaatcagtgaatgaacagtaaattcaacaagatatggttgatgatgaagaaacaagggaaggagtaacttactggtgtaatgcccacgggcgaaattgttagctgcgtcttctttaccgctgatgagttgctcagggtggaaaagctgacggtaagtaccagtcctgacctcatcgatcacagttggctcaagatcaacaaagacagcacgtgggacgtgcttccctgcaccggtctcactgaagaaggtgttgaaagcatcgtcacctccgccaacagtcttgtcactcggcatctggccatcaggctgtaacattccacatccaagacaacacatcaatacaaagagacatataaaacgaaaagatctacacatatagaagcaacgatgaaaagagaaaatcacaacgagatgcttcaactatatcgcaaatatcaatcgccatctctttaagcaaataaagcaaagttttccttcacccaatattataaaacaaatacggatatggcatcagcaaaagcaatctgacatgaaatccaattcaaacacagatctatccaggttcatcgaataatttagaaatgagaaacggatttcgcatcaaccacagaaatttcataagacgtcgaaatcaaacacagatctaaacgattacgtaaaatagatctacgaggtcaatgctgcgcaaaaatatctcagatttgatcttttaaaatacgaaaaatatgaagaaaaacacagatcaagatagaagaggaagagacgaacctgaatgccatgttcaagacagtaaagctcccagcaagcatttccgacctggataccggcctgaccaatgtggatcgaaatgcactctctcattttcgtttcgcggaagaaagaaaagatctagaaactagatttgcagggaagaagacgaagaagaagaagggcgtttatgaagacgctcttcttttagatctagatctgattttttcgatttctaggtttttacagagctgtttgatgctatatttataagcgaaagtatccatctgtatgtaacggcacgtatgatacacgtgtagtgatgtaattgggttgtcgttaaaaccacgatttgttgatatcctcgtgagttgcgtattttctaattttgaattttgattccttagattctgtttggcaatcgctttctgaccgtttctctttatttttgaaatagcaaaattccttgaattgcgtggaaatgaaccggaatttaattagaattgaaccggatcagaccaatatttaaagtaaaccgaaacgataagaaactagtattaaccaaaatcttcgaaatggtaaccaaaaattcaaagctttgagtaaatgatgagagcgctagcggcggcttcacggccactgttttccgatttgccgagtctcgttcgttcatggcttccgacttctagcttcaaatcgtttgctactgtatcttcgtctcctccgtcggatttgaatctccggaatcaatctcgcggtggccttcctcgattcttttccgatgatcttccatctcgcaaggcacacaccctatctatctctatctttatctcatataatttttgttccctttaaatctgtgtaagaatccaatcgaaatgagagtgagggtaatcactgagaagtttagaaattactgtaattcactgtaatctctaagaaatttctggtaaaatcatg

SEQ ID NO: 31025 - DNA, 3003 bp, Unknown
  misc_feature (1)..( 3003): 2750-1469P.txt file - cDNA_ID_3038035; gDNA_ID_2214449; Annot_ID_182399
ttcacggaaatgacggtgaggactacgccttcttgttgaagggacatgaagatttaaggcaagatgagcgtgttatgcaggtgattctcaaaaaaatcagttatgcattgttctgatgaattcttgttggagaatacgtaattgaagttttcagtttacacttcacaaatatacagttttcagctacaaaatcacatctatccctttcctcttatttgtgtttcagctttttggtttggtgaacactttgcttgagaattccagaaaaacagccgaaaaagatctttccattcaacgctattctgtaataccactatctcccaatagtggactcatcggatgggttccgaactgcgatacccttcaccatcttattcgagagcacagagatgcaagaaaggtttgtcttgtattcactaaggttttcagtcctgaaactatctgcggtttacgttaattcttacacatgcctgtctgaattcatagatcattcttaatcaagaaaataagcatatgttgagttttgctccagactatgacaatctaccgcttatagcaaaggttgaagtatttgagtatgctctagaaaacacagagggaaatgatctatccagggtactcaattcattctggtaactctatttattttgggtaaagtacctaatctggaatactaagttgcttctattcttctccttcttattaggttctctggttaaaaagtcgctcgtcagaagtttggctagaaagaagaacaaactatactagaagtttagcagttatgagtatggtatgtagttgatctcatcctttgttctccacttgtgtagcatcaaataaaaagtttctggtgtttaactcgccaataaaatgaacttcatgcgttactttgtgtcaggttggttatattcttgggttaggtgatcgacacccaagtaaccttatgcttcatagatacaggtacataaaactgaaataaggtttacattacattttcaaccttgggttctatttctttatcaatggttttaattgtgcagtggaaagatcttgcatattgattttggagattgttttgaggcttctatgaatagagagaagtttcctgaaaaggtattaattttaatgtttccctcgtatatacttgtttgtgggtatcaaagaacaattttgtgaggattgcttaaataatgttaggttccattccgcctgacaagaatgcttgtcaaagcaatggaagtcagtggcattgaaggaaacttccgctcaacctgcgaaaacgttatgcaagttctcagaaccaataaagatagtgtaatggcaatgatggaagcgtttgtacatgatcctttaatcaattggcgtcttttcaatttcaatgaagtcccccaattagcactgctcggtaacaacaaccccaatgctcctgctgatgttgagcctgacgaagaagatgaagatcccgctgatatagatcttcctcagcctcaaaggagtactcgagagaaggagattcttcaggtttcttttgaaaatcttattatgtttttttcttctcaaagggggatttttttatatttaaatttgatttttggattatttcaggctgtaaatatgcttggagatgctaatgaagttttaaatgagcgtgccgtagttgttatggcacgtatgagtcataagcttacagggcgtgatttttcttcgtctgcaattccgagcaatcccattgctgatcataataacttgctcggaggagattctcatgaagtcgaacatggtttgtctgtgaaagttcaggttcaaaaactaatcaatcaagccacttcccatgagaatctctgtcaaaactatgttgggtatgttcctctacacttctacactcctaaaccccgattgctttagttcatttaaaattgaacatgcatatttcttgtgtttgttcttttattacaggtggtgccctttctggtgagatgggtcatctgtacatttttaatgtaaataggctttttaattttcaactaatttgcatttatgtttgactaattcgataataaactatgttctttttaatgtaaataatttattagtttcatagtcatgtattaatacatgatgtagcgtggatgaataaatgggcaggtcaccttttttacttttctgaaatatacattctcatatcctcaaggtattttaatggaattgcgacaaaagaagaagaagaagaagatggtgtacaatgtacatgttttatgaactatataaagcaattggaatatgcatgttctttttaatgaaacatgtttccggagtttaagatggatttcataaaaatcaacataattttgttaatagtccaaataatataatttttttattttttttttgttaaagcaaatttgtcacatttttttatataaaatttgtgatgtcaaaagagaagacaaatgtaaaattgtgttgtgggttgttacagtatgtagttggtatctttattaaacctaccaaaacgagacaatttgtaacattgagggagcatgtgatagtacattgggtattatactattaagctaacatgagtaatgatgtttttttgttttttttttctcttctatgtattttgtttttgtaccaatattattaatacagaatggggacaaaaaggagacgtggagtctcgcgttacgttaccactctctcaaatgcggcaatttggcagccacacacacatggacagcgttagcgtactgtagataaataatccgtactcgtgctaacgtacgcttcaaatagttaaaggtgataactttcaccgttgtctcggcaccacttgctcgaatattgacacctttttcttccccagaaaaaatccaaacaaatagaattttgccgtctgaaattcctaaaactataaaacacagcttccttcttctcctatatattcatcggcgacgccttgatcatgattctttccggaaactgataagaggaacaaaaatg

SEQ ID NO: 31026 - DNA, 291 bp, Unknown; identical to SEQ ID NO: 568
  misc_feature (1)..( 291): 2750-1469P.txt file - cDNA_ID_3038039; gDNA_ID_1592000; Annot_ID_151825

SEQ ID NO: 31027 - DNA, 3003 bp, Unknown
  misc_feature (1)..( 3003): 2750-1469P.txt file - cDNA_ID_3038039; gDNA_ID_2214449; Annot_ID_182398
aatcagcttctcaccggaagcagcgacaaatccacacgacgcactacggcgagagtaaacctcgacggagagaacactccatttagccttcttaagagacgtctcaatctgagacttacttagactaaagcaagcagcgacggttgagacgttaccggaacaacaccgagactctgattccgattcggttcgcaacagaacgggaacagaaacaatctggcgtgggaaactcttgaacttgattttacaatagcaattaccagaggatacatccgaaacagacggtccagatgaagaagaagacgacgatgatgacgacggtgatctcggaaacctaaccgccaaattcccgacgatgatgcgtacgaaagagcaaggatccattgtgaattgaagattgaattatcggtaaatgttaattagtcagagctacgaagaaaggaactttaacactactaaccctaactagtttagggtttaagagagaattggagtggaagaagaagggattttggagaagagctataaaaatggaagattgatgagaattaaacaggctggaatatagctgtgatttttttgttgagaaaaacaaatggaaattaggtgaaagattttgtggggtcaaaactccaaaaaaccaaactatcgcctgtcaatttccagatgtgtaaattgaaataatattattctttcttttattttatttttttattttttggtaaataaaagtttttttttagtttaagtatgtattgattcttaaccttgaaatttctagtgttctaaatagatttatttctttactcctttatatgatttttttagttaaatgtttttgtcttttacaattttgatataatttctggaatcgttattgaggtttatatggtagatttttttcttttatacaggaaacatatcaagagattaaatagtaacgtgtatatatatttttgctggtcttgaattctttttaatgtatgtacattttgttgttgttttattgacatttcacacgttttattaaatatatttctacttagataacgattgaaaataggaatacgtcgtatactgtaatttgtaagattttaatgtagctttttttggcactgatacttgattacttctaaaaactgaaagatcttgtaaaatgcagtttttttaatggaagagagaaataatggaacagtggataaaaaaaagccaaagacctttttgatttgaaatgatttagcttttaaattttgaaataagctgatggaaaatagttagaagtggataatttatctatctgtttatcacttaggttagatgaattggtcccaaaagttggagcacgcatgtatatagttggcatcattatcctttgctaataatataaaacttaagaagctaataaattaatattgacaaaaaagtctaaactaataataaaattcttctttttttttgatgaggttatttatcctatatggaaatgtatatgttattatttaaattctatacgtataatgcgttaatgatataaaaaattgagttattttgtgtcattttaactcttttttaaatagtactcttagttgtagtttattaatttggagagaaaagaacaccaatattttcaccgacattcttgtcacgttatgggattgcgcaacgttaacacttggaccctgtctattcaccatccttgatgtgtacgatgaaaccaagcgatgctatagcctcccacaagccacaactcttttgaaattttatgttggatgtgcttcgtttaattttcgaatgtaatgcttattttgtcatacacaatcattgtgattattttcgttgtaacaacggagaaacacgaactatattttggaggagccatttctttagtttttcctatacatatgaatatgaatactacttaacatacaagcaaaacaaaaatttaccattggagaataaataatgatttctatgatttagaatttttatgaatagaaaaacaaagtttcatcacatctaacaattcaaatccactccataccaaaaaaaagaaaaacaattcaaattaactgaatgatatgattcacatttcatcaatttttcaatatatgatatatcgattaccatacaactattttacaattctactattatttgacattttttattcaaaatttgactaatattcgatatttttttgtatagatattattcctcttatttatttaatttgttgacaaacttaaccatatgcattcaattgaattttttcattttccccattatttttgttcgtaatgactactaattacaacaaaactatagtttattattttcctacaatttaatgatcattttaaaaactccttatctgcttaaaagcataattggaaataataataataaagtgaaatgacaataaaagaaaacttattcaagaaactacaaagttattccttgacaaaaaaagttattctattgtccagtgaacaaatatgagtttttgactattttttttttcacaagtaattttttttctttgacaagtgtatattaaacattctaaacattacatagcccaaacaaagaccctttcagggttttaagtaattaatcagtgacaaaaaaaaatgaaaatattgtatttataagtttttgatagacaaacataagttttacaattttccaaggaaaaagtcatattttcctagtaaaaacctttcgggttttccaatttatttaccaaagataattggtctctgaaagaacaaagcaaaacctaagaaagctaaaaagacactcagcgaattgaatttgtaaaaaaataagagaaaaaatcttgatttcttctgcgatcttcggttctcgacgcatcatgtgttgaagattcttctatcttcctctgtacatactctctctctgcccaagtgttgttgaaccaaaaaggggtcagatttagggtttttggaagatttttgtggctggactggccctgcagcgatg

SEQ ID NO: 31028 - DNA, 3000 bp, Unknown; identical to SEQ ID NO: 10789
  misc_feature (1)..( 3000): 2750-1469P.txt file - cDNA_ID_3038045; gDNA_ID_2214449; Annot_ID_182396

SEQ ID NO: 31029 - DNA, 3000 bp, Unknown; identical to SEQ ID NO: 10788
  misc_feature (1)..( 3000): 2750-1469P.txt file - cDNA_ID_3038049; gDNA_ID_2214449; Annot_ID_182394

SEQ ID NO: 31030 - DNA, 3003 bp, Unknown
  misc_feature (1)..( 3003): 2750-1469P.txt file - cDNA_ID_3038051; gDNA_ID_2214449; Annot_ID_182393
gcgttcaagcaaccaaagtaaccgaaacacaatgttttacacatataacacctacagaaaacacggaaagtcaagtaaactaaccacttcaatgaaatcttgtgttgagtctttgtaaaattgactgttttctaatgccatccatcttccgcataatgtgctcttaatgtagtaaaggtaacgtaaagtagcacctttataagaaggtggtataatctgtgggagtatagctcgaaccattactgtagatgaaaattacaaacaaagaagcctgtcagcttaaaggttgacattgtaaagcctagccgttagtatatgtgccgtcggcatcaagcaagtgtacgttattattgttctttgttcatacagtattagagaaggagttaggcaagattacatgtcatcttagcaccaggggataggatttgatttgaaatcaaagatggtgttgaactgtctaggaagatgtgttcacctgaaaatctccaagagatatatatatggttaacgcacatcaatagaaaattacaagtagatggtaaagtgagcatgacgtgttggaagaaacatgaaaggctgacagaagatatataacagttgcagtaaaaagcttgttaaaatacctcttcgtcctttgcttcctggtgaaggtttttgagtagaaaaccactgaatgtccaatttctctagacctttaacctcaaaactaagcttttcaaccaaaatggagggattagaggcgttgtcatgagaattagcaacctcaatagttacaaaaatggaatctccaggcctatacacatctttatccgtttgaacacttagagatggtttgatcttgcttccagaaacacccacggagtcattgacttcactggaactgccgatccccaaaaaggaaaaccttgatgatagcatcgcttcaatggctgtgtttcttaaccaatacaacaatgccttccatgaatcgcttcaatggtgctaattacaaggacgacgagacttggatggagttgaatcattcaagggttccagagagaggacaaacataaaaaattggcagacagtagctaacgaatggcaatcaattacttcagatccagagagaagacgacgcgaatcgcgcagatcatagaaccaatttgtgagatttcgttccgaacaaaaggcaaatgtttcgttcacagagagtgagcttctaccttggttccttgagaatgacgagcagaaatgtgaagacggtgccgccgggagaagtcttcgtgataagagagccgagatcacaaatgaagagaattgagcaaggattctggaagagagtttagagggagatgaagaaattagggagataagcaattttctgagatccttgtttgatgacttctattctcctctgcaggagaagcttacaattactttagaaagcttagcttaacttaatctctacgtcttatttcagcccaacatgagcccaacatttcttatattctgcaatcatatttttgatccatttgattagttcgtttcgaagttctttaggatcatacaaatcctttctacatgtatctaattcaataaatcattggctcatcatatttttgtacatatgatgattcgttaaaaaacacctaatttacaaagaagtaattatattttcatattcaattttagcatcttttcgacatcttaaaaatgtgtactcggctaattagaaatactatacagtagtagttccttaaacattcaatttagtgtgttttggattatgtatcatggattttaaagtaggctagactttttgtctttctatcttaagtatttacttgcattcactgattgtcttttacatgaacataaaactatctaggtgtcttgattcttagcaaaatgttgttcctattgtcttttgcaaaacattgaaactgtaattgaacaatatagtttgaagttgtctaattttgcgagttagtttatctataatcacacgaaaccaaatcatataaaatccataaaatttggtcatttacatcacggattgctttggtaagagctagttcattatttatggccacctcttctgaatcagtaacaaatgcaaaactaggcaacaatactccttaggattctatcaagattactcaaaacgattttttgctcatgagtagtccatggaagacaaatcatatcagttacgaagcttgtttagaatctaaaacaaacaaaaaaaaaaatgataaagggaaagcaaaacatatttatcgtggtagcaaacatgttgttgacttgagctttgttggcataaatgtgactgtagtaaaaaagcgaatcaactggaactaaatctctgaactttgtcgtcggattaattggtgaaccattgaatttaacaaagtgagtgattgcccaacaattcattgcaacttgaatcttactccattttcacccgataaattttgtaacttcttttttatattttaatttttagtaatagatatattttattattaaaaatgaaataaaaactaaaaatttatcattttggaaaaaaatagtccggttgtaaaggttctgattatcctgattataaagaaaaaaaaaatagtacaatgtatcggtatcaataatatgtaaatgttttcggtactatgaaactgcattgcactatatggtttactctccattcggagtctcggtgcaatgtattggtactaatgaattaaagacaccttttctcaacaaagaacggccactttagcttaataaaaaaagtctttagccatcccatcaaccttcgtataaaaagaaaaatagttgaagattctacaatttattagtatattcccatcaacaaattctttaaaagaaaaaagtggagaaggaatcaaaagggtttgtttgttgtcagtcacactataaaaagacgctcctgaaaccacgtgaccactacacgcctctcttcttctgcttcacttcactactgctttctctatttctccatagatg

SEQ ID NO: 31031 - DNA, 3000 bp, Unknown; identical to SEQ ID NO: 10790
  misc_feature (1)..( 3000): 2750-1469P.txt file - cDNA_ID_3038055; gDNA_ID_2214449; Annot_ID_182392

SEQ ID NO: 31032 - DNA, 258 bp, Unknown; identical to SEQ ID NO: 10787
  misc_feature (1)..( 258): 2750-1469P.txt file - cDNA_ID_3038063; gDNA_ID_2214449; Annot_ID_182389

SEQ ID NO: 31033 - DNA, 3003 bp, Unknown
  misc_feature (1)..( 3003): 2750-1469P.txt file - cDNA_ID_3038094; gDNA_ID_2214451; Annot_ID_182566
cattttctactggatgacttccttcttcaagatttctatcaacaatttccagcatttttgccgaataaggatctggaagacgcaactgcttattcacccagtctcccatagaccttaaaacagcaactaagcatttcatggcttcaagcttcatggctgcttcctgaggtggcaacaaggtagtaactgtaccaggaggcactccttgagcagtcttaaggagaccattgaccatcctaaaaacaaggtcaagaaaaccaatacagaaatgaatgctacttcaaatagttcgcactagttaatgatcgcagctctgataccacaaaataaatagattcagggcgtaaagataagccacaacaagatattagatcatacctctcaaatatattggatgagttgacatcgcaatcatagttgatgaagatatctaccaaaatctgtgaatcaacgcagagcttgtccaagaaccgaagcactatcatcttctgttggaaatcaggttgagcaacattctctaatactcttagaacaatcatagggaagaacaccccaatctctgccttcagcccagcacgaaacctcgaaaccaagctaagtaaaatcgagcaggaaagctggaaaatgatcataagatttgaagcactgttcttcagcaaggagagacacagatactgcttgatggcgcctaagaacctgttccataatgagttgatgccaaattttcagaagaaacaccaaaagctaaattacattctgtccaagcaactatcaagcagaatgttgaaagctgagggaaaaaagactgaatctagagatatgatagtttaatctacctaacgtgggttataataatgcaagaagataaacaaaacaaacctatcgctggttctaaagacagcaccggcattctcaagcagaatcttcaataactcgagagccacaatcttccctctcatcaactctggatcttccttgggaggcgtcttcatggacagcttgcaaagtgccctgaaaaccaagaaggcgtctcttctcagcttattcccaatctgaacttcagaatcatcgtctttctccacttctccatcggccagctctccttttcttccctcgagggccgacttatacatactgatctcccagtacttggcatccaacatatccttatcagtagaatccaacaaatcagtaggattggcagtgccaggcaatgaagtctcgaaggccccgtcatggccgccgaatgtgcccttggcgttagctgaattgaagactccgtcaatgtcctgcataatcttggtaatgaaaccttgaacagactgcgtcgtagatgggtctgattcggatttgtccatgggctccatcagctcggccacgacgatgggctgaatggggacggtggatgaatctgcctccattcttctgaacacgataacagacatctgcacgagcgaggctttagcagtcgcctgattaaccacgtttctgcttcccaagtagataccataacaagtcctgacgatctgtagcaaagaatctccatggatcctcagggaaattgaagttaccgcagtcaagagcgtcttcagcacgagcaactcgagcccttcgtcgtctagctcgtgacatttgcagatggtttcaatgagcttggaaaggagtagcgcctcaggtccgccggtgggatcagcctcaccgcgaacgtagccatgagcaataagcttctggatgcaatcaacggcgggatcgacaatcttgagaacgccggtggaggaggcgttgatgagagggctgaggatgatctcggactcggcgagagagtattcggcggctcctccgtcgtgaagtggtccaggaatggaggatccagattcagagtcggcaacaggagaggaattttcaggggatctaaggcgttcgatgacggatttgcactcgtgggcgagcttggagtgcttacgccaggaggcgttcttaatgaccttgtccaaagcagggataacaactcgacctaagcgggaatcgacttccgtagaagccattccagattggtagccgtgacttcaacgaatcaccaatttagatctataagaggagagtgagtatctatctatgtagcccagagagaacggataacaacaacaagagcaacgcctcctcctctgcgatccaatcaaagcagtattcttatcagggagtcagtgaattacagacatctacgaagatgaagcagacgagacaaaaaaaaaaatggtgagcttgagtgaagtaaccaatataataaaaatccgagagaaccagatttggatcgccgtcctctcctctatatgaaatgacttatatatccttgaatagtggcggtaatgtctccggatttgagggcatagttggtattttcaaaatgacgaattctgtatctgttgaccgtcccggtggactcccccggtcatgagctttctagcttatttatcctaaataaattgcttttggtaatagtagtgatatcgaaaaacacccatgattaattcccaacaaatatgtaaatttgttttgcgagtaaagagaaaaacaccttcaacaatagtttttgaatttcattatcgccattgaatttcatttgcggaataatgggccataattgtaacggaggcccaatattaataaaaggcccatagtgaagtggtctctagtgttgtctaatccgccagacagaagtagagcagagcaaagaaagctaacagagtcatctccaccgctctaaattctaatctatccacaccagctctgtctatgaactttgcttggctcatctcctttatctccagtttctcctgagctctgctttttgtaagtaatcatcagagaagctcaattctgtacttgtatgatcctcaattaggcctttgaattcatgacttgttttctagagattaggttcatgtgaaatcatacggccgccaaatttaggtttttctcttttagttcttgaggtatacaatg

SEQ ID NO: 31034 - DNA, 3000 bp, Unknown; identical to SEQ ID NO: 10831
  misc_feature (1)..( 3000): 2750-1469P.txt file - cDNA_ID_3038098; gDNA_ID_2214451; Annot_ID_182565

SEQ ID NO: 31035 - DNA, 3003 bp, Unknown
  misc_feature (1)..( 3003): 2750-1469P.txt file - cDNA_ID_3038102; gDNA_ID_2214451; Annot_ID_182564
aattgctcgaataatttagtcggaagagagaaatttgtacgttaaggcgatgaatatcggacttgaagtggtagcgttgatcttgaagagacaggaactcaattttacaagtattacaggtccatctgtccaaaatcacgccgtccttggaactcttatcctcctccgcctcctctggatcgaaagttttgggtggtccgaatgccgattgagtctccgaaggattcgacaaccgacacgagtcaaagaaatccgccgtcaagtcaaatatcgatcgaggctgtttatattctggattaccaatctcggtggtggccgccgcgccggtggtcgccattaattatgaattggacggattgattttcctaacaccggtaccgataccgataagtgtggatttgaaagctttgtgagataaacgattccgttttgttattttcttaaatggatccataatgtcattaaagtggcccatataaggcccaataatacaaggcggcgatgcagaaagatctcgaacgaacaaaagcgccaaaagcatcctagacgcgactgagaaaataaatatagaagaaagcctctctgctcgttttgcgtttccgagcaacaatggtgagtcgtttgtccattgttcgttcgtttgtcctttgttcgttctagtcagttttttttttaatatagttctggcgatatttgtatttatatgttcgagtttcctggttttgattattgcagtcggtaactttgcacacgaacctgggtgacatcaagtgcgaaatcttctgtgacgaggttcccaagagtgctgaggttagttattcactcagctcatgtttctcggtttcgatttgagctgttttctttgaattgtttacaaaatcagtccagttgaggcaaataacaaaacaatattcactaggttatctagtgtccaattagctattacctggtgctgggttcttgtattgtatggatgatttttcttctccttctctggattgtttttaatctttaggcgaaattagggttatatgaatgtcatgattggggaaattatttttccctcaacagtgttggtgtataggttcattatttttcaatgcgtattcattggatcactgagctatttctctctgacaattttcgcaagtttttccatgtatgaagcaccttgacctttagctttgatctttcatattggtgcagaactttttggcgttgtgtgctagtggctactacgatggtactatctttcatagaaatatcaaagggttcatgattcaaggaggagaccccaaggggaccggaaaaggaggaactagcatctggggcaagaaattcaatgatgagatccgagactcccttaaggtatctctattctcatctctgcttatactttccctttatccttcaaactgcatcttcaatgtaatgcaactgtctcatggcctgttggtgtgttacctcttattcagtgtcttcataatccatgttagcatccatccataattatagacttcttttagctcagaaccattattagtcttagaaaaccaaagtggctgagtacactatcctgatctgttccttctgactgtaaggtaaggtatcaatgtgttttagccaggtagtcatatgcatgccattaccctactcataaccgctagtgcaatccctcttgcatttaattccagggaagtagatagatttgagtctgttgcgaatggtcttatctatctctctagttgttcttgataatttaccagattccattctcttatgcagcacaatgcaagagggatgctgtcaatggcaaacagcggtccaaacaccaacggaagccagttcttcataacctatgcaaaacaaccacatctcaatggattatacaccatctttggcaaagtcattcatggcttcgaagtgcttgacattatggaaaaggtaaaccaacctcttaccctcttaaatcacctcgtctttctaagaagagtttgaactcttatgttttcttccttactgtgactgttgttagcctaaatcaagtgtgttaaagaagaatgcttgttagttgttggtgatatgaagcctggaacaggatttattgatctgaattttgtttttagaaaactcatctaatgatatgattgtggcctgttgcagactcaaacaggaccaggagataggccgcttgctgagataaggctaaaccgtgtgacgatccacgccaatccacttgctggttaagtctaatgtggcagaaccgagccaagccaaaagtgttgttctctttatttgtttcgatagagctgacatgtacactcagaaactgaactaagaccactgtttcacccaattaaaaagtttgtactggaggatttaccaattactgtcttcaaaggtgttttgtattatttaaagacaaaaataattttttttgcccaatacttgacgccgtattgcaatctcgccaacaagatttcaaatacacaataatctatctgctgagtgtgtaataataactaataagattcaacgtgggccatcaaattcgaaccaaatcatgtaaatgggctcagccaaacccgacccggatcgaataaaaacggatcccttccactaagccgacccgttcggcgcaattaaagcggccactacctctggctagtagggaccgaaccacactgcgcagtcagcacaaacctgaataagggtaaaaaggtaaaatacggtactctcttttgacaaaatgggacccgttgtaacgcaacgactgtctctgtcttcattcaaatactaaacgcgtgtgggcccgccaacctcctcctcctccatcactgttttttgtttaaacaaaaaaaaaacacaaaatgttaaaagaaaaaaatataacccaaaaattgacgaaacaaaattgagaaacaatacaacaccactctcttcttcttcgtttgaatttgttcttctcttttttgcatagagaagactattgattagaaaatg

SEQ ID NO: 31036 - DNA, 3000 bp, Unknown; identical to SEQ ID NO: 10829
  misc_feature (1)..( 3000): 2750-1469P.txt file - cDNA_ID_3038106; gDNA_ID_2214451; Annot_ID_182562

SEQ ID NO: 31037 - DNA, 3003 bp, Unknown
  misc_feature (1)..( 3003): 2750-1469P.txt file - cDNA_ID_3038110; gDNA_ID_2214451; Annot_ID_182561
atcatagcattcgcttgtcacagatacccttcaacttaatatataaaaagctgattaagtcgtaaaacaacgatttcttggtagatatgagtctatgtagtcatgattattacaaatataaaaacaaatccaatgcataacaataaaacaacgcaaaagaagattctgcttgatcttctttcctgtcctataaagagttgttgctagatgaagaactagagagaaaaagattcagttttaattttccacctataaattgttcaaaacataaacaacaataaacccaaatgacaacgcagatccagaagacccccatgtagaaagcaagtgagttccaagaatatggcgaggaaagaaacttacaattaaagggaagaacagagccttatctttagccactcttgacccgttcgagttcttcttcagctgtttttaactgcaaacgcaatgtgtgtactttcctctccagctcctctacattgctcctgctagtggtaggatggtacggcgtcaagaacttatgtgaaaacgcctttaaggcttcaacccctgtcacctgtgatccaaacatccacaacaagtgtaaatctcaggatgtatattatataaggctttagtttcattttcgtcttgatcatgttccttctcatctatattgaatgtcatgcgttcttacctcttccggaagcagaggaagctttgtgatattaaagtcatcgtatagcatataaaactgatcaagatacttctgttgcatccgcatccttgctctgagcaacttggactccacatctacagaagacaagtgtagataattcgtcaaatttgtatgtaaaacaagttcaaaacgagaagatagacacgacagcaaataaataggcaccttcgtcgtcgtatagtacttggttgatgataatgttatgcgtgtcaatctcaaacttggcgagttcctgaacaagtctctctgtttcatagagagacaagaactcggggatgcagacacaaacgaacgtagtcatatcctacgtaatggagccaaatgtgtcaatttcttatcttaaaatgcagagtttgttagatatgtatcagaattttcactaatgcaaatgaatgctgtcaaaccgtatgctacagaacaatgtgaagaatctaaaactaaacttcacgaacagagttaagaaaacagtcaatgagtactgaaaatagcaaagaacttaaacaattgaaaaaatgttaccgggtctttgaattgccgatttacttgctcaatcacatctttcaagccctcaagtcttcccagcaaagcatcctctccgaactcatcctccatgccaaacatacggctcatctgcattaccaatcagttccatgaaaaatcagccaaagaagaaaccaaagagcaatatctgttgccaagcaaactgaatttgacaagcttaaagacatgcctgagtcatcaagccaccaaatctactcttcaatgacatcaacttcgaaagtcccttttctagtgtggccggaaactgtaacaggcggagagtatgtccagtaggagcagtgtcaaacacaatagtagcataatccattgtttgcaccaacctaaggaaacataaacatatcaaaatttgactgtgataatacatggataaaggcagatgattactagaagaactaaatggctatttacttcaacatctcagcaaaactcatagcctcatcgattccaggaatcgcatttgccaaatcagagaataaaccatccatcccgtctgtaccagccatgtcatcagtttcaacggtaggatctacctcctgagaaaagcaaacaagattcactcactatcaagagggaaggagtgtgaatcgtaaccatttgcttatagtatgtgtatatatatacatatacacacagacacaactaagagcttcaagcttagaagagtagccataaagtcatcatcaagcctgtctattagaggcgacccagaaccacaaaaaacaacttttttttttttttttgaatttggcataactagccatgaattttaactacaatagacaaaaattcgatttgatttggggacatcaaatcttcttcacaatccccttccgtatcaagaatacaaattggcgtccaaattccaaacctaatccccaaaatcagagtgggcatatgataagaaaggcacaaatcaaccgtatttatgcaagtactaaatctgacttcaaaatcaaaattgatccatcaatctgcggtttgaaattcgtgaatcagagaaccctaattcccaatgagattaaaatccaggagcgaaactaccaaattccctctaaaatctagcacgatctagaacaaaatcggagaaagcttaccatggcaaagagattagagaaaccttgaaccaaagtgggagatttagtgaagcgttgctgaaaggcatcactaagattgtgagcaggatcggtggagatgatgagaacggaggatcgaacactggcgagacaaattgcgagaattgaactgcatgtcgtcttcccaacacctcctttacctccgacgaaaacccatttaagagactcttggtccagaatgttctgtactgtcgcctccggcaaatccgccgccattgctaattccttgctcgtctctcttccactagtctcaatctaaagagctccttgttagatatttggcgtacggaagagtttaactgcggcgagagacttttaacgccgcccggttcaatattttggttctcggttttgggatatcacagcagtcttggtttgatttttttggttatcgtttttcacttgttcaatttttctttttttgttaaaaatttaaatttggtgtgtttaagttcataaacgctaaataagcccatacaaaagcccacatagatgaagccattacgacagcgtattgtgagttacgattgaaaacccctctctactcggttaaacccgtcgccggcatattgatcttcgccggaggatatg

SEQ ID NO: 31038 - DNA, 3000 bp, Unknown
  misc_feature (1)..( 3000): 2750-1469P.txt file - cDNA_ID_3038114; gDNA_ID_2214451; Annot_ID_182560
aaacggtgatcatacctcttcaagcatagctgagaccttgtaaatctcttcttcttgcattgcaatggtccttaagccagtcataaaatcttctgggaaaactagtttgttcatatatgtgggcatcttacgcttcccagaccaactgaaattacaggatctcactgtttccttctcatcactttctctaattactgatgtggttcgtgggaaaaacccatgatttaggaccgattttggcaagagacaccggagttgtgcattctgcaatgatattttttagagttcgacagttacatattacatggaaataaatgtattaaagagctacattgtcttatagggtctataatcaaaacttcgggtaagatagtgcgaagacttgtactgctaacctgagcttcaagcagctgccccttggaatcagaaaaagggatactcggaattgcctcaacaggataatgtacctgaataaatccattgttaaacgtaacaacagatgtgagaacaaaattgacgagcatctccttgatcttgaaagttatgtttctcgtcatcattctcaagacttctataatacatcactggttgaaaaggtagggaactgttgatggatgtaaatattaccatgagataatcatctgggttgttatctatcacaaagccatacaggtaaagaagctcctgcattcagcaagaaggcacatcactcaaacaaagggctagatgtgattttttaccaagagacaagttatatagttgtacaagatagctgcaaaacatcttacctcatttcctttgttaccataactgatcgagatctccttctttgggataggacgttgagcaactgctttacagaattgtagcacttagttttccgcatacagatcaaaaagaagagaggaaaaagaatgttctgtattgtttgattgaaaaattgtagaaagctgagaggtaacacaaacaaatatttggccaaccagagagaaggtacatggagaaaggaaccctagatactgatccgatcccatcaacttcccaagtcgccacaggcttcaaatctatactgccataaccataggtcattatatcacatcacactgggatatactcattaaccatatcaacattatggaacggagaaactgataatagagtctttttgaaacaaagattggcataccatggttgcaaaagtcaatgccaggaacaagcccctcaacccatattgtatctccggatcctacagatggcgcaggttgagcctgaatttctacccatcagaaaatgaagaaacccatgaaattgtcgttacatgatagaataataataattaaaaaagaggcatttcacacagaattcagcagaccgacgttaatgacttgcctttttcctcattagaattaactggagccgtttcaggggactcacttgttgatgtgcattccccggtatcatcttggctttgtggaaacacgaaagaatgtggaagaggaatattcaaggcgcgactccagaatacagagtttgccctggcataattgaaaaaagtcgcaagatcactaagcagccctttacaagacacaaaagtctggttctactaacaaggaataacaccagtaccaaacataccagaggaagtgttcaaaggagaccttgctgcacgaagagagaaaacaaaatatgattatcaatgaacaataatttggtctaaaagtagtgtaaatatgtcaacctttcggaatcgccatccaaaataagaagctttgtcaccaggacctccaccttgtcatggtaaagcgagagcaacttcttcttctgagaatgaatacacgatggttattgggtttaataaatgaaaagagaaaatgtggttgctattttaaggacgatatgataagacaggaataaatgatcaagattgagacctgtaactcggttgcgtgatacaagttagtcccttttagctcaaggatgtcatcatcagaaaaccaaagaggattgccaaatcgagtaggaagcatatcaagatacctatcatatcatttctagacagatgaatacccttaagcttacgtaaatgtgtgctaagagattaaaaaaaaaacttacggcttccaagaagaattgatacgaagacgctccaaagtgaggaacagaatcatgagaaagcggtcatcaacttgtccttgttcgaacattttctgacactcagggcccaggagagggtcctgaagaactctcataggggtaatggccagatcaagcggaacaacaagcaaaacttctgaaaatttccagagctgaatcagaattcaatatcaactttccatacatattccccggaaaaaaacccagcaagaaatggtaagaacaatactataccatcggaagcttgagtggaggtggaagcgaatatgccaaatccttttagggagtcagaatatttgatgttgcagcctcttaattcacctccattcacctgaatgaaattagatcgaaacacaaaatgccatgatatagagcagcagatcaggactgaaaaacaacacttaatccggatctaacctgaagccaatctaggaacctttcgagtttggcttcttcttctgaaatcgccatatcctccggcgaagatcaatatgccggcgacgggtttaaccgagtagagaggggttttcaatcgtaactcacaatacgctgtcgtaatggcttcatctatgtgggcttttgtatgggcttatttagcgtttatgaacttaaacacaccaaatttaaatttttaacaaaaaaagaaaaattgaacaagtgaaaaacgataaccaaaaaaatcaaaccaagactgctgtgatatcccaaaaccgagaaccaaaatattgaaccgggcggcgttaaaagtctctcgccgcagttaaactcttccgtacgccaaatatctaacaaggagctctttagattgagactagtggaagagagacgagcaaggaattagcaatg

SEQ ID NO: 31039 - DNA, 3003 bp, Unknown
  misc_feature (1)..( 3003): 2750-1469P.txt file - cDNA_ID_3038118; gDNA_ID_2214451; Annot_ID_182559
tcacatctaaaccctaatggttttttaatgcaaccactatcacaaccgcagtgctcacaagaggacttaaaatgagttctcttgctgcccaggtgtccacaacgggaacagtgaggagatctttttttcatctctgagcggaattcttcaccatcatccccggatttgattccaccaggaactgcaggttgcaacccatttccaatgtcctgtagtctgcacgaaaatatatatcccaacacattcaagaaaatgacaagtcaccaaaaagcagagacaaaaagcttatggattataacctttcaagtacttggtcttcagaaaactcacgaacaatgcgcagtgctttatccacaccaatcccaagaacaccgcctgaatcataatcgtttcccaccaatagagaaatagcaatcaagtgtttccgcttcaaaccgaggccagactcgatatgtgacatatggtagcattcaaaaggttcctgcacacaaggaaattaagatggtaaagagacgataagtgagtcagggtaatactcagttacaaatgaatacttactcttgaattaggcttgatgtctttgatcacgcacatagcaccaaaaaggaaagcatcactatcaggagtaatgcaagcatccacaaaaccttggctgtttaactgtgcacagagagcttcagcctcaccattagctttcagcaccggaataccgagcaattcgagtagctcctagagaaccaaaaaaagtcataagaaaacaatgtgaaacaaaacaagcataaaggtttgaagggaaagccatcttaccacacattccctaacccattcagaaaacagcttgtttctctcaaccgagacaccatctttaatcacaggtagattacaagtatcaattccagaagaacggaaaaacctggagattctcgcctgagatttcaaaggtgatggtgttccatcaaccacaaaaaccgggtacgctccaaactgcaaaaccctaaaccgcattacaatcatctccatagaaaaaaatcaagatttttcaatcaagcgaaaacctaaaaaattcaaaaaaacccgtaatccacagaaaaaaggaacttttttagccaatgccaaaaaaggattaaaggagacgaaattgggaaattcagtagaagcataacaagagagaagaagcgcgcagcaataaaaaaaaaaaaaatgggacctttgagaagaggttgatagtacggaagaaagtgagtcggaggtgaggtttaaggacgaaacccttaacagcggtttcatgctgaacgatccagaaggagagatcaacagcgactcgtttgtttctgagaaaatcaaagccttgttgctgagcatatggtctcagcaaatcccagaaattgcctcccacacccattcaatcaaaatgccgtaatagcctagcggagcggagcggaagatcacaaaccgaaaagcctaaaccagcaaaaggcgaattaaaagaaaaggaagccgaaggatagaatcaatttctgaccgttatgcgagtcttgttggactcgcttgtgttgtgcctatctatttatggcatcgtcacatcacccgccacggttatgggcccaacaattagcccggatgatatctctgtagcccattaagtctattaagaaaaaataaaataaaaaactatttatacagatcgcccaccgtggggctcgaacccacgaccacaaggttaagagccttgcgctctaccaactgagctagacgggctttgttggttaagtattactctattcaattgtctagtagaaaaccagaaaagcattatccaaaaatgtgcaagtatggaccttaattggtgtctcgctgaggcctgcgggtaaaatagtgaaacacacgataaaccatttctagactgtagttatccttttttaaaagggtattgaattaaatgagaagatacgatgaatatctccgaatttcataggagtgaggacatcaaagaaaaaaaaaaaaaaatgtaagtcgtcggcttacgtgttcatacttggcttgaaagccagtacacaaagggattatgagtgaagtgtgaacaagcaatgatttgaatcataggaaatatagaagaaaacttggttatatggtatgagtaatatattaagtcacgccccaattattgttgcgtttgtcccctccctctccatttaatgtccacctacccctaccggcggtggaagctgcctgcattcctcgtccttcttctaaactactacccgttttcttttctttttttcctatttaaaactttcacggcttttttttctttttctttgtatagagtaaagattattgcaaaattcccacgtcttagatgaaaatttgcacctcataagactagacttgttcattacgtgttccatattctggtaggcaaatatttttatcattcaaactcttctataagtgatattaataaaaagcttgtatttgtttgtttttattggtaaatatataaatgaacccacgtcccctaaaggctaaagcaacattcagtaacagacggtcccgcacaagaacctcacaacagcgacagttacaaaacatatcatatatttcatttaaccttttcgtatatattactctttctagtcacattttcctcagctcccactgctcacagtattcacacgtcacatatatatatcttttatgtgttatatacccacagagaccagtcctaagaatcacatgtagatgcatcgctttcttttaatgctcttatttccctttagcgacaaccgtcccatgatgttcttcagatcattcatcgttttcttctttcttatctttttcgcatcaaatgtttcttcccgtaaacaaacctacgtgatccacactgtcacaaccagtaccaaacacatcgtaacttcactttttaattcactccaaacagagaatatcaacgacgatgatttttctctcccggagattcactatatttacgagaatgccatg

SEQ ID NO: 31040 - DNA, 3000 bp, Unknown; identical to SEQ ID NO: 10840
  misc_feature (1)..( 3000): 2750-1469P.txt file - cDNA_ID_3038148; gDNA_ID_2214452; Annot_ID_182598

SEQ ID NO: 31041 - DNA, 3003 bp, Unknown
  misc_feature (1)..( 3003): 2750-1469P.txt file - cDNA_ID_3038152; gDNA_ID_2214452; Annot_ID_182597
gtgagagtcctcaagcattgcctcgaagatgtagactcaataagctctttgcctgatgtgatcctccaagaaaacctctccttaattccgaccaaattcgccataagaacatcggtcttgtccaaacgatggaggcatgtttggtccgaaacaccttccctcgacttcgatgattgctataaactagatgttgattttatagacaaaaccctagctctctacagggctcgcaagattatgacttttgacctctggatcaccaacggaatcaatcttccttacattgatggatggatcaagttcgccatgtcccgaaacgtggagaatctgtttctgagtttcgattttcggttatatgatgttcctgattacttgtacatcaattcctctgtcaagcaactcgtccttgggacagaatcttctgaattgaatcccagatgctctgtttcttggagttccctcacgaagctttctttatttctctgatgagtccattgctaagattctttctggttgtccgattatcgaaagcttaacattgcatttttgtgatcaactgatggttcttgatctcaccaaatcaccgagtttgaaaatattggaaatccatggtagcatttggggttcggggccaaagcacattgtggcaccgcatatccattctctcacattgaaaacctctcaattctttatctacttttgttgatatctcgtctttaaccgaagctaaagtagacatttgcttttgctcacttaaagagataaaggctaatttccttctcgacacggtgctcaagtgtctttacaagttgcagaatgtagacaagcttacctttggggcaaactttcttaaggtatgtttttcatgttttcaagtgtcatttttcttattgagatttgtttcaaaaaaaaactaattgtctgtactatttgtaagattttatctctggccgagggccgcggtcttccttttccgatgttcaaggctaaagctttgactctcgagacaacgatctctaaatacgttattcctggtatattaagagtgctacaaaattcacctgaactaaagaagctaaccctacacacaatggatcgcgaggctagaactatgtcctttcactttgagtttgtagaatctgagatattgacaatctgtttttacattaacgaaattcttttttgttctagtacagggtgagtatgatcccacgtacttgcgttgcatgaagctggatcattgctcgatctttgcaaagatttcccgtcggaatgtagagtcaaagcatgtggcttcgttcatggaacttatgattaaaaccacaaagaaattagagaagatggtcgtaaggttggaaagttatcttgatggaagaggtttcgaagaattgcttgagatggttccaatgctttctcaaaacaacaatgtctccattgtgcttagctcaaccaagccgagacagagtctttagtcttgaattttattggatattttacataatctcattttaaaacaatagtaggtaaaaacattcaggacatttcttggaaaaactttttttgtttgaattattttcttaaagttaattttaaacttaatatgaggaagaggtagttaagtaatattctagttattaatcctaatccatcaaatattaattcataaggtttgttttcaagtttcaacagatagtttgatatagcattaattatcgcttaacaatgaatgccattacaatatttttgataatcttattttgagtaagagtgtctctcaaattttatttgtttaatattctatctcattcttcaccttagttcctcaagacatgaaacttttcatagattttatgaaatatcaatgatattattttttacttaaaatctaacatttacctccggtgtaaatggttatccattagatgaatgttatgaaaataaattggaggaaaaaatagagatgaaaatgctatagagtggatgaaaacttttcttaaatttctcttctttgttcatcttattaaagatgaaagagattaatactaacagattttaaactttcaatccaaatggtaacattttagatgagtctttttttcatccagttttttcctcgtaatatgtctacaatttcaagaaagcttatcaaacgtttagaatttggcaataatataatttaataattattcctaaacttttcataacatttcttaaatgttgtttacagccaacaaagagtaccttttaaaggtgtcttatgttcatgtttcgggtagattgtatcccaacaaagcttcaaaattgatccgacaaagatggcatcaatttgtttctagccaactctccaaactatcacaaaaatttatagttttcacatctttttaccattgattccttttgcatttaaggatcattataacaccaatcacaaattgttttaatgaaaaaaacagtttatgtcacaagttcccctcttcatagaccacaatgcattgaaacatatggattcactagctaaaagtctcatcatcatatgtctctctattggtttcaatatccatttataatcccaagaaatttatttacccgatttgggaacttaaatcattcatcaactgtcaaaagttgatgtcaacccctaaaaatacggtcgaatcagaaccgtcggatctaaaagtacataacatggcttcacttacgtaactgggccccacgttcccaccacttctctctcagacctaaaagcgaaaccaaagaacaaaaaaaaaaaaaagccttaaaccctccgaatctacacaacacaacactactctcttctctctctctccgcctccatattatcctccaaagaaaccataaaccaaatctaatcctctctctctcggtctcctccattacctaaacaaaccctttccaacacatacatatcgagagagagagagaccgaagtttccgagtctcgtaaccagatcggatccgaaagttccatactttaaaaagatg

SEQ ID NO: 31042 - DNA, 3003 bp, Unknown
  misc_feature (1)..( 3003): 2750-1469P.txt file - cDNA_ID_3038163; gDNA_ID_2214452; Annot_ID_182594
gttgcatttgttcacactcttcatctgaaatcatctccgagcatcctccgttcgtcagggtttacaaagacggtcgtatcgaacgtctttccggcaccgaaacagtcccggcttctctaaacccacgaaacgacgtcgtttcaaaagacgttgtctactcaccggggcataacctctccgttcgtctctttctccctcacaaatcaacacaactcgccgccggtaacaaactccctctacttatctacttccacggcggagcttggataaacgaatcccctttctccccaatctaccacaatttcctcacggaggtagttaaatccgctaactgcctcgccgtctcggttcaataccgccgtgcaccggaagatccggttccggctgcctatgaagatacatggtctgctattcaatggattttctcacattcctgtggatctggtgaagaagattggattaacaaatacgctgatttcgaaagagtttttctcgccggagatagtgccggtggtaatatatctcatcacatggctatgagagctggtaaagagaagcttaagcctagaatcaaagggactgtgattgtgcatccagcgatttgggggaaagatccggtcgatgagcacgatgtgcaagatagagagatcagagacggagttgcagaagtttgggagaaaattgtgagtccgaatagtgttgatggagcggatgatccgtggtttaatgtggttggatccgggtcgaatttttccgggatgggatgtgacaaggttttggttgaggtggctgggaaagatgtgttttggcggcaaggattagcttacgcggcgaagctaaagaagagtgggtggaaaggagaggtggaggtgattgaggaagaagatgaagagcattgcttccatctcttaaatccaagttctgaaaatgctcccagcttcatgaagagatttgtggagtttatcactggttaacattgttctttgtgtgacacgaataaattttgatgtaacctttgaatttgatttggttctctatataattatggttaaggaattaaatacaggaatgactcggttgtgactatatgagatttgtggtctaatattttattttattttttgttgctgacaaatagtaacacaatttagtttcaaatacgttttatgcatatacatgtatcataacaaacctcaaattgtcattgaattgggttcaaaggaatagatgtacagtttgacaaaaaaaaaaagaaaaggaatagatgtacaatgttattgatctaatttgtggctattagttattacaggctcagaatcaagaaggtaacgactggtgcatgcatatgtatacaagtactcacaagatggattgaggtcgggttattgtctggatacatttgtaataagagtttttggttatacaccatcgggtccacctctagtctgattaatatccaaatatggaaagcaatattggttaagcaacttgtgattttatcattttgctaaaaataactaatgatttgttagcaaaagtaacttatgatcatatcaaatttaaccaaaccagttcatatcaagctgtgtacttgtcagggtttgattggatgaatcagtgtatactcatacatatagtaaactcacatacatattactctgtttctgttcttcactctcttttccaaagaagatggaatctgatctaaccacagagcatcatctaccattcatccgaattcataagaacggccgagtcgagcggcttagcggcaacgacatcaaaccaacgtctttaaacccacaaaacgatgtcgtttcgaaagacgtcatgtactcatcggaccacaacctctccgtccgtatgtttctccccaacaaatctagaaaactcgacaccgccggtaacaaaatacctctactcatctactttcacggcggagcttacatcatacaatctcctttctctccggtttaccataactacctcacggaggttgttataaccgctaactgcctagccgtgtcggttcagtaccgtcttgcgccagagcatccggttccggcggcttacgacgattcatggtctgcgattcagtggatcttttctcattctgatgattggattaatgaatacgctgatttcgacagagtttttatcgccggagatagtgccggagccaatatatcgcatcacatgggaataagagctggtaaggagaagcttagccctacaatcaaagggattgttatggtgcatccaggtttttgggggaaagaaccgatcgacgaacacgatgtacaagacggagaagtcagaaacaagatcgcatatatttgggaaaatatcgttagcccgaatagtgttgatggagtgaatgatccgtggtttaatgttgttggatccggatcggatgtttccgagatgggatgtgaaaaggttttggttgcggttgccggaaaagatgtgttttggcggcaaggattggcttatgcggcgaagctggagaagagtcagtggaaaggaagtgttgaggtgattgaggaagaagaggaaggacactgcttccatctccataaccataattctcaaaatgcttcgaaattgatgcagaagtttttggagtttatcataagttgaatcttgatgctcaagtatggtattagatgacataatccttttatataatcatattgttaactttaataataatttatgattttaatcgtcaaatttcggagagttgaacatacaaataacttatgattttaatctctaattgctgtgaatttgtgtatcaaactcctgtatattcgataaatcattcgtataagattgttcggccatatcaataaccggttaggtccatacacatagatttcgaaatttgcacctccggtttaaattttcgaaccgaaccgctttaaaactcctcgcggtcggattaaactattcgcatccttaagcacagtctttgccggagaaaatattccggtagccatg

SEQ ID NO: 31043 - DNA, 3003 bp, Unknown
  misc_feature (1)..( 3003): 2750-1469P.txt file - cDNA_ID_3038177; gDNA_ID_2214452; Annot_ID_182590
ggtacattgggtcggatctcaatgggccgggttcggcttgggctctttactggcctgcccattccaagtcgggagttgagatatcttctgagcgaaggttcggagccaatatctctttagagcggaggagaccgcgtgaggctggtttcacagagcagcgtccaccttccgttctcgacggtggaaggataacgggcccgttgtcttccgagcccactatgacccattaggccgactccaactgagccatcacttttttttggatcatcagggctacaaggtacacaatttacttactcttaagaggaaaaaatctataactcttgtatttacatattcgttttttcagcttggaagtcggaactactaggttatttggatatgaaatcagttaaagactcattgatgtactacgccttcaatacattgttaataatgctattagttttcacatatattggtggctcatttgtacgacaatcataagagagcttcaaaacagaggagaagtgggagaagagataagatcaggtaccaattttctttcaattgttgtttttaagattgaaagttttgcttataagggatcaatggttgctagaatctgttacataaacattgaactatcacgcatacgaatcgttaagtaacttgacttatgttatgtctttgagtgattcctttttataatttacatcaatggcagattcggaggatgatgactagggtttgctagaggtcatggtgaaaaatggttttcagatacctcagaattaatgacactttaagcattgctattactcagatatgtcttctcttttgctctaggttaatgagtaatatatagcaaagaaatctatttttattgtaaatgaaaattaaaccccttttgtatgggtaatgggttaatgtaatttagttgagagtccctgaaaaagaagattgtcttctgtgtgcgtgtgtgtgtttaaactcttttgtactttgagaagaagattaaccaaagtctgagtggattgatcaaaaaccatcaaaccacaataaaaaatcgattaaaccaaattgttgcttgagttgagagttacttttatagtgtctcacatatggcaaatctgaaaatggaaaaaaaaaaaaaaaaacaaagaaacgcgccaggtaggggtcgaacctacgaccttctgcttaggaaacagacgctctatccactgagctacaggcgcttttttgaacaatagttattgttgataatatttaatcgtatgcgactttaggcgcagttgagaaaataaagacataatgtgtgtcacacattcttttacactgtaaccaaattagtacaaagaaacgtattctgtagacaaaaaaaatggcgtggtgcgatattcttgtagtttttagtttgaccgtatcttacaagttcatgtagttttagactttaaaattaaggtaataataatttcattagttaaataacagcctagaaaaagaagataatcaaaaaacaaaaagaagaaaagaatcttctattagattttgggttggctgattttcgagtcataaattatttcgattctcagctttcacccccggacttttgggcccttaaatttccaccatcaattttcatattcctcaaaattacatcatctactttcgaattcatgcttaaacatacatttccaattgaaccattcatttaaccgggattaaccacaaatccgcgtttactgtaccgcgattgtgattaacccgactaatacccagacccgttaagaaaacgacgtcgttttcatttcgtttaactcatcaaaaagagaaagaaaacgacgtcgttttcattcttcttctttaactctcaaatcgatttggtagtcctcttcttttgactttcatctctgtctccatcgtcttctagattgacgtctccatcagacgctatgtcaccatcgtcttctctattctcctctccatcagaagctctgtctccatctatcccgacgtcgtctccctcgattctggtggcttcgtcctcctcgactccgctatcaccactatcacttccatcgtcggcttcaatgtcactctctggaggttcgaaatcggggtcatctggatcgctttggtaaatcaatccttcctcccaccaattcttcatttctccctattcgaaacccaaatcgagacccaaaaattcgaaccgaagaagaaaaccccaaatctccttttgtctttctctctcaagaaccctaatttcacagtgtcgagattaaagaagaacgactaaatcgatttgagagttaaagaagaagaatgaaaacgacgtcgttttctttctctttttgatgagttaaacgaaatgaaacgacgtcgttttcttaacgggtctgggtattagtcgggttaatcgcaatcgcggtacagtaaacgcggatttgtggttaatcccggttaaatgaatggttcaattggaaatgtatgtttaagcatgaatccgaaagtagatgatgtaattttgggaatatgaaagttgatggtggaaatttaagggcccaaaagtccgggggtgaaagctgagaatcgaaatagtttatggctcgaaaatcagccaacccttagattttatgtcgtaataaaagcattatttgaagaaaaaaatcatatcttttggtttttaaaccccttatatagttattagtatgcttctaaggtaagaattgattttttcctatccatcctagagtaagagttgatttcttgttcaatagctagccgttccgttaaaaacaatggaatgaccggtttgggtaaggactaaccgggtttggcaaaccaaatgccgtaattattgcagacgtgtcacaatggaacactcagtggcttcttgattatatttttcgagtttcgaggatcaaacaattcaatcatcatcttctacctctgctccaatttctctgaaaacaagaaaaccttaatcaatcgaaatctcagtgtaactaatcaatg

SEQ ID NO: 31044 - DNA, 3003 bp, Unknown
  misc_feature (1)..( 3003): 2750-1469P.txt file - cDNA_ID_3038187; gDNA_ID_2214452; Annot_ID_182587
gaaatatgtttgttattgatgtggcgagcccacattttttctctacatcatttatttatttaattctactactgtctgtattcttaatattctaaaataataaccaaacagagaattaaatcgactaatcataaatatatatttcaaaattttaaatattgtcttatatataaagaagtttatgtataaatgcattgaattcatctattggaatattggtctgtcatcaactagataaaaaagctaaaatttataaaatatatgacttacgcaatttatttaatctttctcctataagtgttctaaaaagcggtttagatgctcggtgctcaagctacacataaaaaaatatctattagtgtattatcccaatttttaaatatgttttattttcatagacatagttataaacatttatttatatttttaatataaattaagtaaatgatttctttagttttggtttacaattttatattgtaatttctaatcgatattttatgtattttttaaaaataaaaaattacaaaaaaatttagacattttagtttatagtgtgtaaaatgttcaaagtatcaattgtatgtatacttgttttattttgaaatttaaaatagaaattacagagaacaaaaaatattttaaaatggccggtaaaaaatctccgttcgaatttaaatgtttcacgaataaaactatttttgaaaaaaacaacaacccgaatctcaaaaatagttttgtcaaaaatcttgagataaacgataagaatcgggtttagaatttgtcaaaaatagttttattcgtgaaagattttaattcgaacggagattgtttaccggccattttaaaatattttttattttctctaaataattttaaaataaaataattataataaaattgaaattttgaaatttttagacaccataaactaaaatgttaatacaattattttttatccaaaattagaaacttaatgtcatataatctaaaaaattaatagttaattgagatgataagagtaaaattggaattttatttttgttgtgagtatgaaaataacaacatttaattgtttgagtatttaaattgtacagttttattatttcatgtatttttcttccaacaaaaaataattagctattaaacgtccaaataaaaattagttgaggtattttttgggtttttacccgttttctaatgttaacaaaaaaaagtttggccgctcattgtttatctttacaaagagttagaacttagaaacatagggaaaaaaaacggaggtaaaatattataataagaaataatacttataaatctttactcaattttgtacgaaaacataaaataaaaagaaataagttgaataacaattttcaaatttcaaatgagttgttaccatagtaacactagtttttgaaaaaaagacatataatccttttgaaactaaaaaataattaaaatgccatttagatttcctaccaaaaatataaaaataaattacaaatataatctaagagaattctcaatatctcagattcacaataattttttatgatcccttttttttgttttttcttttctttgatcatcagaaattacaaaacccttaactatcatcaatatctaccatttgtcgcttttctagattgcctctctagccacatgtatttatttttatgaccacaactgttcatcttgaataaaaaatattcatattttcatattacaaactttttaccaatctcgagtcttcatctatttcatcctacacaatgtattttttcttcgagggagttctttccatacatgattaattatattttaattaatttccaaaaaaaaactttttctaggtctttcactttaaaaataacaatttttctctcatagcaaaaaactttttctttaacctattttcagccgtttttttatccgtccttttctgatcggagattgacggtcagtgtcttccatagcaccaacgtcgatcatcttttagtcttaattttcatgtttacttcgttttttattatgaatttgttgcaagtttcttcttcaaagttttatcgatgattctctcaaccttcaaccaatcgaccaaactaccatcaacaatcgttcttgtagttggtgttacggtaaaggcggcttcttttaagcttcctccattctaatcaacatacatatatgggtgaggtctattgtttttttattccttcaaacttgatgcaatcgatttaatatcgccatcatcggcccaagcacttttcggcagttgcaattccctctataatttggtttcgtcttgtcattcttatgtagctcaagatctttcattttcgaagtctccaaaaaataagtgaagactataaaaccgaaagtttagatgatgtccgttttcggagatgcatgaaatagcttctgattttagaaaaaattggttaactgaagaagaaagaagcaagtgataataattgtagttttgatgtcatttgtaacctgattatttggataatcattttctgttaattagttttgattatttgtcatctcgagcaataccggctttgtgtaatttctgttttcagttataccattaaataaaaaggtcttccactttttaaacactcatactatgggggttcgaacttaagcggaagtgacatactaacataagagtattttaaaacctctagaccatcaacccaactataaatatacgtggccaattcatgggctccgtcgatgaccataaaataacttgtgcattgactttgaagctaagccttaaaaaatcaaaacatatgtgtacattattcacattcctaatctcttacctaaacttaataaagcctcgtactgagagatcaaaacaaaacaaaacaaaacccaaacacttaccaaatcaatcaattatcgagaatcttccttcctttaatcctcaaaaaaaacaaaaacctttcttcacctcctttccttgattcatcctctaggttaatg

SEQ ID NO: 31045 - DNA, 3000 bp, Unknown; identical to SEQ ID NO: 10837
  misc_feature (1)..( 3000): 2750-1469P.txt file - cDNA_ID_3038195; gDNA_ID_2214452; Annot_ID_182585

SEQ ID NO: 31046 - DNA, 3000 bp, Unknown
  misc_feature (1)..( 3000): 2750-1469P.txt file - cDNA_ID_3038203; gDNA_ID_2214452; Annot_ID_182583
tgcattggtgtcccggcgaaaatgggagtctgcagtttcttgaaacatgtccaaatcccggagactgatgcatttgtgtaacagtggttcgaccgtcacagtcatacttaacaaggatcttggttcccaaaccgcagaaactagtggcgtttctcgagactccgtagccctccatggctctagagatggaagcaatgcaggtttcagataaatctgatgtgactccaagattagttgacaagttcgcgtaacgagccacggacaccgcaacaaaagcgttcatgtagcggcaacatttgcctctgttggttatgttggagcacacagtagctactagagtgaaatttgatccactgaaatctaatggacaatctgcaaacacacatgacaatgcagcattagtgtctggtaacctataaagattggtccgcaagtttcaagcttttaactttctaaccacaatagcttgaaaagaacaaacaaagtttgaatttttatggtttctcaagatctgatttcaatttaaaaagagagtatttttgcatgtaagcaactaatgaaccaaaattatgcgaatttccatcgaaactcaaatctagtcaaagaaagcaacaaaatttgcaaaatccagaagctcaaaatccaacattcataatcttatcctgatttaggcaagaacaggattaaataatgaagctttaaaagagaaagaaacagaggaaaatcgataaagagaaacctgcagccattagtgaaggcaattgggtagcaagtaatgcaattaatgccaacaagaaagcttgactattcacaaccatggccaagagcaaccagagagagaaagagagaagagagaacgagattataaaaaaggagtttaacggaaggtccctgtgtgaatatgacatgcgaggctctgtgtattgttttgtatactcactgacaagtgacaaggaaagagacaaattttagacttgtcaactattcaattcgtgatcataaacgaagacaattgtagaaaagcccctaactttctcatttcatctcctttctaacctacaagtttcttttatgcataacataccaacactaaacttgtgaatgttgaaggaaacataaaaaaatttgatattcagaaatttgtattagattagtttctttcctgtgaaatgatttggaccaacacaacaaaaatacatgattagtagtaggattaaaactgaaaacaaattaaaatggaggtcgcatgtttgtatcatgatgtctcatgccatttcgttaattattaacttttgtttgtttttattcgtttttttaagattataaaaacacacaaccgttgtatgattgtaatttgtaacaacaattgttaattcataattagtttctaagcaaatattctactttgtgataaaacgaataattatacctttgtctttatcttggagaagaagaaaggtatatattgcttgttaaaaaataaacaaacaagcatttatgaagtgtttggtgaagcgaaagcgacataaggataaaatggctcgagtgctttgggattgatcctaaatcatcccagttttagttttggatataaattctagaccgaattcaaaaacgagaaaatgagatggaagtagcaatgtgaacccaaatggaaatggtctacataacgttggtagggtcactcacatgtgcaacaccctgtcatatctcagacccctcaactgcaatatttttgtaaaggtttagatttattgtatgcaattttttcctacaacattccagtaatgccatgccatatacaaaacgtttatatggtcggtcttatgtaggcagggtcggcccgaaccttttttctgtatgtaggggttggatacggaatagatatcttataaaaagcaatatttgtgatccgttttgtaattaaggaatgactaataattaggtaattgttactaatcttaagctggttctagatgaatgattgtgtagattgtatgatagtcgaaaaggttacacaagttattgagtttgcaaattcataaaaggcaaaagaatcaaataagaagggatgtaaaaaatgtttcacgagtggttacaaatgtgagtgtgaattagagctgacgatttgggtccctacctacccaataaaaacaagattttgaaaaagaaaaacttcttgaaattctcgtccttgtgccaattttccatgatttgtaatttataacttcgagttggttcagacctatcccagacccaaactatgtgtgaactggtttaaggatattgttggcaaagtgggctatgattgggccggctgaatggatcatcaatggtttgtagaaggaatgtgaaactagttaaatggaaaaattgacgtgagaagctatgttaggaaagaaggtatgcaattgcgtgcaaacttttctaagtgtttgggctattgctatcatgccatatttgccttaacatcgtctaagcttcaaagccgtttcatctttctgtattagtaaaatgaaagaaaaataaaattctgtatatttgtttaagtcttttttttttcttatgtaaaaaacaattacaagataactcacattttattattgttgttgatatgtctttcccttataattgttgttgtgtaagaaagttccaggcagaaaaaggtcttagcattaaaaccaaaaaaaataagagttttgaaaaagagaccatgaaaaacaaaagtggcgaccaaaacaacaacaaacccactaattttgcagcatttattatcatcatgtcttcaccgactcacgcgcacttccgttcactctatttttatccttaaaatcctctcattgtatttactttattttatttgtttcttagaatctttttcacgcaaatgcaaaccaccaacaaatctatattctagcatgatgatgaagtagctacttgcttcttcttcttcttcttcttaaattttggggtttttactttttggtgaagacagccatg

SEQ ID NO: 31047 - DNA, 3003 bp, Unknown
  misc_feature (1)..( 3003): 2750-1469P.txt file - cDNA_ID_3038207; gDNA_ID_2214452; Annot_ID_182582
aaaagttttaagaagtttcgaaatcgttatgttgcaacttcatacctcagtcaaggataatagaggctaaagatagtagataattaaaaatgggccaacaaatcttgtgaaccagtttcttgatgtcttggaaaattatggaccgaaattctagcctgtattgggcccaatcttgcataatttaaaattagtcgatcgaacataactctttttgcctttctaactgtttttagtatctcttcagcgtgaaatgtgtaataacaatatcatctcttctattttcagtcagaagaaattgaaacatggtataccgaaatcagtttatgctaattcagaaggtaaatttttttaacagattggtaacgaccgttatttttggctttagaaggtttgactttaaaaatttgaggtacaaagaatttagctgtaaagactttggctgttaaaatcagattggtaaaacaaagttgtagaagctgtgactgttattttttattagtaacaataaaactttattactgatttttaaaaatatatattattcattcatttttaaaagaccaaacattgcattatttatatttattgtttcatgcacttaatatccaaacacttaatatccaaacacattaataattaaaatactcatcttgaatgattcttatggctaaatttttttctcaaaactgttttgaatgatttttttgacttatcataaaatcaacaaatttattaatgataatgaaatgacatctaactttattagtgttgatgataaaaaataaaattattattagtgaaatggatcttaaaaaaaaattagtaacttgataataattattaatcaaaaacgttttgaaaaaagaaatatgtaatttgtagagaacttttaattatgtttagagaagaaaacgaaaagcttttaatttgttttaaaagcctcatttacgtgactttcaaaaagaaaaataaaggaaaaagaaaaaaaaaagctttaaaaacttccaaaaaaaataaagtgaaaaaagtctgattggcaaaaaaaatactacaaaggctttaaaatccatttgaagccgtgaaagcagtgaagccgtgaccctatgaggttatgtcaatgttgtgataatgttgcctattttctttctctataaagggatagttatcattagttgaagaatgctaggatgttatgtaaataagaaagttaagcaatgttttcagtaaatttcttttagcacaaatttactatttttaagtgatgtctaatccaatttctttccaagttcaattttctttctctgcccatatctttacaaaccattatttttcggggtgaaactagttttgagaacaagttcgaacaaatggttgaaacttgagttgctttacggtatagtcaaatcatttgaaaaaaccatgttattaatttggaattccgactttctagtcatacaaaaaaaacaataaatgaaatacgagaaaagtagtgagtgagaaaagtgaaaatataatattcatacctcttgtttcatataacgttctaccaatcctcttgttcctgcatattaaaagtaactcatatcagaggagacatgttgtatcaaacaacaagcaacaacagataaacatttatctttttttttagtttctttttttaaaaccaagttgactatgttttagagcatcttcaatggtgagtttttaatattaattaatcaaaaataataatagaaaaggcaagagaataagaatggttcttattttaaagtatataaaatcttatttaaaatcccaaataccacatatcttagtataatgtcttaatatgatttgttcatttttatttatcacttaaaatttagttaaataacaaaattatatttaaataatattataatattgataagagacacttggtgaatatttcaccattagagatgctctttcttgtttgttgttacaaaataatacacccatccccaactatccttgaaaaatcactgatgttctctaatgaacgttctcacaaaaaggtaaatcatccgtaaatggccaaaaactccacactgataatcattattgataaacttttgctccgttcaattctcttttctaaatatgttatattatatattagtatttatttattaggaggttttgtcggcaacaaaaaaatagacaactctcgtaaataacaaaaataagttttcttatcaaatttagcacacaatcttcaaacttccaaaaataacatgaaattaatattaaaaagactaatataagcatttgattgataattcacacgatttgtgatttaaaatcataattaattttatatatttagataaaaataaattagttattatgtaaaattactaatgctaattttggaaatttgtgaagtttgtgttataattgtccataataaattttttcatgttattttaaagtatttctctataaaaagtaaaggttgggccaggtaaatgtacttattggactcaataaacaactcaaagatgattaaattcatatattttactatgaaatatgttttactataaaaaacagctcaaaatgctacatttcattattcctttctccatttcatttttaaaattcatactactcataaaagttcatagtatgactataagtttatgactagtttaactttcaactatctagctttcatatgattccctagttcaaagttatactactcataaatttagatactcatactatgaaatttttatatagcaaaaaaaaaattacatctcagtttgatatcaataactaaacatacctatgtaaaaacttacatagtctactacccaaaatatcaataattattgtagctcccactacccaaaagacaatgtccattgacttcacaagcttcttagtcttctctatttctatgctctaaaatctccttatatacatagtccccatacttatcctcaaaactcaccacaaaatctcatcaactcaatg

SEQ ID NO: 31048 - DNA, 3000 bp, Unknown; identical to SEQ ID NO: 10834
  misc_feature (1)..( 3000): 2750-1469P.txt file - cDNA_ID_3038211; gDNA_ID_2214452; Annot_ID_182579

SEQ ID NO: 31049 - DNA, 254 bp, Unknown; identical to SEQ ID NO: 490
  misc_feature (1)..( 254): 2750-1469P.txt file - cDNA_ID_3038249; gDNA_ID_1591418; Annot_ID_150961

SEQ ID NO: 31050 - DNA, 3000 bp, Unknown; identical to SEQ ID NO: 10851
  misc_feature (1)..( 3000): 2750-1469P.txt file - cDNA_ID_3038253; gDNA_ID_2214454; Annot_ID_182628

SEQ ID NO: 31051 - DNA, 3003 bp, Unknown
  misc_feature (1)..( 3003): 2750-1469P.txt file - cDNA_ID_3038268; gDNA_ID_2214454; Annot_ID_182620
ttccatcctcatgaatagtgttcaacccgttctctctggtatgtatattagctagttggcgcgagatggttattattacagtatcgaatataaaccgatatttgaaatattatgtgtcttggatcggttttaaccttaacaggagttgccgtcggagctggatggcaaggatatgttacttacgttaaccttgcttgctattaccttgtcggaattcctattggtattatccttggttatgtcgttggtttgcaagtgaaagtaagttttattttctttataattttctccttctttataacggtcttgaaaacaaaaatgtgtgaaagtaaaaaaattaacataaaaaaagttattctctaaattttcttagggcgtatggatcggaatgctctttggaatattcgttcagacttgtgtgcttaccgtcatgactctgagaacagattgggatcaacaggttataaatcgattactatgttttctaatttgttcctagcaagctatgtttttggtgcttattcttataccgtttgttgccaaatatattaggtgtcaacgtcgttgagacgtttaaatcggtgggttgtaccagaatctagagacgtaaaccaagtatcatcagaggaataaattggattctagattgtctttagcaccgtcacattttattcttaaaagctaaaatgtaacttttaggctatgttccaagattgtgaagacaagaatatgacaaatttgggtcgatttgatgtcctcgcaactaacttgtaataagattctaatgtttaaccaaaaaacgaaaacgagatcctaatttttggattaacactagatagtgttacatttagctatgattcatcaaacacaaaattattttggggtttataaccaaaaaaataaaaataaaaataaaaaatttactatttatgtgaaaagaataacaaaaattaaaatatttgggtgaccttctcaaatagtatagaaaatcacaccaattttattttgtactatttgagatattcatggtaagaaaccatagagcgatgctctaaagtctaaatagtgacagtttggttttaaaacatttaaaacaaatttgttgactaatagaactgaatttttttttgtctcatttaacaactgcaattgtaacatatatatatttttaatagaaataaattaacaaactttttttgatgatttatgaaaactatttaatgatataaatgtttggatactaaacttgaattatttctccgtcggctttgtttgaaaatatatagaaaaaacaattaacgggccatgtgcttgttgcaaataatctatttatttttcattttaggaattttgtttctcggcacgagttgggctgattttgataagcccacatgacattgttttagggtttctgtttttcttctttatactttttaaaacgcggccagtgaataattttctaaggtttatgctttaatcaatgagatcagttagagagagagatagagagttttgtacagaaaaactccatagtggttcatattcacaactttatccttcaagtccaaaaaatacaaaataatcttatgaagtccaaaataatacgcaatataatctttttttcactattgtcaaatttaaattttttgataaataatataccaaatcaaagatctctagataaggagttcaactttatcttcagaattctcaaaaactaatgtatgagatcgtgaaaacattctaatatatgtaaaattaaaaaatggactatattgcgtattattttgtatttttaggacgtataggataaaattataaaaatagacgattttaaggttttttttcataaaaccttttttttaatacaagttaaataatttttttgtaaataattttttgttggaatgtcaaatttattcaacaaaagaaaatgattacaaagagttttgaaagctaaaaaatagagaaaataaacgtgaaaagtagaaacaaaaataatggaattggcgccacttacatcattacagaaagttcaaaaggcctaattctgacacaatattattaacgggccatgggcttaatgacaataataaacttttctcacttttgagttttaataagcccacatttgctttagggtttctgcgtctctacctttaaattgcttccgacgattcataaactagggtttctgcctttagccgtcgtgagagagagagcaaatcgaagagagagcaaagagaaaataatatgttgtttgcgtttggtacggtgactcgatctgtggctaattcagtggtggtttgctacggctttctttcgacaatggtgttttctttcgacctaaacttgatagaccgaaccaaactgaaccaatttttatatatatttactcaattaaatcctaaactcctctatttgatctgaacccgatcaacccgaatacataaatatctaatcttatccatctgaaaggatactaaactctctaattcgaattacccgaatccagaaaaagccgaatagcatgcattctattggtacttgattatattaattggcatatatatgacctgttattgccaataatatattttgggtgtttcctgggcttcagttttattgggctaggaatgggtgtacttttaaacccacttctgattagtctcttagtaaaacccacttttaaacccacttctgacccacttctgacgccgtcatttttcttgagaaggagagagagcaccacttccgtcattccagcccaatatttttaacgggccatgggcttattgtaaataatgtatttttctcatttttggttttctttatgggcacgattttagtgggctgaattttgataaaggcccacatatgaaagatatttagggttttttctcttgataccttttaaaacgccgtcgagaaatctccctctagggtttctttgatcaaaccagagagccgtcagggagagcaaaacaaagatcggagaagatg

SEQ ID NO: 31052 - DNA, 3003 bp, Unknown
  misc_feature (1)..( 3003): 2750-1469P.txt file - cDNA_ID_3038272; gDNA_ID_2214454; Annot_ID_182619
tttttttctacaattatttattaaaatttaaatgccaaattggtatcaaccactaatttgggtttaaaaacaaatacatatctttgttggatcagaagaatagttgtggtattgaaccgttggattgaaccagaatgtaaagattaaacgagacttcacaaacagaacaaataatatttgttcgggagaattctctaatctatataacaatatcttaaataatttaatttcttaagtctttctaccaatttttttttttacaaccatatttcattaagaaagttcaaaggactactacagagggaagcccaattactacaatgaaaatacaacctaagttttaagaaaacctagatgctgacacgtgttgaagtcttctgcttcatcaagccacgcatcagttgatcgagcgctgccgtgtttttctcgccaaacatcaccgccttagatcagccaccgtcgatccgtcgtggagcgatgggtggttgcctcctgtctgacgatctcgaacccaagccgtaaacgccgagaacctccagatctatcatatggtatgcttcaagagttctccgagcaaatccaactcctgggaagttccatcacagacaacacctttactgatgcagtcgaaacattgctccaaattcacgaacaaagaaagataatgaagatattactcctcgagatgattgggaggatcggatgaacctcgaggggcagttggacaagagattagtctcgccgtcgcgagaaaacaaaaaccggactactctagtagactgacatccgactagaagtcgaaaacttatttaaatctaatataaatctatatctactaaatcaacagtcactttatcacaaactgcaacattctcctgtttacacgtaagcaaagtcttaatttattgagttttgatttttctgaagcgtaaaacaataattcttttctcattaacataaattattaaagagatttaatccataatttatttctttctttctcgccatcttcatcactatcttccccattccccatatcttgcaacagttattgctaatttatgttgtttcatcttctatgcaattttctaattacgaatctcaaatttttcacattcggatcagttattttcttttccgcctgctttacaccatgacgccatggcagattaacaatccttacattttttttgctgcttgccattctcaaaccaaaattcatctcactctcccttctcattcgaggtcagttatggctgaagaagaggtcaaccacaacgactgtatattcaattaaggtatcaaatttgtaaaatttctgaattattataattttcagttttccatatattgttttggctttcagttttaacatcattttctttatactttgtgaattattacaattttcatctaatcacatctcattgttggctattaatgttgtcaagagaaagtgtttgagaatctgactttaagacgacatgggtttcgttttcaggatcccgtgtgaaacattttcagaaaaataaaactcttacacgatcatgagtcatgactaacccaatgacatgctaaggttatcaattctcaattagttcttcctttattttttatttaaaaaaatagttgatcttatatttttaaactcaaatatagtgctagacaaattgactttttgattttgtgaaatcacagtaaaacaaaaaacgaagccatacaagcacaagatgtactgatatacactagagaaaaccaaaattttttcagttttaaaatggtgatatagatgaacacaagagtcatatatctgaaaagctgagactatacgacaaaggaaaacagaaacagaagaaaaagatatccataaggttgtaaaacatgttttctcatgcaattgaatcttcaatagaattggattgattacaaatttatggaccattggatttttgttatgctagaatctttagaactttggaaatttcgagttatgaggtttagaagttaggcattattgaaattgtacgacgaatagactatatagagaatatatattttattttttattttttgggcaaaaaagaatatgcttttacctgtttttctaaaaaaaagttatcttacacaggacacactaaagataacgctttcaaacaaaagaatttattttttatcaaattatttttgtcccgaacgtagtccaggcttcatactagtaatatttataagtccgaataaatccgaaaataaacccagacgatatagagcctcttctctctgaaaaattagaagagataaaagaaaagaaactctcttgtattttgcaagattttattttcggtttaacggaaatcgcctgctccccaaaaaaaaaagagtttttttaactgaaataagtctttctaccaatcttgttagcagaaaaatgtgacaatagtagtagttcgatacgctcgtgacttgattcttgtctttttatggtttatggtgtagcaaaattaaataattgttagtttttctattttattatataaaacaatatagaatgatttaattattttatttcttagaatgttttataagtttcaactttcaatacatgactatttgtattttataattggttgaatcaaatatcaaataataaatttgtttactaaaacattattatatattttctatattatgaaacataggtaggtttgttagtcaaaataaatggtctataaaatgcaagatatcttagctaggtgtctataaaccactcactgctacttgctgcttggcgtagacggcttttcgtttcccaataaaaatgacgatttttaagcaaacaaaaaaacattaatctataaagacaacaaaaaaaacagagttgttctcataaaccaattcatacacaaacactctagtctcctctctttttctctgccttctctcttttatttattccctccttccctctggtcctccatcagatacaacaacagagactccaagatg

SEQ ID NO: 31053 - DNA, 3000 bp, Unknown; identical to SEQ ID NO: 10515
  misc_feature (1)..( 3000): 2750-1469P.txt file - cDNA_ID_3038276; gDNA_ID_2214454; Annot_ID_182612

SEQ ID NO: 31054 - DNA, 3000 bp, Unknown; identical to SEQ ID NO: 10515
  misc_feature (1)..( 3000): 2750-1469P.txt file - cDNA_ID_3038276; gDNA_ID_2213656; Annot_ID_181775

SEQ ID NO: 31055 - DNA, 3003 bp, Unknown
  misc_feature (1)..( 3003): 2750-1469P.txt file - cDNA_ID_3038294; gDNA_ID_2214456; Annot_ID_182663
tcttccctttcggaattgcccaaatgaagctgccaacaatgaccttttaaggaggcaaacacacatagttaagcataagaaatctaaattcatctaaggaatttgataacaagcgtaagctcacctggacttggcttgctgctattagaggacctccaattccaccaccaatgacacgaccatcggggctagcaagtgagaccgctagacttccagtgcggtttgggtagtcattgtcagttgtgttcagataagaagttgagagagatatgagctcgaatagaccctataagtttcaaagtatacaccaaaataagtaatgtttttgtcttctaaaagataataaaatgtgagtgatgattcaataaaacctcgtatataatagttccatgagaaggtgctggctgaagaagagttgcagtagagacagcaccacttgcggataagacacatatcgctcgtggaccttgatgcgagaacgatataacctttgaagcaatgtcctgaaagcaacaccgagagtatggttatctcaagaactagaggcaagattacaaagaaaaaaaagaacagatttattcaagaggagacagaagaaacatacttcaccaatggaaactacgattacatgcggtgtgaagctcatcccagttgatgaaggcatcatttcaccttacaaaaaagaatcaaatgtcttcagaaaaatcacagctaattgtaatcagggagaaacagagcaataacaaagtttaagagaaaggccaaggaataataaaagaataaatattgaattcaacaatttgacattataaaattccacagctttaattaatccttaacagttcgaattagcttataataaacttcccaccaatgtcctcatttgaaaaactatatcatcaattaagctcaaaacttcccaccatattcagagccaatgtccttgtcggaaaataaaactcataagttagagattagggatattaccaatggaagatagccgttgcttcttgccggagccaggaggtcttccacggccacgtttgttagagttcggggaaacgttggagatagaaggagacaatgccaacgaaacagaaccaccatcttgtccatattttctaggccgtcctctcttccgcttcacagacgtgtcacctgaaggaggagcaaccaaagctcccgccgccgccgctgacgaatcagccggagaagagtcaacgggtaaaggaggagacacgaatccagtagagacacctccagggtttggatttgggtttgggtttgacccaaaaggagagatggaattggtgaaatgatgaaatccttgtgatccgtgaaacgttggttgagtttgaggaggaggaggaccagaaccggggattcctctttggatatagtaagaacccgacccggataacgccattgcgtctcttcgatccatagcttaaccaaaaagactctgactttaacttagtaaaattcgatggggaccctaaatggctaacttataggaggagggataagaagagaacaaaatcagaatctaaaagggttcgatagacttcaagagcaagataacaacatgcaaccgaaaatctctgaaaacttatcaaaacacacaaactttcatttcacctaattgttttttatgtagctttagtatcaagctatgagaaaatctcaagatgaaattagatccaaaagagaaaaggaaagaactttaattttcttcatctcttcttctctgtttcattctctcaccaaaagcaaagaaatgaagtgtgaataagctttctcatccatcaatcaacaatggtgaagaaaaaaaaaagttttctagggttctctctctttctttcttcagagtgtatgtgatgttgctttttttcttttactgggtgacagagggaaaacagaaacaaacaaaaaaagatcctttctccaagcatttactgtggattacaatacaatgggatgatgaggcaggatttcaaaattcgaaattaaatttgaagtctctgacttttgactgtgatataagctctctctctatctctctaatagacttctttctagcatctagcaatttgtaggagggatccatccatccatcatcatcatcatctttgtgtggctcattctcaacgctatagattaggtgcgtgtatcaaacgaagcattgggaatgagagagtgaatctcacgcttctgatgtcgagagtgagagaatagtgatgtgatctagtcaagactttctttgttcctcactggcttccacttcatcataagctttcaaaatttatgaatcccccaatctatctttagactctattttaccataaatacttgagactaatgattatatattggcattaagagacatataacatgaatataaattcccattttgtggagtaaatattgttcttgtctctgttctgttcactttaaatcttcatttttctctacaaacaataatcattaggacccaagagtttatcaacaatacagaatctgaacgtttagtactcatgtcatgtgaagtgaagtgaagaagatcaacaagaacattaattgtttgctataatcttctatgggccggataggaataattaggcccagtatctaacacatcaaacaaaaacacatcgaagtcgaatcgtcggtgggataattaggcccagtatattcaaacaaaataacatttaacagatccaagtccaatgttgtcgtggaacgaacgtcgtttagaataattaagcccagtatttaacatatcaaagcccaatgttgtcctaaaacgacgacgtttgaatgtggaacgtaaacaatcctggaacaaccgtttcaactacctttttcctatcacttgttttttcacctctcgaagtcctccgatttgctacccttacgcagcctcatgtgtcaaccaccatttctcttcttcatcttcgtctctatcaaaccctaaacctaaaaccccttattttcccgccaatg

SEQ ID NO: 31056 - DNA, 3003 bp, Unknown
  misc_feature (1)..( 3003): 2750-1469P.txt file - cDNA_ID_3038306; gDNA_ID_2214456; Annot_ID_132950
acgcaagcttggacattgtcttccctgattggtccttttggggctggtaagcagcccaataagatgataaaaggcttattgttgttactgatttgttaatatttgggcttctaatgagccagggctgaagtgaacgtaaaaccatgggggaaatcgttggaggcaataaaagaagggaacagtatgacgcaatggaaggaccgcgtggcgtacgcttattggagaggtaatccttatgttgatcctggaagaggagatcttctcaagtgtaatgctacagaacatgaagagtggaatactcgtctctatattcaggtttctcccaaatttcactttccaaaagattatgatataaatataagttttgtgatagattatctgaatttgaataatgttgcttttaaaggattgggataaagaaacaaaagaaggattcaagaactcaaatctagagaaccagtgcactcataggtaaaaagaaagaaagtattactatactttttattttatttttaattactataagtcttcgattcttcttttatggaattaaaacagatacaagatatatatagaaggatgggcatggtcggttagcgagaaatacataatggcatgtgactcaatgacattatatgtaaaaccaagattctacgatttctacatacgaggaatgatgccattacaacattattggccaatcagagacgattccaagtgtacttctctcaaattcgccgtacattggggcaatacacacgaggacaaggtccatatatctaactaaagatttcttacatctttaatctttacgtctgatttgtatcaatttaaccctgtgtttgttgttgtgtataggctcgtgagataggagaggtaggaagtagatttataagagaggaggtgaatatgcagtatgtgtatgactatatgtttcatttactcaaagagtatgcaacactcttgaaatttaagccggagattccgttagatgcagaggagatcacgccggatagtatggggtgtcccgcgacggaaaggtggagagattttaaggcggagtcaatgattatatctcctagtgaagagtctccttgtgagatgcttcctccttatgatcctctagctttaaaagaggttcttgagagaaaagctaatttaactcgtcaggttgagttgtgggaaaaccaatactttcaaaatcttaccaacaaaccttaaattgttttgttttttccttcttcgttgacgagatcaaccgcaaccaaatagttcagtcgtgggaggatcaatactctcttgatttgacttataaaccttgatttttttttctatcatcattaaccatttgtcgaatatacttttcaaagtatactttgtttatggtcttgttatatgctcatctcattgatccttttaaattagattatcagaagagatatgtaagtctttcgaatacatctacattctagctcgtatataaataagaagaagtgaaaaaaatttaaacgatttttggcatgaagtgattttgttgtcaaagtgaattaaatacagaaatttggagggcactattgttatattaagataaggtgggaactagtcctaaacttggcctatcatggcaaacctttttttctaatatcctgccaatctttttgaccaattgaatattctttttctttcttagaaatttcttaatcattcatctcatctcaactagaaagttttttttttcaaaagtaacttataatttctttcattgttggtaattttgtgagatcactcgggctccataagtctgtttcattgacaaaaagaaacaactgtaagaatattttctcccaaaattaataaattaattaacatggaatatatatacgtaggtgggttgacttgacttagttaggctttggctatggttctccttaaagcctttataaaataagccagcactaattaaatatcagtcatgatctttttaaaacacatgctgaaaattgtttttttttaaaaatcaaacatataattgtactaatttagacctccaaacccttaaatcaacccattttctacctcataaaagagatccatgataagtgagctctgcttcatctctttctagttcttgtgttcttgttgtgttttgtccgatgagagagaacacacaagtggctcaattcacagaagatcatcaccagagacatcaaaccccaataacttgtttaagctctaaactagcaaagatatggacattgttcaccaccaaaatcttcatcttcgtcctcttcatcatcctccttagtgcttctgtctcttggatgtatgcggtatatatttttctctttctcttgatccaccagtcatatctatatataaacctctttcttttggcttgatgataaattatacatataacaatatctcatacgacacgttaaagagaattatatattgtaaccagtgtgtgtttgtttgttttctctactctttaacccatttaaataatttcatattttgctacttatatacttgtattccgaagttggatcttaaattattttacgtggtgtcgttaaaaagtttgttttaggtgagaataaattccaagtgacatcaatattcacaagaaacaccaaaaaaagcactcccacaaaaacaacaacaactacagatatccccaagatcgccatcaagatcccattaaactgcacatcactcaacagcaacacaacacaaacatgtccttcaaattacccaaccaagttcgaaccagcgatctcttcctcggagacatgtcctgactacttcaagtggatccaccgagacttaaaggtatggcaaaagacagggatcacaagggaaacactagagagagcaagaccaaatgctcacttcaggatagtgataaagtcagggagattgtacgttcatcaatacgagaaagcatttcagacaagagatgtgttcacaatctggggaatacttcagcttctaaggatg

SEQ ID NO: 31057 - DNA, 3003 bp, Unknown
  misc_feature (1)..( 3003): 2750-1469P.txt file - cDNA_ID_3038306; gDNA_ID_2214456; Annot_ID_182659
ttttttgttatcttcatacttttgtgttgcgtttctgttgattctccttttatgtatcctctcggctctctcgttaatcttttattacataaactcgtgcatcaacataaacacaaaacagaagcatgaagatgaataacaacgacggccaacataataaaacggtgacatttcctcgaaaaagcatcgtgaaggctactgttttcatcgtcgttctattcatttcagctgctatcttagacttactgggctatctcgatttcgtgggttttaatatcaccttacattcttggtttatctttaatataaatcgcagtagttaacgttaatcataatcataatttgtcttattgttttgttttatagaatgcttttgcaggtttaaagctaacaacaaagacaaaagaaccaaatccttacggatgcgacttcgtacagaaccaatcaagtcaaactcctatctcacaaaaccgcaaatcgagattaaaccccaacaacagttcaaaatcatccacgtgtccttcttatttccgttggatccatgaagatctacggccatggaaacaaacggggataactagagggatgatcgaagaagcgagtagaacggcgcattttagattggtgatccgtaacgggaaggcgtacgttaagagatataagaagtcaatacaaacaagagatgaatttactctgtggggaatcttacagttgttacggtggtaccctggtaaattacctgatctcgagctaatgttcgacgctgatgatcgtcccgtcgtccgatcagttgactttattggtcaacagaaggaaccacctccagttttccgttactgttcagatgacgcaagcttggacattgtcttccctgattggtccttttggggctggtaagcagcccaataagatgataaaaggcttattgttgttactgatttgttaatatttgggcttctaatgagccagggctgaagtgaacgtaaaaccatgggggaaatcgttggaggcaataaaagaagggaacagtatgacgcaatggaaggaccgcgtggcgtacgcttattggagaggtaatccttatgttgatcctggaagaggagatcttctcaagtgtaatgctacagaacatgaagagtggaatactcgtctctatattcaggtttctcccaaatttcactttccaaaagattatgatataaatataagttttgtgatagattatctgaatttgaataatgttgcttttaaaggattgggataaagaaacaaaagaaggattcaagaactcaaatctagagaaccagtgcactcataggtaaaaagaaagaaagtattactatactttttattttatttttaattactataagtcttcgattcttcttttatggaattaaaacagatacaagatatatatagaaggatgggcatggtcggttagcgagaaatacataatggcatgtgactcaatgacattatatgtaaaaccaagattctacgatttctacatacgaggaatgatgccattacaacattattggccaatcagagacgattccaagtgtacttctctcaaattcgccgtacattggggcaatacacacgaggacaaggtccatatatctaactaaagatttcttacatctttaatctttacgtctgatttgtatcaatttaaccctgtgtttgttgttgtgtataggctcgtgagataggagaggtaggaagtagatttataagagaggaggtgaatatgcagtatgtgtatgactatatgtttcatttactcaaagagtatgcaacactcttgaaatttaagccggagattccgttagatgcagaggagatcacgccggatagtatggggtgtcccgcgacggaaaggtggagagattttaaggcggagtcaatgattatatctcctagtgaagagtctccttgtgagatgcttcctccttatgatcctctagctttaaaagaggttcttgagagaaaagctaatttaactcgtcaggttgagttgtgggaaaaccaatactttcaaaatcttaccaacaaaccttaaattgttttgttttttccttcttcgttgacgagatcaaccgcaaccaaatagttcagtcgtgggaggatcaatactctcttgatttgacttataaaccttgatttttttttctatcatcattaaccatttgtcgaatatacttttcaaagtatactttgtttatggtcttgttatatgctcatctcattgatccttttaaattagattatcagaagagatatgtaagtctttcgaatacatctacattctagctcgtatataaataagaagaagtgaaaaaaatttaaacgatttttggcatgaagtgattttgttgtcaaagtgaattaaatacagaaatttggagggcactattgttatattaagataaggtgggaactagtcctaaacttggcctatcatggcaaacctttttttctaatatcctgccaatctttttgaccaattgaatattctttttctttcttagaaatttcttaatcattcatctcatctcaactagaaagttttttttttcaaaagtaacttataatttctttcattgttggtaattttgtgagatcactcgggctccataagtctgtttcattgacaaaaagaaacaactgtaagaatattttctcccaaaattaataaattaattaacatggaatatatatacgtaggtgggttgacttgacttagttaggctttggctatggttctccttaaagcctttataaaataagccagcactaattaaatatcagtcatgatctttttaaaacacatgctgaaaattgtttttttttaaaaatcaaacatataattgtactaatttagacctccaaacccttaaatcaacccattttctacctcataaaagagatccatgataagtgagctctgcttcatctctttctagttcttgtgttcttgttgtgttttgtccgatg

SEQ ID NO: 31058 - DNA, 3003 bp, Unknown; identical to SEQ ID NO: 26880
  misc_feature (1)..( 3003): 2750-1469P.txt file - cDNA_ID_3038314; gDNA_ID_2214456; Annot_ID_182654

SEQ ID NO: 31059 - DNA, 3003 bp, Unknown; identical to SEQ ID NO: 26883
  misc_feature (1)..( 3003): 2750-1469P.txt file - cDNA_ID_3038318; gDNA_ID_2214456; Annot_ID_182652

SEQ ID NO: 31060 - DNA, 3000 bp, Unknown
  misc_feature (1)..( 3000): 2750-1469P.txt file - cDNA_ID_3038321; gDNA_ID_2214456; Annot_ID_132943
ttagtatatttacctgtgacgtcgattttcataatttacagtttttttttctttttcttgcattatattgacacatatttgagataactaaagttattatatttgtttggaacaaaacgttaataaaggcaatttgttttcgttaataaaggcaatttgtttggaacaaaacgttactgatgatagttatcatatttgggcgatggttaattacaaacttacaagttattataatttattttagagaatattatattgtgagacacttttaaaaagttatttgtcgatttaggcatttttaagttatgagacacttttgttagacaaaattctcgatttgccctttaactatatctctcctacatttacgctaacaattcttcttattataattctctctctttctcgatacaattcatctctctctctcttccccccctccaattcaatccatctcccccaattcaatccatcggttcacggtaatttcacaacaacaaaacaaaatcttttttcttttctccttcctcactccaaaaacaaaatttcacaatcaatcaattgttgtgaaccaagcttctcgctcaaattgattcttcatatcttctttcttatggcgacatgagttagaacgttatcgaccgcttgatcaacatcaccggcgcttctgacgtcgtcgtcgttcataaactcaaggtgatttgagtttactcatctccattcatgtttacttttgtcttgcttcgtgattcttcgtgtttttgaggtgtcatagtctggttttgatgttattggaagtttctagaatcggtatagtggaaagtttgatgtgacgagatgcaggaagtttcaatgttgcagaaatttgaaaaattgttgtgagattgtggatttgattgattgtggaattgaaattgtttggaattgaaggtataaactaaccttaactcttatgatgaaattagattgatttgaacgatttattcagactttgattttgctagtggagagtattagcgtcaatttacacatatatagtatttgattgagacacatttatctctttaggtttgatatggaggagtgaagtgcatcccttgatttttgtgtggttatttctcctataaaactaaagattaatggtttggtttactaaaagcttccaagtgtttggtgatcttgttcataattctatgataatgttagataacttctctgccccgtttgtttgaaattcagtacttgatgttctctattggactacaacatttggacaatccgtaatggacaaccacgtattttgtttgcagcatatgtgtctataaacaagtgatcaacccacataacgatgagagtgtctataaacaagtgaactagtggtcaacaaaaaatggacgctactcgtgaaattggtgatattcattgatgtatgaacttttgtgtgttggtatgatttgttttgaccaagttgtgattcttgcatcaccaatgatactcttattcattcaaattataattgatgaaagctctaaacatgaatcatttgtgttcaagtgtttgtcatgtttcaccattactccatatggtcaagtttaagtggatgagttatcatggacacaaactatcattatctacttggatttagcgtgttgatgtttgaaagtaatgtctacagattgttcttgtgttttggagacctatatgattattagtttctacataatgaaatcgtgttggaagctttgataataacatgtccacttagacgtgaccatgtggaaataattgattctcgtatgcaaagtaaaatactcttaacttagaagttcaacgatattatcaatttatcgagccaaaatcatatgataccaaacaagctgatcaaatggatataaaattcaatactggaattggccaatttggtttattcacaacctggtggttcatgaaatcgaaaaataaattatttaagagcaaaaacagaaaacgatagaaaaacgaagaggatgtgaatatgtgatgatattaccatggcagttctttaaatccaacagatcctctcttataaaaatcagattcatattctgaagttggtgatctgaaaaattctccttaatcaaagcagacacggagaaatcgggagatccgattaactggaaaaataaagttgaatctgattgttcaatcaatctctctttttgtagaaagctgatgatttgttgaagaaggaagaaagaaagaagttgatgatttcttctttgcaaacgttcaacaacttttttctctctttaatggcgtaaaaaaaatgtaaattttgaagatttgttttcttgattttttatttttgataaagcgagagaaagagagagaatggatacgaaaaagagagagacaaaatctcaagggtaattttgtctattttctcaccaaaaacaagataaagtgcctaaactcttaaaagtgtctaaaacggaaaaacatttcttaaaagtgcctcatagtgtcacattccctttattttattattattctattcgatttctagttacttcaagatttttccagttgttaatctgaactgaaatttacttcaaaaaaagctgtatttatttagtacgtagagtttttcatgtatgattttagtggagtttattatttacggacaaatctgtaacgtagttaacctatgcgataatcgttatttccttcaattcggtgaggaataacaataaaacatgttcttttatagtggattgcggcataaatgcgatgttagacgttatatttctgtaaattcgacatcatctttttctagcatccttatcttcaaagaatataaagacttaagacctaatctagttgagtaaggtatgagattcgagttttttcttttccaaattttcgtgactactataagtaatattaaattatgaagtgaaattgtaatctatcaaccaaaagcaaagaaagagagggggaaaaaacacaaggaaaaaaatg

SEQ ID NO: 31061 - DNA, 3000 bp, Unknown; identical to SEQ ID NO: 31060
  misc_feature (1)..( 3000): 2750-1469P.txt file - cDNA_ID_3038321; gDNA_ID_2214456; Annot_ID_182651

SEQ ID NO: 31062 - DNA, 3000 bp, Unknown; identical to SEQ ID NO: 10859
  misc_feature (1)..( 3000): 2750-1469P.txt file - cDNA_ID_3038325; gDNA_ID_2214456; Annot_ID_182650

SEQ ID NO: 31063 - DNA, 3003 bp, Unknown; identical to SEQ ID NO: 26889
  misc_feature (1)..( 3003): 2750-1469P.txt file - cDNA_ID_3038346; gDNA_ID_2214456; Annot_ID_182641

SEQ ID NO: 31064 - DNA, 3003 bp, Unknown; identical to SEQ ID NO: 18341
  misc_feature (1)..( 3003): 2750-1469P.txt file - cDNA_ID_3038361; gDNA_ID_2214458; Annot_ID_182716

SEQ ID NO: 31065 - DNA, 3000 bp, Unknown; identical to SEQ ID NO: 7186
  misc_feature (1)..( 3000): 2750-1469P.txt file - cDNA_ID_3038365; gDNA_ID_2214458; Annot_ID_182711

SEQ ID NO: 31066 - DNA, 3000 bp, Unknown; identical to SEQ ID NO: 28240
  misc_feature (1)..( 3000): 2750-1469P.txt file - cDNA_ID_3038448; gDNA_ID_2214460; Annot_ID_182729

SEQ ID NO: 31067 - DNA, 3000 bp, Unknown; identical to SEQ ID NO: 26894
  misc_feature (1)..( 3000): 2750-1469P.txt file - cDNA_ID_3038455; gDNA_ID_2214460; Annot_ID_182726

SEQ ID NO: 31068 - DNA, 3000 bp, Unknown; identical to SEQ ID NO: 10906
  misc_feature (1)..( 3000): 2750-1469P.txt file - cDNA_ID_3038487; gDNA_ID_2214461; Annot_ID_182782

SEQ ID NO: 31069 - DNA, 3000 bp, Unknown; identical to SEQ ID NO: 10898
  misc_feature (1)..( 3000): 2750-1469P.txt file - cDNA_ID_3038491; gDNA_ID_2214461; Annot_ID_182779

SEQ ID NO: 31070 - DNA, 3000 bp, Unknown
  misc_feature (1)..( 3000): 2750-1469P.txt file - cDNA_ID_3038501; gDNA_ID_2214461; Annot_ID_182771
tattttaaagttggcgataaaatgatgagagagatttaaatgcgccattatgcattaattaatacaagaatctttatgggatcatgtgcatttccttaatctaatcttttttggtgacagtgtatcagatgccaacatgtatttgaaacaattttttataattatagtataattgtagtgtagctacgaccaaacaaagaattacccgtaaagaagagctggctatgtggccatgtgcttggtgcttcaatttccttataaactactcacttctaatggaaaaatggctcagaagaatatcaactaaaagtagataagatatattgtctttaagctacatacaagttacaacgatccatttattagtgatagcgttatcattttatttttatactattgtaaatttactagtaaactataaatgttatatacggaatgaacgtttagatatctaatatatttcctcaaagataaacactttcaaagagatatatccatggaactgggtattatatttgtatatacgaactttactaataagtaataagtatatttttataatcgatatatacgtaggctatagtgggaaatataaaattctgggcataaatatggctactaaaattttaacattaaacaatgtacacgaaattgtttagaattgttatgtatgctgtaagttccaacgaaaaatacaaaactatgagcaagataatatatataaataaaagaaacgatgatatatcatttgtaagcataagtatacatattacttttctcttttagtgttatattagtgtaaataaaatatagtgagaaaagggaaaagagagaggggatgcatgtgactggcacgacatgaaggatagtggttcgatgtttggactttgtttaagtgttagcaaacgatctttcgttgccatttcacgttgccacatatatttttattaccttttcattatttttaatttattttgtcaacggtcgaattacggtattttatgtacacatatatgaatatatgataataccaaaaactcaagttggactttgggaccgactttcgtgagggatcttcctattgagtgaccacttctaaattgaaatcataaattctattaccaaaaaggtcgagactaatgcttagattggtagatgcatacatatttcccttgatatgacatttaaactctcaatccggcttgattagctcgagtgaaagagtatcaatatatagtttagttatatattttaaaaaatgttcttgattatattttatgaaaaatggatgttttcttatgaaagttttagtttcaaattttgtttgccttatctttgttactcggtatatatattcaaagcgtgtaattacatagattgataccttgatcgtttggataggttaaatatgtgtgtgaatgtgcttagccttgatcgtttggatatgttgttgtatttgcgttaataaagtagttaaaaaaaatctatataacaagagaaaaaatgtaggttctttgagtagatttgtgaaattattttccgattgtattgttcaccaaatgatcctccactttatttgttcaagtaaatgatcattctgctaactataaacaaaaaagaaatgttcatgggataatatctcttgtcgaaaaaacaataaaaaattatatgaaaactattttttttaaaatcctattatgtaaaatattgtttattgtttaaatagaaacgctaatgtcaaacgctaaattagcattcttttaactttgtttcacacaaattaaaagaaaatactgatttttgtgagttcagttttttttttttttaaacattaaagaaacggtaacagtgtttggaccaaaccaaaaattggaacgggacagtttttccaataactttttgtgctactgttcaatgtagatgggcttttaaatgtaaggcactattgagtctggcgttttcaaagcccagtaggagagatgtgtgatactttttagtttttaaagaaaggaaaaagggcttttgagctgctagatagagaaaagtaatcgatataaagacgtttgactcagaaaattgcatataaaagttttgaagctttgcttggaggaaaagcaacaattcgtctttttggagatgagaattgacttcacaacgcatttcattgacttttcgttgtaatttgtaaactaacccttacgcaatttacttgcaacattcttataattaacaaatatcctattcatatcccttcaagccttttctctctttataatttttttgattatttccagaaacttgtgcggaaagtacgttttcaagtttgatatcttcacatactttttttttaaaatatgaatgaagaaccgtacgttgtgatctatatattgtaggttaaattattgtgatccgagtaagttatatcgtcacttatcaagaatttttggtccacataatttgttcaaatggatagaaagttcatctaataatatcgagttaaaccatttacgaaaactgatgttgttcaaatttctatgaatttcggaaatcgttgggtgtcggcatattatcgatttcatatttgaaaatataaatatatcgtcaattataaaatttgaaacattataacggatatgaaaaagatgatctgacataaacttttggaattaattactatgctagaaaattctatgagattagtagatagataacttggaagaagaaaaagggaaaattagaaaatgcagcagaccaaagtagtgataggtggtgcacacgtttttggtgttgacctacgacaacgacaacgacagacaaaaatttatcatcatacaaaacctttctttgtctttatctcattttgttttcttaatatcctctgtttcttcttctaattttctctgtttttattccttctacttctgagatccataaagattcatctcttattacttcatcggaaaagaaacctcgatttcagttttcttgatctctctaatg

SEQ ID NO: 31071 - DNA, 3003 bp, Unknown; identical to SEQ ID NO: 21649
  misc_feature (1)..( 3003): 2750-1469P.txt file - cDNA_ID_3038523; gDNA_ID_2214462; Annot_ID_182816

SEQ ID NO: 31072 - DNA, 3003 bp, Unknown; identical to SEQ ID NO: 26902
  misc_feature (1)..( 3003): 2750-1469P.txt file - cDNA_ID_3038527; gDNA_ID_2214462; Annot_ID_182813

SEQ ID NO: 31073 - DNA, 3000 bp, Unknown
  misc_feature (1)..( 3000): 2750-1469P.txt file - cDNA_ID_3038539; gDNA_ID_2214462; Annot_ID_182810
atgaagctcaagttactatctttggtggtggataatgtgacaggggctagggatcgtttgtcttggggagggtgttccaatggtaaatttacagtcaagtcagcttattcttttttaagcttggactggagttcgaagcagcagatggcgcgttttttctctagaatttggcgtgttgtagctcatgaaagagttcgagtgttcatatggttggctgcaaatcaggtgttgatgacgaatgttgagagacacagacggcacttatgtgattcgagcttatgttcagtatgcaagagtggggaggagacaattctacacattttacgggactgtccggcgatggcgggaatttggacccgcttgttaccagcacggagactctcttctttcttttcgaaatcgctgttagaatggatctatgcaaatttaggagaggagatagagattaatggttgtccatgggcggtcactttttcgcaggccatatggtgggggtggaaatggcgttgcggtaacatctttggcgagaacaggaagtgtcgggatcgggttcgttttattaaggatcgtgcgttggatgtttagaaggcgcatgtgcacaaaatgggagtgacgacgcggacagctagggaggagagattgattgcgtggtctccgccaagggtgggttggtttaagctcaatactgatggggcttcgcgtggtaacccgggactagctacagtaggtggagtagttcgagacggggatggaaattggtgttatgggttttcgttgaatattgggatttgttcggctccgcttgcggaactatggggagcatattacggtttaaatatcgcttgggagcgcggtgtcacacagttggagatggagattgattcggagatggtagtgggttttcttcggacagggattgatgattcgcatccgctgtccttcctggtgcggttgtgccatggcttactttcaaaggactggtcagtccggatttcgcatgtttatagagaagctaatcatctcgcggatgggttagctaactatgcttttcttttaccgttaggttttcatttgtttaattctactccagatagtgttatgtcgattgttcacgacaatgtagcggggtctgcgtacccccggaacgttcaagtgtaattttttttagtttttcagttttaataaaaatgggggttcgcccccctcttctaccaaaaaaaaatacaaagccaggaacagttttggttttgatcatacacaacgagaaacaagacttgtaagaattttccattgtacttaagaggctattactgtgtatcaagagctagatcacgccaagtttcagcatctgcttgctgagtttcctgatctgaaacaatcacaatgtgagggattatattagtcaagctgcttatatgaagattcataggtatcttggaagtgaaagttgttaaatctcagaaaccctctgaaacaaagctcaaatttgagctttactatgtttgaaacatacacaaaaagtgacgtatgtgtctccattactttccttatgacatttcaaggtctcaatatgggtgtttaacatcttggatcagaaatgcatcaccagtgtggattcacagctagcagttttaagaaaagactatattccaaagaatttagaccttaagaatcataaagctatgtaaactgtaaagcaaagcaaagaaaaaaacaaagagccatactggtttcttcagtatcatcagttttaacagcaagcactggaggcaatggaagatctgcaacaataatctcttatgaaatagaaaataggagaaacacaatgatcttgaggtataatgtaggaggaaaaagggttaccatcatcaggcaaagtgtccctcatccactcttcgtccacaatgtctataagcataccaagacttacttccgccatattcgaaaaactggagcttggaaatcccacaaattactgatgaaatcatccaataagtaaacatatatacaaatatcagacaaatggtgaagaaatttggattgttgaagtaaaaagtcaatttctttacaataggaaaacattgaacagaattgggacttctgatatccaaaattttgaattttgagaaagtgacagtatataacagacagaataaagctcaataacctatatatgaatatctaaaacaatctacaggtagtttcgccggagattatgaaaaagagagtagggattcattgagaaattacgtcgagcagttggtgaactatctagtaaagagaccaaatacgaaatcgtaccacaactcaaagccgactctttataaacagatatgattctctaaggaaaaaaacctaatttgaatcgaattagcaagagattcacctggtagaaacaatgcagccgtactccacacagagaactaaaaacctctagcttataaaaaaagctgattttttttctctttggttataaatatacagtaaccttctggtttacctagagtattcaaaaggctgatgaaatttaagttagggtatctctttatacggttcagagcttaagccggccactacagcgaccgacttctctcgccgtcgattaccggatcgtctccgttattgcgtgcttcatttaggtgctttcttcttcttcttctccagtttcagattttcctgttcttgcatttcacctttgagaaattgtgatataaaagttgtttactttacttcaatccagtaaagtaatttggtgattatcgtttcctctaccgcgatcactgtgtaattgatgatgagggttttatacgttcagtacaaatttgagagcttttatgttgacttcaatttgtaaccagtgtatcaattctgggattttaattttcatcattgcattatatattaggtgtatcaagtaagcaatgagttcttcaccgtcgttggagattttaggtacatatctctgaaactcaatttcattcttcgagttatgtttaaatg

SEQ ID NO: 31074 - DNA, 3003 bp, Unknown; identical to SEQ ID NO: 26906
  misc_feature (1)..( 3003): 2750-1469P.txt file - cDNA_ID_3038547; gDNA_ID_2214462; Annot_ID_182804

SEQ ID NO: 31075 - DNA, 3003 bp, Unknown
  misc_feature (1)..( 3003): 2750-1469P.txt file - cDNA_ID_3038551; gDNA_ID_2214462; Annot_ID_182802
gttgggtcgttgctatatggttgacggctatatttgggtttattttgaaaagattatttgtttgtatgtttttatgttagaagatatttttttttctttaagtcgaagggctatttagcaaaaaacctatgaaaaacaaactaacaattatcgagaggtgtttggaaagaaatgatcagaaatttgtctttctctctttcttttgtactttatagatagaaacattttaacaactgcatatataaaagtcaatgatccaaaggcaaaatttctacaaatggtaaaacgtcgtcatttatgcagatatggtaaagtgaaactgttgcagaaaactgagtaaatcaatattagaagaatgttcatgtttatttttgtaatgaagataaatctacgactctatgtcttaagccttttaacaaaaaaaaaaaaaaaaagagagagataagtctatgattttgtgcttttggatctcttgggctactctaatagaaaacagattttttgtaggatcgcattatcgagaaattaaagttggcaatattgagaaagaaattttcatcacttgaagcacatactgacatctactcattaaattaaaagttttataattcccaacaaagatgatcatgcacatggcaaattgaatttatatatgaatatttgcctagagagaaagataaatacatgacatgtaaggattaggatcggatcaaagtctatgatctattacgtgtccattaattaggttggttaagtcaaattgaactgcaatagacactcaaaaagcataaacaaatcttggtttgcattctttgcaaattttctatatctgaaaacgttattgaaaccattgagcgaaacataattgttttaagaaattcgagttgtaatttgtcaggaacggagaaaattgaaaacatgctaaatcaaactagaatagcagcaaattttaatccaaaatccacacgtcaggacacagtgatctcgactcttaagttaatagcttccaccttcagattagtcaaacactttgaaaaaaactgagcttaaccaaaatatataaatcaaagaaacgtgtgtagaatgttcgtagatatgatcatgatcatcttctcaatgtgtagtatgcttaaattcatataaatattgagagtttaaagttcacaagctaagcatacactagctatcaagccgcctcacctactctccaatatccattggaataatcatacttacgtgtttataaataagtattacatcaacccatatcttcttcatccacaaataaccattggctataattatgacaaaaactaccaaaaccatgaatcctaagttttacttggttcttgccttaaccgcggttctggcctcaaacgcatatggtgcggttgtagacatcgatggaaacgccatgttccacgaaagttactacgttctccctgtcatccgtggccgaggcggaggcctgactctagcaggccgcggtgggcagccatgtccttacgatatcgtgcaggaatcttcagaagttgatgagggcattcccgtaaaattctcaaactggaggcttaaggttgcgttcgttcccgaatcacagaacctcaacatcgaaacagacgtcggagccacgatctgcatccagtcaacctactggcgggtcggtgagtttgaccacgagaggaagcagtacttcgtggttgctggtccaaagccagaagggttcggacaagattcgttgaagagtttcttcaagatcgagaaatctggagaggatgcttacaagtttgtgttctgtcctcggacttgcgactctggcaatccaaaatgcagcgatgtcgggatattcatagatgaacttggcgttcgtcgtttggctttaagcgataagccgttcttggttatgttcaaaaaagctaatgtgaccgaagtttcgtccaagactatgtgagaggacaactctcgatcttttactttgactactcataataaaacctctatgttttttttttgataaaacacccgctctctgttttcttgaaaactacaaattgaataaaagctagtgaagcacatgcctatttattaaatcttcatcttctctcaatcttaatgcccgatataaatcaaagggatagagtggacgtccatttaaataaaaccagctaacaatacaagcccctaattattgttgtgtatttaataagaaaaaggaagcttttaaacagtacccgttctctagagaattctgatgatggtagtgatatagaaaatgataaaaataattaatactctagtctctagattgactaataactaatgttttcatttagtctaatgactttagttcagtttctctttacataatctaattgatttttttatatatttaaattctcttattctttaatttgaattttatttttgtttatataatagcaaaagtgactgaatcaatttacaaaatgatatttaggtaatttaaaaaacttttgaaaaattgaatctatgaaaggttagtttgcaaaaattctgcgtagaaatttatagaaaaatattatttttgtcctcaatgcatggaatcagttaagggataattttatgcaaaacaaagaaaggcttatgaaaatgtgtggcgttgcaaaatttttactagaacaaaagcaaagttgtggaaaacattgcgaaacgtgaggaacacactaatgttcaggtacgaaccggaatctttcggtttacctaatatgttatcaaaacagctactcaaagatgggcctgttttgggccaacgagatttgtttcagtcgatatcaacacaaattagtaaattaaagttctacgttttatcggtgaaagtcaacggtttcacagatccctggacctaaacagtttttttaaaaggtataaatttttttgctgaccaatatcgtcttcttcccgatctctcagcttcttccatttacaattctaccctttgcctcttggaacctttgaacgaaaatg

SEQ ID NO: 31076 - DNA, 3003 bp, Unknown; identical to SEQ ID NO: 26909
  misc_feature (1)..( 3003): 2750-1469P.txt file - cDNA_ID_3038554; gDNA_ID_2214462; Annot_ID_182800

SEQ ID NO: 31077 - DNA, 2532 bp, Unknown; identical to SEQ ID NO: 10910
  misc_feature (1)..( 2532): 2750-1469P.txt file - cDNA_ID_3038558; gDNA_ID_2214462; Annot_ID_182798

SEQ ID NO: 31078 - DNA, 3003 bp, Unknown
  misc_feature (1)..( 3003): 2750-1469P.txt file - cDNA_ID_3038599; gDNA_ID_2214477; Annot_ID_183172
gagtctattgttcaccagaccgctagtcttggtgatgtcgaggtaaactgattcatacactgttagtctctcgtgtttctgacggtctatattttatacttaagtcggaatcattgatcgaggttagctcataaactctctgtgcattgatttcctgaaccaaccagggtttgaaagctgccttggcatctggtgggaacaaagatgaagaagactctgaaggaaggactgctttgcattttgcatgtggatacggcgaggtatgtcaacgtctcaacaagccttaacaaaaaaaactgtcgaaatgtcactatcacagaatcatggaaggcagtatatactaccaatatttactagcatcatgcacttgatggataagcagcttcggtttcacttagtagattattacacaattatctgtagcattctttacaaaggaaattgacagttgccattattacatctgcaattagaagttgttataaaagcttaatccgaagtttgaacccagctgacctaggttgagtttgtatgtaggtgagatgtgctcaggttcttctggatgctggagcaaatgcaaatgcgattgacaaaaacaagaacacaccattgcactatgctgctggttatggaaggaaagagtgtgtaagcctcctcctagagaatggtgctgcagtgtaagtttgcaacaacaagaacacaaattcgatttccaaacaacttagtaatggttatataagactcttttaagtgtcgtttcattttctgtttgcagaactcagcaaaacatggacaataaaaatcccattgatgtggccaggctaaacaatcagctagatgtggtgaaactacttgagaaggacgctttcctctgagctgctttgactcttgaaggatatgtttcttctctgtcatgtaatagtgtcacagagtctgattgcaaccttgtcttctgtgggggttttcatcattaaatctggaaaaaaaagatggagaaaatggatgtttattatggttttgtaatgaattattttcttcttgaattggttttttcttttggctcttaaagtcttttttgtccttctttgtgtgccacagggctttagtgttgcaatcacaaagaaaaaacccttaaactgttatattcgagaaggaatagactgtttaatcaaatcggtgataagataatttggagatttttaacatgccaaccgtaaattagaatgaagagtagaaagcccatagaggataacgatactaatagatgagatttgtacataagtaatgtgcagaatggaagtcgatagaatgaaatgcaaaagtgaactcaagaacagcaaagatgataaaacttggacctcaaatcatctttggctctttgctgtttcttttgttttctctcttgaaagtattattgaaaaaacagtaaaaaaaaactcaaaattgaggttacttcaatttaacaatagtaaaatcatcaacacaatttttttttttaaagacatcttaattttctaaaatggatatacaaaatcatatcttgcacctcggaatttggtccaccttagacgtttttagtggcaaaaattcccggatttatgtggattccaatattagtctaggtttcggcatagaattctcctggttaattaaaaatatgtatacaatgttataatttaatcaaaccaacaaaataaaaagagtttgtaaaaatttcaaaatagttctttcaaataaattctgaacagtcttttaaatttatttttagtgtttagtgtgtcatatgtcatatgtatacaaaaacttaatttaaaatttgttattttgagtgagagttttaactgtaaaactaaatatacgattttacaaaaagtaatataaataaattaagcattatttggaaaataatgtaaagctgataattatattcctaattttaaatccatattgtttccttaaagaatatttcaatataattgcaaaaagaaaagaaaggaaatatatcttccgacaatattatctgatgcgcgtgaaatagactatcaggccaagattaggtcaaaaagcccgtgagcccaaaaacctgagaaaacccggttcaaattgcaaaccctcgatttcatttctccaattcgatagacgctgggtaaaaaaattcggaggacgacgaaagagaaaacgagtgtttcagtcactgccccacggagctctcggaaatttgtcttccccttgtcgtcgtctccctatctactgcttcttcttcgttttcgtcttctttatcaaggtgcgctttagcttctcaacgccgtttgatttttagaatttcgatttttttttttttttcttctagttcttgaatcaatccggaatttggcgactatgttgcttcgtttgtaaatcgtattctcctgtttagaaatcttcaattgactgtgttataggaacaatttaaatctcaatttcaatgtctcttttagtcaccttcgtgtagtaatttgcttttgaattactgttaatgaatctcaaaaaatggattttataatttgggaaaaggggcttctgggtttaattaaagaacacgagataaggtctggttttttcttttcatttctttgtgtgtgtttttggtttctttgattttcttctgggttatggtccgtttgagtctggtgatagttagttggcaaccaatttttattgatctattacaatcgagaacacaaaactaaaccctaagaaagaagtacataaagttgttgaaaagatctcgttaactctcccaaagtcctagggctttcacacaaccagtgattaaataacctttgagctgttctccttcccacactttatatgtgtgtttgtggtttgtctaatttgtgaggagcttctatgaaacctctggttattttaattgttttctgcaattcctgattgatatgtttatatatatttcttgtatttgtgaatttgtgtaggaatgctgtttaattggaatcaacaatg

SEQ ID NO: 31079 - DNA, 3003 bp, Unknown
  misc_feature (1)..( 3003): 2750-1469P.txt file - cDNA_ID_3038603; gDNA_ID_2214477; Annot_ID_183171
taaccaacacttttttcctctcgctcttcttcgctactgtttattttcttcttagccgatggcgtgagaagatccgtaactcgacgcctcttcacgtcgttgacttatctgagatctgtgctctaatcggtttcgttgcttcgtttatctacctccttggtttctgtggtattgatctcattttccgatcttcttccgatgatgatgtttgggttaacgatgggatgattccatgtaatcaatccctagattgtcgtgaggttcttccgattaaacctaattccgtcgatcctcctcgggaatcggagcttgattcggtggaagatgaagaaatcgttaaattagtgatcgacggaaccatcccttcgtactcattggagacgaaactcggagattgtaaaagagcagcagcgattagaagagaagcggttcagaggataaccggtaaatccttaaccggtcttccattggaaggtttcgattacaattcaattttggggcaatgctgtgagatgccagttgggtatgttcagatcccagtggggattgcaggacctttgttgcttgatggggttgagtattcagtgccaatggctacaacagaaggttgtttggttgctagtaccaatagaggttttaaagctatacacttgtctggtggtgcttttagtgttcttgtgaaagatgccatgactagagctccagttgttagattcccttctgcaagaagagctgctcttgtcatgttttatcttcaagatccttctaatttcgagagattgtctctcattttcaacaagtgagttttgaaagtttctccttttacttagtgatttgagtgttgttgctgacttgtttgttgttctatatgttatagatcgagtagatttgctaggcttcagagtattacatgcacgattgctgggaggaatctgtatccgaggtttgcgtgtagtactggtgatgctatggggatgaacatggtctcaaaaggtgttcagaatgtcttggactttgtaaagagcgagtttcctgacatggatgttattggcatctctggtaaactcttctttccctctttggtgttgtctcgattttcgaaataaagttgaactctttttgattaatttggtgttatggtgttcagggaactactgttcggacaagaaggcttcggctgtaaactggatcgaaggacgtggtaagcatgttgtatgtgaagcttttattaaggctgagattgtggagaaagtgttgaagactagcgttgaggctcttgtagagcttaacacgctcaagaatcttgttggttcagccatggcgggttctcttggtgggttcaatgctcattcaagcaatattgtcagcgctgtgttcatcgccactggccaagacccagctcaaaacgtggagagctcacactgtatgaccatgattcttcccgatggtgacgaccttcacatctctgtttcaatgccttgcattgaggtataatgcatgttctatcttgaaattaaacccattattgcagagaacacaaagccgttagttttttgaattattgttggatccaactcatgaatgttttgtttattgatgtgactccaggttggtactgttggaggtgggacacaacttgcatcacaagcagcttgtttgaatctactcggtgtgaaaggatcaaacaacgagaaacctggctcgaacgcacagcaattggcaagaatagtggctggttcggttcttgcaggagagctttcactaatgtctgctattgcagctggacagcttgtgaagagtcacatgaaatacaacagatccagcagagacattggcccttcgtctcaagtcaacaggtgatgtttggagcacgatgagacggataataataaaacaacaaaaacccataattagatttgatgtaattctaacttcatttgatttcttcttcatcgatctcttttcttttctatctattttgtactaagtctccaaattttcttaatttatgtaaagtcttttgtccttccatctttatggcttatattaatatcatagcttagcatcaaaatgtgtaattaaattgcggtttaagctttaaagccatgatttttttttctaacattgaatagattattgtggcagtgtttgctttgtgatgattatgtacgtgacagagttaggtactactaataaatgtagaaatgtagttgtgaatattgcagacgatggaggagtgatatggtagtttgacaaatgaagcatttgaggcaatgaagtctctcctcatggcatgtgtgtgtatgggtctttgatgatatcttagaaagtaagcagtagagactgtgcagagagctaaaccaacaatcattattgattttaaaccaaagagagtaagagttttattattattgatttctgattacttctcttacaattgaagtaatgaattttatgttacgacaaatttgatcatttatatagacgtaaaaatgtaaattattatgcatgcatagtgacgctgaggctcatacaagttataatttactctcaatattttcaggttgcacatcaattgttgatattttgtttcctcctttgttctaacttttacaacaataatatctcattttgaaaaattgcctaaaccttttaataaaaagttgtgattttgttgcaatttttaatctgtaaaaatgcaatccgattaagtcggaccgtcagatcagtcctcatcttgtttgtttaacggtccagatttaaaacactaccccagtaaatacaaaaccaactgaagaaaaataaataaaaagtaaatttttaaagagtccgacccgggtccctcaaaaaaaaaaaactccgacccgggacaagatccgtatccaacaaacttatatgtgtatcggacacagaagaatactttccacgatcatcagcttctggagatctcttctgggaatcgagcttcactgttaaagattttccttcaatcggctaaaaatg

SEQ ID NO: 31080 - DNA, 3003 bp, Unknown; identical to SEQ ID NO: 25357
  misc_feature (1)..( 3003): 2750-1469P.txt file - cDNA_ID_3038607; gDNA_ID_2214477; Annot_ID_183170

SEQ ID NO: 31081 - DNA, 3000 bp, Unknown; identical to SEQ ID NO: 11057
  misc_feature (1)..( 3000): 2750-1469P.txt file - cDNA_ID_3038611; gDNA_ID_2214477; Annot_ID_183167

SEQ ID NO: 31082 - DNA, 3000 bp, Unknown; identical to SEQ ID NO: 11056
  misc_feature (1)..( 3000): 2750-1469P.txt file - cDNA_ID_3038615; gDNA_ID_2214477; Annot_ID_183165

SEQ ID NO: 31083 - DNA, 3003 bp, Unknown
  misc_feature (1)..( 3003): 2750-1469P.txt file - cDNA_ID_3038646; gDNA_ID_2214479; Annot_ID_183284
aagataaaactttaatataatggaatacaacctggagaaagtgggtttttgactttttttttagtgaagtggagaggatgatggtaaattttaaatattaaaaactaaaaaatatggtgctactccactaattttttatgtaataatagtatcaaatctcatatgctccataggttaattatagtatagtataagaatagttaatgccttaatgggtcggctattaatcaaccattaatgtatactaatcattttccagttagtttatgttttactttaattcacacccatatatttccatcaccttctatttcatccaattatgttactttttcacaagttgtttggtccatatctctcaaaatatctatagacacaattactacagaaatcatctatatgtagtatgcgaaccaaaatttaatcattacttcatagtttggattacaaagattctcaaagaaattatcaaaaacaaaacaagaaaaaagaaaaaaaaaagattctcaacgatcaaacaacaagtagcaaataggacaacgtcgttcgcagatatatctacatgaactcatcttttagtcatggagcaatcgggacgacgtcgttcagcgatccatttatagttaagttataatgatctccctctttagacaaggagtgaatgggacaacgtcgttcgctgatccatttgcattatcgcaagacgcctgagccggtcgatgaacagagacaagattcacatcgtccattacaataccggtacatggtttctccttactacaatctaacaaaaccgccacttccgtattcgaagtcccgtgtatatcttcatatctcacatttgatactttaactcctgattcctataataatagaaattaatatacagattaaatgagtcaatatatcgagttatgggtgtaaagatatggttaattaataaatattcttacctgtttagggcaaggtttatgaagacagtagtgttggtctataatgattgggttcttgaccatcttcatgttaatatgttggaaaacaatgtttctagcgaaactgttgctatctttcccccatgttttgatcctaactccgttattcgttcccatgaaatccacgttactcacggtcacattatctactccttgttcttcctctgctcgtccaagacttccaatactgttggagagttcacacaaacaaaaaaaacaagagaacattttagaaagtgaaatatcaagaaagatggggagcaagaaatgtatgtgtgtgttacctgatgccgtggcctggaccgcatcgaatggtttgtatgaatacattagtggatcctggaccgatggagatgcaatcatcaccggttccgattcttgagttagtgatatggacggagtgagatgattcgacgtgaatcccatcggtattagggctattctcatcagcagaaaccttaacgccgtcaatgttcacgttattgctattatcgatgactatatggaatttctggctgttgatcgacgttaaaccactgattttgatgttatttgacccactaaacaccaaactctacaaataagattaacaaaaaaaaaaattaaaaacctcatgagagttaaatttgttgtttcttgtgggtcaagcataccttggcaccggtaggacaattatggccaccgttgttcttgcatttccacaaactagtgccttgagcgtcaagtattccaccgtagattgaaacatcagtaacatcctcgaaccagatccaatgttttgagcttgcgataattctaaaatcttccggagcaacgattgagcctgctatacgaatagatattggcgcttgcttacactcgttgccatgaaaaacaaggttcccgaccaagaaccgtccttttggtacgattatagttgtaggattagcggatgcacaagcaacgtcccatgcggctaagaaggctttggttgagtcttttgagccgtctggtttagctccgtaggataagacgttgagtgtgcttggaatcggatgggctaatgatgagattaaggtaaaatcaagaatgatgagagccaaaggaagaataaggcatgaagtgttataaaccattttttggatttttttcagagaaggttagtgttttaaggatgaaggatattgtagaagaaggtacatgagatgggaatttataggatttacgatagtaacgtaatgattagtttatatggaactttcttgattttattaatatctaccattgtgtcaacttgtgtacctagataaccgggtaatttgttatgtaataaaatttggttggtttaatgaaataatagtaattattcgcaagataagtttccttagatgactgcattagtgtacggtaatgtacgaaattagattagtcgttttcgacagagatagttatatggattgatttaattggaaaattttgattatggatcgatttggtggctctcgtttttggattaattaattatggaatgaagaaaacaagaagaagaagatttattacctcttaggattgtggtgtccttttatgtattttttttggtatcactatgatttaatattcactaacttaactactttagtgatttatataaaaaatcatagcgcatgcatgttcaagttctttaactttgccgatcgctagaacagtatccgtactttcgattttctaacattcacctatactcgtttggtaagttaacaaagaatcattagtcattcaaattgcatatcaagataataataacttattggtttttttaagtaagtgtaataagaaattattcgaatgattcgtcaactttttcggatagattccaaaataatggttgataacgagaattgatttacttatagcaaaaacaatctagaaatgtgaatacacattcaaaacaacacatataaggactaagtatattatattttaaaaaacaaaattgtgaaatacagaaaacatgcgcatcaaacaaaggatg

SEQ ID NO: 31084 - DNA, 3000 bp, Unknown; identical to SEQ ID NO: 11129
  misc_feature (1)..( 3000): 2750-1469P.txt file - cDNA_ID_3038648; gDNA_ID_2214479; Annot_ID_183282

SEQ ID NO: 31085 - DNA, 3003 bp, Unknown; identical to SEQ ID NO: 17466
  misc_feature (1)..( 3003): 2750-1469P.txt file - cDNA_ID_3038652; gDNA_ID_2214479; Annot_ID_183281

SEQ ID NO: 31086 - DNA, 3003 bp, Unknown; identical to SEQ ID NO: 25385
  misc_feature (1)..( 3003): 2750-1469P.txt file - cDNA_ID_3038655; gDNA_ID_2214479; Annot_ID_183279

SEQ ID NO: 31087 - DNA, 3000 bp, Unknown; identical to SEQ ID NO: 11124
  misc_feature (1)..( 3000): 2750-1469P.txt file - cDNA_ID_3038668; gDNA_ID_2214479; Annot_ID_183271

SEQ ID NO: 31088 - DNA, 3003 bp, Unknown
  misc_feature (1)..( 3003): 2750-1469P.txt file - cDNA_ID_3038688; gDNA_ID_2214479; Annot_ID_183261
tgtaatatctatattatttctctctctctctctctccctgtatatatagatcggtttaacctagttttatagcaaagctgtagacgagctttcagacgtcaaacatggctaaagcacaaatatgtctttgtttcatcattttcttatacctctggccaggtaatcacaactataatcatgatgttaattagtataatataattggtatgtagcgatgcatacatacgggtttatatatagatcatttaataatcttatattaattgtaatcttttccaagtactgtaacaatttagtttcatttccatgtttctcttacagaaggaaatttcatcaaagtcaccaaggcagatgtaagaacataagtgaaataaccaagttataaaatgttttgtttattctttttctttttttttgtcttttcttgtaatgaactttgggtttgatctttgttacagcgctcggccggagattggtgcgttgctaaaccttctacggataacgaaaggcttcaagaaaacataaacttcgcgtgttcgaaaatcgattgtcagattatctcggaaggaggtgcatgttatttaccagatagtatcattagtcgtgcttctgttgccatgaatctttattaccaagctcaaggaagacatttttggaactgcaattttgaaggctctggtctcatcggcataactgatcctagtgagttttctttttatatttttttcctctaaacaactatggaactattattatgtctgatatcatatcaatttttatttattttccacatttacaggctatggaagttgcatttatcaatttcgtaagtaaaacatatcaaggttcgatcttgttgcaagaagttagaggactgtatctgaaatttcctatttaaaatctaatgtttggatgttttaattggatttctcaacagttaaatgtttgagcctagatatgtgtatgccattgttaaagcaatataatttaatttactgatcaatacttcgcatctattcaatattaatattaactaacatataccagtataaatacattagatgtgaattgtttaatgtttttgcctataaatagatgtatagtactatagtttgattttcttgccaacaacacctaaacattaagttttctacagttttcaacaagagatatggctgtagatcacctaattgtgttgtgtttaattatcagttgagggtagatatagttttctaattgtgtgtaaatatttatatcttagcatcatatcgaccaaagattaatccatattagccacacatagatattgtgtaatataggtagggttaggttaggtcctaatgcggaaaaaagaattattaaatcacacacacgaccaaatgtggcagcatatgaaaacgggttatagtgggaaggaatgtgggaagaatcaattagttgaaatattttattattcttgcttgaatgtattccaaagtataattatatgcgtttttaacactaattagtaaatcatttttccaagtccctaaacgatacattacatttgattcgcatgtcttcctcttagaccaagaacaaggtcgagttttttgtcaacagaaatcttctccccgaaacatgaaacaacttatagagcaaaagataaatattatgaactttaattgcccaagcatctgtgatccagtggtgggagaagatttggggaagggtgaaactttcagagctgggttcgatcctccctggaaacaaaaatcacatttgtttggaaagtctgtcagttgggctttagcccaattggtttacctggtagtcagaaatgcaggcggcctgactaccccctggcattagtcggaaagcatccaaattcgggacagacagtgtggtggtctttcggggagaagtccactctgaagtatttcggtgcatttctactgaggctgaccggatcagccgataaagtttataaaataaaataaataaatgaactttaattaaccagaaaatgtagaaacaaaaaatcttactaaacctatgaccaaaaaaaaaaaaaaaaaaaagttgtggagtaagaagtatgaagcgttttatccaacatatcccagaggagaacagtgattggtcgatgtcacgtgaaataacatttggcaaatagtgcacaaattaatgaaggcaagaaagtgagaccagacgcgagatgtgagcgcgtatgaagaaacatgatgagacaacaaagagaatcaacctcgtctatgaaaatttcttcagattctcttctcattgcgataccaaacaaaaactcgtagtatatttttgttggtcgtttttgtacaaaatatataaaaagcaaactgtcgcaattatggtttgtatattatacaccagataaacaaatcagaatctctccactaaacctaatatattttaaaattttgataagtctatatacttttttggcggggacaaccggatagttcttctttgagacttctggcttttttttctcttgatgataataagaaactgtatgaatatttgaaaatgccttatgacgttttcttaccaaaaaaaaaaggcaaaggaactacaaaagatagcttaaacaaatttagacaattcatgtggccttaccttaagtattttagtgatgatacgattttaaaattattagtgccattctatcatgttctatactatataaaatattcattcaatattgatttcatagttaaagtttacaccaaaaaattgacatcacatcctatcagctacggaaatggttaccaacacaaaatagtatatctatgtcctatatatatataggaatttaagacaaagcaatattagtctacttttggaggagatgaaaagttacaagaagtctccctataaaacactattaatgaaccaaaaacaatctactaatcaaacttatagtctactagaggtactttgttaccgtttggttagggatgagtttcaacgtttgtggtggttacaatg

SEQ ID NO: 31089 - DNA, 3003 bp, Unknown; identical to SEQ ID NO: 25383
  misc_feature (1)..( 3003): 2750-1469P.txt file - cDNA_ID_3038697; gDNA_ID_2214479; Annot_ID_183258

SEQ ID NO: 31090 - DNA, 3003 bp, Unknown
  misc_feature (1)..( 3003): 2750-1469P.txt file - cDNA_ID_3038701; gDNA_ID_2214479; Annot_ID_133201
ccagaaaaaaggttgaaatttagtaaatgcgtttattatggattggctgatagcctgatatacttcattctgtgacaaccgattcaaacaacacattggtacattaggatacaccgcataatcttttttattcgacacctttagttataaactcacacgtgaacgaccacacttatactatgaaaccgtgtcatacgaaccacattttaacatctttagcaactaagatttgctccaggagtgatcccaagcgtcctgcagaactccaagtaatagtttactctgctctgcacggctgcaggacgcctaccgttgcattcaccaccattgatcttcctagtggtggctccaaagccttggtccaagactggacgaacatttaggttccagaaccacatggcacactgaaaggcaacttgggggctacgagccaccatgtctggatcagtcaagagagggagtccgaggaactttccagctgcaccgtaattgtagttccatgtgatttggattggaccgcggccgtagtagtcttttcccggtgtacaagggtacgcagtgctcggtgagcagtatttccctctagctatttcttctttgtagcaaaaaccttgcataacgtaaaagaagatcgttatttataatagagaatgaatatgtatgaattttaatgataaaagaaatgatttgttaacttacccaagaaacattatggtgcttaattagtgtaataatattcttgataataataattcattaatttgcttaattaaataattagtatacatgcattcatgtagtagaactagaagggtttataaagaacttacttccagattcatgagaaaactgagccaacatagcggcaatctcacgcttagcgacggttcctttataggcgtcgaacgattgggcagccgcaatgaaagcctggcgagtgtagaaccctttcgctggacagccatttccgactttgctcatgataccatcaaaaaatgctggtgtgacaacattttcaattgtatcacgaggatcagcgtttagaccgcctgcaccaccgctaggagttggtgggataggtgtggttgaggagctgcaaggtccacttcggcacccggtaccacagtaggcatctgtggtgccacaatatccatatctactgcaacataagttggctgcacatccggttgtaccgcactgttgcgaaaacacggtttttgccatgatggttaaggtgaagagaaaaaggatgaaagcgtttttcaacattgctcttagggtagccattttgtgtatggagggtgttgtgtgaagaaatgaagaaggtgtgttgatgtatttatagtgtaaatttggtctattcaaattgaaatattgatcagtgttagacatctttcacgattattgattggctttttctgagtcaaagtcaatgccactttgtaccacttaacaaaagtcaatgacacagttttttctcttgtcgttatgagaaattccatgtcggtcatagatcagatcaaaaacgaatatgtaatcaaaattttaaagagccaagttacttggatgaaaatcattctcataaaaacttgattgagataatcaagtttagattagttcaaacgtttgagatttttctattgaatagttccaagtttttgttaattagctcaaacgatattgttagctaatatagcattttttttggtcaactaatatagcatttagaacgttcttttaaagtcttactttgatttttaacaaaaattgtatggaattgtgagaaaaatgactagtgaagccaaaatgtttctatttataaatcaaaatcaaccaaaattagaaaaatccaactcaattattgcaatttccaaatagtcatgcgtcaaaattaaaccagcatatcaataaaaagcggtttagtcttaccaaccctggtctagagactctagaaccatcggagctcaagtgaaaaacgacgccgttaagctgcatctttcaagatagataaaaacttttgtcgatcgcttcatctctcacagagtttcggctcctccgttgtgtttcaggacgacgcaaaggggaaaaaaaattgaattctttctctccaagcgaaactagggtttcgaaagtctctgtctcatcaaagcttcgaaaaggtagatttatggtttcttactctcctttctctatgatattccaatttcttgcgagcttgctcagtgttcttaccttatatttaccgaaccagtgcctttatattctatcacattcgaagttattggtttctggttacttatattgcttattgttctatgactacgatataattatcccaaagatttgttcttttctccgaatttggattagaaatggatatactcaaattctgaacatgcccagaagaatccttgttttggtcaatgttgggttctaattggttgtgttcgttgtttgctgttgatttgttttcttttcagaaagtgattgcattaagagaaacattgggataaaagatgagctttactcaggctaattgttttcgaccatcctactatcctgcaaggataacacgaccaaattgcatctccagtgtacctattaggtcttcagtacgctttgatcacttcccgcgtacctcgtttactcttcgagctactgctgcagtgtctactcagttttcgcctcttcttgatcatcgccgtcgtttacctactgggaaatcgaaacaaagttctgctgtgtgcttatttggtgggaaagataaacctgatggtagtgatgaggtcagatgctttttcctcatgttaagttcttctgcctgtaaatgaatttactttgcaactggagagtgatttcttttgtgtttgtttctaagaactttgctgttctgtttgctgatgataagtgtgttcttcttattttttcaattttgttcttagtgattgttgtaatgaattttgttatcagatatcgccatggaaagcaatagagaaagctatg

SEQ ID NO: 31091 - DNA, 3003 bp, Unknown
  misc_feature (1)..( 3003): 2750-1469P.txt file - cDNA_ID_3038701; gDNA_ID_2214479; Annot_ID_183256
tacttctcgtggggaaatagaccgtttttccgtgaatatcctgatccgtatatattgaaaaaagtttgaattacttttccttcattttttaaactgtcaatatcttatttcattcaaatatgcatacattttttaggcctatttatcgatcggtcttagttatggaaattttacaactgttgtcatcatacaaatatacattactcggcagtggttccctcttaatattctcactttctgacacttagaaccatctggttacatttttaattattatatatcatccttacaagtgtctgacgaaatggtgaatcgagaatcactagaaggaaccacttagacaaataatcttttataaaatttaccatttgttcacactttttctttcattcgtaaagaattttctctgaagtttcagcttatgtaatttgttcccagggaaaaaattcaaacactatcctctgtaaaattggataaccattaaccagaaaaaaggttgaaatttagtaaatgcgtttattatggattggctgatagcctgatatacttcattctgtgacaaccgattcaaacaacacattggtacattaggatacaccgcataatcttttttattcgacacctttagttataaactcacacgtgaacgaccacacttatactatgaaaccgtgtcatacgaaccacattttaacatctttagcaactaagatttgctccaggagtgatcccaagcgtcctgcagaactccaagtaatagtttactctgctctgcacggctgcaggacgcctaccgttgcattcaccaccattgatcttcctagtggtggctccaaagccttggtccaagactggacgaacatttaggttccagaaccacatggcacactgaaaggcaacttgggggctacgagccaccatgtctggatcagtcaagagagggagtccgaggaactttccagctgcaccgtaattgtagttccatgtgatttggattggaccgcggccgtagtagtcttttcccggtgtacaagggtacgcagtgctcggtgagcagtatttccctctagctatttcttctttgtagcaaaaaccttgcataacgtaaaagaagatcgttatttataatagagaatgaatatgtatgaattttaatgataaaagaaatgatttgttaacttacccaagaaacattatggtgcttaattagtgtaataatattcttgataataataattcattaatttgcttaattaaataattagtatacatgcattcatgtagtagaactagaagggtttataaagaacttacttccagattcatgagaaaactgagccaacatagcggcaatctcacgcttagcgacggttcctttataggcgtcgaacgattgggcagccgcaatgaaagcctggcgagtgtagaaccctttcgctggacagccatttccgactttgctcatgataccatcaaaaaatgctggtgtgacaacattttcaattgtatcacgaggatcagcgtttagaccgcctgcaccaccgctaggagttggtgggataggtgtggttgaggagctgcaaggtccacttcggcacccggtaccacagtaggcatctgtggtgccacaatatccatatctactgcaacataagttggctgcacatccggttgtaccgcactgttgcgaaaacacggtttttgccatgatggttaaggtgaagagaaaaaggatgaaagcgtttttcaacattgctcttagggtagccattttgtgtatggagggtgttgtgtgaagaaatgaagaaggtgtgttgatgtatttatagtgtaaatttggtctattcaaattgaaatattgatcagtgttagacatctttcacgattattgattggctttttctgagtcaaagtcaatgccactttgtaccacttaacaaaagtcaatgacacagttttttctcttgtcgttatgagaaattccatgtcggtcatagatcagatcaaaaacgaatatgtaatcaaaattttaaagagccaagttacttggatgaaaatcattctcataaaaacttgattgagataatcaagtttagattagttcaaacgtttgagatttttctattgaatagttccaagtttttgttaattagctcaaacgatattgttagctaatatagcattttttttggtcaactaatatagcatttagaacgttcttttaaagtcttactttgatttttaacaaaaattgtatggaattgtgagaaaaatgactagtgaagccaaaatgtttctatttataaatcaaaatcaaccaaaattagaaaaatccaactcaattattgcaatttccaaatagtcatgcgtcaaaattaaaccagcatatcaataaaaagcggtttagtcttaccaaccctggtctagagactctagaaccatcggagctcaagtgaaaaacgacgccgttaagctgcatctttcaagatagataaaaacttttgtcgatcgcttcatctctcacagagtttcggctcctccgttgtgtttcaggacgacgcaaaggggaaaaaaaattgaattctttctctccaagcgaaactagggtttcgaaagtctctgtctcatcaaagcttcgaaaaggtagatttatggtttcttactctcctttctctatgatattccaatttcttgcgagcttgctcagtgttcttaccttatatttaccgaaccagtgcctttatattctatcacattcgaagttattggtttctggttacttatattgcttattgttctatgactacgatataattatcccaaagatttgttcttttctccgaatttggattagaaatggatatactcaaattctgaacatgcccagaagaatccttgttttggtcaatgttgggttctaattggttgtgttcgttgtttgctgttgatttgttttcttttcagaaagtgattgcattaagagaaacattgggataaaagatg

SEQ ID NO: 31092 - DNA, 3003 bp, Unknown; identical to SEQ ID NO: 26916
  misc_feature (1)..( 3003): 2750-1469P.txt file - cDNA_ID_3038736; gDNA_ID_2214466; Annot_ID_182857

SEQ ID NO: 31093 - DNA, 3000 bp, Unknown; identical to SEQ ID NO: 10942
  misc_feature (1)..( 3000): 2750-1469P.txt file - cDNA_ID_3038740; gDNA_ID_2214466; Annot_ID_182855

SEQ ID NO: 31094 - DNA, 3003 bp, Unknown; identical to SEQ ID NO: 26919
  misc_feature (1)..( 3003): 2750-1469P.txt file - cDNA_ID_3038743; gDNA_ID_2214466; Annot_ID_182853

SEQ ID NO: 31095 - DNA, 3000 bp, Unknown; identical to SEQ ID NO: 10951
  misc_feature (1)..( 3000): 2750-1469P.txt file - cDNA_ID_3038747; gDNA_ID_2214466; Annot_ID_182851

SEQ ID NO: 31096 - DNA, 3000 bp, Unknown; identical to SEQ ID NO: 10948
  misc_feature (1)..( 3000): 2750-1469P.txt file - cDNA_ID_3038753; gDNA_ID_2214466; Annot_ID_182845

SEQ ID NO: 31097 - DNA, 3000 bp, Unknown
  misc_feature (1)..( 3000): 2750-1469P.txt file - cDNA_ID_3038757; gDNA_ID_2214466; Annot_ID_182844
ggcttcagctggattttttttttttttttttcctgagaagcttccgatgatttaggggttagtgcgatttaggtctcttcctgtaatttttcgcgattctctgtataatttgtgtggttggtgtgaggagaatcttggaattgggaatggaatctccgatcaaatgttgcgactgtggatgcgattgttgttcttcctcccctggttcatggattcgatctgtgaagaagagaagacacgacgaattacagaccgagaaacgattctcgataccggagctggacgacctagacatgttctctaatcctagagtccaaattgagaacgaatgtgaattactacgcgagactgttagcaatcaacagcaaacgattcaggatttgtatcatgagcttgagcaagagcgtattgcttcatcaactgctgcagatgaaacagtaaagatgattcagacgttggagcgtgaaaaagcaaaaatcgacttggaactgaaacagcttcagcgtagtgttgacgaaacattgaattatgaaaaccaagagattgaggcattggaaaatatggtttatcaaagggatcagacgattcaggctcttacgtttgaaactcaggcttataagcacagaatgatgagttttgggctaaccgaagcagaagctgatggtgagaggagcttgcttagtcgtaacccgagcatgatcgactttagttctgaatatgactgccctacacaagattaccctcctcttaaatgcaatattaatgagaaccaagaccctcttgaggctgatatctatgttgcagatgatgagaactatccaccagctgattctcctcatgggagagtacatttaaagactttggatcgaagactcagccagatggagacgaatcctagctttactcagttgaatagagggagggatgtttcagagaaggggatggttggtgagagtcctaggcgtcaaagacattttaggaggatttcccctactggttcatcaagttcacacttgggagcatctaaagaactaagacctgatgtttttgttgattccccgaggtcccaaagctacagctctaagaaaatggaagatgtctcgtatacagagaataataatgctaaagatgacttgtcggaaataggagatgacatgagtgatagagtttataccattgattctgttcatcacagcagtgtggctcatagtggcggtgtagcggagcagaagattgaggatggtgcttctgatggcaatgttgttttcccgagagaacacacggatcttggtgatcctgatataacgaaactctacatgaggcttcaagcactggaggctgacagggaatcaatgaaacatgcgcttctctctatgaggactgaaaaggctcaaatggtactgttgaaagaaattgctcaacacttgtcaaaggaagttgtccctcaacggagattgcctctacgtaaagcatctattgctgggccattgacttttacgccggtctttaaggtgattgtcatgtttctgtatgatcacaaagcaacttcgtctaaagctgtctcttgttttctactgttctcactctaacttgtttctgtaattttgattcttattcctctgcagtggatcacatcttttgtttcctggaaaagaaaggctcgtcgaagcaagtaagtaacctgtaacaaattttggttactctatgcttcacatacctatcacaagagaaagatctgtgaatctctttgagaaataactattgtcatccattttcaaaccggtgctctcttgcactataatctcgtccttaatattcgaaaaacaaggcaatgtttcacatgatagtttagaaattactgttggattttagggagctgcttatgaaacttatgctggtctctgttccaatgcaaatacgcagatacatgtatgggatgtcaggaaacaacatcggcttgcaaatgcttctagaaaaagtccctcggtcaaggaaatggcgatgtcttaggagcacgcaagtgtgaaacagatccaatcctttcaagccaacaaaatcactctcctgactctagattcgaagcacataatgtcaaatactgatgtgggattggcgaggtaacatttgtcggcctttcttcaacttgaattggattctcgttcttgggttgcagagaaaatgtatttgctgtgcgattttcaatctgttttcctcaatattttaactgttgtataaaagaattgggttgaagaatgatataactcagaggctatacaatctttgtatggtttctaacatgaattgtttcattcatggattcttttttcttttttttatcaatattttggagatggattcatcacataaataagtgaaggaaaatgtaaaatgttcccgtttcaaacctcatttcccacacttgggaaaaggaaaataaaaatatttgttgtcagcattcctcctatatatttgttgaccttaaaatgaaacaaaagaaattttccatgaaatataatagaatgttctgtttgctgaccatgagttgaatagagttaacaaaaagaaaaaaaagtttgtaatcgaccatggacatattttggaaggatcaaaattcagaccatgttctaaagccgagttgctgctgagagtaaaaaacaatatatagatttaacatatttgctctagtctcttgttcaaaaaaagatggtctagaaatcttcgatattgaatttttcgattaccaaaaataaaaataattaggaggggacttacataaaattgttattttattcagtatacgtgaagagtgatttcatttcattgacaaataaacagacacgtgtcatgttttgatagtgaatatttctttgtctaaaaaacatatgttagtggaattcaaaagcgaagaccaattaagtaaacggagccgccatttcttacttccaccacatgtttctcttcttcttcatctttactattattctagatcatcattatatg

SEQ ID NO: 31098 - DNA, 2879 bp, Unknown; identical to SEQ ID NO: 451
  misc_feature (1)..( 2879): 2750-1469P.txt file - cDNA_ID_3038771; gDNA_ID_1591076; Annot_ID_150482
  misc_feature (2)..(3): n is a, c, g, or t
  misc_feature (2524)..(2524): n is a, c, g, or t

SEQ ID NO: 31099 - DNA, 3000 bp, Unknown; identical to SEQ ID NO: 10927
  misc_feature (1)..( 3000): 2750-1469P.txt file - cDNA_ID_3038783; gDNA_ID_2214466; Annot_ID_182827

SEQ ID NO: 31100 - DNA, 3003 bp, Unknown
  misc_feature (1)..( 3003): 2750-1469P.txt file - cDNA_ID_3038800; gDNA_ID_2214467; Annot_ID_182889
ccagatttaacttgtcgttttttgttatgtactcttcaagattactttggtcgttcctgttttattgtctaggaatgtaaataaaacaaaattaatgctagttaagctcagataaacaaagttagaactagaagatgtgtatgttctgtgtcggtagaaaaacaataaaaacaaaatatttgaatttagatatgtttgggcctttacacgtttgtgtgtgtgtgtttgttcacagtttgtttggatggaacattgcctggatatcacttgcaccgtggacatggatctggagctaatagctggctcattcaattggaggtttagtgaattatttgttgtcgatgaaacactagttaaagtcttcattgttgatgtttgatgtttttgtatcagggaggaggatggtgcaacaacatcaggacctgtgtatacaggaagactactcgacgtggttcctctaattatatggagaaacagcttcagtttacaggaatactgagtgacaaagctcaagaaaatcctggtttgtctcaatctttgtttaagttttgttcatgttagtgtaatgttaatattgaaaatcatatattctcattgtcatgtgctttacttctgcagactttttcaactggaatagagttaagcttcgttactgcgatggcgcttctttcagtggagatggccagaatcaggttgaaatcaatcattttttgagttactagagttcataagagacccattgttgtgatttggaacaacttgctagtttctaggcctttggaactctgtagtctataatcgtcaaggctgttattagccacagagaacgcttgatgtgatcttagttctgtagaattgagcagccattggttttgtgtaacatctgtgaactaatgcaaataaaattctttaccttaactttttcaggctgcacaacttcagtttagaggagagcgtatctggagagccgcaatagatgatttgaaggcgaatggaatgcgatacgccaatcaggttttgacacttaaccttctataagagtctgtatctcttccatagcataatatcaagggcaggaatggatttaactatttatattctgtcaggcacttctctccggatgctctgctggtggtttagcagcaatcttgcgctgcgatgagtttaggaacttattccctggatcaaccaaagtcaagtgcttgagtgatgcaggcttgttcttggacacgttagtttatttctcccaagtcaaagattgtattaaagctagttcattttcccttaccttagtaactactactgactcctttgtttctgtaattatagtgccgatgtttcaggcggccgcacaatcaggaacttatacaatggtgtcgtagaattgcaggttggattcctctttcttcacttgaaagtttcttactttacatttaaagagcacaagaaacttaagaaatcttcttcacaatttacagagtgtgaagaacaatcttccacgtatatgcacaaaccatcttgatccaacctcggtatcttatcttttgttctctcattctgatgctgttgcaaaccggtcattcgaagtcttgtgttttgataactcatatatctgtacagtgtttcttcccacaaaatctgatcagtcaaatgaaaactccactttttatcgtcaacgcagcatatgatacatggcaggttatgttttttctccctttgaaaagtgccacattgctactaaagaacagaaagttgatggttaggctgacaagtctctgtaatggtttttaaacagattcaaagcagtatagctccaacatcagctgatcctagtggattttggcatgactgcagactaaaccatggaaaatgtactcctgcacagttgagattcttgcaaggttgttctatagatcataaaaacttgtggacttcaccctttaaagcatcattgtatcactctaatcgtttaatcttttattcgagaacaggattcagggaacagatgcttagagtagtcaagggcttctcaatgtctagacagaatggattgttcatcaattcttgctttgctcactgccaaaccgagagacaagatacttggtttgccgatgattctcctgttatcaggaaaaaggtaaaacctcactcaaatctttcccacacaaacaaagtaacacacaaggaaagcctgtttccactttctagatcttgactttgtctatggaatgtttgtaggcggtggcaatagctgtaggagattggtatttcgatagagcggaagtgaagttagtcgattgcccatacccgtgtgacaagagctgccacaacttggtgttcagatgattgtttgactatgttctttattctctctcatatatacataccttagaaaatttctttctttcaaaaggaaagattttgtatcctttggtagtaaccaatgcctcattggtatatgattaagtgtatcgtggaaaatcataataaaaaaacaaaacaaaacaaagtttgcttaaaaagagttcaatgtaatcaatcacagagaaatgctctttcttttgttttgttttctaattttctttgcaaatgcaagtagttgatcaaatatattagaaatgtcaacattggtaccaaaagaattcaagcctaactaattcttttatgtattataagtgtccaacaaaagcagataatggataagaataataataaaatagtaaaagatagagagaaagtgaaaagagtaagaatatacagagtgtgttgacaacttgacaccctgtttttgtggggggtgtgagtgacagctatctagtgttccccactttgtgtgtgtatatgtgtgagtgttttttttacacctatcatttgctttcaatttctcccagtcaaaatactaacttcttcaacaacttctggaataataatctgaattcttgaagttgaaccctgtccattacttttctccttcttctcctgccttctgaatcttcttccatg

SEQ ID NO: 31101 - DNA, 3000 bp, Unknown; identical to SEQ ID NO: 10255
  misc_feature (1)..( 3000): 2750-1469P.txt file - cDNA_ID_3038800; gDNA_ID_2213639; Annot_ID_181162

SEQ ID NO: 31102 - DNA, 3003 bp, Unknown; identical to SEQ ID NO: 26930
  misc_feature (1)..( 3003): 2750-1469P.txt file - cDNA_ID_3038809; gDNA_ID_2214467; Annot_ID_182879

SEQ ID NO: 31103 - DNA, 3000 bp, Unknown; identical to SEQ ID NO: 10968
  misc_feature (1)..( 3000): 2750-1469P.txt file - cDNA_ID_3038846; gDNA_ID_2214468; Annot_ID_182930

SEQ ID NO: 31104 - DNA, 3000 bp, Unknown; identical to SEQ ID NO: 10966
  misc_feature (1)..( 3000): 2750-1469P.txt file - cDNA_ID_3038861; gDNA_ID_2214468; Annot_ID_182915

SEQ ID NO: 31105 - DNA, 3003 bp, Unknown
  misc_feature (1)..( 3003): 2750-1469P.txt file - cDNA_ID_3038871; gDNA_ID_2214468; Annot_ID_182907
aaaaccttgtgatgtgttgtgtgtttcagtgttttcgaagttgaaaactcgggaccaagaatggtacttcttcagtgcgttagataagaagtacggtaatggtgctaggatgaatcgagcaactaacaaagggtactggaaagcaactggaaaagacagagaaatccgccgggatattcagttgctcggtatgaaaaagacgcttgttttccacagcgggcgtgctccagacggccttcggactaattgggtcatgcacgagtatcgccttgtggaatatgaaactgaaactaacggaagcctgctggtattatgttgtccaaaagagttacttttgaattggggttatctcattttgtaagaatcctatcttatcttacttctttgtctgggtgcagcaggatgcatatgtgttgtgcagagtgtttcacaagaataacattgggccaccaagtgggaacagatatgcgccattcatggaagaagaatgggctgatggtggaggagctctgattccaggaatagacgttagggtcagggtagaggctctaccacaagccaatggaaacaaccagatggaccaggtttgtactttctttatactcaaatgtttcttatatgcataacctctgtgatacatccctctaatgtgaatcatctctcttgattcacaagatattatatttcttattgcaaaagctctttgcttctctaagtgctgtttcagtgggctgatttacttaaactgcacaattccattaagtttgctatcaccttttgtagaactcagctcaaccttacagctttatctaatgaaaggtctctcttgattcacaagatatctaatttttctttatggtcctttttctttgagatttatcctttgattacatgatatttcagacttacaatcttcgtttggcattaaaggtgctcaacaagagaaatatttattgtgttttggttaatctgcaaagtcgatcaacgcgttttggtttgagatattttatgtctgttggggttcacataacttgtaatttgttgtaggaaatgcattcagcaagcaaggatctcattaacatcaacgagctaccgagagatgctactccaatggacatcgaacctaaccaacagaatcatcatgagagtgccttcaagccacaggagagtaacaaccatagtggttatgaagaagatgaggacacactcaaacgcgagcacgcagaagaagatgagcgtcctccttctctatgcattctcaacaaagaagctccactacctctcctgcaatacaaacgtagacgccaaaacgagtccaacaacaactcaagcaggaacacacaggaccattgttcgtccacaataacaaccgtcgacaatacaaccaccttaatctcatcatctgctgctgctgctaccaacactgccatctctgcattgcttgagttctcacttatgggtatctccgacaagaaagaaaaccagcagaaagaggaaacttctcctcctagtccaattgcatctcctgaagagaaggttaatgatctccagaaggaggttcaccagatgtctgttgaaagagaaactttcaagcttgagatgatgagtgcagaggctatgatcagcattctccagtcaagaatcgatgcgctgcgtcaggagaacgaggaacttaagaagaagaacgccagtggacaagctagttaaaccaccgcaacatctctccaggtgtcttcttcttcttcttcttcttctttgcctcttagctgtaatcttcttaatagtatgagctatggatgtagcttcttcagacggatcagaaaccttatgaatctctgttgtaaaattaggataaaacggaacggagccaaccaactaggtctttttattttatccttttttactttggatgtttctgcatcttttgggaacattttcaggctgatccattgtcgtatattatcatctatctatctagtcttttcagacaagaactcgcttttgtttggtttcctctcaagaaatgttcagtctccataaagaaagctttttccttggggtaatcattagtggtcagatatgagggcataatcgtcattgtcatttgaaatgaccttctggtcttccggacaagaaccactctgttgcttgatgtttctgtgtgactgtctccacagtccacagggaagagagcttcttaggtaaagtcgtgattagtggaaatgattgagggtataatcgtcattgactaattcagcgttacgatttaggaatgtggttccgtcaacgacgttagaagacttttgttacacgtaatttgcaattatttgttttttctctaaaagcgaaaagcgcttggtacgattcaagcctggattccatctctctcccattaagttttcaagaagaagttttgatcacagacgtattttcgaaatggtttcatatcttactaggcaatggaatttcgtaggtgttatagagtttggtgtttatattttacttttaactacatcgtcctattatacggaacctgtcttttttttttccacacggaaccctgaatgattgtactttttggtaggtttgttctttattcgagagttgtaaaaaaacattatttacttttaagatgactacgaaagtgtaatttactaaattacttttcattatttactcccaagtataatttactacaaaaagctacgcagtaaaattttgctagggtttattactgcgacataatgaaatgtaaatcgaaaattggtatcgcaatccaaaatacttttttgttgctctctactagcctgcctttctgggaacgcgaaaagaaagacaaaattttcttgcaattgaaggtacctcaaatcttgtgcttatctctttggtttcttcttcgtcaaaccatctgcccaacttgtgtttttgttcttcaggtgaggtttggtgaaagggaaattgagaaaaccctagaacaagtacggtctctattttgctttaatg

SEQ ID NO: 31106 - DNA, 3000 bp, Unknown
  misc_feature (1)..( 3000): 2750-1469P.txt file - cDNA_ID_3038871; gDNA_ID_1972067; Annot_ID_178417
accttgtgatgtgttgtgtgtttcagtgttttcgaagttgaaaactcgggaccaagaatggtacttcttcagtgcgttagataagaagtacggtaatggtgctaggatgaatcgagcaactaacaaagggtactggaaagcaactggaaaagacagagaaatccgccgggatattcagttgctcggtatgaaaaagacgcttgttttccacagcgggcgtgctccagacggccttcggactaattgggtcatgcacgagtatcgccttgtggaatatgaaactgaaactaacggaagcctgctggtattatgttgtccaaaagagttacttttgaattggggttatctcattttgtaagaatcctatcttatcttacttctttgtctgggtgcagcaggatgcatatgtgttgtgcagagtgtttcacaagaataacattgggccaccaagtgggaacagatatgcgccattcatggaagaagaatgggctgatggtggaggagctctgattccaggaatagacgttagggtcagggtagaggctctaccacaagccaatggaaacaaccagatggaccaggtttgtactttctttatactcaaatgtttcttatatgcataacctctgtgatacatccctctaatgtgaatcatctctcttgattcacaagatattatatttcttattgcaaaagctctttgcttctctaagtgctgtttcagtgggctgatttacttaaactgcacaattccattaagtttgctatcaccttttgtagaactcagctcaaccttacagctttatctaatgaaaggtctctcttgattcacaagatatctaatttttctttatggtcctttttctttgagatttatcctttgattacatgatatttcagacttacaatcttcgtttggcattaaaggtgctcaacaagagaaatatttattgtgttttggttaatctgcaaagtcgatcaacgcgttttggtttgagatattttatgtctgttggggttcacataacttgtaatttgttgtaggaaatgcattcagcaagcaaggatctcattaacatcaacgagctaccgagagatgctactccaatggacatcgaacctaaccaacagaatcatcatgagagtgccttcaagccacaggagagtaacaaccatagtggttatgaagaagatgaggacacactcaaacgcgagcacgcagaagaagatgagcgtcctccttctctatgcattctcaacaaagaagctccactacctctcctgcaatacaaacgtagacgccaaaacgagtccaacaacaactcaagcaggaacacacaggaccattgttcgtccacaataacaaccgtcgacaatacaaccaccttaatctcatcatctgctgctgctgctaccaacactgccatctctgcattgcttgagttctcacttatgggtatctccgacaagaaagaaaaccagcagaaagaggaaacttctcctcctagtccaattgcatctcctgaagagaaggttaatgatctccagaaggaggttcaccagatgtctgttgaaagagaaactttcaagcttgagatgatgagtgcagaggctatgatcagcattctccagtcaagaatcgatgcgctgcgtcaggagaacgaggaacttaagaagaagaacgccagtggacaagctagttaaaccaccgcaacatctctccaggtgtcttcttcttcttcttcttcttctttgcctcttagctgtaatcttcttaatagtatgagctatggatgtagcttcttcagacggatcagaaaccttatgaatctctgttgtaaaattaggataaaacggaacggagccaaccaactaggtctttttattttatccttttttactttggatgtttctgcatcttttgggaacattttcaggctgatccattgtcgtatattatcatctatctatctagtcttttcagacaagaactcgcttttgtttggtttcctctcaagaaatgttcagtctccataaagaaagctttttccttggggtaatcattagtggtcagatatgagggcataatcgtcattgtcatttgaaatgaccttctggtcttccggacaagaaccactctgttgcttgatgtttctgtgtgactgtctccacagtccacagggaagagagcttcttaggtaaagtcgtgattagtggaaatgattgagggtataatcgtcattgactaattcagcgttacgatttaggaatgtggttccgtcaacgacgttagaagacttttgttacacgtaatttgcaattatttgttttttctctaaaagcgaaaagcgcttggtacgattcaagcctggattccatctctctcccattaagttttcaagaagaagttttgatcacagacgtattttcgaaatggtttcatatcttactaggcaatggaatttcgtaggtgttatagagtttggtgtttatattttacttttaactacatcgtcctattatacggaacctgtcttttttttttccacacggaaccctgaatgattgtactttttggtaggtttgttctttattcgagagttgtaaaaaaacattatttacttttaagatgactacgaaagtgtaatttactaaattacttttcattatttactcccaagtataatttactacaaaaagctacgcagtaaaattttgctagggtttattactgcgacataatgaaatgtaaatcgaaaattggtatcgcaatccaaaatacttttttgttgctctctactagcctgcctttctgggaacgcgaaaagaaagacaaaattttcttgcaattgaaggtacctcaaatcttgtgcttatctctttggtttcttcttcgtcaaaccatctgcccaacttgtgtttttgttcttcaggtgaggtttggtgaaagggaaattgagaaaaccctagaacaagtacggtctctattttgctttaatg

SEQ ID NO: 31107 - DNA, 3000 bp, Unknown; identical to SEQ ID NO: 10986
  misc_feature (1)..( 3000): 2750-1469P.txt file - cDNA_ID_3038901; gDNA_ID_2214470; Annot_ID_133064

SEQ ID NO: 31108 - DNA, 3000 bp, Unknown; identical to SEQ ID NO: 10986
  misc_feature (1)..( 3000): 2750-1469P.txt file - cDNA_ID_3038901; gDNA_ID_2214470; Annot_ID_182993

SEQ ID NO: 31109 - DNA, 3000 bp, Unknown; identical to SEQ ID NO: 10993
  misc_feature (1)..( 3000): 2750-1469P.txt file - cDNA_ID_3038905; gDNA_ID_2214470; Annot_ID_133062

SEQ ID NO: 31110 - DNA, 3000 bp, Unknown; identical to SEQ ID NO: 10987
  misc_feature (1)..( 3000): 2750-1469P.txt file - cDNA_ID_3038905; gDNA_ID_2214470; Annot_ID_182992

SEQ ID NO: 31111 - DNA, 3003 bp, Unknown; identical to SEQ ID NO: 26937
  misc_feature (1)..( 3003): 2750-1469P.txt file - cDNA_ID_3038912; gDNA_ID_2214470; Annot_ID_182985

SEQ ID NO: 31112 - DNA, 3000 bp, Unknown
  misc_feature (1)..( 3000): 2750-1469P.txt file - cDNA_ID_3038920; gDNA_ID_2214470; Annot_ID_182978
aaagatatgttgttgtcaaaagaaaagttcaaaattgaaaatgcatttacttacgccggctacaccacctccaatgatcacgtacttgtagcttttctcttccgccattaattaataaataaaacttctttctcagtttcgtttttggtatattatgagaagtactgacttggggtttatataaagtggagagacgatgaggatctcgagtcttggttgcctgtatttgactaatctgactcaacttgtatttgacaataattatgtattggtggatgatataatattcatattggaaagacttgactataatataatccacacctttaatgtttctaaatagctattatataatccgaagaaatgatctgctgactaagtaacatgataaacgtacatatcacgttggaattgtctgtcctctcctattacgacgaaaaccattattattttttaactcaaaaaattcaaaaatgtttgtcataaaaacgtgtatactattagctggtacaaacgttaaattaaataattatgtagttaatcatagtttcagagtgtcagataatgaatattaaatttcattggcattattcactcgaatctcaatgatataattaagttacttttatttaaacaattttgttttgggtatgactactttagtgggataacgttcgtgaaaattactagtatatgtcatttgtcaacttaagaacttgcctgatttctacaaagttaaaaaaattgcaagcaacattttcactgttcaaaaccaaagtttaaatgtgtaataagtagtatatatataagaacaaaaaaaaaaaaactgttttactttatgattgttaaaagatactattgttttagaatttgcttcctcagtgatgcttatgaagaagtacaatcacggacaacaatagtggcgagaacgaacggactagtaaagaaattaagggtggagatggagatgaatcatgatgtttatatagtgactttaatgatcttttgttttttctctgtttttctctgttttaacatgagagtcaatctcatttgagtaagttttggatgaaggctttgataccataagaagcggtaaaactatattttattgaacggaaaggttaatatatgcaaaatccaaagccaaacttatatagataacataacataaagagatctaatgaaaactaaagaatatagtagaaatcaaattactaaaaatatactaaaatctttttgtgacatatatatccggtagattgatatcccggtttttgtcatctcttccaatgttgtatctctacaatctccgttactcttaagaaatataaacaagataaatgaaggagatgaaattatgggtgatgaggccatataaaagtgtcgattgcaaaagctcgcttctcatggagagtattgtcatggaaggcaagaagtccgtattccgagagaagcaaatccaatctccactcttccatctcttcataatcctcctttgtgtatcttgggtaatgcaacggcatcttaaacccactgcttggggcctttacggcaccgtttttgtcaagattctccacactttcttgatttttggcatggttcagaaagttaagaagccaaccccccttccccatctctctctctcgttttttttggtttatgatcgattgtgttgcttgtgtgcttatatatagagattacggtgagattacgtgaagaaacggaaatgacacattacatgaattaaagggtacaattttaatccacattaattataccatttatataagccacctcatgagttcgattaaagaagcaacaaggggaatgaattgggttttaatcattgaagatatttatcgtaattaagaacaataccacaaaggggaagagcttttatcaaaagaaaagatgatgtgtgtataaaattggtaagttagtaacgtttggtgaagagcacattattttagccatgaatggaattgcgtgagtaagttaattaagaaggagatgtacgtaattatgaatttataatcacgattcacgaatattattactgcagtctggctgtatatacgtcaccgtctcattcaattataccatgttactttccgtttaagaatgaatattatatttttgcccaaagaaaaagaatgtatattatttacacaaaccagaaaacgtaagagaattaatgaattagggacgtgaagaaactagtaagcatatcaatatatcatgaagaaaaatttctgttggcgttttaaaaaaaaaagttatgcctcaaaagtcagtccaatgttttccacatgctatgctctgggcaagtatatattctttgaaccaccatcgaaataagtaataaaaatttgagataaaatatttaaaaatacttccggtgtcaggaaattgacttatataaattgtagtttataagaatttttaaaatggagttggtttaattaccacatgttgccatggattaattgattcctcctaaaactttatgttaattaccacatgcactacgaaagtacaaattaattgatatcttattacagttaaaaagccagctaatatcatcatcccagttttttccgctataagaaaattaatccgttttatactccacacaacacaacaatatccaaaacatgtttatgtcaaaaagagcaattacagaataataattacacgagagaatcaagaagagcgattgagagaattgaagaattgtatgatgctgtaatagtaatgtgaataataattagtcttttttttcttatgaaataatgaagaaaagtcattgagtacataggaatttgaccgtacgatctgaaatgtttacacgcgaagatttcgacggttgcgatgaagtaccttatgtaatcataaccattgaaacagttgacttttgttgacaaaactatcaaacatcatcgaatcaaataatgcttagaattattgattgcattgcaagaaacaagactaatgatg

SEQ ID NO: 31113 - DNA, 3000 bp, Unknown; identical to SEQ ID NO: 31112
  misc_feature (1)..( 3000): 2750-1469P.txt file - cDNA_ID_3038920; gDNA_ID_1972096; Annot_ID_178601

SEQ ID NO: 31114 - DNA, 3000 bp, Unknown; identical to SEQ ID NO: 11000
  misc_feature (1)..( 3000): 2750-1469P.txt file - cDNA_ID_3038923; gDNA_ID_2214470; Annot_ID_182977

SEQ ID NO: 31115 - DNA, 3000 bp, Unknown; identical to SEQ ID NO: 9337
  misc_feature (1)..( 3000): 2750-1469P.txt file - cDNA_ID_3038923; gDNA_ID_1972096; Annot_ID_178600

SEQ ID NO: 31116 - DNA, 3003 bp, Unknown; identical to SEQ ID NO: 26938
  misc_feature (1)..( 3003): 2750-1469P.txt file - cDNA_ID_3038932; gDNA_ID_2213625; Annot_ID_195824

SEQ ID NO: 31117 - DNA, 3003 bp, Unknown; identical to SEQ ID NO: 26938
  misc_feature (1)..( 3003): 2750-1469P.txt file - cDNA_ID_3038932; gDNA_ID_2214475; Annot_ID_183094

SEQ ID NO: 31118 - DNA, 3003 bp, Unknown
  misc_feature (1)..( 3003): 2750-1469P.txt file - cDNA_ID_3038936; gDNA_ID_2213625; Annot_ID_195823
aactagtgcatctcctgatcgagaacaaaaataaaaagcttgtcgtgtaagttttgtcacaacgtacttatcaaattaagcatccttttacagatagtctaactagtatctcttctgcagattcttcatgacatgtgcttgtgttgattactggggactcgtactttcaaaaattcctaccctcaagtccatttccttcttttccacccatgggaagatggatcagaaaggtagagacacggcattagcttcgtttacagaggcatcaagcggtgtccttctatgcacagatgtcgctgcacgtggacttgacattccaggcatcgattacgttgttcaggttgattgattaatgcttgttatgccatctttgttgcaatggattttgacaggttattgtatgtaactggtgcagtatgatcccccacaagacccagatgtatttatccatagggttggcaggactgcaagaatggaaagacaaggtagggccattgtgtttttaatgcccaaggagacagactatgtagagttcatgcgcattcgaagggtccctcttcaggagagaaaatgctctgagaacgcttctgatgtcatcccgattgtaagaaaacctccacgtatctcttttttctctctttctctctctcgctctcggccacagggtggtttaataataagtgctacaatgtaaaatgcagatacgttcactagccatcaaggaccgggcagtgttggagaagggattacaggcatttgtttcctttgtccgtgcttataaggagcatcactgctcttacattttcaggttcatttttcgccttgtgttgttaaaatatgttagcttttgtaactccattcttttgttccccttaaatttacagttggaaaggacttgaaatcggaaagttagccatgggatatggcatcttgtcttttccttacatatctgaagttaaacaagacagaattggcattgtcggttttacacctgtccaaggcatcacgtttgaggacataaaatacaagaacaaatctcgggagaaacaaagacagcaaaacttactagcaaggaaagacaaactgcaacaagaaaagagagggaaacgcaagaaaagctccaaagaggcggttgatgattctaacaaagcgtcgagaaagagaaagttaacggggaggcaaagacaaactatccaaacagcgcaagatgaagaagaaatgaatttgagattatagcttactggaaaaactgaagaaaggctcaattatagaagatgattttgctaaacttacaggagctcatgattttgtctgataaagaagcaagaaaacatttcaggcttcagcagagatgggaaggtggacgactatttattataactgagatcatgttttgtcttttggttgattctaaacatattggtcagaaagaatttaacaaaaggattctcaaatttaaaaagctctggagtggttttgtttttggtgagaacaagggttggaaaagttctgtaattagaaacgaaagctcaagacacatgtctaaagctattttcaatcctggtgaacataccagccggatttcagagtagagaatatatagccactgttgagagtcacaaaatacctcaacgctctttaagagatgtcaatctaaaatcgccccattatttttccagcttagctttcggcccattatatatttatttgaaaaaaatacccgctcttttattttaaaattttcataatctttcatgatcatgatccactgatccaggattaaaacatggcataaccagcaagtgatccgactaattctagaggtgaaacctacctgataatcataagaaatctattaatccatgtaattagcaagatggattactatataaaatgagatgaacatcaatgtttgtaactttgagaattgtcatttgaaacaaatctcatcttcatgattttatatctcaatctattaatctattataacttggtgatttcattctcccctttttaaaaaactttcttgcacctaataaaattctaatttatgttaataagctcatttgagcataaacctatcttggtttggttacataattgcttttcgttaacaaacatatgaaggttgctggtgtcacttgatttataactttcaaagactttcgtgtacaactccaaataaaaagagtaaaaatgaaagaagaggtcggccaaaggcgaggtcgacgcagatgaaaacgccaggtgtctcagaagaagggagcaatcgaagctggatctctctttacgccacgtcatttttagtcaacatcatgtgggacccatttccttaaccgtcattctccttctctaccgttcactagtttcctaattttgaatttcaattatttattggatttttaatttttatgaagtaatttcacactgacaaatatagtactgtaacttattcaactattcaaacttgctactttggttgctgctatatacgataacactgttatagaaaggtgtatactcattgctcgttggttttaaattggaatacaaacaaatttccagaagataaacaaattattgaaagataacttatgtcctaagtaattggtatgatggtttttactctgataattaaattagtgattttggacaaacggaaaaatcaggaaatcttaaaaatatttgtttattttgtttgatcggtttgttgttgctgaaagtttttgatcgaaaattttgtgattgaatatttagagttactttgtcaaagttggatacctaattaccaaattgcatttccaatctaaatctaacttatacatatgtctgtatgtttgtaactaacataggaacacatatgtcttgttttaacgcatatataattttattttattttgttgtgatgttttgttacaatctaaaatatgtaatagaatttttgaatacttttaatttaaaattttgggatattcctaatgatgatattaatagaccaaaatg

SEQ ID NO: 31119 - DNA, 3003 bp, Unknown; identical to SEQ ID NO: 31118
  misc_feature (1)..( 3003): 2750-1469P.txt file - cDNA_ID_3038936; gDNA_ID_2214475; Annot_ID_183093

SEQ ID NO: 31120 - DNA, 3003 bp, Unknown
  misc_feature (1)..( 3003): 2750-1469P.txt file - cDNA_ID_3038950; gDNA_ID_2684228; Annot_ID_192120
tcacccaacagtggctgatacagaatggaacggaggtggaagcatcaaaagacaaactaatgcagagatgaagtctaggacatctcaaacaggagacttgtctggtgaatcttataggagagatcccaacagagattactcaaccgtaagtctctcctcttgttatatcgtgtaccttaaaccttttggtatgtaattattaagttgctttgggctgtgtcatcagggcaatgcaccaaggaaaaacagaatcaattactcaggaccattgatgcctcctggtggaaatcttgaagatttgcttaaagagcatgagaagcagatccaacaagctgtccgcaaagcacgtgtagaaaagtctgcatcaagaaaaaaccaagctttaacaggacaacaacagcagcaacgttacacaggaagaaatgctcggtagctgaaaaagggaacaagaagccatagaactcataagcgtttttgttgttgtgcctcttctgtgcttgaagccagggattgatacaatgtatagtcgaatttgtttcttaggccaacaagattgactacactataatgtcaagctaccttttgtatatacacaaggtctctctattgagttgagtcaaacaaacaaagatgtatctgcaagggaaagcaaaaaattccaaatttgctacattctatgattctagctcagctcaagtaattaaaacctaccattagctgaaaatctcataccacataacctctgcaacaattccacatatcaagctaaagctactgagcaaaaaactcacgaggaaaaaaaaggctgaattcttgagaaattagcaaacttttttgcataaacaagttcgctctgacctagctactgagtagtgagtactgagcaaacattccacgagaaaaaaaaaaccttaattcttgagaaattcgaaaactttttgcataaacttgaaaagcttaaattagaatcagataatgaattcttcaaaccagaaaaacttcaccgatattcccaaaaccaaatcatatgttttcaatcgaaagactaataaacctaaaccctctgttttctatttcccggcgaagtggccggcgatatcttgcttttttgtaacctctgttttctgtttggcccaaatccagaaaagcccaaagcccatttgggaagatattaataaaaatattttaattaaaaaatagacgggtatgggttcaaagacccgacaacgtacggtattcgggttacatatgaataattcgggtatatatatgtttttaaggattaattagaaacaaagagattacagtaatatactatgtatggtcaaagttgaaactcgtaaattgtgaatttgtgatgttactagatgagctgataattttttccttttttttttgcaaggattgaatccaaatctcttatgatgtttttatttattttccattttataagtacaagactttattatacttttaaaaaaacgtaaagtataataaaattgtaaattttcaatgcgtacttaaggaaagtcgttaaaaaaaatgtaatatttaacaggatgtcaaaaataaaacatatttggtcatacttgcatattttactattgatgatatccttacccacaaaagaaaagtaatttgtctggtttgaaaatcttataatttatgtattttttataaattggtaataaactgtgtaattatatgaaattttcttagtttaaattgttaatgatttgtaggcttattgaagtgcgaaaaagtcgggatgagtaaggctagaaatgttagtaaagaagaaaatatctgaaaacaaaataaaataggcaatgtcttgcttaccgtgaagaggaaagggcattaacccaatgccacacaaaaaaaaactgaatttcgtaggccataattttttcatttttagccttatgtatttaaattgtatagtgcatagtgagtatttgtttgggaagtccacacgctatgtattagaaatttatgcacatgctaatggaagataattttaataacataagtacataactaaaataacgaaaatctcttttggaataatcaacatattaaaagaaaatgaaaattaaaaagaaaaagagaaattgattttgtgttatcaatgggccacttaaaaaaaaaaaattataaacaaaattagtagtaaggttaatctttgtaaccgtgtcttcttctaaatcataaacttctttttttgcttcaattttataagagtatttggctatcatatctatagagagaaaattggtttgataactacgtgagtttgttgaataatttttttaaaggaaagatagataaatagtggtttgaatattttattttctttcatcttatcactatcgaatatgtttttcgttatttggattatttttttaataataaaagccacatttgtttattcgccctaagctatatttagccttagcacgacactgaaaatagaaagagaccagagtcgttagattttacgagtgacttctaacttacgagattaaccgcagactggttcaaaagaccatcctcactttcctaagatccaagtaatcaaaattcactttcactcaaatcacctctctatttaaacaacaacaccactttttcaatcctcattaacaaagttaaaaaaacaaaacaacaccatcttcactttttttttttcttcttattttttgttttctttctctatacatattgtatcaaaaaataaatacattttcctgtattttattttttttgtgagtattaaagaaaacacaagacaagaatgacatacacagcggtaactatgctctctctctgcctaataaatatcttttcatcttatggcaaagagtgtcgagttttggcccgacttgtaatgtagtttcatcaatgagactcttaacattatatcatatcattgcctcactttattacattttttgtaacgttacgcgctgttagttctcttaattcattatattaagcatg

SEQ ID NO: 31121 - DNA, 3000 bp, Unknown; identical to SEQ ID NO: 26943
  misc_feature (1)..( 3000): 2750-1469P.txt file - cDNA_ID_3038950; gDNA_ID_2214475; Annot_ID_183074

SEQ ID NO: 31122 - DNA, 3000 bp, Unknown
  misc_feature (1)..( 3000): 2750-1469P.txt file - cDNA_ID_3038961; gDNA_ID_2214476; Annot_ID_183150
aagtatagaaaatagaaatatgacgtgctaaattgagctatggacaaaatcatatatgagaaaatgaatgtagatggatagagtcgtcccacacttaaggttggtccacaatgaataccgttggaggcttcgcaggcttttgttctgtccttgtctctctctcccctaaaaaaaatttgttaccgaaaaattcatttgaattaattttggtcggtatgtgtataatattatacaattataatatatttctaggtttagacatttttttattttatttttcatgaagtaaagaacacaaacaaaaacccataaaataatgtaagatagataaaacaagaggatgtcgtcataaataaattggaatttggcatttaatgaaaaagggtgaaaggtgcttgacatacacgcgccgtagtttcttacccggaaagggattggtattgatgttaactagaccgggcccggtttaggctggggcggcggccgaaccgaccacctggctactattcttgtttgtattcgctgattctgcaaatctaaactcggatcttttatggacttggattttcgggtgggtggggttctgctaaagagacggcgctcttgtcattttaagtcgggtcactgcaaaacggtgaaccctgtgactgtatttagagtctcgttacgttggatctctctccatgaaccgtccaaagtaggtcaatttttgtgggttcactcacgtatacaacgaagtacggcgctatttaattttccgaaaattttgaaagagacttttataccagaaaagtttgtaatccaaatttttaatatattgcagatttggttcgttttgggcttaaagagcttttattggtgtggtggctcaaatcgtttttgtaggcgtcaggtcaggcccattttcaatgtcgcttgctcatttgatacgctaatatagggctttgcttaagatttgaatgggccgtacccccattttgcttcatgagaatgggatggtaataaagaaaaaaatgacaggaaacaatgaattggtcacgaaaaaatgttgtattactttttccaaaatgcacctttgagaatcttaagattcaatcatacagtgaggtccatgtccacaataagaaatcaaataccaaacaaagtataaacgtgaattgtaagctaggcagtgtatgaagatgcatttgtcttaaagttaccgaatctgataaataatattattcgatcgactttagatcgctttccatgcagatttatgcaattatctggaagaagaacaaaacaatatcttagtttcttcggcctcactattcgacttctatcttcaatatattttcgcgtatttttttatttgaattatttggtttttggttagttaactaaacgagcaacagaaccaagatcgaattgcgtttgccgtttggattcaattattgtagaaaattcgacttttcagacatttgttacgttctttctagtagttatattagttattatatgtggagtggaaagagatgaaagtagatgtaaaacataagtgatttcttcatagtgattttaaaactttttgttgattttcaaaattatataatatccataaaaaatagcctatgcgtgttggatgcttacaaagaagaatttgttttcggcgttagccaaaagtcgatggcatttgctaaaggtgttatttgagtggaaatgatctagaacaaaaacgcattgatataccaccactataatgatttggagacgtatctagttctcatcaacttttcaatagtaaacgcattatcaaggtaaaccgaagagttttgctttatcagtgtaccatacacacattaatagattgatggacgttagtgactttggtattgactttaacgccaaatggacatcaattctgcaaggcaatgcctagttccaaagcaggcgttacttaacatttaactaaaggtagtgcaaactggttaatactttttaacggctttggcaggaagagtctcgactaaaaggagaggaagagatgagatcgacgaagattttcatatcataaaaagtaatataggtttttgaaaatagttagaataattatttttatttttatttttatgggaaagaagttgcacgagtcggtccacagaatgacagaacaaaagcattttagaagtttagaaccaaccaatcactatagttttccacttgtccggtatctcattggttcatcgaatattaacttacatggaaacagtaaaaagcgtggaataagtcggtaaaactgaaatctaaaaatgaaaagatttcgatttcgatataaatacttaatctttataaaataatatcgaaatcttttcatttttagttttcagttttacacttttacttgataaatttaatacatctgttaattttttttcttctaaaattaacatatgatatctattcgggagataaccctaagaaaactgataaaaataaataagttactttttacaaagtcgaataaattatttacccttctgctttaatggcaattatcttaatattgcaaaaaaaaaaagagagaaatattactacaaaacagaagcaagcaagtgaaaccagaccagaagagagaggaagacgaagagagaaacagaacagagtagggatcgatagaccgtggaatctcagaatcacaaacactttgcaaaagggttttcaattcctatttatttacaaagaaatcatcaatagtagtggtctctagggttttgcttgctcttcttcgtgacccctttttacctgcaaacaacaacttcaaaattggcgtgtttcgtacggtctatctaaccctaatctgtcacaaaacactcttcttctctcacccctttttctgggtttattcaattctcgtgcttttggttctgttttcttctctggggatttggttttcttgagtgagtttttctcctctttcttatgttcttgatttgattattatatagaattatggtaatg

SEQ ID NO: 31123 - DNA, 3003 bp, Unknown
  misc_feature (1)..( 3003): 2750-1469P.txt file - cDNA_ID_3038992; gDNA_ID_2214480; Annot_ID_133246
tcctccaatctaaaaacccatatgagtaatctcgacattagtaataaactaataatgcattaatagcctattagtctgatgttcacaagaggtgtacattacctttagtacagcaacaccacccgaaagcttagccaacctttcttgcaacttctccttgtcataatcagaagtgcttgcttcaaccatggatcgtatctgcgtggtttaataaaaattcaaaacatattaaaactaccagttggaaaaaagggcaaaggtatatgacactgaaccactaaatgataaaaaagcgaaaaacacgctaacctgttcacatcgttccccaattgcttgcttgtcaccagccccatcgagaacaacagtatcatctttggataccgttacctgttaacaaatgaaaaccaagttatcagaaggtacaagggagaaagagagaaagcagaaggaattggaccaaacgaaccttcttgcagtttccaaacatactgaggtcaatgttgtctagattcatacccaactcttctgttattacctacaaagtgaaatcaccaaagacacattatggctcatccgattagtgtgggtgtgatggtcttggcagttattataaaaagaaacatgggcatgcctgggctccagtgagggcagctagatcatgtaaattggcctttcggttctctccaaaaccaggggccttcacagcacagacctataaagcaataccatgtacatcaatccaatcaaattaattttttactaagacgttgtaaggaaaaggcaaataacaaaaggctgaaaagaaaaaccttgatattagcacgaagtttgttcagaattagggtggcaagagcatcgctctccacatcctcagcaacgatcagcagcggcctttgcttctgaaaaatggcagtgaaaataaatttcgatcttcagatcaaagtaacttaatgaatatcagacactattgacagtgaagaaatcgccaaattgtttataccttgagggccagttctaatactttcaccattgcgtttatattggaaattttcttctcgtggataagaatgagaggatcttctagttcctgcaacacatattcattcagagcaaattaaatccgcaattccttaaattgataaagtaacaaggtgggaatccttacacatttttgtgttttcgggttagttatgaagtacggggagatgtatcccctgtcaatcttcataccctcaacaacttccagctcattaaacaaggtcttgccatcctgaatcaagagatgataacattggtcaccttaaggaataagcaaaataatttgacatttagggataaaattcaactcacttgaattgtgatcactccctctttgccgacagtttccatagcctttgcaatcagttcaccaatttccctatctccattagctgatattgttccaacttgggcgatttcttcagaggtgctaatcatgcgtgctcggctctgcaagttcgtcacaacagtatcaactgccaatttgataccacgtcttaggtccattgcattcattccagcggcaactgatttacaaccttccgtgaagatagctctagtaaggactgtggcacacgttgttcctgtaacgcataccatatattttgtcagatacaaaaacaccgattaatatgagtagataggagactaacaacccaattagcaaaaacagaaaaaacgttttaatccattgaaagggaacacttaccatcaccagctacgtcatttgtggcgttagcaacctgtttcacaagactggcaccaacgttcttaattctatccttgaactcaatgctcttggcaacagtcacaccatcctttgtcacctttggtgcaccccagctttgttcgatgatgacattacgacccttcaaaaatggttttagacatgtagtatcagagagtgtgagggtaacaaaacagacgattgttgatacttgtcaataggtcgtcacgttatctatttttaactagattcacttacaatacaagtctcttacacagaaattatctgaaacataagtttataccttgggtcccatagtgactttaactgcatcagcaagatcctcaacacccctaagcattaaagcccgagcttcaacaccgaaccttatgtcttttgctgcataattcctagtagaattgagcctgcttccaatctaacaatacacaaattcacatcaatacatacccacaaacggctaaaccacaaattagatacaaaatgaagaacacgaacctggcttgtacactttctggcaatcctgttgaaacaaagaaaaataaatcccatcaataaatgaagcaacttccagaaatacaaagaaaatagaagatgctaaactctccaatggcagagaaatattcaattcaatccgatcaaaatccgattcaattcccaacagtttctcgcaactttccgatttcgaggatccaatcagaaacaaattcacagaaaataaagcagcattggaatcatatacacaaagaaaaccaaaaagtcgaatagatctacctagctttggaagcaacgttggagacaagccgatacatggtgattgattctctcacacaaccgagaagattgcaattaattcagatcagaccgaactaaagaagctaaattgacaaattctctcactcgtagatgaggagaaatgaagcagatcgtcgaagattctataagcagtagggtttagggttttacgttttctccaagctcatcattgcttggtcgagttttagcctccggttttggatccggttcgagttttgacccggtactattttaatatgggccttttaaagcccagttcattattacaacattttaaaaaaaaagtcaccaaaaaaaagatttttcatttcatttcatttctgattgtctttctcagaatccctagaacacacactgattaacgaatcaaagatcgatttggggatcaatcgaggaagaagatg

SEQ ID NO: 31124 - DNA, 3003 bp, Unknown; identical to SEQ ID NO: 31123
  misc_feature (1)..( 3003): 2750-1469P.txt file - cDNA_ID_3038992; gDNA_ID_2214480; Annot_ID_183316

SEQ ID NO: 31125 - DNA, 3000 bp, Unknown; identical to SEQ ID NO: 11157
  misc_feature (1)..( 3000): 2750-1469P.txt file - cDNA_ID_3038996; gDNA_ID_2214480; Annot_ID_133245

SEQ ID NO: 31126 - DNA, 3000 bp, Unknown; identical to SEQ ID NO: 11147
  misc_feature (1)..( 3000): 2750-1469P.txt file - cDNA_ID_3038996; gDNA_ID_2214480; Annot_ID_183315

SEQ ID NO: 31127 - DNA, 3000 bp, Unknown; identical to SEQ ID NO: 11144
  misc_feature (1)..( 3000): 2750-1469P.txt file - cDNA_ID_3039010; gDNA_ID_2214480; Annot_ID_183305

SEQ ID NO: 31128 - DNA, 3003 bp, Unknown
  misc_feature (1)..( 3003): 2750-1469P.txt file - cDNA_ID_3039026; gDNA_ID_2214481; Annot_ID_133276
tatttgtatatacatgatatgtgagcagaaatatctgagatagaagcgaaagataaggaatgtctaaaaggatacattgatgcgcctttaagctattgtatggctaggatttatccgtcgttgtgttatcgaaattgtcgtttttacaagggcgcgaaaggtggaaaatgcgacggtcttaagtgcttctgcgacttctgcagcgacaagcctttttagtcagtttctgatgagaaatgtttgaatcttggcatgtataatggtttgtgtaatgattaaaggtaaacgaacaagtaatagtcaataagtaaaataaaaattaaaaacgctagactttgattgtgttatcactaaaataaatgaagataagtgggacttcggttgtggatcactcacgagtgaacaagagatcttgtatttggaaaaactagataattgatgggaagcttcataaaaataattatctaaataaataaaatttataatatatctcgtgaagaacgagagagagatggagatatcttcgaaacgagtgaagacaaattttattattttgatttttttgtttgtttaaagagaagatatgatatgagagcatattccttaggcaaactatgctagttcccaaattcacccactacacaaacacaatgaggtctactagaaatataatagttatgacagctaatgactcgtggttctcgtggttgttgtcctaacgatgaagatatatagcttagcaccacaacaagtgttgagcataagtccatatttgttaactccaactccaaagtgatcaaagagagaaagagatagagaatcgccatggcaaagatgtcagcactttctatcttcgccatctttatcatcctcgttctggttatctttggtaaatttatttctcacatatttattcaactttatgattcacaggatccaaagagtatttctttcggtgatagcaataagtttcattatatgtgattttttatatgcttaaatctgtatgtacatatatttgtgcagaaatacctgagatagaagcacatgatagcgagtgtctgaaagaatatgggggtgatgttgggtttggcttctgtgcgcctaagatatttccgacgatttgttatagaaattgccaaaaggacaagggggctaatggtggaaaatgcctctggggagagggcggtaaagtgaaatgcttatgcgacttctgcagcaatgaatcttttaatcagtttataagtcttacttgaaacttgcatgtgtcgtcgtttgtgtaataagcaaggctaatgatccaagaaataatgtaacaatgaataagtaaaataaagaaccgctaggctttgctagtcttactactattattaaataaggatacttcaatctcgttaagatcgatctcgtagaagatcaatccctttctctcttttagccatctgaaaacaaatcaagtactgcagatttgatttgacggatagaagtatataacgttgtattgataaatgataaacccaaaacaactaggtataatgcgataatttaaataaacgtataaacgacatatgagtttgtgataagtgttggatgagcaaccaaaaataaatcaagatccattaagagatttcatcgtaaagataagtgtttttttttttttttgatgcaattttatctcttactatacattacctaattatggcgtcggcttcaactttgtgttgaaactgtaaacccaaacaaaaaaaaacaaaaaaatatgaggttagatgcgacttcgctttccgtaattatgatctttattgttacagatgaacaagacatttttattataaaatacagaaatgacgaagaaattaatggtatttatcatatagtagatagtaaattagtgtgttctgtcgtaaaaaaatattaaataatgtgttccaaatgatcataaatcatgtacgacaaaaagaaagtcataaagcgtccgattaatttatggctaaatccaacggttagaaattaacttcaatttggtgacgtgtgaacaacaagatcaatagattctcggtgagaagaaaataaaagaaaaatggggatatcgggttcaaagcgagttacgacgattctatctaactcgcccgagtttgactcggcttgtgactcagcatacgacgaatctctctctcttgcacagcatgctttcgccggagttcgtccttaccagctcgtctccgccgccgcccacatccaccggaatctttccgctcttcgtttccctctaatcaccagatggctctcttctcctccgagtcaatcccaagtcgactcagctctccgagtcaccgtctctcgagtcacggcggcggatgaggaggagatcctcgggcaagaggagttcaagaaatgggccgtcgaggttttcgcggaagccgttgtgggaaacgcgaggaagacaatagcgagtcggattccgttaggaatcgtcggaatcggtgggatcggcgccgtgactcggtcgggtcaaaacttgatcggagctgcgattggtgtgtacgcgataggagttgctacttccgtttttctaagcctcactgattagaagaaaagattacgttgttgttcttgatttgctgaaattaataaattttaacaatcttgtttaaacatcaaccctatatttgaacaatcataaacttcaaactcttacatgtggtttgattgctaaacataaacatatctgtttaatccaagataaaagacagaactagtggagcttaaaaaagatcacgtgaaaaacgtctttacctacaaagcaatataatccagatttgcccaatctagtagggactgttcgtgcctccgatatttgtagtttcctttttttttggctccgaatatttatttgatattaataagattttacaaaagaagctcaatcaatcatttcatatcactttaaaagcagcaatgtccgaatacatctccaaagtaagcaataagcaaaggaaaatg

SEQ ID NO: 31129 - DNA, 3003 bp, Unknown
  misc_feature (1)..( 3003): 2750-1469P.txt file - cDNA_ID_3039026; gDNA_ID_2214481; Annot_ID_183364
gcaagtttctttatatgtgaattttatttgccaaaactaatttatttgtatatacatgatatgtgagcagaaatatctgagatagaagcgaaagataaggaatgtctaaaaggatacattgatgcgcctttaagctattgtatggctaggatttatccgtcgttgtgttatcgaaattgtcgtttttacaagggcgcgaaaggtggaaaatgcgacggtcttaagtgcttctgcgacttctgcagcgacaagcctttttagtcagtttctgatgagaaatgtttgaatcttggcatgtataatggtttgtgtaatgattaaaggtaaacgaacaagtaatagtcaataagtaaaataaaaattaaaaacgctagactttgattgtgttatcactaaaataaatgaagataagtgggacttcggttgtggatcactcacgagtgaacaagagatcttgtatttggaaaaactagataattgatgggaagcttcataaaaataattatctaaataaataaaatttataatatatctcgtgaagaacgagagagagatggagatatcttcgaaacgagtgaagacaaattttattattttgatttttttgtttgtttaaagagaagatatgatatgagagcatattccttaggcaaactatgctagttcccaaattcacccactacacaaacacaatgaggtctactagaaatataatagttatgacagctaatgactcgtggttctcgtggttgttgtcctaacgatgaagatatatagcttagcaccacaacaagtgttgagcataagtccatatttgttaactccaactccaaagtgatcaaagagagaaagagatagagaatcgccatggcaaagatgtcagcactttctatcttcgccatctttatcatcctcgttctggttatctttggtaaatttatttctcacatatttattcaactttatgattcacaggatccaaagagtatttctttcggtgatagcaataagtttcattatatgtgattttttatatgcttaaatctgtatgtacatatatttgtgcagaaatacctgagatagaagcacatgatagcgagtgtctgaaagaatatgggggtgatgttgggtttggcttctgtgcgcctaagatatttccgacgatttgttatagaaattgccaaaaggacaagggggctaatggtggaaaatgcctctggggagagggcggtaaagtgaaatgcttatgcgacttctgcagcaatgaatcttttaatcagtttataagtcttacttgaaacttgcatgtgtcgtcgtttgtgtaataagcaaggctaatgatccaagaaataatgtaacaatgaataagtaaaataaagaaccgctaggctttgctagtcttactactattattaaataaggatacttcaatctcgttaagatcgatctcgtagaagatcaatccctttctctcttttagccatctgaaaacaaatcaagtactgcagatttgatttgacggatagaagtatataacgttgtattgataaatgataaacccaaaacaactaggtataatgcgataatttaaataaacgtataaacgacatatgagtttgtgataagtgttggatgagcaaccaaaaataaatcaagatccattaagagatttcatcgtaaagataagtgtttttttttttttttgatgcaattttatctcttactatacattacctaattatggcgtcggcttcaactttgtgttgaaactgtaaacccaaacaaaaaaaaacaaaaaaatatgaggttagatgcgacttcgctttccgtaattatgatctttattgttacagatgaacaagacatttttattataaaatacagaaatgacgaagaaattaatggtatttatcatatagtagatagtaaattagtgtgttctgtcgtaaaaaaatattaaataatgtgttccaaatgatcataaatcatgtacgacaaaaagaaagtcataaagcgtccgattaatttatggctaaatccaacggttagaaattaacttcaatttggtgacgtgtgaacaacaagatcaatagattctcggtgagaagaaaataaaagaaaaatggggatatcgggttcaaagcgagttacgacgattctatctaactcgcccgagtttgactcggcttgtgactcagcatacgacgaatctctctctcttgcacagcatgctttcgccggagttcgtccttaccagctcgtctccgccgccgcccacatccaccggaatctttccgctcttcgtttccctctaatcaccagatggctctcttctcctccgagtcaatcccaagtcgactcagctctccgagtcaccgtctctcgagtcacggcggcggatgaggaggagatcctcgggcaagaggagttcaagaaatgggccgtcgaggttttcgcggaagccgttgtgggaaacgcgaggaagacaatagcgagtcggattccgttaggaatcgtcggaatcggtgggatcggcgccgtgactcggtcgggtcaaaacttgatcggagctgcgattggtgtgtacgcgataggagttgctacttccgtttttctaagcctcactgattagaagaaaagattacgttgttgttcttgatttgctgaaattaataaattttaacaatcttgtttaaacatcaaccctatatttgaacaatcataaacttcaaactcttacatgtggtttgattgctaaacataaacatatctgtttaatccaagataaaagacagaactagtggagcttaaaaaagatcacgtgaaaaacgtctttacctacaaagcaatataatccagatttgcccaatctagtagggactgttcgtgcctccgatatttgtagtttcctttttttttggctccgaatatttatttgatattaataagattttacaaaagaagctcaatcaatcatttcatatcactttaaaagcagcaatg

SEQ ID NO: 31130 - DNA, 3003 bp, Unknown
  misc_feature (1)..( 3003): 2750-1469P.txt file - cDNA_ID_3039070; gDNA_ID_2214481; Annot_ID_183349
tattcccttttgaagccatgaaacaaacatttcctttaggataaacgcaaaaaaatagaaaagatttcctttggtcaatatttgctcatttggttaaggtcaatttagattaaacgcttgccttgatcatttgggtttttatagaatatataaaatttatcttatcaagtaagaaaaaaaaaagcattaattatatcagttatcataaattgaaacttttaacattagttgataatatctagattctgggatgtgtatatttagtttgttgagattcttttataatcattatcttttttctttatctcaattgaaagttgaagaaaatatatagagttcaataccaaaatagttcggtaagaattgtgcatatctctatcttattgacaacgaaccatttgtatttattgtatagaacctcactttcaaatatatgattggcttatgtagttggttaacatttaatacatctttttgacaattcatatgtttttaaaaaaacttcaaagcattccttcgacctttcttgcatttttctttacatgagagacatgttttatctaacaaaaaggacataatagtgtgtattttcctaaaggtaattaagtttttcttaattcagaactttagattaaaaaaatcgaacgcattaacaagtatcattggtgaccgacatgtgcttattctcaattaaattagtaattgaataaaattaccaaaccaaaaccggttttcagacacgcaactgaaagccgtcgatatttaaagggtttatcagaagtcagaaatctagcacgacagacaaaacataaaagatggaggaaaaaagagaaaacactaactcgatctacatagttcccgagctattggaagatattttccttcgattgcctttgaaatcaatcctgaaattcaaaaccgtatcaagacaatggagatcaatcctggaatccaagttgttcgtggagaggcgcgggaatcttcaaaagcaccaccggaaaatcctagctgcttacaactgcaactactttatgcggccgagtatcttccctgagtctcgtttcgaaggggacgaagagatcgtttatctacactgcgacgccgcgcaaccctcgatgacttgcgacggtttactctgcatcaccgaacctggttggtttaacgttttgaacccatccgctggacaactccggcgattccctcccggcccaggtccagtaaaaggtaaaatctaacattatagttgtttgtttcttgcagtgaaagaaattaaaaatatttacaacttgcaggaccgcaggaaaattggctattgggattcggtagagacaacgttacgggcaggtataaaatagtgaggatgtgttttcatgattgttatgaatttggtattcttgatattgaaactggtgtatggagcaaactgaggtcacctcctcataatatgcttccgggaagtaaatcggtgtgtgtgaatggatcaatctactggttacaaattagtgcgggttacataatattagctatggatcttcacgaagaaagctatcatggtgtccaccaccttccggctacgtgggtcacgcaggaaacccagttagtgaaccttgaggaccgtctagccatggccatgaccaccaacgttgggcctgaatggatactagagatctggagcatggatatagaaggaaaaggatggagcaagggttactcgtggagcaagagttactccataagtttagcccatggagttggtttttcctggccatggcagaaaaggtggttcactcctgtgtgggtttctaagcaagggaatcttctcttctacgataatcacaagaggctattcaaatattattcaggaacagatgagattcgttgtctctcctctaacatctgtgttatatcttcttatgttgaaaatttggccccacttccgttaaaaccaagccatacgcatcatgatcttgggaattcgaattccaagttcagcacgtccagatgccacttgtttccgacgcgaggttcttggatatccaaagttttgtttacctctatactatttgggtatatctgcttacctctctagaagtttacttatttagtatcaaactattgttgtggttctaaaatcttgctatatttttaaagttaattcaattaattgttgcttttatagtttactctactattttattaaagttataatgttaagatccgtaagtaaacattgtttaagcattaattagattattatcaacattgtttatttatgagaaatcctaatatcaactatcataaattgaaacttttatacattagttgataatatctcgatgatattaaatatgatgtgtatattttagtttgttgagaatcttttatataatcattacctctactgaaagataaataaaccaaaacaaaaatcagtttgttcaatactaaagtttatttcagttcagtaagagttgtgcctatcttattgacaacgaacccccccttgtattatttgtataggacctaacttcatacccatttttcaaatatatgattgattgccttatgtagttggttaacatttaatacattttcttgacaattcatatttttgaaaaaacttcaaagcattccttcaggcttcaaccaagctcttttatttctgaaatcactttccttgcatttttacatgagaagacatgttttatttaaccaaaaaaaagggacataacatttgctagtttgtattttcgctcacacttgttgccgttaacctttttcctaaaggtaattagtttttcttcgtttagataaaaaaaaatttggaacgcattgagatgtgaattacaagtcataattggtgaccgacatgtactttttctcaaataaattaattgaacgaaattaccaaaccaaaaccggttttcagatatacacttaaagtcgatatttaagggtttatcaaaagtcagaaccacgacgacagacaaaacataaaagatg

SEQ ID NO: 31131 - DNA, 3000 bp, Unknown; identical to SEQ ID NO: 11163
  misc_feature (1)..( 3000): 2750-1469P.txt file - cDNA_ID_3039078; gDNA_ID_2214481; Annot_ID_183346

SEQ ID NO: 31132 - DNA, 3000 bp, Unknown; identical to SEQ ID NO: 11162
  misc_feature (1)..( 3000): 2750-1469P.txt file - cDNA_ID_3039082; gDNA_ID_2214481; Annot_ID_183345

SEQ ID NO: 31133 - DNA, 3003 bp, Unknown
  misc_feature (1)..( 3003): 2750-1469P.txt file - cDNA_ID_3039086; gDNA_ID_2214481; Annot_ID_183344
tgtaatatatctattaaattaacacacaccaaaatcatattcataggattgggttcatgcctagtccaaatgggtggaggagaaaagcatgattcatgcactcgtacccattttttcttttaaaactattataaatggtatgtttatttttttgtactaaaaaaaggatgcttttaaaaatcctttaaaaattctaaacttagaggatgttattggtttatgattttaaaagagtttttgtgacttaaaagtgtcatgtaaaatatgttgttattcaatcataatttttaaaagtttgtaaaagttttgtgttattcaattaaaacaaaaaaatctctcaaaattcaattatcacagattaaacatcattcattattctcagaattcatattgtttttaaaaatttcataacaaaaaaactacacattttacgaactttatatttgtatatctacgtatatttttttgttagccaattttcatagaccaacattctttatcaaattgccacataattaggcacaggcttccgtctacgaagggctttgatgttcttacgaaattattcaaatcacattcattttatacagcctttttaaacatatttattttagtatttacatcaaaacatattgaacattcccgtctacttcatccttttaaaatcacattcatgttatacagccttctttatctaaacgacggaggaaaacaaaaaaacgaagatgcgcttttggttgcatctgtaggactggttggttcgaacacttgttaccaaagaacaaagcgtctctcttggtcaggcaagttttagctctcaaataaccaccaacgcaaaatgatcgcagtcaagactctttgactcttatcttttgtattaaagataaatgaacatgtgataagaataataacagattagatgttgcatgtaatactactagactagatctacagaaggatcaaagaaagtagtaccaaagtagacatcaataatgaaattgcaagcaaaacagaataaatgttgtctcctcgattgcaagcaaaacagaataattattgcaaattctcccctcgatcatcttgtgttagatatctgtgccgctgaagacacttctctcgaaaggattcgataaaaatcacagatacacatctcccaaactaacaacacagcacaaccaagcaatgcaaaagcttttcaatgatagaatccagctcccatatatcagcttctttaaagatatcaccggtaacaagtttgttacagttggacattcttttctagaatttccaggaaaaccaacatcctagtatcacacaaaagaaaactcaagttcatatataccatgaaaaaggtagatctgctgtttcttataaaaccaacatacacccgtgtctgaattaataccatctcaaaaacccaactactctaaaaccatcattatcgcatcaaattcactacaagaaaaaacaaaacaaaaccaaagaatccagctcccatatatatctaaatatgctataaaacatcaattgtaacagttttgttacagttgtatcaaatgagtgagtccattgttttccaatatttccaggcatatacaagaacaagaaaaccaacattatttcagggactaaaaatcattccagggctaaaagaagtgctctttcaaactcaagttcagataaatcatttgtatgtcttaaaagacaaaactgtagctgcttttaatttagaggaagacatgagaagacatcagatcaagactgcctccaatcgtgataagaagctaataaataatgtaggcaccatgcaaaaggttgctctgctgtttcttataaacccaacaagcacccgtgtctgacttaatgccatctcaagaacccaacaactactctaaaaccatcattatcgcatccttatcaccacaagaaaaacaaatcaaaaccaaagaatccaaataatattatgtcgccaagagtattgaatcatgaaactatagagaaataagtttcatgggtcttcctctggcatttgatctaggctccaagcggcagtcaggtcaccattaaaagtggcgcctgctgttgactcgataaaaatggagcctttatctcgtaaaacaaaaacattcgaaaacgcacagatctataacaagtttcaaacgaaacgatacatgattgatgcggagaaagagagagaatcgagattatatagtagtgactgtggggaggagaagcaaaaccctagcattttgaactgtgagaataacgggcttttaaactgtctttattaagcccaatcactcattacttgggcccatcatagtcatctatatatattcagaaacgatggcttgttgaaccaatctcacaagtcacaagtcaaaatgacgtagttttgacttcgagcgatgtatttgcatatttggtaaggttttgcaattgtttataagaaaatcagaaatttttgagagatccaactgaaaaaaattaacatctatattcattcatacccataatggttatcacaaatattattatttattatcaaaattcatatatatgttaataaaagttgggttcataacataaaaaacactttcactaagtttatatttgtatctacgtattttttttgtttttgttaaccaaatttcatacacccacactctgtgtagaccaaaaacaagtcctcaaatttcatatataggcctgcctaaaggccaaaaaagttttgttgcccatttacaaacaaaaattccaaaaatgttaaaattttgagccatcaatttttctatttctaaacgtatataattaacaataaaagcgatattcaaataccatccacaagaaacttttaacaagttgtcttaataagtaatttactatacttggaagcttggcttaacatataaatacactaatagttaaaccatattcaacagccagaatattcaaaggaaaaagaaaaagaaaaaaaaaatacattactagaagaaaaaaatg

SEQ ID NO: 31134 - DNA, 3003 bp, Unknown; identical to SEQ ID NO: 26952
  misc_feature (1)..( 3003): 2750-1469P.txt file - cDNA_ID_3039097; gDNA_ID_2214481; Annot_ID_183338

SEQ ID NO: 31135 - DNA, 3003 bp, Unknown; identical to SEQ ID NO: 25393
  misc_feature (1)..( 3003): 2750-1469P.txt file - cDNA_ID_3039100; gDNA_ID_2214481; Annot_ID_183336

SEQ ID NO: 31136 - DNA, 3000 bp, Unknown
  misc_feature (1)..( 3000): 2750-1469P.txt file - cDNA_ID_3039141; gDNA_ID_2214482; Annot_ID_183400
ttgtcatctgtaattcgactcctccacccacaaaatatttggataggctcccgacatggaggccatcactacgtaaatgcaacagtgacaaaataaagtataagaaaaacttgattatcatcctatgtaaatatttatatatctaagaggaaccgtgataagattcttaaactgatctaagtttttcaaagtaaattgcccgttgaacatgatgatgcattgattacaagtcttttgttgtataacttttaacacacaaaaatagtattttatcaacaacaaaaaaaaaaccttcaacaaaaatgtgaggtatgatcttatgagttatgaccaacgtaaaatgaagtaaaagacaaattaataaatacttaagtgtattgaagcatgtgcaagtatgggccacttgattaggaatcgaagttggtctaaccgcaacatttgcatgtggccacaaccttcaaagtcccttgatcttattatatcattaatgatccattcacatttttttcttttctaactgtttaattttgttgtccacaaacatattttacaatacatatataaatctggccgcaacaaaaaataaaataaatatatcttactctgctcaaggttaacggtggcatacattgttgactttgcttctagttatccacacaagtcacccatttggccatttctaaatttgatgttccatttcgttggagaaaaaaacccctatgtgtgtattaatgtatgaaagaataccaaaagataataaggatattcattgggatttaacgagaaataaaaggcacaattctctcgcaaattggtcaaaaatacgaataaataaatcaactaaatacccaaaaaggtgaaagaattagagacaccccaatgtacttcatatagtaaacatttaaatatgattatcgcttggcacaattattcactcgagtacccctatatatacccattccttccatttgtagattccatattattcacgattctcatcaaatcatctccgatactcacaaccgaaataactaacccctcctcaacaaaaaacaacaaaacatgtacactccatcatacttaaaatattcaataatctcaattatatccgtattattcctccaaggaactcatggagacgacggaggttggcaaggtggtcacgccacgttttacggcggcgaagatgcttccggcaccatgggtacgtatgaccaatcccaatatctaaaaatgcataagttagctaaattgtctctttatccacgtgtaagttagctaacaagtggcatgcacaaatcaggcggagcttgtggctatggaaatttgtatggccaaggttacgggacgaacacggcggctttaagtacggctctattcaacaacggactcacgtgtggcgcgtgctatgagatgaagtgtaacgatgacccgaggtggtgtctcgggtcaaccatcaccgtcacagctacaaacttttgcccacctaaccctggcctctccaacgataatggaggttggtgcaatcctcctcttcagcatttcgacctcgccgagccagcttttcttcagatcgctcagtatcgtgccggcattgttcctgtctctttccgaaggtccgtttacttttctttaaacttgggacgctaagtgataagattgcgaaaagacaattaactgacagtttttaacatgtagtcccaatccatatatagtagtgtttactattaacaaattttcaaaacattaaaattgtaggtttatttgggaaaagaaaaacacacttttttttaacaaaaccaacctttaccttataaatttactagtccgaaactaatagacaagtcttttgtagctagtagctaccatagttaaaacttaatacccaacaaagaatttgttcctaattaatctctatttaatgagcttatcttaactaaatagtatatgttttttgggtcttaaatgggatatagcatttttctgataatgtttaacactaaaaccacactattaagcaatagcctatgcaagatcttgtatgtataagtccatgtttcttaaataatggcttaattttgtcggtgtttttacgtgattattgcagagtaccatgtatgaagaaaggaggaataaggtttacgatcaacggacactcatacttcaacctcgttctgatctccaacgtaggaggagcaggagacgtacacgccgtctcaatcaaaggctcaaaaacacagtcgtggcaagcgatgtctagaaactggggacaaaactggcagagcaattcatacatgaacgaccaaagcctttccttccaggtaacgaccagcgatggtcgcacactcgttagcaacgacgtggctccttctaattggcagttcggacaaacctaccaaggtggtcagttctgatccaaaccatcatccacatctctctgttttgggtgctgacgtggctgcatattgctgaggtggctcgtaagcacccgcttaattagcttagccttttttttctcttatttacgaattattgcttcaatggttgtattttcattgtgcctacaaaaaagcaaggtttttttacatgtttattggatttttttcttctctttataagccaatatcgacgcccaaaagaatgaaattacacatgaattgatttaataatttcgaattttatttaatcaactacaaaggtttttttttttttccttacacaaagtgtttatatacacgattataaactatccggacaaaccggttcaccaaacgaaaatcaaatgtgtaaaccacattatcatctctaatagcaaccccgccaaaaataagccattgtatcttgtagtaaacttgtatgattgtatccatcacatcacaatttgatgtttatgaaatctttgagtgctttctcatctaatcaggcccataagtaggccattatcatcactattagtaatgggccaaaaccccgtgaatttggtcacgcacgactcaaatg

SEQ ID NO: 31137 - DNA, 3003 bp, Unknown; identical to SEQ ID NO: 24979
  misc_feature (1)..( 3003): 2750-1469P.txt file - cDNA_ID_3039145; gDNA_ID_2214482; Annot_ID_183397

SEQ ID NO: 31138 - DNA, 3003 bp, Unknown; identical to SEQ ID NO: 17140
  misc_feature (1)..( 3003): 2750-1469P.txt file - cDNA_ID_3039161; gDNA_ID_2214482; Annot_ID_183389

SEQ ID NO: 31139 - DNA, 3000 bp, Unknown
  misc_feature (1)..( 3000): 2750-1469P.txt file - cDNA_ID_3039165; gDNA_ID_2214482; Annot_ID_183387
tggtcaccatcaaagcatcaaatgttagtatgcaatgcatattaatgtgtttgtatattacactgatctgacattgaagaaaaaactgagaaagaacaaaacttacgaaagtgtcatcaagcttgaaaggaacccaataaccacgaccaccgaatcgagtcaccgcctcctgaaccgatccgaatggaggagaagtatcgatttcagctctcaacccaactctcctaattccaggtacattagaaacaccaaccggatcaacacagaacccggaattctcagaaccgggttgaatcctgacatcatggatcccaggcgtacccggaatcgcctcagccacatgataattctgatgctgctcctctgccaatgccatcgccaccacaaagaaccaagagatggacgaattcgaagggttttaaagaggagcccttttcacttatcataattaataaaattacaaaagaaaagagaaagggaaaaggagatgaaaaaagcaaaagagcttttgaagaaggaatcgatatgattgtgctttctcgttacagagtcacactatcaccccactcggagagtgagaagaagagagagacacagagacagattataacgacgtgatgacgtggtgaattatgattggttggttgtttagattgaccggtgttaaagacaaggttcatgtgagaacggttgtatgggatggttgactgattactcgatttgggccgttgattgcgggcttattgggaattgcagtttcttctgtgtagcttttgcaaaaaaggcagggatttagggtggcatggaccaatcaatcaaacgacgacgtttgcgctgccgacggttgatcccacggatcttttgttttcacgatgttttcttttaggaagttatgggccaataataagcccatactgtttgatgtatgaatacattaatcggaaaagtaactcgttcatagatacaccaaagtaaaaaagaaaggtgaaaaatgggttaaatcatatatagtcaatgctataaaatctgtgttcatcataaaatagaagtcacaaaaatgtaattttttttaacgaatttatcactagtgaaaatatcagaatacatatgcatacttgatactttacataacgaaatctaattttaaaagattttcaaaaacaaaaaaaggggacaaacgtatggtaaatgagcagaataattgttatattgatttttggtacgcataattatcacaaccaccttatctttcacaatgttatgatttttttttttttttatggggtcacttacgtaaataagtggaaccttgcattgcatccattattttattttgtctgattctatctcaagatgaaagtttaccatacatcaaccatgattaatggctgtaatcaagtcggaagtaactcattacaaagtacctcggttttgagctttccatttatagataattgattatatgtggggttttaaacaaaattttatagtactttttaacatagctagtatttggggtttaatgtttgagcatataaaacctcttaatcaaaataatggattaatattcgacacgtgacaactacactattacactggcataaacaaaacaaaaatagttaagaaaaaaggtgacgaataccaccaatagctatgaagaaaaggcaaaccaaactaattatgtaatcaatctacagtttgttatagtgaattttattatacatacgactattagatatctttgtttacctataaccctatgtttaaatagaaccatgagcatgaaaagtaaatgtaaaatatcttcactcttttaccaaaaattatcttcaaactaaaatgcattaatacataatcaaccgtttagagtgtctataatctataagcctatagcctacactatttaagtaggctgttcttcataacctagccgtctacaaaaatatcaaaaccgaaatgcatagaactgcctaatcggttgtctcttctagtcttctgttattagaactgccctaaacaataatctgaaataaattgtagatgcatacatacacatatatacacgtagtgcatgtaggtagatgtatgaattaaataggaggagcttcgccttatatttttctaactaactttgtcttcatttctctatcgaattaaagaaaaatctcagtacgagacaatggaccacgaacgcatctcctatacattaatacgactcaactgtacatccaacggtccacactcttccgcctctctaccttctctttagtatcctacacgttttttttatatgatcatcttccaaacgacattaatagtgacatcggttttttaatctttttctttagtaaacttttcttacatggatattctagctaccactggagttcacttgatttctaggttcaatcaattgtagaaaaagttatgatcctacgttataaggagtaatacgtttttttcttgtccaatctatattaaactcatttcgaaatcaaaattgatgtgtaaatagtagtaacaattaagtcgtatacactaatgaacagtataacgcccccactcatttattatctaaccattttttggccctctacaattattttcgagtatcttatatatatgtcatatgcatccatgtgaaatttaccaatacaaaaaaaaaaccccgaaaataatacagatactacaaaaaaaataagaacaatagattaaaatgcacatgacatgtgctaacacatgacatgtgctaacacaccccatgcaaaaaaagagatcctttaattcttccgcaaacttctcttacactaccaaagcatcacttttccaaaaatagatgcgcctttgtctctcttttgcatatctgcagaagcttcgttgtcttcggatctcgcattttctttcttttttctccattttcgatattttcattctgcagataaaaacctgtctcaacgacatatccagagaggaaagttttggttacagaagcattaaatg

SEQ ID NO: 31140 - DNA, 3003 bp, Unknown; identical to SEQ ID NO: 20977
  misc_feature (1)..( 3003): 2750-1469P.txt file - cDNA_ID_3039168; gDNA_ID_2214482; Annot_ID_183385

SEQ ID NO: 31141 - DNA, 3000 bp, Unknown; identical to SEQ ID NO: 11174
  misc_feature (1)..( 3000): 2750-1469P.txt file - cDNA_ID_3039172; gDNA_ID_2214482; Annot_ID_183383

SEQ ID NO: 31142 - DNA, 3000 bp, Unknown; identical to SEQ ID NO: 26953
  misc_feature (1)..( 3000): 2750-1469P.txt file - cDNA_ID_3039180; gDNA_ID_2214482; Annot_ID_183380

SEQ ID NO: 31143 - DNA, 1146 bp, Unknown; identical to SEQ ID NO: 11173
  misc_feature (1)..( 1146): 2750-1469P.txt file - cDNA_ID_3039184; gDNA_ID_2214482; Annot_ID_183379

SEQ ID NO: 31144 - DNA, 2063 bp, Unknown; identical to SEQ ID NO: 11201
  misc_feature (1)..( 2063): 2750-1469P.txt file - cDNA_ID_3039207; gDNA_ID_2214483; Annot_ID_183438

SEQ ID NO: 31145 - DNA, 3000 bp, Unknown; identical to SEQ ID NO: 11203
  misc_feature (1)..( 3000): 2750-1469P.txt file - cDNA_ID_3039211; gDNA_ID_2214483; Annot_ID_183432

SEQ ID NO: 31146 - DNA, 3003 bp, Unknown; identical to SEQ ID NO: 24993
  misc_feature (1)..( 3003): 2750-1469P.txt file - cDNA_ID_3039223; gDNA_ID_2214483; Annot_ID_183428

SEQ ID NO: 31147 - DNA, 3003 bp, Unknown; identical to SEQ ID NO: 16933
  misc_feature (1)..( 3003): 2750-1469P.txt file - cDNA_ID_3039233; gDNA_ID_2214483; Annot_ID_183423

SEQ ID NO: 31148 - DNA, 3003 bp, Unknown
  misc_feature (1)..( 3003): 2750-1469P.txt file - cDNA_ID_3039239; gDNA_ID_2214483; Annot_ID_183420
tttcccttttctacttggttatccagtttatctgattatttctggtgaatctgtcaaattttcagcttcatgtatacttgagaacctatggacttgaacaaatggtccaagctgcaagctctgctgttggtcttcgaacgatcaagcgggttgagcagactctgcaagatctcggggtttgtctttgcttcttgttctgtttaactctttctatttgtctatctcatttgcttatctttccccattgattgatgatgagacttaactaatgttataaaaggcacccgtactgaagctagctttgaatgtgttctatgtaattagttgggattttggttcgggtagaggctagtaggttcttgtcagtttatttgattgtagccactcttaagatttactaaatggattttttgagtatatagagttttctgtttacaggttaatttaaagccaaaggttcctaccaaaactgtatgcgatgagcatcttgagctaagaaaagaaatattaacactactgaatcttcagaagcaggtaaaccatacaatacaagtcttatctcacatagattcacaaatatacagctatttgtttatttaacttgttgccaaaacatggtggggtcgtaacttcagctgcaatataaggaatcagaaggttcatcacatcgtgaagggtcgtatgccgcaatgccagacactccaaaggtgagcaacaaactttgtttattggttctcgctacagtttcatcttcctgttgatctctttaatttctatatatatttgatcaggatcgtgttttcgcaccggacccattcagttttggaggtacattatttccttatcttgttggtttcagcattgtatgcactacttaaccatctctaagttcattttgtgtgtttatttcagctgaaagaccaatcaagaaggaacaaaaacgcaaggtggtgcacatcagagtttgctcttctttatttttcgtaccaattcctccgaaaatcctttgcatctacatgtaaaacttgaatcttaattaaaatatgtttgggaatcctgcagggtcctggaagacaagcagatactccttcaccagctcataagcgtccgagaaagttgaaagcctctgatctctaaaatctctctactcggtgcatactgactcgcaatttcatgtgtatgtatttgcctttttccggtgatttccgcaatgttttcagttcttaaattatttctgatctctaaaatctctctacttgtactcagacaccgcactatcttgtcaagccaattagagaaattgagaaaatgttgcacattatatttatgactagtaagaattattacatctaaagacattttcgaaaatgttaaattacaaatggttgattggtatgataaagaaaagaataaaaattaattagatagaagagagagtaaactatcgaaataagaaacacaatatcaggaggtggaaggcgaggagacacattcataagaatgtagataacagggagcttgaggtgggtagagacagagaagaagacagttgacaacaattgttgagtcttgaaggagtctcgctacatacatgtaaagaaaaacaaggattactactttatttcttcaaacttatagattcttctattgataggcaaaaatcttagcttcaatgtgtttatatgtatgccaaaactccaaccaaagaaagaatgtccatactttttctctcaacttagcaataagtcccattatacagtgggatttaagattactgaaattttcaacacttagaaatcttgagtttttagtatactaccaattagaccaaaaaataactaaatttgttccacatgtgacagaggtatactagttattataatcaatatcattatcaatattaagcacaactacattcgaatgactaacagagattcctacgaaaaaacaataatctgaagcaatagaagtaagagaagcaactatacatttggaatcgaatagccgatatgggaatccgccacagattctggagaagaatttgcagtttgtcggagagagcttttgattgaagaaatcagacaaaagttttggaggagagatctcgaaccggaacaaaaagtttacattagtattgaaattagaactaatttgcggttcggtttacactgggctaaagaggaaaaaaaaaaattcacgcgatggtgattttgaagacaactgcgttgataaaaaaaggcatgatttcaaaaggtgaacccctacagaattgctctcacgctctcaacgcgcactttgtgcgagtagatctgaaatacagccttgtgattggctaaaaaactctaaaaaaatagaaatagtagacatgttgctagcttatgttattatttagcttttctacaaaacgccgtcgttttttatttcgatcgtttcagcttttggcattgatccgaaccaatcggttcaactggctaagtctatccacaggtttgtataaaaaatctcatttggtcatgaaattaagcactaaatttatattaattaatcatttaatgcttatagacaaattctatttcatatttctaacgaatcagacctaattgtacgaaataaattattggttctgaaaatatcaattgggaaattaaaacccggttcaatttgaaaccggaaacaagactagctacgcctggaaactctcacacagagtcacaggagaagctcccgcgtctgcaaggaacggataaagtctctctctttctcactctctctcaatgaagaagaagatgctgacgagtcccagtaacgcacttcacagtagtactccacagttctggccagttcgccggagcagactttgccgttcccggaatttccctcgttttcactccggcgaacgcagcagcggcggaggaggaaaattgtgctcgctctctcttctctccggaagtggcgccagtaaattcagtgtcagagctctagttaggcctgatgataccgatg

SEQ ID NO: 31149 - DNA, 3000 bp, Unknown; identical to SEQ ID NO: 11228
  misc_feature (1)..( 3000): 2750-1469P.txt file - cDNA_ID_3039275; gDNA_ID_2214484; Annot_ID_183457

SEQ ID NO: 31150 - DNA, 3000 bp, Unknown; identical to SEQ ID NO: 26956
  misc_feature (1)..( 3000): 2750-1469P.txt file - cDNA_ID_3039279; gDNA_ID_2214484; Annot_ID_183456

SEQ ID NO: 31151 - DNA, 3000 bp, Unknown
  misc_feature (1)..( 3000): 2750-1469P.txt file - cDNA_ID_3039286; gDNA_ID_2214484; Annot_ID_183448
ttttcaccgtcggattagggctaatcaactgtgccaacccaaacagtccccgttgccaaggtcctaacgggacccgattcgcagcaagcatgaacaacatgtccttcgtgctaccacgaagtaactccgtcatgcaagcatattaccaaggcaccccaggaatcttcacaacggattttccgcccgttccaccggtgcaattcgattacacaggtaacgttagccgcgggttatggcagcccataaaaggaaccaaagcttacaagcttaagtacaaatctaatgttcagattgtgttacaagacactagcattgtcacgccagagaatcatcccatgcatctacacgggtaccaattctacgtggtcgggtcaggtttcggtaatttcaacccgagaacagacccggctaggtttaacttatttgacccaccagagaggaacaccattggaacacctccaggtggttgggtggcaattcggttcgtcgctgataatccaggttagatgatcttattgactcgaaagcatttgatactttgtaaccataggttaaatgatcttattgactcaaaaatgaaaaacatattttgatatacttgtggtgtaatgcaggagcatggtttatgcattgtcacattgattcacatttgggatggggtttggctatggttttcttggtagagaacggtcgtggacagttgcaatcggtgcaggctccaccattggatcttccaagatgctaataaaaaacttctaccgttggatctaaagaatttatggggtttggttttttgttcttgttttttaatcaaaaaaagacttcgtgagtcttgatatgttaaagatggacaactgctctattgaaagtggttcaacctttgttttcgatgtacttttgttattttcctcgtaatagagtgagtgttttcatttttccgattaaaaatttaccaaataaaagctgtgttagttaatcttctttttctagctgactttcccaaacaactttattagttattaacttaatatgaacccacaagatacttttaattacattatcatacataaacttttcttgcaaaaatagcatcatatcgatctttaattggccatctttacgagaaaataattcttgaaaaagaacgtaaatagtgtggttgcgattccgttgatcaaaatttaccattaaactgaaaaaaaaaaatagtgatccatgaattacatttctgtataacttcttccacaaaaagatgattttttttggtcaactttctccaaaattctcaaaacaattcgccgtcaatgcctataactcgacataagtaaattgactacaactgccataagattgtaagtttggtggtctgttggtcatcctgatggaatgtagttgtaccattttgaactataatagaatctaatgagatagttttgatcgattgttataaattggataaccctaaatgtaaaagtacaaaaaatacattcttcgttgtggaatcctaataaacaaaattgtcctctggatacttaataattcaaacgtcatgacataagtgatccaaacatcacaaaaaaaattcataatctattggaacaaaaggttgatagacttacatgagtggtatccattccaatcgacactaagatttactgatcccaagttgaattcatgcgaaaatatttacactaaaatggttagaaataggatttggtatggtaaacatttttgggatactctttattggtctcgattttgcaatcaacgtcgcaaataattgatttacgatatcttttacctcacacgaaacgtgtacacaattgtgtattctttcttgcacaaccctagaccttagtttaaacttcaatcttctccgcaatgaaataaaatacacaattatacataatttccataatccaacatttttttttttatatctaaaagcacctccaatggagagaatctgtcgaagggttctctctatttttttatgattaaatttcaaaaaaattaacaaaagagcttttttcttttttttggttttttatagtccaatggtaggttcttttagaagaattctctggaaaaacaatattaatataaaattattttatttcatacaatttaataattattacaaagtataaaatattaaacatacattaatttgaaatattataaaatagatatgaaaaaaaacggaataaagatcagttgttctgttgattgttacaacatttagtcacgatatacaagagaaaatgacttgattcatacctaatttggagaatccgtcaacgattactctccaaatcatattttctattctccgattgagtttatcttccggtgatagtcatcaccatctgcaatgttataaaagtcatgcagtacgtacttaggtgctagagtaccgcctatttcggattaatcgtcgactaggcgttaaatcaaattggcaaatatgctatagtttatataaatatatagtatatataacttttaatcagtcatatttttaaaatttgatgtagcattgtggtctggaaggttgtttttggtagccaaagtgataagttcgatacctacaagtggacaatattatgcattttagttaaaacgaggggtacatctgtaatttcacgtacaaagtcaactgcttttcctacaaaacctaatcgccgtcgtcaaacctgagtttttttttgttctgattttttcgtatttcttctatttcctcatcattttatcgcatctctttaccaaaataacacaaatacaacattaatctttggatgattgaccacaaaatggaatttaacgtagtcttgaacacacgaatttttttgtttcttttgttaagctttacatccaatcaaatttggacacgtgtccgtttctctcctttcttcaaaaacttcccccagctaccatcatcttcgttaactccgctaaagcttttttaaaaaggattactactgtttacttctctgaatg

SEQ ID NO: 31152 - DNA, 1893 bp, Unknown; identical to SEQ ID NO: 11242
  misc_feature (1)..( 1893): 2750-1469P.txt file - cDNA_ID_3039295; gDNA_ID_2214485; Annot_ID_183494

SEQ ID NO: 31153 - DNA, 3000 bp, Unknown; identical to SEQ ID NO: 11252
  misc_feature (1)..( 3000): 2750-1469P.txt file - cDNA_ID_3039302; gDNA_ID_2214485; Annot_ID_183491

SEQ ID NO: 31154 - DNA, 3000 bp, Unknown; identical to SEQ ID NO: 11235
  misc_feature (1)..( 3000): 2750-1469P.txt file - cDNA_ID_3039306; gDNA_ID_2214485; Annot_ID_183488

SEQ ID NO: 31155 - DNA, 3000 bp, Unknown; identical to SEQ ID NO: 11236
  misc_feature (1)..( 3000): 2750-1469P.txt file - cDNA_ID_3039309; gDNA_ID_2214485; Annot_ID_183487

SEQ ID NO: 31156 - DNA, 3000 bp, Unknown; identical to SEQ ID NO: 11248
  misc_feature (1)..( 3000): 2750-1469P.txt file - cDNA_ID_3039313; gDNA_ID_2214485; Annot_ID_133348

SEQ ID NO: 31157 - DNA, 3000 bp, Unknown; identical to SEQ ID NO: 11237
  misc_feature (1)..( 3000): 2750-1469P.txt file - cDNA_ID_3039313; gDNA_ID_2214485; Annot_ID_183485

SEQ ID NO: 31158 - DNA, 3003 bp, Unknown; identical to SEQ ID NO: 24998
  misc_feature (1)..( 3003): 2750-1469P.txt file - cDNA_ID_3039317; gDNA_ID_2214485; Annot_ID_183484

SEQ ID NO: 31159 - DNA, 3000 bp, Unknown; identical to SEQ ID NO: 11238
  misc_feature (1)..( 3000): 2750-1469P.txt file - cDNA_ID_3039321; gDNA_ID_2214485; Annot_ID_183482

SEQ ID NO: 31160 - DNA, 3000 bp, Unknown; identical to SEQ ID NO: 11239
  misc_feature (1)..( 3000): 2750-1469P.txt file - cDNA_ID_3039325; gDNA_ID_2214485; Annot_ID_183480

SEQ ID NO: 31161 - DNA, 3000 bp, Unknown; identical to SEQ ID NO: 24995
  misc_feature (1)..( 3000): 2750-1469P.txt file - cDNA_ID_3039329; gDNA_ID_2214485; Annot_ID_183479

SEQ ID NO: 31162 - DNA, 3003 bp, Unknown
  misc_feature (1)..( 3003): 2750-1469P.txt file - cDNA_ID_3039333; gDNA_ID_2214485; Annot_ID_183478
tgggcatgtgaagccaaaatatctccctgtttccaacatagaaaagataccagtcttgttcaggtagtataatcatcaaagttgtagcaaatttgtaacaactaacccaaggagatactgccattattcaagaaatgctaaccaattcacagaataaacagagagatgtacaagaaaaagtttgaaggcgacaagaaactagggatgaaattgccttcttattagctggaaaaaagaacaaaacatacctcacttcgctacagacaccataatgcgcagatgttatataagtttccagctctatgtcatctttaaaaattttagtaactagctgcaaacagaagacacagggtcgattaaacgtgtgacatatgaagagtaactatcgatctagaatgcagcataagatgaagacgtgatgatgattacccgcagttccggaaacttaagagacaaaatgtcgatcatgttattagtttcatcagtgtcaggtgcaaaagctaaaaaatccccctcagcaagcaaaagcttcaaaacttctggaaaactaggagagttgcctttgcccacttcgacgactgtatctttgtctatgttcctttcatgatcaacagaacaaaatgcagaaaacgaaatcaaaatccaattttagtacgagagagagagaggctagtgacgagtgtaaaaaactgatatcttacgagtgagccgggtgaattgtggtgtcaacccgtgtcctgacggctatcaacagcaacattacaatagtcggaagcaaaatctgccaatgaataagagaaagaagcaaaatttgatcaacaattcgaaattttaaaaacaaaaattgcattcagcatcaaggagaagaagacccattaagacgagcagtgaataagcatgaaaacgacatagttttgaggagcaaagaaaaagagagaaacctcagctgaagtaacgaagggatgacgagttttgaggagccaattcttgcggagcatggccttgaattgcctcttcgatgaacccatttttccttggaacccagaaagaaccctagacgatagattctagtcttggcttcaataagaaatcatacttttatggttcttctttgggaaaaggcaaagcaaagtagcaaactaagaaagcagagagaggtggcgaagacttgggctcacctcactgacatttgtgcttccttttttttttttttttttttcctgccaatttatttgattcattaatcaatttgattatacaatcaaacaaaagaattttgcaactagctgcggataacacaagtggtcgacaaaaatagaagaattccgaaactgtttcatttatttacgggacctttcttcttctatcaaaaaacccaaaaaataaggagaagattagattagttgtcgtgatattaagaaggtaatcttatattaaaccaaaaaaaaagaagaagataatcttataattaatatatataagtacttaagtacagttgctgatgttgacccaaatataaatctttgcgtcaatgccaagtaggggtggctctctcacgggctccacattaaaagcctagtgtagtgtacgtggaacatcctgattcgttttagagttgcgttacgccaattatattacgacgaaaacgacgacgttcctaagtttgacggcaaagtatacgaatgtttttattatttttccgaaggttgccaataaaagccgccattagaattattcctttcattgccactccccaacttgattcttatttttatttttatcagttgtgacacaactttaaagaaatccaccttcatattcaatcctcaaaaatgctgtttttttttaacacagaaaaaaaacaatttttagtaaaattatatcaaatgtagaatcaaaatgacactattttcttcaactaaaaacaatgaaactttttttttaataccattaacttttaataatttatctggattttttcaaaatatatgatcaaatttcaagtaacatctaaatatatgttaaagatgattttgtttgggctgtcgtttccaaggatatttttgttatccgccagagacaaaaaaaatctgttatgagaagcggggctactgggccagctctttgtggcccataatttagaaatattttaaaacttatgtattgtttttgttttttttagggtgcgattttcccgactaaaccaactctacttgtctgtacatgtgtgttcgactaaacaaagttacaatcgtcttctgctttgttgttcgtccatcttctacaatcgaacctacttcccttaacatccaataaaccagagaataaattgatggttttcgattgtctcctgttagctcgatttctccgccggcgacttttgggatcaaatttgattcttcacgattaagattgaattcgccattaggtaaagctgctgaattttaaatgtctagctcaaaatccaaacccaaaacaggtcccaatctaagaaaagtattcattcgtctttgccacctgtacaactttttaagattttcgtttttttctctattggtgaacaagtgattattttagtctacctttttttcgatttccactaactaaaacgcaagtaaatttttatcttttgttttaagggatagtggaggacaaaatcttgaaaactgtttttggatcccttcaccaggtcattcttattctgcttctgtagaaagtaataaactaaagtcataatctatcatgaatatgtgaacttttttgaatttgttgtcttagtatcaaaaagctatggttttgaagattacagctaaacttttcaaacagtgtctttaataagcattaggaatttctcgaatgtttacttgccacattgttcgattatctcttgtctctttttgcacattccttcatgtcttctttcttgtgtgtgtggctgtggcttaaaatatgtgcaggtggagcatcatttaagaatcttatgctttggctacaacgcctatg

SEQ ID NO: 31163 - DNA, 3000 bp, Unknown; identical to SEQ ID NO: 11241
  misc_feature (1)..( 3000): 2750-1469P.txt file - cDNA_ID_3039337; gDNA_ID_2214485; Annot_ID_183477

SEQ ID NO: 31164 - DNA, 3000 bp, Unknown
  misc_feature (1)..( 3000): 2750-1469P.txt file - cDNA_ID_3039341; gDNA_ID_2214486; Annot_ID_183511
atcaacttatcatttcatcttcagattttttttctcttttttttttgttacattaaatcaaatacagttttgttatttaaattaacagagtacttatttttgacaaactttcaaaaactcttgattttaattttaattttctaataacactagtttagtacatttgtttggccaaaacattagttcggtattacacgttttttatgccacaagtcatgttagtcaaatataatgtgcttcaataggactttcaaattttgaatattcctatttattaaattcatttctaatatctgtatttagctttccaccaagacaaaaaatcactgtagcgtgattagcacttagctcacaacgagagaacaggcaaaaggaaagaatgagagattctatcgattcataaaggaaaattgtacctctccaattctctgcttccgtcatcgtagatccatgagatcttcagcgggaaagcttctctcccattctctacggagaaaccgcgggaaacttggtgatggattttggattccggctacgaggtctcagaagatgtggaattcgacggtaccgtcagatgaaaatcctgatcaaaattcgatcgatgcaggatcttcaatgcggaaaccaattagcttatggcctggaatgtatcattctccggtgactaatgcgctttgggaagctcgtcgtaatatgttcgaaattcctaccggagacgacgcttctcagtcaaaattgacggctaaatctccgtctcgaagccgaacgtcaattctctataagttttcttctgattttgttcttcgagaacaatataggaatccttggaatgagattcgtactggtaaattggttgaagatcttgacgctcttgctggaaccatctccttcaaggttcttgtttttggctcttgccttcttatttgtttgcatcctgagtatttgaatataactttgttttgtgtgcttttactgaaacagcattgtggtggtgacagcagtgcgagatcgatgattttggtgactgcttcagtggataggattatcatgaaaagacctattcgtgtagatactgaccttagtatagttggtgctgttacatgggttggtagatcatccatggagatgcaattacaagtactccaaattcaaggtatcagtttctctgtaaactatatagatgatagacacttgagtcttgttaggtttggaggagcttcactgtctcaaaaaaatagaaaggtcatgcttgaactgttgaataaggtggtaaataaagaaatatatatagttgtgaataccagtttgaagcgttgtgagatgtatttgagatgttctgtcaacaacaatcattgtcatcatgtcgaagaagctcatgatttgctatatctttcttctaacaactgttttttgcagataccaacaactcctctgagtcggttgcccttgaagcaaactttacattcgtggctcgggatgctcagacaggcaagtcagctccaattaaccaagtcgtgccagaaactgagcatgaaaaatttctgtggaaagaggcagaagagaggaacaaactacgaaaacaaaagagagcacagggtaaagaagagcatgagaagttgaaggacttagagaggctaaatgagttattagcagaaggacgagtattcctggacatgccagctcttgcagatcggaacagcatcctaattaaggatacttcccatgaaaactcattgatctgccagccacagcaacgaaatattcatggcagaatttttggaggcttcttgatgcgcaaagcttttgagttggctttctccaatgcttacaccttcgctggggtttcaccacgttttctcgaagttgatcgcgtcgattttatcaaaccagtgagttcatttctttctcatcttcatctagttatggtgtgatgtgaaaagaaaaaagacagtgagatatatgatagctttagaagaaagcgattaaggggctgttttctaatgatgcaggtggatgttggaaatttccttcgtttcaagtcacgcgtattgtacacagaagcaaccagttcagctgaaccgctgataaacatcgaggttgtagctcatgttacaagtccagagctcagatccagcgaagtaagtgtacacagataagaatatattgattgaactatgcacaatacatgtttaagctgtgaaggaatttattgagatgtaatttttgggttggtaggtctccaacaggttttacttcaccttcagtgtgagacctgaggccatgaaagatggattgaaaataagaaatgtggttccagcaacagaagaagaagctagaagagtgatcgagcgcatggacgcagagagacccatctcattgccttgattgccgcatttgaacagttgatttcggtaaacaagagaaaacatagtctgactaatatatgaataagaagccatttatgcaaaatagattcgtttgatcattctttccctctgtgatagattaacgatcttcgacaataagagagaaagtcaatgtatagcttaacctacactaataatttgttttttcaggctatttgagtattttctaattaaaaaaatcctgtaaaagaaaagagtaatcatatacttcgttcatttgttgtgttgagtagtgtttatgactggtaaacattttttatgcccaaactatatcaaacaaagttgccttgaaaactactttattaccgaagagaaccaatacaaattcaaggagtgatttagattaacgcctaaatgcatcatttgcgattacaaaatcaaattttgctccagatggattttaattacttttcgtcgcttttttactttagagtttagaccttgaaatcgatggaaagcaatcgaacccgaaattctctcatttctcaatcaaaactatcttctttcacttctgggcaagaagctctgttgtggaacatcggaaatcagaactgaaacagaaacagaaaccatg

SEQ ID NO: 31165 - DNA, 3000 bp, Unknown; identical to SEQ ID NO: 11266
  misc_feature (1)..( 3000): 2750-1469P.txt file - cDNA_ID_3039345; gDNA_ID_2214486; Annot_ID_183510

SEQ ID NO: 31166 - DNA, 3000 bp, Unknown
  misc_feature (1)..( 3000): 2750-1469P.txt file - cDNA_ID_3039361; gDNA_ID_2214486; Annot_ID_183504
tataactagatctataatgcaaaatttgtttactttactcaggttagatgttatcgataggtgcttctcgaagagaacaatggaagaaattatatctgcacttgtaagtttttcattaatatataggatatgtcgacttccgttcctaagttggttgagtttacctttgacattgcactctgtgttggttaggagagagagaccactcaagaactagatgattggagcttaactacgattcgagctttgaagaagtcttcaccctcaagccttaaaatatctcttagatcggttagttcccaaaatgtgtcatatgcaataatgggacagagctgactatgtgtataaatttcagataagagaaggaagattgcaaggggtaggacactgtcttacccgcgagtatagaatggtgtgtcatgtgatgaagggagatttaagcaaagacttggtggaggttttgacagcttttctgattgtatcttcaacctgaaattttactttgtagacaagacaataattaaaaaatcatgttttacttatgcaggggtgcagagccatattgatagacaaagataggaatccaaaggtttaacaaatctctccatttagtatttgttgttatgtcatattgttgaaattatatatgttgtattgttggaattatagtgggagccaaggcgattggaggacatgaaggatagcatggtagatcagttctttgagagagtggaagaagaggagcgatgggaggatcttaagctttcaccaaggaacaacttgcatgctttaagaattgcagcaaagttgtgaagtagaaaaatgtgattggtcagacattaaaccaatgacctaaccaagattctgtgtcggaaccattcttctttttctttttttttttgttgttgtagaaaataagaatacacatgcttcttttactcctttcaaggagtttaatatctcatatttccactactttccctttatgtaattactttcgtgtatgtaggaacttatggttccaagttttttattgaaaataaaagaaaacaaaatcaaggctgaaattttttcctacggaaatattgtgttatatattgtaattgcacatgctttgattggaggttccattatgtgatattagagccttcattacatttttgatctaaaccactttatggtatccaaaccactcattcatcacagatttttatttttatccggtcgcgatttgtggtattaagaggaacacacattatggatgcaagattcggttccaattatggtgtgaatataagtataaattggaattagtctttcttgataaaaccaaagagaagaattgtagaccgaaaacaaaaggaaacaaagaaatgaaaaagttggtatttatgatgaactgtattaatacacagaaattaaattatatagtacaaatgtaacttgctagctaggttttttgtgtgcgaagaagattatcctcgatgacattcctcttattttatactagctcgagccttctaatatattgtgtttttggtgtcttttgtcctatgtttagcagtcgttttggttcatttgtcgtgttaaagtctatcttttgtgtcttttttattgtgttttgaatcttgtacatgttttaggtataggattgggtggtttcgaacgtgtttggatcaaaagcagggatcaaagctgaaactaggagcagagactggtggaccgatggatcggatagctgacggatggcataaactcagtcggatcgattagtcttctccaagaccgattggtctggttttctgactcgtttccttttatttttcagtattctacgacactcatttttaataaatatatattcttgaccgaaacaaacaaagtataattaagatttacaaccacttgacagaaaacaaaagtcataaataatgatttcttacaacaaaccaaaataaagtcacatataatataccaaataagaatctatctttttcaaccatactagcaaaagtcaatgttaaaagaaccataatagcgaaaccacctttctatttctcagtgtcacgcatcaatccaacggacaaaaaaggaagatgaatggaaaaaagggaaatatgagttataaagacaatttattcacgtacgacgtaatttttgtttgattgaaaatgtgcaagtgaaaagatgggtcgactataagataaaataaatactaaactaagagaaaataaaaaactatttgttttagaaaacaaaggaaaatcgatcacgacgaaagttagaaaggttaggcacatgtagtactgtcaatgttgtcatatcttattgatgcaagaataggaatgtgaaattaaaccaacgctctcttttaggacatgtatgagctgacaagtttcaacccctataaaaacgggtagattgtggaatgtgatttgatataagtagcaaaattagattcttacttttagagagctcaatgagatagattaaagttcattaaagctttatttagtgaaaaaatgatttgaagaaataccaaactatgatatactttttcattgaatgaattatgaaacgatgaaacaagagagttgcacaaagtgacaattcttcatgttactctattgatggttcattacatacatatctattaatctacttattacgaaaccctatttacatggatttttggacttttattaagttatgtgtgctttagcagtttcttatgtaagctttaatgctagtggatgagtgtgagacactcagattttcatacttgtgttttcataataagtattaaaattttcattcatttgtttacataaaaatgagatttatataaatcaacaacaaaataaataagaacttttaaactttattttagctacacaaaaaaaaaaaaaccaaaatattttcctatatatatatgcatgtccgggaggatacaaaggcgaaggaaaactgtaagaaaaaaaaaaggagaagaagaagatg

SEQ ID NO: 31167 - DNA, 3000 bp, Unknown; identical to SEQ ID NO: 11274
  misc_feature (1)..( 3000): 2750-1469P.txt file - cDNA_ID_3039426; gDNA_ID_2214487; Annot_ID_183534

SEQ ID NO: 31168 - DNA, 3000 bp, Unknown; identical to SEQ ID NO: 11273
  misc_feature (1)..( 3000): 2750-1469P.txt file - cDNA_ID_3039434; gDNA_ID_2214487; Annot_ID_183531

SEQ ID NO: 31169 - DNA, 3003 bp, Unknown
  misc_feature (1)..( 3003): 2750-1469P.txt file - cDNA_ID_3039473; gDNA_ID_2214488; Annot_ID_183563
gaatgatgttcgtcggagattccaactcatgttatctccaaaacaatttgcgacacttacggtaagaacaaatttactttgtaaattcatctttggttatcacagtaaatcaatcttttgaaattctagaatttctgaacttgaatttgacgatgacagagctgtaccattaattagtcgtcacactaatccaaattgcttaaccggtaccaaattatttaaccgaagtccggtattcggcgatgcggtctagtgtgttcggatgagtcataacgaatggataatgagtgatggtggataaggatttacggcaaagaaaaacagaggcaaattcgttaccagtttaaaaatggcggctttgatccagaccatccatggtggtaaacccaacttgtaaactctcttgtgttcttattgattctttcgatttcgctatctagtggtttaaaagttttccccttttttctgattactgttgtatagacaagaaactagaattgttgaaaacgaattccggtttaggttcttattgggtaaggtagaatccctaattgcacagtttctctcttaagttcacatctcgtgttaaagtacaattttttattcagtttctcagtgtagcattagtttctctaattgattggaattgaattgggcattttggcattaaacgtatgtaatttagcaattggttctcagtttctgattcaattcatcgatatgggttgatttcttggtctgtacttggttattcatattgagcactatacaatgcaggtgtggttgttaccagaaccttgactcttgtttatccttctacctttacgtccagacacaaagctctgaaccagatgacaagtagcagtaacagcggcttgcgacggttcctgttcactccgcctcagcggctaagccaaggtatctgttactggggagcagagctaagcaacaatgtgtcatggacttacaaaacgaaaatggttgttcgatccaaggccggagcagtgcctctgatgaagcatggcgaccggtttctctcctctctctcgtctccagccttagctggtgatccgtcagcgataaaccgacacattaagaagtttgtggctgcttcacccaaatcagttgctctcaatgtcctctctcatctcctctctgatcaaacttcccatcctcatctctccttctttgctctgtctgtgagtctttgcttttttttcctgtttctctcaataaaatattgatgaaggtaaatgactttatattggttgttgttttcttctccagttgtattcggaaattactgaagcgtcgtggtttgattggaatcctaaactcattgctgaacttattgctttgctcaataaacaagaaagatttgatgaatcagaaacgctactttctactgcggtttcgagactgaagtcaaatgaaagagactttactctcttcctctgcaatttggttgaatcaaattctaaacaagggtctatacaaggtttcagtgaagcatcttttcgtttgagagagataatccaaagatcatcatcagtttatgtcaaaactcaagcttacaagtctatggtttctggattatgtaacatggaccagcctcatgatgcggaaagagttatcgaggagatgagaatggaaaaaataaagccgggattgtttgaatataagtctgttctatacggctatggaagattaggattgtttgacgatatgaacagagtagtacacagaatgggaacagaaggtcacaaaatcgacacagtttgttcaaatatggttctctcttcctatggagctcatgatgcattgccccaaatgggttcttggttacagaagttgaagggttttaatgttcctttctccataaggacgtataactcggtcttgaattcttgtcctaccatcatatcaatgttgaaagacttggatagctgtccggtttctctttctgaactgcgtacttttctgaatgaggacgaagcacttctggtccatgaattgactcagtcatcagttttagatgaagcaattgagtggaacgcggtagagggtaagttggatttacatggtatgcacttgagctcatcgtatttgatattgctgcaatggatggatgagaccagacttagatttagcgaagaaaagtgtgtaattcctgcagagattgtagttgtttctggatctggaaagcatagcaatgtaagaggagagtcaccggtgaaagcgctggttaaaaagataatggtgcgtactggaagcccgatgagaattgaccggaagaatgttggtagttttattgccaagggaaaaactgttaaagaatggctctgcaaatgaagatttataactgtatattttgatcacaatttgcttaagattgatcaggaataagttttgcttggaatccaaatcaactcttggtgtcaaattttccaccagaactaatcaggtgagtcgaaattttctctttacactcttaaaattacctgcgtggtagtaaaattctgaatagctggttttagaataagagaaatctgaacaaaaatcatttcagttttcaagtatgtatgttaaaccctagagctctgtgaaattttaacaatagtttgtttgtttctgtttctggtgtatctttagctatattccatgaagtttctagtcttgaataatgtgtatagtttatttcaagcaatggctctggagctttagtttgtttaaaagtgcatctgctctagtcctttgatttggatagcaaataagtgaaagttcttgtccctataaggtttcttcagattaatggtattgatttctcttttgtcttcttaagatttttattcaagagagaatcttggatgtctgcttttctcattcaaaaatttgtcttcaaaaagtgatttttcatgcttgaccttgtccacctttgaactctattaaagtcaaccgatcaaatttgaagaaaaaaaaaagcttttcgtttcacccatgatg

SEQ ID NO: 31170 - DNA, 3003 bp, Unknown; identical to SEQ ID NO: 26964
  misc_feature (1)..( 3003): 2750-1469P.txt file - cDNA_ID_3039477; gDNA_ID_2214488; Annot_ID_183562

SEQ ID NO: 31171 - DNA, 3003 bp, Unknown; identical to SEQ ID NO: 25020
  misc_feature (1)..( 3003): 2750-1469P.txt file - cDNA_ID_3039489; gDNA_ID_2214488; Annot_ID_183558

SEQ ID NO: 31172 - DNA, 3000 bp, Unknown; identical to SEQ ID NO: 11308
  misc_feature (1)..( 3000): 2750-1469P.txt file - cDNA_ID_3039512; gDNA_ID_2214489; Annot_ID_183611

SEQ ID NO: 31173 - DNA, 3003 bp, Unknown
  misc_feature (1)..( 3003): 2750-1469P.txt file - cDNA_ID_3039525; gDNA_ID_2214489; Annot_ID_183605
tactatacttttggcttctagtggtgtcgaatgtattaattataataccatgcatgttctaggcatagattaagggatattattaggattgtgtgattaatatataattaatatgaatgagagaaaataaaacgcgtgaatgagatggaatggaatagaaagcgtaggcgtggcacatgatcatgcaactatcttaattttgtgtctccacaaagctaccgtttttctcgggactttgctttgttgatgttgcgaactctcttcctttttcttttctttttttatataattgatttaactttttggatcggccattcactgataaattttatcattataattaatttgctaatgcaaggaaattccgttatcgattgatgtttattgttcgcagttcaagattgcttttcaatcaccagtatgaatttgtcatctgagcgatgtagcaaacaaacattaggtgagtttgatcttatagacgtatttaccatttgaaaatgatactatataagtgttctaattattaatgttaaatacttatttccatttcttccatagagatatatgtgtgtattgttaattttgtatgattaattagttaagagttcaacttccaacaaccacaaaaaaaacaaaaataaacaaaaagtaacaaatgaagaaaaaacaaaaaaaaaactctaatcaattatgtgatttgatagttttcgttttcccccctgtatagcaaaaaaagaagcagagagggaaagaatttgttttttgttgtaatccgttaaatacttatccgaaacagtatttgaatattccatcaattttgtaagaatctggatcaaaatgtggtattacgtttagttttttttaaaacatatttaacgtttgtgtaattgatatcgtgacttcaccaacttttagagaagcatgagagagatccaaaattccacgtttaaaaataaaagcaaaaataattaatttgttttagagtatagtatatttcttatggacattggtgatttgagacttcgatatttatatattctattaattatagaaaacacatctcgatgactatacaacagtaacaatacaatagtgttagggggggatcaatgatccctacgttcctaagtctagatcgtagatggctattctaaaactcacaatttttatatcgattacagctacccccaaaaaaaaaaaaaaaaacgactacagctataatatattacaaacattactactttattagtgaatgcgcgtgatgcatgacatttaaatgaattctaaataattttcttttgggtttggttcacaattcacatcacgcttctatggtccatatatttttttcctaaaatgccatttaaaagaaacaaaacagtattaattaaaagaaattaatacaagattgttaatggcttatttgccaaaaaataatataaggattattaatgacctcataatacagacaaattaagttccgagtagcctttgttttacggatgatgattattttacaaaatgaatacttattgttttatgttttctacatgtacaattaaaaagagtttaatgttgtactgatataatattgttttccagttgaaattcagtaactattctagttgataaattttatgatgaacacaaaatttgaattcatatataaaaaaatacttatacattgtagaacgtaaccaactaagttggacgttaggtgtttggtattcgtcacataatatattaaaatttgaaactctcagcaaagctacaagtctcttataaaaatgtcattttttggataaagtagtaaatgtagttttacaaaagggatggtgtcctactggtaatatatacagtataaggggagaaaacaaactgttatcaaagatggatgcagtcaaacttccagcttatattttcggttaactgaaagttctaagtccgattcatctagttctgtctctaaaagtgtgttgccagtagtgctttcgtgtcttttctcaactttacatgattgtaacacttcatagcttcctcctccttaccttgctcgaaccaatactctacgaatgcgctactaattcataatgcaaaaggaaggaattggaatcggaatcggattcagatccatggaaggtaaacacgttctcagaccattccacgactccctaaaccagcttgcccatcatgcggatctcaaatgaaatctgtgcacaccaaatctccgtttttccttagtatacgtcttccaccaaactgtcactctcctttctccgccagggtttgccaccgaaacaagataattacaagacagtccttcaagtcccccaaccttggtactccacgcccacggcctagaatcatcactgcaaagtagtttgagtttcccattggaaaccgttgcttggaagtctttgcaatctatgagtaccatgcaaacattcggacacaagttaagcttgtccatcagaagattgtcataaacttttccactaattaggatgccacaatcatgaaaaactaattcaccaactataaaattgttggtcggtaattgagttttcagttaaaggttgtaagtttgtgttgtttcactcaagaggcacaagtagaaagagacacaagtatgaagtgacagaactaattgagttgttgtgtctatttgttttctatataaacaccttgtatcgtcatgtaaagattaacaagtttcagtttcaataaaacaaagttttgttcttgtcttcttcacaagagaagagatatgtctctcttactctgtttttcttctttctctcaataaaccaacatggtatcagagccgatggttgtccttggttgtctctacaaaaataagatgtgttctgctgcgaaaagaaaaagagagatggagacaacaaatctatggtgagatgaagaggaagaagaagagggaagaagaagaaataagaggtggtaactacagagagtaccatcagttttcacaaacacattcacatg

SEQ ID NO: 31174 - DNA, 3000 bp, Unknown; identical to SEQ ID NO: 11328
  misc_feature (1)..( 3000): 2750-1469P.txt file - cDNA_ID_3039528; gDNA_ID_2214489; Annot_ID_133431

SEQ ID NO: 31175 - DNA, 3000 bp, Unknown; identical to SEQ ID NO: 11310
  misc_feature (1)..( 3000): 2750-1469P.txt file - cDNA_ID_3039528; gDNA_ID_2214489; Annot_ID_183604

SEQ ID NO: 31176 - DNA, 3000 bp, Unknown; identical to SEQ ID NO: 11311
  misc_feature (1)..( 3000): 2750-1469P.txt file - cDNA_ID_3039532; gDNA_ID_2214489; Annot_ID_183603

SEQ ID NO: 31177 - DNA, 3000 bp, Unknown; identical to SEQ ID NO: 11314
  misc_feature (1)..( 3000): 2750-1469P.txt file - cDNA_ID_3039536; gDNA_ID_2214489; Annot_ID_183598

SEQ ID NO: 31178 - DNA, 3003 bp, Unknown
  misc_feature (1)..( 3003): 2750-1469P.txt file - cDNA_ID_3039543; gDNA_ID_2214489; Annot_ID_133423
ggttgggagaaggcacttcctgtaagtagaactttctggtaatctataacgttttatcagtattcttcatatataaggctcttattttaggcaacttaaaattttcatttagacatatacaccagactctccgggtgatgccaccagaaacctgtctcagcaatgtcttaacgcacttgcgaaagctgtgcctggttttcttggtgggagtgctgaccttgcatcttccaacatgacaatgcttaaagcattcggcaacttccaaaaagccacacctgaagaaagaaaccttagatttggtgtcagggaacatggtatgggagctatctgcaacggcattgcccttcacagccccggttttatcccttactgcgcaactttctttgtgtttactgactatatgagagctgcaatgagaatctcggctttgtctgaagctggtgttatatacgttatgacccatgactccattggtcttggagaagatggaccaacccaccaacccatcgaacacttatccagtttccgtgccatgcccaatattatgatgttccgtccagctgatgggaacgaaacagccggtgcatacaaaatcgctgtcacaaaacgtaagacaccttctgtcttagccttatctagacaaaagctgcctcaacttccaggaacatctattgagagcgtcgagaaaggtggatacaccatttctgacaactcaaccggtaacaaacccgatgtgatcttgatcggaactggatcagagctagagattgctgctcaagctgcagagaagttaagggaacaaggcaaaagtgtgagagttgtttcctttgtatgttgggagcttttcgacgagcaatcagatgcatacaaggaaagtgttttgccatctgatgtatcagctagagttagtatcgaagctggatcgacttttggatggggaaagatcgtcggaggaaaagggaaatcgattggaattgatacgtttggagcaagtgcaccagcaggaaagctttataaagagtttggtatcaccattgaagctatggttgaagcagccaagtcacttatttaaaaaagtatcttacaggtactaccgaggtttgcatttgaagtaagagacattccataagcattatcttctttgtccaaataaaaatatactccttccaatctttttataaatgatgtttaaagctttcattttggtttttaaataaatgatgttttaaattttcaatgcaaaattatttttattggttgattaaataaatgatgttttaggcttttatttatatttttattgttttcttgtaattaacatagttttgatctttgtaaacaacaactctattgtacttttattcttgattagttgattttatttcgcaaagacatgtaatccttacatgttaattgcaatcgtctcaactagtcttacatctactttgtagtctaattggttgacacaaaaggaatttacggaattctgtctagaatctttccatttttgcttacaaatatggcacaaccggaaattcccttacttatttatggaaaaacaaaagtgtcatgtgttatatatattggtccctttttatgtttgtagggctatcactaccaatccacaatggaagattcacaaccgtgtacatcacgtaacctagatcatgccgaaaactccacagcaagcattcctcttaaactcatcttcgaaatactatcgaggctttcgacgaaatttatcatcagattccgatccgtgtcgatgctgtgacgctctatcatcgatagtaaagatttcgtcgacgcctttctgaatcctcttttttcaatgaagactctttttttagtccgctttatggaataatacttatgttttaacgtaatgaatctttatatctatttgtatttttcagttacacttttgtttggacgttttgttttcaaagaacttctcaagttttcttttccttttttcttcttgtagtttgccttgctcgttggtgaatacactacattaattgagggcacttgcgattatgatgttctcccgcgtgaaagagcattgacctctcttttattcaaaacatcacataacagagagtctgtgaggtttgggacatcgcattctcaaatctcaatataagtggttttggtcgaatgctagaaaagggtgacttgtatgttgtgtcgccgctagtgttcgtacatacagtttatgatctaacgtatctataacatattattaatagatattattttgttttaattttgcacattgtttataaattaagtgcaaaaatttttagctccaagagatcgcctttgctaatcaataaaattgaacgcatttaataaaattgtaagagcaaactcgcactgatacgtagaataaatttgttgcttttgccttcacgacaccattacctatagttaatactccaaaagaaatagcagattcaacatacaacgtgcaagaccaaaaaacaaatgactcgtaatctccagagaatcataattcataacatgggagattgtccacaaaaaacataaattccctttcatgtctttttgttagaaaacccatttcttaaggcccaacaaaaaacataatcccctttcatgtctttttgttagaaaccccatttatctttcttgaggcccaatttgaaaacccacattttctttcacctaacccaccaaagcctttgcacatgttgacgtgaacaccaaactaacacgtgtcatactgccagtggttatgataaatgctcataccataccagagtcatagagtttttggttggtgaaagatttgacggatgccttcttctcatttctcaccaactccctccaaacccaacaaaagtgtttatattagcaaagccgccaaagtgtaaacgaaagtttataaatttcatttctgtgatcttacgtaattggaggaagatcaaaattttcaatccccattcttcgattgcttcaattgaagtttctccgatg

SEQ ID NO: 31179 - DNA, 3003 bp, Unknown; identical to SEQ ID NO: 31178
  misc_feature (1)..( 3003): 2750-1469P.txt file - cDNA_ID_3039543; gDNA_ID_2214489; Annot_ID_183595

SEQ ID NO: 31180 - DNA, 3003 bp, Unknown; identical to SEQ ID NO: 21002
  misc_feature (1)..( 3003): 2750-1469P.txt file - cDNA_ID_3039555; gDNA_ID_2214489; Annot_ID_183590

SEQ ID NO: 31181 - DNA, 3000 bp, Unknown
  misc_feature (1)..( 3000): 2750-1469P.txt file - cDNA_ID_3039558; gDNA_ID_2214489; Annot_ID_183589
aatttaaaaatctcatctcttcaaatctatatataaaacagggggataacagaaaatgcaatggacttggtagtattaggctgagtctcaagtacaggtgtaagtagatagatacagaatgcaatgggatcttaagcccaagtctcaggagtttaacatcaagacctttggagggatctaatctaatctattgaaatctcctaactcgtgggagcatctctccaaaatgatttactaatagtatgatttccagattatgaatccttcttagggtagaacaaaatatggatacctgtcaaatatatatatcttctcttcgagtcacaatcactgctgtaacaatatcttggataatgctcctttctgcctcattactgactgccctttctcctttccaccacatgtgttctggaaatagacaccaagatgtttctactgatcagtctaacagagaccaagatgattcaagacaatctaatgaagccaagtgactagtactaacaacacttacgctgcccatttcccttcactcatttgatgtagattttatactattcacagaccttcctaacacgtttaaagctgctacgcgctgcatctctctcgctgcaccagaggatcaacaacattatttctagcaaatacttgattccagatggttcatagctacaaacctaaaagcatgtgactaaagcctatatagttgtcagcagatatggaaaaaatggcttaagcagcagcatgaataatccacttatggatggtcaactagaactgtgccaaacagatatgattcagcaatggtaggaagtgagagagtggaagcaaaggagtagagtaccttcctcgagagagaactgaatagacctcttttccaagtcaacagcatgcttgctaagctcggcggaggaaagtgaccaaagcactaataacagaggaaacatatctataaaaacaaaagcgcatcaaggtcaggaattagagtgatattgggaggagctttactctgaacatgatcggtccgatcagattgattaagcttgttaagaagcatttgaagatgaaggtaacgctcttcccagtctaacttatggctggtaggggttggttcctgtgcctgtgcctgtgcgggtgatgaaggtatctggggtggtgccttagtaggaggcggattcggattagtagtgctagcagcggctttggatgtgtcaacctccactcttctccggacataaacaagtcgaccgctagcagcattagtagtggctggagagtccactggaggtttctttaccccaattgatgatactgtatcttgttcgatggccttttctgaatcttttggtgtcccctccggaatctccatttcactgcgattaaggagaaactaagaagaagcttacaaataacaggttcaaagaggatctgcggtgcttcaatatcaaccatacgaggactcaggattataattattggaatctgatcagtgaataatcaatcggaggagcgcgaagcaaaacaatttacctggagaacggagatggtgatggagatggatcagagagagaatacgagcagagcagttccgctccgagagatggtgttttcctcatctcctcgctagctagagaggagagtaaagcattgatgggccagtttaaggcccattatgtgcattcacgggccagtcttactccctctacatactgtatagcatcgcattctatggcccatgcttttcagtcacgttgataccaacaaaaaaaacacaagtgaagaacaacactcccgagtgaaattgttgagtttcctttggtgagtttttgcgagtttgagaaaaacaagagatttggacactattccgacacacatcgtgtaaggcttaattcaaaactatcaaccacaaaaaccagatgagaacagaacacaatttttttttttgtcaaaacctggaaaacagggtacgagacgtattggtcattgctgtgagacttggaagcgagggaaacaaagagagatttgagatcatcaagcttcttctgagtaaaagctctgcaacaaaacacacacacacaattgataagatcgattttcaaattagaaattagagagtgaaagtgagattggttccgatgaagacctggaagcagaagtgaagcgatgatcaacagaagacgaattcaaattcccattttcgacggatttttttctctcctcagttctccggcaggtttcgtcgtctctgttcttctattattttttattgatcttccacttcttcaaaattacaacttcaaccccttaaaatctaaatattctaaatgtaccccattacttttaatgcgttgatctcgaagcagcagagtaaaatataaaagttggtgagttgaaatcacacaaagaagagaaaataagaaagataataaaaggacgaggcaaacacgaagagctcacaacgagattcatgctttcagatttcaactggtaagtctaatctgtataaaccttaattattgcaaatcgtccttgttcttatggaatctacaattctttttggtatctttttttatgtgtcactttgttgccgagaaattttactaaaactagtaaagctaagctctttcggtcgtttttcatgttcttcttcatctattggatgccatggaagtagaaatcttcaggaatcttctttggctttgattctgagatttttgcaatttgaaagtttactgtgatttttgagttgtagtgcaatttaagggtcaaaggcttttgtgattttcttggatattttttttgtgattttgagttgtggtgttttctctttttcccgttgttgggatgttgagaaaatttctgtccagaattgttgcttcacactatttgctgattcggtttggtttgcattggttttgaaattaaaactgatttcggttcggtttcatttggttttgtggaaaaaaactaaaagagtcacgcgatagagaatttggagagatg

SEQ ID NO: 31182 - DNA, 3000 bp, Unknown
  misc_feature (1)..( 3000): 2750-1469P.txt file - cDNA_ID_3039564; gDNA_ID_2214489; Annot_ID_183584
cgtcaaagtgtttcgtatccaaatcagacaaggcaaccacaaaagccaaaatattttgtcgtctaacctagctaggcctagccatacttaaatagtattcgaaatatatttatttgggtataagtagtattcaaaatatataattagttagtgggaataagcaagcaacaaacatatccttgcaattgatagctaaaaatcttgagtagacccatatagagaatagaatcgtgttacacttttcctttggtgtttcatcaccaatttccatttcatctttatatcaatgtccaaagacagtataccactaagtgtccccatgctaatcacatcattatcgataatcactattagactcttaataattatttacgttatcagcttactgtataattgagactatcacaagaaaagtgtaaagtgacaaaaagtaacaagattagaaaatggtaaatgaaagggaacaatatctacaaagaaaataaaagcttgaaaatcctaagaactatttccataattgtcttcaattgcggcaatgacggccccatggaaatacccgagaacttgaccccgatgcgatccgggtcttgacccgttcgaaatctgaatacagacaaggaatagtgatacctccttcgtggcaaaatccgtactctttttcggcttctcgaagcagctcaccgaacaaaggatggttaaagtaaacgatgggtaccaaaactctatgacagtcgccgtctttttgacccacgtagatagctaagtgtccccttggaaccgggtcggctttcttatgatcaacgggtatgtatgcggatcttctcgtagacctgcgtctgaaactttgcttgagacgttggccccaacttttgagtttggctaatggtctcatcagcatgcaagcttgctgggtcgagtgtatccggttgtatcctgaacgttggatccgggttttgcgaaagatccatcttgagactcgtctcccgattctaaaccctatgatcttcctcatcttcttatagctaactttaaaaaacagtttttgtcacaaaactacactttttgagagatctgagaggaaatagagattaagagagtgagacgagacatggactaacgagtcaaataaagagtgattcatttgaacgagaataaataaatatatcaatcttttttacattttcttgattttctctataagaaagaaaaaaaaaaagacaatttctagggaaaacacaaattcgaaaatgatgtgaacggacaaagaagaaatgctttcgatgtatataaagtataaacgttaaagaagaagagatcaagagaagaatgagtgaaagacaagaggtctttaaaggagtttatatggagtctaaataaatgaacggttagatgaagactaaggtctatgaccgttggattagattaaaactgccatatttctcttgcttggcagatagtccaaacccgaagaatctacattaaatatgacacgtcccattaacctttagcctacatttatcattatcactgaaacgttttgatgggttatcaatcacaaattcacaatacgaaaaaaaacagtagtgtcaaactattatggtattttagcgtgtaattcgttacgcagatattattatctatggttgattttgaatctgaaaatatgatctatcgaagaaaggcctgaaattattttattatctgaatatgttttgtcggagcttacatgcttagcatgtttgaacttcgaagatgaagacaactatgccaccacacgtgtgctggccaagtgggacaaagttttgaacctattcggtaacactcacacgagatcaaatccccaccatctcattttataatgtcgtttatttatttgttagtgatcatctactgttttttaataaggttagtgccctagtgatcatctacttgtctgtgattttgtaaaaaatatatatagaattaaaattatattacgagaacaaaatgtgtacggtgtgtcctctagttgcgttacttgtgtacgttgatgatggttgatatatatacatattcatatcaggacaaaaaagcttttaaaaagaccaataaagatagatctagttttgagtaattggaggattcactaagctttttggagctaaaatggtgaatttcccacgaatcaaatctgagaagagaagctttctatattttgagttactttacacaattacacgttcatttgtaaattaagatcgtgtttgtgctgcatccaaaaaattcttggaattttaaagtaatgaaatataactaaacaaaatgaccactaaaaaataaaataaaaagcacatgagagatgagtgattatactctgataaattagctaacaaaattatgtatatataaaaaaggttttatgcagtgtaaattgtacttacacacttaatcaaagcaaaacaaaaatattaaaccgacaataatacgtaaaccaaaaaaccaatattccttaaaatcaatttgtgtttccaaccgacaagttctttgtatatatggttaatcatattttgttgtagtccgtatcctagctaaaagacgtttaaacgttcataatggatatgacccacccagctggtgaagatattcgtttttcgtgatcatatatatatgtttctttttgcccatccctgtttctattaacccaagttaaattagctatatatgagcaaaaactatgagttgaagttaagcacaatttccgaatcacaaaaaaaaaacaaattgatttggacctttcgataataggaatcagaaagaagtttgttccaaacacttctcttatataaatcccaactcatcagcttcgtgtttccgtacagtgcgtacatatacgaacgtgtcactcggcttttaacgtcaacttaatcgagagcccaattcaggcttactataagccttaataagcccaatattaaaagtccctgattattgtgagcccaatattaaaagtccatgactatg

SEQ ID NO: 31183 - DNA, 3000 bp, Unknown; identical to SEQ ID NO: 11305
  misc_feature (1)..( 3000): 2750-1469P.txt file - cDNA_ID_3039566; gDNA_ID_2214489; Annot_ID_133413

SEQ ID NO: 31184 - DNA, 3000 bp, Unknown; identical to SEQ ID NO: 11320
  misc_feature (1)..( 3000): 2750-1469P.txt file - cDNA_ID_3039566; gDNA_ID_2214489; Annot_ID_183583

SEQ ID NO: 31185 - DNA, 3003 bp, Unknown
  misc_feature (1)..( 3003): 2750-1469P.txt file - cDNA_ID_3039583; gDNA_ID_2214490; Annot_ID_183642
aagagctgatgatgtattgatgtttcagtacattgcatatttaagaatgtgaaattctggaatgaagcgtgtgaatggtgtgggagagagtgtagaagaagtaaagcaagagattcaaaggaaatagaagaagtggtggtcacgtgggaaatgggaaggggttcacgtgggaagttgccaacgtggcagaacatggtccccagtgaccacactcgtgcggcgtaatttttgttcctccacgaccagacattcacttctctttaatcattggatacttctctcctcctccgactcgatggttcctaacaattccacgcgctcactctcgcgtaatttttcctgtaaaaatcgctgtgatttttttttttttttttttaaatcgttgagagaatttaaagaagagaacgttagaagatactcgataagatctttagcaaaacaaaaaactcaatatattaatacacgtaaatatgagttaaattgtggatatgagtatatttacaatatggtttgagttttgttataactgtatggcgagggaattaatttaaagatatcagttcggtaagagacagctacgaacaggatccggtgaaaaccggccaaagcaaccaaagcccatgttgtaccaacaacgagagtttctgaggtaatcatgcatgaatataaatccttatcatacttacttaattcaagagttcaataattttgatacatctacatttttaaaaagaagatacacaatttggtcccacgtgtgtgtccataaccatgtgcatttataattatacatatattaatgtaaagtatcaatttatattctgttattagcaaaaaaaatatatataaattttgatctttgctcaacatttttttttgacacggtaacaactaacaactgaaatctgttgctcatcggcatatttttattcgtataaatcactcactatcaatgacgtcaaaaagaaaagaaaatcattcaaccatagttctactgtttagtccatccatcaatgttattgcttgctgagccaatttaatcattacaaaataattatgatattttcacgtaccacatgattgtatcgacgtatctaacaatttactcgaaatcattacacatgtccacgtgggaagcccgtcacttattttggtccgttccaagatttgattgattcttataatttattatttgctatccgtgcaatctgtattaataataacatatgctacgttttgaacactaaaacatagggatacgctggaaaggtgtgtaagatattagaatttcagaataacagctgttcacatgcatgcagaaattatatttataaacagagatcataaaggcatacataatctaagtagcatttataagaactaaggtgatcgatcgaacactgaattgaattatatcagaatgaacttgccgccttatcggtgcttttttaaaaagtcgacgaaatatctagtgaattgatccgatagaaaaaagatgtctttagatcaaatcgttcgacaaattttttctttcaaatatataaatcctagacaaaatatatctcaaaacgtctggactctggatagttcaactagctagttaccaaattaaaatcttttgaaataagactttactatggtataagttttaaatggtgacggtcacaagatgaatcgtatatgaaactataacacaattgaatgctgttttgttttttgttattgacagttttcggattcgcaacttgtaaccatctgaaccctaatattaatcatagttaaggactgaaaacaacagcatcgagcgtatttccgttgaacaatctttacgaaatccaaaataaataaataaagttaaaaagcagaaagtttcaagattcaaaaaaaaagttagcgaggagacatagcgagtgagagccacgtgactaagatgtgtaaagaatggagtgaggagaaaaaaaaaacagacaaaggacttaaaattaaattagatacgccagcgtttcacgtgggaagtcacgtgattgagtatccacgtgtcaatcccacaagtgaaataatagacgggttcccattgtcctaccttcgcaccacccccgcgcgtgtctctttgcctctctctcaccggacaccaatcatttgatgcgacacgagcttcttctacgtaattacatttataccccttagcctcctctcatgatgttatgatcacacagcctcgatccaatgcgttttggattgtgtgtgggtgtccagctgttatccatgtgaattgcacgtgatctcgctttgtttgagaaattagatttcattgcactaaaattggtagagagacaattagaacttgagtgatggataattcgtcttttcttaagacgatatctatttaactatattagacttatgaacaaaactaaaaatttcatttgaaatgtactatcgctcaagatctcaaggccttcatattgttctttttttttttaatcaaaattttaagtaatatcaattataagtggtttttagattatagatttttggttttggtctttggattttacacaaaagaagaaataaaataaatggaaaaatatataaaataaataaattcaaatggtaattctaaaaactagtaaatatggtttttggattttgggaaagaattgacaaaatctctttaaatctagattctctaatttttaggaaatcatttttattataatcttgaatgagtaacaaattgtttttttccaaaatcaaaaactaaaaaccatttcagaatctacaaacaataaaaaagtcttaatatttgcatataagtcaaactggtggtatctgggttaaacttaacaaaatgtgttgggcctaaataagctcaattaaaacgggccttttctcaagtacaccggtcaaaatcaaattttatccacaaggagtcgcttttggcttatccactgaaacaaagagactcgttggattcgtgaagccgaaaaaaaaaaaaaaatg

SEQ ID NO: 31186 - DNA, 3000 bp, Unknown; identical to SEQ ID NO: 11335
  misc_feature (1)..( 3000): 2750-1469P.txt file - cDNA_ID_3039588; gDNA_ID_2214490; Annot_ID_183638

SEQ ID NO: 31187 - DNA, 3003 bp, Unknown
  misc_feature (1)..( 3003): 2750-1469P.txt file - cDNA_ID_3039596; gDNA_ID_2214490; Annot_ID_183636
cctccatgaggtattgaaggaaggcactgatgtgtgtttgatagaccagattgcatcagttcatcactgtcccaaaactattgtgcttggatttagcaagggtggagttgtgatgaaccagctcatgagtgagatcagttccttggataccaactttgcgaaaacttcatctgcaatggtagaagaatctaccagccagcatgaaaagattcagatcattccagcctccaaagaaagcttcctcaacagcatttctgaagttcattatatagatgtaggactgaactcttctggtgcctacattactgatcacaatgtcgtgcagagaatctcccaacgccttgcacgaggtgcagactcgctacgcattgtcattcatggaactcctaggcagtggtgtgatgagctgcgaggctggattcgcaaggaaaaagatgagttggttcgtttgctcaaagctgaaactgagaattccggtgggaaactacaggtctgtgaaaggttctatttttctgatagacttgctgatttgcaaatgcactttgagataattgatgctatggatgtctcctaaccattcgcatgataaaagacacataataatacattgcaaaatgatagcaacttaaagccgttttatcagtacaaaaaccaaaacttttttttttttaaagacttccaaaaacaaatggtaagagaaactaaagaagacttgttctttaagatgacaccagcatcagagtaagtgagaggcttttagacggatcatattgttaccacagaatcactcttccatggcttcgttttgaacagacttcttttcggaaacatcaactttgatcttctgtgccccgggagcctggaccatatgaatgttctgatcaagttctttcatatcgtcattgagtttcttctgcttgtttggcttcaacctaagtcccatacaaaaaacaaaaacaatcataatcaaaaacagagtctagttttaaaatcatacaagcagtgttatcaaggatttgcaggagactagaagaagaagaagaaggaatgtatacctattttcgatatgtttggcttcccttgcggttctgatcttagcaatcttcttaatggccatgagtgtattctctgtaacgttcctgtcgtatctctcaggtctgtttctcttcttctcaaactcaaatgttgtatccttttagggtaaagtaaacaaagaaagacaagcaggagggtcagcatcaactagacaaccccaaggaaacaaagaaaaacttttgctcaaatgaacacgtaccttagtcatgtccttcccgtgtgcagctctgaatgctttagtccatttcactttacgtgggtttctcttcatcttgaagttcttgtgacacttcgacctacagaaccggaatatctgcaaaggagaagataccatgcttgtaagtgaattacaataacgcataagaaacaaagctaatcgataacaagacatacaaacaataaggtgttttgattaacatttatgctcaaatttttatcagaacatttgtaaacctcttatatactaaactcctagctaaagacacataaacatattgtaagaatatacaaaatggtcatttttttagctaaagactcacacaaataacgacatatatcaaaaattgttcatttaagctagagaatacgagcaaggagacattcacatatatagaatctaagagtactatgtaatataaaactcaagcaaactatttactgtgaattaaagcaggttgataaagatttatgccaaattaattaccttggcatcgttacggacaaattgaataccatgaccaggatatattgtggaagagcaaaaccaacacttctccaatctcatattgcctcgtcttgaaaaccctacaaaagactgttgcaaagttaagacatgtaaaactgaaactcagaccacaaaattgacaacaaacaaacaaaaaaagaggatactttcccagaaataaagtcgcttacttatagtaagagctaagaagcagaagacaaagtttcaatttttctctaattacacggtttcaatgaacagatattcaattatactactcaaaaattagtctagatttcaacaaatatgaaaaaatcataacaaagagaacaccaaacgaacgagatgggattaggactttgagattaagcggcaaacctgtaggtgattcttctaatttgcgacggcgatttcaggaaaagggttttgctttagagcccccctgcagaaaaaaaggtctaaagagaagaagatgactacttctaagaaatctcttagggtttatgaaacgttaacataaatttctaatttgaggcccataacctaacattgattccggcccattagttgttatgttttgtctgcccattaatgcggtaattacggcccaaatattcaattttggattccttattatattatatagtatctcgatcctttcatataatatgtaaaaaagttgtaaataaatatgcaagtccatttaattttgttttcatataagaaaacttttaattgcatatatattgttatttgaagagttttagataaaacttttattgtcaatcgataattttcatgttcatggttttgtatcagattactgaatgagtttagtcattaaaaatcttagaaatcaaatatgtaaaatatacaaaagacacacatagaagcatggaacccatctgttgcaagagaagaaaccaacatgatatgtaatttggttttatttaatttatttccggtttaatgtcttgttaaccggttaagtgatttaggttttcaatttgtctctttatagccttacaagtttaaccaatcaaaaagaacaattttctcaaacgagcccaggatcttcgagctgataattctattttctcaattcatcttctaagacttgtggtttctccttccttggagttcacagagaattgggatttatcctcccttgtccggtttctatg

SEQ ID NO: 31188 - DNA, 3003 bp, Unknown
  misc_feature (1)..( 3003): 2750-1469P.txt file - cDNA_ID_3039601; gDNA_ID_2214490; Annot_ID_183632
gttgaaattccccgagtcaccagcaactagctatgcaggcagggacttgatacaggctttactggtgaaagatccaaagaacaggttagggacaaagagaggagcaacggagataaagcagcatccattctttgaaggtgtgaattgggcattgataaggtgtagcactccacctgaagtaccgagacagatggagaccgaaccgccaccaaagtatggaccgattgatccggttgggtttggtagtaatagcaaaaggatgatgggaccaccagcagtatcagcagcagcagcagacacgaaatctggtggtaaatttctagactttgagtttttctaaagcttccaagatttggttccgtagtagccatttttagtcttttatctatgtcgttatatattgtaaccacgcctctagctttaatagatcaagagtgagggtttaattcttatagtaacttaggtcttgtttggtttttgtatcggagattaaaatcttcttccatggaaccaaaacttttgtaaggacatggaaagccccaagtcgaaattatttaagataatctcctttggtactagtactgctaggtttctcggaatcctttttctacacatagcaactaatagatcgtaatgtcaatgtcaatgtcactgccatttttgggtacatctatactatatgaacatttttgtggtcccaaacggtactataatctaaaaccaatcaacgatccaaaatgttatctttcttttttgtatattctaatcccaaaactgaactgattttggcattcgtgtgttttgtttcgtttaaaagagtcggcataactattgcttgatagtctatagtctataccaagaagaaccccatccatgtgcttcagacaaagaagagagaaatgatgacttgtcagatcctaactcttatctctcagggaatccgatgaaaacggaccccatagacttttacataaattctaccgaccagtttcatgccaaaaagagacaattcgaggccaggtcctagattgtaatcatcaccttatatcacttatacatatgattaacgaacaagcatgagattagtctttattcatttcattagaacatgtagctgggaactacatgaacaaaaaatccccacatttcataacaaaaaagaaaagccaagtcctagggaatagggatcatataggtaaaacgataaaaggttatactatgatacacttttttcatttatacgttaattaatgactggattagtgttttctctataatcttctcagctatagtatttaactaattaaacaaggaatagtttctacagtgattttctttaaataaagacttatgttgaaagaaatcaaaatagtaaaccatagttgaaacaaaacatccattttaataacacatttcgtctttttaatgtccaaagcagccatcagccatgtggattaattggtgctttatgataagactccaaatcgttgcgtaggacgttggtcttattattactccacttgatttttgattaagccgactttaacgggcttttccacaaggcatcacctacttgtgccttggcccattatcaaaaaacctagtagaatattctcacgtcatctttcccacgtatatgtgcacgacgtttttgttattttgtacgtaaacaagaggactggcgtttttatattccgataattaaaatactgaatataattatttaaacgatttgcatttgtctgtgtagagatgttgttgcaacgaaaggaacgattagagagaataaaacgaaagtcgcaattaagaaaacgtgtctttgacagtcacagtgggtcgacttaacctttcgacgtcagacttaacaatattttattacattcagcacgtgaaaattgcgttgtttccgattagttttatttttttaatgggagttgcttattaatgttttaaatttggagggatttatactttattcctgaaaaaacataaacgaagaatgaatctaatcttttgtttattggtgagtaactaactacctatattcaatttcataccggaaaattttgtattatgtactaatatactttgttagactcgtcgttaacgactaaacgaatcttgtaattttccatagctttcttgacttccactgttgtattgcgcgtttcaagtgttttcaataacttatatttgctcttctctctctctctctctctctcttttttgttgttgttgttgttcactttgatgaatcttgacaaagtttacaaagttgactctatttaagcaaccaatggcaaaagatgatcgagtgaaaacctattatgtgtatatagcactaaacattatttgattaacatccaaagatatatatgagtttatacagtttcttagtttttaaatcggtggattcttttttaacaaaaaaggtttaagatcttgtagattgatttttgttcgtcaaaaaactttattatagatggatttttggtgagtacagataggccacaaaaagtgaatttaactaatttcttaatcagttatttaaaatcgtcaagtatatatggattatcattttataatgatttgggttacaaaatatcaaagaacagccaacaacaaaaaaagaaatcgaagaacaagatcatctatagaaaaaaagacaaatattactgaaaaagaaagaccaaagaccaaaagtccaaacaaaaataaataactaatatttttgtcgctgttctattttaagaacgaggcaaaaaaagaacagaaaaaaagaagaaaacgaatcttctaagaacgtaacaactatcatcaaatcaaaacctcaaagaaccttccatggactttctctcattccatacctttataaactcatacacaactacttatctcttcacttcattagtctccaagaagaaaacatctctcactctctaaaatacacactctcatcaaaaaccttctcttcggttcagaagcattcaagaatccattatg

SEQ ID NO: 31189 - DNA, 3003 bp, Unknown
  misc_feature (1)..( 3003): 2750-1469P.txt file - cDNA_ID_3039621; gDNA_ID_2214491; Annot_ID_133477
agttattccgctatttatcatacatattagtcaagcctaataatgttttcctccgccttttcaatacttaaccaaaatttccgccaaaattcgtcaataatggtgaaaccgtaaataagtagtgtatttttgggtgtggtttaaactttaaacaaataacgtaatatcatgtaaaaccgcttgttatcataagtgatatttttaacataagcataaaattccactatttttcaaaagaattatacaataaataatctaacttatttacaattttgcaatctatttttttttaaatggtaagagttaaactatttagtgcatatgtacccttttttcattgtagaaaaaatgaaacagtaaaagatttatgcaaatggtagctgaacaatatttagcttactagtgcccattgtaccgacaaattcagcagcaaggaatataaagatattttggttgaaccaaagcaagaagtaccgtaaaagagagtactttggtggataaacaaaccaaagaatgagaaaaacattattatttattggtttgttaatcaaaagtatggttaaatgagaatcaaatacccaagaatctgataacttaacccatcaacaaaagcagaagctgattctggttctgcacaaagacagagagatgtgcacttacaaaggtaatccttgccgcgtcccctaagttctcagaagcttcttaagtttactaggctccattacgacaattaggtgaagaaatagaagaaactaacaatggtccataaaaagggtataacaatagcttagcaagtcttctaggttggttctttcttaggaactactggagattggtgtcttcaaatctctacacaatgtccacattgttcttattgagtagattttgcactggatttaaagtcatgaaaatggttcatccttaactcaagtcgatagaagtgacacaagaccgtcacaagatgtgaacataggaggaatgtagaatcatttgtcctcaaactaacaaaacttttaacagaaacattcattacagaataaagaaactagatgaattgttgtgctatatagtcacaactctagcatgatagtcaactagattagaacgaaaaccataaccaaaagcttcaagatttcaatccatgctatcacatatccatcacatgagaaccggacaagtgaatgccaatgccaaatattataagaaaatctaacaaagctataatctgaaatatcctcataagcctcatgagtcaatgatataacagagacataaattgttcgaaaagccacaagtaggaacgtataacctgagcatagaagtgcatacaaagcaattttcaatcgccttttatcacatgaaagcatgcaattctgagctgctgaaaagggaaacaaaagataacctggtaaaagccaatgacaaacaatatgatgattattttagtaaaaactggactagtgaatgccaatgacaaactataggacgattagtataagaaaagcattctgttagaaatattaacaggtgcagagagctctcagttctttcacttcgtattaacacagcaaaaacttccactgccaatgagaaaagcaaaaacgtgccataagatttcaggtgtgtgtcaagcagcttttggttttcatttcacaatgaccaatgcatacactttcataacgaattcaactccatttataaatcttgttttccaacagcatagatcaaaggctaacatcaaattattgaaaacaaggaaaccaaagccaacaaagttataatctgaaacatcctcatagcctcatgaggctgtcatatgactttgaaaagacacaagcaggaacgtataacctgagtataataaaactgcatacaaagcaatttccaattgcaatttatcacagggaaagtatgcaactcagagatgttgaaaagggggaaaacaaatgatcacctgataaaagcagcgtccttagacaacattgaaaagaagaactagtaagatggcttataagcccaatgcgtagaagagaccactcaccctcaagatccagcttataagcaatcttaccattccttctcttcaatgtaaaagattcattaaaccaactgcaaacatctccttcctaaccatcatgaactcactcatcaacactctactactccactttattgcttgcacataacaatcaccatagcttaaactaactttccacattaaacctctagaactaaaaatgctcaatttcaatactcaataaccagaaaagttacaaacttaacaaaccaaatcagatgtagtttcacctatcatcaaatgaaaaacagagacagagaatttgggtttctactctaacaactagaattctcgataacaagaaaagttacaaactttacaaaccaaaccagatatagtatcacctatcatcaaattcaacacatttttagatagttactctcacactcgtaatcattgtacataatcgaaaaagagattagaaacaaaaatactcgaattcaaacttaagcagtcacagtaacttcgtgcaggagcttaccggagatgaattcatcataaaccggcgacggtagcggcggagcaaagcaaaaatgcgatgattcatggaataggtctcaaaagtcacgagaggatcacgtgagatatcttgaaaagaatcggacggctaagaataaagcagactaattctcttatctatctctaaccgttaaataaaaactaaagttttaaccttttaacctgggactagggttttcagatttcactactcttgtcgtgtaagacttgagcaactatataatctcaacttttctcaatcactatccgctgcggtctcgccgtgctgcccacaacaatctccgacttcgtcttcctcatctatcatcgtcgtcgtcaaccttatttatctcttaatttatcattaaaaccaaaaaaccaaaaaaaaagccttagctttcgtttcttcaatcccagcaaaaaaaatg

SEQ ID NO: 31190 - DNA, 3003 bp, Unknown; identical to SEQ ID NO: 31189
  misc_feature (1)..( 3003): 2750-1469P.txt file - cDNA_ID_3039621; gDNA_ID_2214491; Annot_ID_183675

SEQ ID NO: 31191 - DNA, 3003 bp, Unknown
  misc_feature (1)..( 3003): 2750-1469P.txt file - cDNA_ID_3039646; gDNA_ID_2214491; Annot_ID_183668
taacttatgaaaccattttctcagtttatcatgataattgatcctctatttaaaaccctaaagtttatattttgtttgttcaaacacagtcggtactcaaaatagatgaaacataaatttgattttatttctaaaccacttggaaaaacatatactattattcttctcatgcaaaggaccccattataaaactaacatggcttttactattggattcactgtagtgattaagggtgtatcaccaactgttttgaatttttgtcaacttaattagttattaattaagaagtgggtaaagctaacataccaaccttttactacacaattatcttaaaaaatccttaaatttataagaatagaagaaagctaaaacgaataaggaaaaagaacagcaatcgagtgaaatgatgaacatattcaactcccaccattttgtttatatggatgagttccaaaattttggggcatacattctctaacagtattgagatatttcaataatagtatttgcataatgaaaagtaatattgatcatttcagaagattatatgctctttttatttaactattacgagatacatggttttattttgtaacatgttatttttaccaaataaaatttgttaattgttttactcatatcattaagctattttcaatggaatctaatatattggacgtgtgacattatcttatattttctgtaattatttagcatgttaaatattgatttttagtatattcatgtatggtaataacaaacaattatattgaaagagtcgtatactcgtatgtatgactgtttatatcgtaatcgtatatactgcaagttaaattcaacaactgtaattactaattagataaaatcaaatatctgtcgggcgtaacatgcgacccaacaaacgtcatgtgaatattttaattcttctattagtttgttaacctaatcgtgattgggtattcatataaatacacattttcatataaatacactttgtatatggtaagttatcattttatacaaaaaaccaaagaatgttttcttctctattatatcatcatatcccataattatgggaacccaaaaaaaaaaaaaattggaccctccattataaatataaactattgtcatataaattttagacataactgattttgtcataaagaaattgaaaggagaatctccgtgacggttggatatagcaataataacaactcttaataatcatagcaacaagcaaataaaagcagcacatggaagccatttgcgcaaggataattcttgtaagaacacattacctaaaagctaataataatgagaaaaacagcagaaatattcgaaaccatattaaaaaagaatgaaacatttcttaaataaacctaaactagattcgattttgcatgtttgatccacttgatgtatgaacaaaagaaacataaaacagtaagcaaaagtcaaggatctaatgtaaagtcataaggaaaaaaactaaatttaaacaagttgtaactgcagatcatgttatgtcttttaactagtaaatcctacgaccaattagattagagcaaccaattcttttatgattttgatttttgagagccaatttttatttgtattgaaaataatagttatatttttcactcctataaatttattttctactaatgaaattgttgtttataaaagtattctgtgtgtaatagtctataaaaaatatagtacaattttacacatttttaaaagttaatatttttgatattttgtatagtaaatacaaaaaataccaccacacaatacattgatgattcgaagtttcgaaccaccattttcattgaatcagctctaatattaaaaaaaaatgatttttttgataaaatatataaagaatgttagttttgttaaaccaatatatcataaatacgatagtatatatttttgtattttattgagcttgtaatcagtacatggatgcgaatccgagtgacgttgatattggtacaaactacaaagtatagtagtctaagtatatgtccatatatatataataaatctgttatattcaatgattaatgaaacctggaaactggaagtgcaaaaatgcattgattactttaatcgaaaagaaaaacaaaatgcattgattatagtatttataaaactgcagattttgcagagagcaggaaacagagaggtttggttttgcgttgcgtgagctgtttcctctttaactctctcttcttctacctcttgaccctctctctctctctctggtgatgcggtttcttccttggaagccatgaaaacacaatcagcttcaccgttcttcttcgtctccttcttcttcttcttcttcttcttctcttctctgtttcttctctcctctgctttaaactctgatggagttctcttactgagtttcaaatactctgttcttcttgatcctctctctttattacaatcatggaactacgaccacgacaatccttgttcatggcgaggtgtgttgtgtaataacgattcaagagttgttactttatctctcccaaactctaacctcgttggttcgattccttccgatctgggtttcctccaaaacctccaaagtcttaatctttccaataattcactcaatgggtcattaccggttgagtttttcgccgccgataagctccggtttcttgatttatcaaataacttgatctccggcgagatccctgtatcaatcggaggtttacacaacctccagacgttaaatctctccgataacatcttcaccgggaaactaccagctaacttagcgtctcttggaagcttaacggaggtttctctgaagaacaactacttctccggcgagtttcccggcggcggatggagatcggttcagtatctagacatttcttcaaatctaatcaacggttcactcccacctgatttctccggcgacaatctccgatacctgaatgtctcgtataaccaaatctccggagagattcctccgaatg

SEQ ID NO: 31192 - DNA, 3003 bp, Unknown
  misc_feature (1)..( 3003): 2750-1469P.txt file - cDNA_ID_3039669; gDNA_ID_2214491; Annot_ID_183656
atgacacagatgaagacagtggctgtgaaaattatacaaaactatgagataaaggtcgttgaaggacacaagatcgagccagttccttctattattcttcacatgaagcatggtcttaaagttacagtcactaagagatctaatttgctctgaatattatgcattactattgtactacatttagtatgaaaataattattagaattttacaaaatacttgaataagaggggtaatgtttacaataaaattaatatttactcttcttagaatactaggaggcttccatagtttaagaatagtcgaatgttacatttctctttagattcatccaaattttctcgaattcacaacaatctatattttttttttcttttcaatttttaatcttttgctcttatcgcttctgctccttgtatatacgaaacaacattagtaacgttcgattatacctactctagctaactaagtaaggatcataagtttttgtaaaacattagtatataacgttactaactactctgttatatacaccgtgaatctccatatagtgtaatactaatgttgacttattagtgttgactttacaacatgtcttttcgttttggtgtaaatactaatgttgacttattacacatgtttatttgtaattagctgcatgagacgttacgaaacatatctttagtgacaggtgggataatgatttcccatgataacaccaaaacttgaacttctttttttcatcatcatgttccacgtaaactctcgctttcgttataaattaagctataacttcgaactcccatgttcagttcaacacatttacaagttcttcgatctaatggaaacccatttcctaattttatctctcgccttcctctttttcatttctcttaaacttttgtttggtaaacggcatagcaagtttaacctaccaccaagtccggctaggccacttccgtttattggacaccttcacctcctaaaacagccgcttcaccgcacattcctctcattctctcaatcactaggtgatgccccgattttctccctccgcctcggaaaccatctcacggttgttgtctcttcctactccatcgctgaagaatgttttacaaaaaacgacattgttttggccaataggccaaagttcattctcgggaaacacattgagtacaacttcaccactatgaccagtgcgccttatggtgaccattggcgaaacctacgccgtatcggcaccctggagatcttttcgtcacacaagctcaacggctttttatctgtccgtaaagatgagatccgacacttgttattgcgcctctcaaaaaactcgcaacatgtatgtgagcttcttctacatatcaaaacattttacttagccagaaaatattataacctattgatttgtgatagtgccgtcactgtttcattatataggtttatacttggccatgtgcatgtgcaaaatgtagattgtagacgccaaaaatattctataccaaatgaagattgtgaagtatgattttgaaagtttgaggattaatcatttgtttatgtgattataattaaaatcagggttttgcaaaggttgagatgagacaattgttttatgatttgactatcaacaacattcttcgaatggtggctgggaaacgattttatggagaggggacagaacaagatgaagttgcgcggcgagtgacacaactgattgacgagattgtgtacagggctggcgttgggaatgcagccgattatataccgattttgcgttggatcacagattttgagaaaggggtcaaggagttggcgagtcgggtcgatgagtttttgcagagtctggtggatgagagacgtgtgcataaacaaaagggtaacactatgatggatcacttgctttctctccaagaaactcagcctgattactatacagatgtcactcttaaaggaatcataattgtaagtttgaggaattcatatactatatgtaacaacactaatcaaactttatgatagcttattattgattttaagtttacaggttatgatacttgccgggactgaaacattagcagggactttagaatgggcgatgcttaatttgttgaaccatccagaagtattagagaaagcgaggaccgaaatcgataccgaagtcggttttgaccggttaatggatgaagctgatactaaaaatctgccttatctccaatggattgtgttggagaccttacgtctttacccggtagctccaacaaatattccacacatgacgtcagatgattgcatattggcaggatacgacgttccacgtgggtcgatgttattggtgaacgtatggtccatgcatagagacccgtctatatgggaagccccagaaatgttcaagccagagaggttcaaaaatgaaaagcttaatcagaagttgttgtcgtttgggtttggacgacgagcttgtcccggggttggcctagctcatcggttaatgagcttggctcttggatcgatggttcagtgtttcgaatggcagagaattggtgaagaatatgtagacactagagaagaacctatggccatgatgcgtcctgcgacaccgttgctagccatgtgtaaagctcgtcccattgtccataagtttctcgatgcttttgcttgaagtgtaactcttctttccttgacttgggaataaaatatgtagtaaaaaaacttatcatgtcaaaaaatctaatagtatagactgaccgtttactaggtcagtgttggggagccaaaggtaaaaagattagagagtgattgtttctcacgggacaaaagacgatgacttcaaaagtcaactccagtcttctttctttttgttccaccaataatttcaattctctatttctccttcaatctcatcttcttcctcaatccagtcttcacatagaccacacatgttttttcatccattgacctcaaagacttgactttctctctttctccttctctgcatcaaagctatg

SEQ ID NO: 31193 - DNA, 3000 bp, Unknown; identical to SEQ ID NO: 11352
  misc_feature (1)..( 3000): 2750-1469P.txt file - cDNA_ID_3039677; gDNA_ID_2214491; Annot_ID_183651

SEQ ID NO: 31194 - DNA, 3000 bp, Unknown
  misc_feature (1)..( 3000): 2750-1469P.txt file - cDNA_ID_3039681; gDNA_ID_2214491; Annot_ID_183650
aaaagagctaaacgatgtctttttttccgtttgttggattactaaatgttgctgtgagtggtcatactacttttgtttaaagtttttttttttttttgtttcttaaaataaaaaacgccctatttaaacttaaaactactactttgatcacacgaaattgagttatcattccaactgttaatgttactctagtgtttgattcattggaagctacactcgatgtcttaaacgagtggcttaacgtgcttagtccattcaaatcccatttgcactgattccattattgtgtttggtctccaaggaacaaatcatggtagcttcatgatcgttcctttgtacaaggtttgtcgatttctttcaaactcttttactacattcgttaaagatcgctttataattaagctcgattcacctagttgtgcaaacaatcgcgtggcttgttgctgcgctcgtaataatgatcaacggttatctattgttggagttcttctccaatgaggtcatggcatagtctataccggtttttgtgactgtgttcacagcttcgtatggtgcattcatcatctatctcattgctcgtggcatgatcactttcactccttggcgatttaaagcggagtctagtcattgagagtgggccaaacaaaatagtgtagtagctatgtcttgtaatccttaggatcatgagttctagctttctcttttgtattatatgtgttgttgttataaagcagctctagttttgttgaagaaggctcttctatgtatcagtagataggtcctggagataataattaataagatctttcatcatttgctaatgatgtttgttgtaatggatttaacttaataataataactagttttgtcccaaaaacaaaaaaaaaacttaataactagattatagcctatgctattaatgttttttttttaaattcgaaactataatatatttaaaagaaaaaaaaacagcttcacgatgtataacacaatatatgataacacatctcaaatttagagatgtatagccaacaacatgaactatcttaatcgattataaaattttattcaatagatttattcaagaacataagatataaaattgtagttaaacctagatgattaatacattatttgctctcatagggggctctccactctcatagagggatccccggggatccatttatactctaatttaggtgtttctttaccatgtgtgaagtaaataccatcttctctagcatcccaaaagttctttttaccgtagtgaactatcagacctccacctttatatgccctaaatcttgcataaaagttgtaattataataactacttccttgctttaactcacaatcaaatatagttttcaagacactatcatgaaaactgaatgcgtaagtttgtccatgtctcaggtaaacgtagtcggtgtcgtcgtgttctgatgtacaatgaatcctgagaagttttttcggaccaagagaactcttaaaaattacggagtttttttcgttgaatttcgcattattcaatcctgcacataatataataacaaggaaaaaataagaaaaacaattcattgtgaacttttttttaagatttatttgttctttagttttaggggtgatatatatataaagataaaagatgcttatttatacaaagtgttttgctcatgctttaattttcttcctgttttggcatcttattaaaggaatattttgtttcaataatatttggtgctgttctggaaaaaagctcattcaacgttcaacttttacatttaagggacatactggattagtaatttgggatgatttattccataaaaacaatctcaccttactggactggtcatcattttctgaaatgttttaaaatccagtctcattgaaatctagtatttatcaaaacattccaaatctgtggttattcagttgataatttataaaattttcaaatctcatgttattggaaaactgggattttatcgtaagattttagtaaaaagtttcatatgatttgagagacaatttatagttaaaaagtgtgggtagaacaatcaaacattctataataataaaaaaagaacaatcacacctcatatatgattatatttatatactcaccttgttatatttctatgatctaacaatatagaagaagtcaataatcaaataacgtagacaaaacacacatatatatattgatttgttactagagtgtcgttagtatgcaattgttcaatatacataatttatgttattagataacatttagacaattagttaaaatatatgtatttttttgtaatctaagggttgatttgtatattttaaaagtttctatcaaaagattgatttttgtaagtttcctgaaggaaaaaaaaaaaaaagacaaaacacaaagtggaggagaccaagctgacaaaacaatgtccgaaacggcttagaacggcttaaaacgccagcaaatttcgatctgaccaattgcagacccaaacaactcgtcgaatcttttttttttccttcttctttggctaatcagaaataataatacacggagaagaagaagaagatttgcgttttacgtgctctcaactataatctgcaagaccgagaaagattgatttcccttcttcttcacgtgcatgtttgtttctttcttctctctttctctcgtatagtttcgatctatctatctatctcacttagggttttcaattttaccccttttttctctgttccaattctctaacctctcttcgtcaaagctcttgctcattacatttccgagacacccatttgatcaatttcgtaagatttcaggatttttctcctcatgggttacatttgaatttgaattttcttcaagagaaaagttttggattccataaagttcgtaccttttggtgattgttcgattcgtagcaagttaattcgtgaacccttttgatctgaagtttcaaattttgttgctttttcagggtggaaatg

SEQ ID NO: 31195 - DNA, 3000 bp, Unknown; identical to SEQ ID NO: 11375
  misc_feature (1)..( 3000): 2750-1469P.txt file - cDNA_ID_3039701; gDNA_ID_2214492; Annot_ID_183719

SEQ ID NO: 31196 - DNA, 3000 bp, Unknown; identical to SEQ ID NO: 11366
  misc_feature (1)..( 3000): 2750-1469P.txt file - cDNA_ID_3039705; gDNA_ID_2214492; Annot_ID_183717

SEQ ID NO: 31197 - DNA, 3000 bp, Unknown; identical to SEQ ID NO: 11364
  misc_feature (1)..( 3000): 2750-1469P.txt file - cDNA_ID_3039724; gDNA_ID_2214492; Annot_ID_183708

SEQ ID NO: 31198 - DNA, 3003 bp, Unknown
  misc_feature (1)..( 3003): 2750-1469P.txt file - cDNA_ID_3039734; gDNA_ID_2214492; Annot_ID_133480
atcgattattaacgaggcccatttaatcaaggaaatcatggaaattgaatttaccaaatttgggcctatgaatcatggaaattgaatttatcaaatttacgattgcattttttttttcttttatatttttttttttatataagaaaagaaaacgattgtatttgtaactaatgtaaattaaatatttgaatatcaaaatatactgtaatactatgatatttcactattgtcattaatattgttttttttctttgttgtgtgtttcgaccacaaatgacagatattgttttattctatatgaacgtatgatgtctagtaaacgtgctggtaaagatatttgggtaatattggcatatgtatgtttgtcctaagtttttcatttatataattgtagtagtcacctatgttatatcatcgaagtatagaggtagagttagagattgagagaacttgtatcctccgaattttttcgatattagtgaaatctgcagcagaagaaagtggacgtaactctttttgagtaaaaccactatatatcttgtgtgcacattattttttctactttaatttcgtgttcttgaaaaaaaaattagatccttaattcctgacatatatatgcaacaaatgctaagccacattagtcacctagtgggacataaaattaatacatcaataggggcattattagcaaaccttataaaattacttttaatttttaaaaaaaaatcatgtgtacaagtgaccctcccaaaacctatgtacgtcggccaatgtgcataatattacggacacgcttgcaagaaattttacacaatttcttagttgcataaaactactccgaccaattatctagctagtcctctacaattaatctaaaattagagagctttctcaaataattgtagtctacctaaattttctcattgcctctttctttaaatagcttaacaaaaatcactggtcacatatgtagtcagagtatgttatatatatgcatatattgaaacatcatcctattcaatctcacaacaaccaatctacacacaaaacaataacaacaacaacaacaacaacaacaaacaacaacaaacaacaacaaaatgtttacaaaatcaatccttttaccttttcttctggtaatcatcttcgtctcagcatctcaagctagtcgtcaactctgggatagtggaatcagcgagatgtttggttccaaatccgggtttcatcatggattttccgggttttcggggtcctctggaggtgctggaggtgctggaggatcattcggagatatgatgaatgctggaggtgcacatacatgctcggcgcaaggagcttgtagcggtaagaagctgacatgtcccgaggagtgctacaaatcaaccaacgttaacaaggatggttataaaagcaccagccgcagtggaggatgttcatttgactgtacgaccaagtgtgccgcgacttgttcaaattaacatgttaatttgcacatatatattatatgttcgtatagtatgttgttatgttatgttatagcattatatagtctatatatatgtcaatataataaaaccggcaaggtatatgggaggtttgtgtctccctttgtaattttgtatggatcttgattagaagctttctatgaatctatgtacataatatgattttgaataaaagaaaatttagtgtttcttataattgtgtgagtaaatctctatgccttatacatgccaggaaatttgagaccgtactaatgtacatagcgcgatcaaggaattttggcactatctatatagagttttagttcatgtctttttaagatcaacaagacattagcatcacatggctataatacttcagattattaaaataattcatctaatactttagattggtaagcatataatactaacgttttatgaatgttaaaacttaaatcccccaaaactttaaagaatcaaaacaactaacttatctgtataattataaacatcaattaggttcatttagagatcccaatgattataatcgatataatcaaattgaaaggaataaacatagatcttggtaatagttatagctagtattttaattcacattacggattggtgtttatctggcatctgtgatctactataatttcatttcattcgttatgcttattctaaactcattgcattcctttcttctccaattaaaatttatcatatgaataacatgcctttttcaccaatttaaaaataatgattacttgttatatttagatgtattataaagtaaaatatttttattttatttacataacccatattaattattccaaaatatatgatgaataaatgatgcatagtataaataattgtgatttgaatgattttgtcagcggtaaatgtcactagatcactatttgtgtttggtgaaagacgaattatactttttttgttgttcaaaaaagtacccttttcccccaaaacacatttttagactaagattataatttatcatttatcaaaaagtaataaacttaaatttgaatcatcgttgtaatattagtattatatatatcgaataagaagctatttaaattcttaaaattatattttttttttaaaaatcagatttttcatagcaacactttaagatagggggtactagtagtatgctttgatgatacaaatagcttaaacaaaatatttgcaaagaaattaaaatacaatcttagtagcatgattcgctatcacaaattctcaggttaactaaaattaaagatcctccccacatacaaaaagattgtagtctcccttattttgctcattaccctttcttttaaatagccttttaatattcttcatagaatcaatttcaaatctaaacttaaactctggcctctcttatatgacaactttaatgaataagatcttacttcttttcttcaataaatatttcctctgttcaatttcttgttttattttatttttgaagaatatggttgaaagaatg

SEQ ID NO: 31199 - DNA, 3003 bp, Unknown
  misc_feature (1)..( 3003): 2750-1469P.txt file - cDNA_ID_3039734; gDNA_ID_2214492; Annot_ID_183699
aagtttggcccaatcgattattaacgaggcccatttaatcaaggaaatcatggaaattgaatttaccaaatttgggcctatgaatcatggaaattgaatttatcaaatttacgattgcattttttttttcttttatatttttttttttatataagaaaagaaaacgattgtatttgtaactaatgtaaattaaatatttgaatatcaaaatatactgtaatactatgatatttcactattgtcattaatattgttttttttctttgttgtgtgtttcgaccacaaatgacagatattgttttattctatatgaacgtatgatgtctagtaaacgtgctggtaaagatatttgggtaatattggcatatgtatgtttgtcctaagtttttcatttatataattgtagtagtcacctatgttatatcatcgaagtatagaggtagagttagagattgagagaacttgtatcctccgaattttttcgatattagtgaaatctgcagcagaagaaagtggacgtaactctttttgagtaaaaccactatatatcttgtgtgcacattattttttctactttaatttcgtgttcttgaaaaaaaaattagatccttaattcctgacatatatatgcaacaaatgctaagccacattagtcacctagtgggacataaaattaatacatcaataggggcattattagcaaaccttataaaattacttttaatttttaaaaaaaaatcatgtgtacaagtgaccctcccaaaacctatgtacgtcggccaatgtgcataatattacggacacgcttgcaagaaattttacacaatttcttagttgcataaaactactccgaccaattatctagctagtcctctacaattaatctaaaattagagagctttctcaaataattgtagtctacctaaattttctcattgcctctttctttaaatagcttaacaaaaatcactggtcacatatgtagtcagagtatgttatatatatgcatatattgaaacatcatcctattcaatctcacaacaaccaatctacacacaaaacaataacaacaacaacaacaacaacaacaaacaacaacaaacaacaacaaaatgtttacaaaatcaatccttttaccttttcttctggtaatcatcttcgtctcagcatctcaagctagtcgtcaactctgggatagtggaatcagcgagatgtttggttccaaatccgggtttcatcatggattttccgggttttcggggtcctctggaggtgctggaggtgctggaggatcattcggagatatgatgaatgctggaggtgcacatacatgctcggcgcaaggagcttgtagcggtaagaagctgacatgtcccgaggagtgctacaaatcaaccaacgttaacaaggatggttataaaagcaccagccgcagtggaggatgttcatttgactgtacgaccaagtgtgccgcgacttgttcaaattaacatgttaatttgcacatatatattatatgttcgtatagtatgttgttatgttatgttatagcattatatagtctatatatatgtcaatataataaaaccggcaaggtatatgggaggtttgtgtctccctttgtaattttgtatggatcttgattagaagctttctatgaatctatgtacataatatgattttgaataaaagaaaatttagtgtttcttataattgtgtgagtaaatctctatgccttatacatgccaggaaatttgagaccgtactaatgtacatagcgcgatcaaggaattttggcactatctatatagagttttagttcatgtctttttaagatcaacaagacattagcatcacatggctataatacttcagattattaaaataattcatctaatactttagattggtaagcatataatactaacgttttatgaatgttaaaacttaaatcccccaaaactttaaagaatcaaaacaactaacttatctgtataattataaacatcaattaggttcatttagagatcccaatgattataatcgatataatcaaattgaaaggaataaacatagatcttggtaatagttatagctagtattttaattcacattacggattggtgtttatctggcatctgtgatctactataatttcatttcattcgttatgcttattctaaactcattgcattcctttcttctccaattaaaatttatcatatgaataacatgcctttttcaccaatttaaaaataatgattacttgttatatttagatgtattataaagtaaaatatttttattttatttacataacccatattaattattccaaaatatatgatgaataaatgatgcatagtataaataattgtgatttgaatgattttgtcagcggtaaatgtcactagatcactatttgtgtttggtgaaagacgaattatactttttttgttgttcaaaaaagtacccttttcccccaaaacacatttttagactaagattataatttatcatttatcaaaaagtaataaacttaaatttgaatcatcgttgtaatattagtattatatatatcgaataagaagctatttaaattcttaaaattatattttttttttaaaaatcagatttttcatagcaacactttaagatagggggtactagtagtatgctttgatgatacaaatagcttaaacaaaatatttgcaaagaaattaaaatacaatcttagtagcatgattcgctatcacaaattctcaggttaactaaaattaaagatcctccccacatacaaaaagattgtagtctcccttattttgctcattaccctttcttttaaatagccttttaatattcttcatagaatcaatttcaaatctaaacttaaactctggcctctcttatatgacaactttaatgaataagatcttacttcttttcttcaataaatatttcctctgttcaatttcttgttttattttatttttgaagaatatg

SEQ ID NO: 31200 - DNA, 3003 bp, Unknown; identical to SEQ ID NO: 25688
  misc_feature (1)..( 3003): 2750-1469P.txt file - cDNA_ID_3039750; gDNA_ID_2214493; Annot_ID_183743

SEQ ID NO: 31201 - DNA, 3000 bp, Unknown
  misc_feature (1)..( 3000): 2750-1469P.txt file - cDNA_ID_3039754; gDNA_ID_2214493; Annot_ID_183741
cttggagtgctcctctcgttcctcatgtaccaaattcattgaacgatgatcaattgattcaccaattccaccattagagagatgatcgtcattaccatagatcataagaagccctaagttcttgtgtttcatgtggtgatcaggagcttctggctctttgcaaaacacacataagccattcaaccagctctcgtttatctcttcccacgatatgcgccgacgactcttcatcgtgcaagtagctttgatctccaccgaggacacgattggctctgataccagtgataacggaaaacagagtaacgaaatagaatgcttcgattaatgaaaatgacagattgatacaacgttcatgaaacgcgatatcaacttctcatctacaagagttcaacatgaaactccggcgaacgatgaggaacgattctcagagagaatccaaaaggaaactataaacaacaaatccaaaatcttcttatcttctgcaaatgatcttcattagctatatatctctgcatctcgattcttcctctaacactcccatcgaccaatcttctcttgccacgtctcacagctactgtctccactcatgtattgccacgtatctaaccatatatcaatgcctagtttcctatatcagattgacaccgaagtattgaggacgagagagaagagagaagtgcttcgttatagatgcaaatcttatctctgtctccctcaaaacccaaggagagggaagataactattttaatgttgattttttttttttaatgaattttaaaaaggtaaaaataccttattgcttttatttttataaaaaaattggtgtggccttgtgggagctatttttagttagtgcatataatatgatgctattgaaaatccctaaagcttattaccattgttagtttgttaccattcacaccttgagtgtttgattgatgggttatttcaacacattccacgtttgcgaccaacgtttgatcttatttctttctattaccaaaaaaaaaaaaaaaaaaaaaactcgaataagattaaattggaattactagtcggtttagataagatcataagagagaagtcgaagttgttttggaaaaaaaaattccgatagatgtaagcttatttgtggttgaacttataaaaccatgtatgtaaacgagcacacatttagtctgtaacctgtttattctaatttcttataacggaccacagtcacatgtttatctctaattctacaaagttgtctattttcaacggtggtcaaagtatggattagattttcattgcacccaccaccacctctctttgcaagcacctcccaagaaaggtacgtatatcagatcagagggtttactttttcataatgttagtctttgatgagtttgtgttcttttgtgaagaatataatgtagtctttcattattttggcttgtgtctttcaaaactctcgtgaaaaaatgatgctttataccaatatacaccttctcatttcctagcggatttcattatttcatagttttgaactttgaacgtgaacgaaaagccaatagttatatctatttaaaatgcatcaataaacaatactctatttgtgatagtatgaggtgagagagaagaaatgatgagcgatgcagaggggagaggagacatgcgtgacggaaaagagactcaaaaacgacacacagttggaaagtgaggagataatatagcattatttttagggtttagatcagaagagagaagtttcgagagaaagagattaacggagacaaacaaaaacccttccttcactccaacacaatgaagtcaacgtgcttttaacatgtggataccgatatctcccacgctcttcctctgcttcttggttttacactcgcccttgtcttttgccctttgtacccaaatatatattcagcataatcgtgaaatgacgactatgtagaatgataatgcaccaaagactaagatattttagacgcccaagaattaaatttggatacacaaaactaatcacttggtggtgtcccgtctcaaagctcgatcccaaaaagtcaacaacatgcaccatgaccatgagtattctgtattcactaccaaatcgacactactataactataacgtcaaactaatccatatgctttgttttacttttatagccccctcgattacgaaacacgtatagtttggtatcaagacaattgtagagattatgtatggtgagaaattcatatctttgcagtcaccttaaacgcaatctatttgagatttgtgaaatcaagaaagtaattatataaaaaaaaaagatatataacgaatcgcgaaaaattattactaagtttattttttgggagataaatgatatattccccaagtaatttacgtaaattattttaaatgaactattaagtcaattatatatttaaaagaaatcttaaaactgatatcctaatttatgaaaaaaaaataataatttaaatctgctttcccaaatattaaatgaactattaagtcaattctttaaaaataacagtttaatatttttttgaagatcaaaattactacttactatcttaaacatatataatagtcaatcaaaaacaaattcaaaattaaaaaacccactagcacatcataaaatttaatttagctactcttaggaaaagtgttattcaaaataaatttcccaatttatttttctagatttgctgtttatcatttattttggaaagcgattaattttggatattataagtttcatgaatcactagtgtaagttagcgagtatgattccggagcgtaagacccacgcgcagtagacgaagacggaagcaagcaccttctacttcctcttcctctttgtctttaaacccctcgtcgtctttctcccgtgttctaacctcattcctccataacccctttcttccttttgaatctctccttcttcttcttcatccccaaattcgaaaccctaaccctaaaactcagtttcaaaatg

SEQ ID NO: 31202 - DNA, 3000 bp, Unknown; identical to SEQ ID NO: 11378
  misc_feature (1)..( 3000): 2750-1469P.txt file - cDNA_ID_3039766; gDNA_ID_2214493; Annot_ID_133505

SEQ ID NO: 31203 - DNA, 3000 bp, Unknown; identical to SEQ ID NO: 11387
  misc_feature (1)..( 3000): 2750-1469P.txt file - cDNA_ID_3039766; gDNA_ID_2214493; Annot_ID_183732

SEQ ID NO: 31204 - DNA, 3003 bp, Unknown
  misc_feature (1)..( 3003): 2750-1469P.txt file - cDNA_ID_3039770; gDNA_ID_2214493; Annot_ID_183730
aatctcttcaaaacccatcacatgctttctaccactaaaacaggcccatcacatgctttctacctctaaaacaggcccatcggatatgttcctatattttttgtccgataaagttataagaagcgcaaggcccataatatttttagttattaaaaaaattagcagacgtagggttgacttaaaaaagactcttattacattagtcgacaagtaaaaaacacgtggcatatattgtgcgttcgtagagactgtaataaagacggagagattcttctagagtcagttcttcttcttcatcctcttcttccccccaaatcctctctcgctagggtttctcattccgatccataattctagatgtcgaggtattcttttgattgagctccgcttttaaccaaaccatcttagattttgttttcatgattggatcactgaattgaaattcttctcttctgtctttagatttcttctcaggtaattttgctctgctttgtgaagcgttttcattgatcggattttagcttctcgtatttaaattgatacttgtgtgcatctgaaattcgtttggattaagccattccgaattttgagttacttgtgagttgtgagttgttacattaccctctcatttattttcccactccataaattggtttcagttagaaattgtagtagctacaaggtgattgattgcatcattatttgaaccttcgttggtttgtgttggcttatataagcaagttccgtcaaaagattaaaactttgggttcagtctctgtgtgtttattagcagctagactttgtattgcctgaaaattcatgattgagggatatgctttatgtactattataagttctgagtttgtagaaacaatattttgtgttttggggaaaacaccacaataactttctattaatgtattagaaaaagaaagttggaacctatgttttagaaaattttttctctatatattgaagtatgacctataattgaatcttctgatgtgcactaaactgaggcaagcgggatttcctggagtctttggtttgcttacttggaaaaaactgtagataactgattactaacttatacccacttttgcaggtttttaactgagacctgtcaaataagctaaagcttcttctaagagcttcaaggaaagcattgcattgttgtggtcttgtttgtgtccacagaaggaaagaagagtgagaagctcaggatgtcaagcagtcgaaatacccactggtgtcacagatgtcagcgtgctgtccgccttcacggccaagagcctgtatgcttttattgcggaggtggatttgttgaagaacttgatatggctcaagccagcccctttgatatgtttagatcccacaggggtgttgtagaacgtgatcagacttttgatctcatggatgctttctctgtgtttatgaggaaccgcttagctgaaaggagccacgacagagaaatcagaggaagaaccatcagttcaggtcctgaaaactttcctggtctggcccctttgttgatctttggtggtcaagtcccttatagactaactggcgacaatgcagtcgaagccctcttcaatggcggctcccctggcattggcatcacacgtggtaacaccggcgactacttcttcggtcccggccttgaagaattgttcgagcagctttcagctggcactactcgccgaggcccaccacccgcaccgagatcagcaatagacgcattgccaactatcaagatcgcgcagaggcatcttaggtcatcggactcgaattgtcccgtgtgcaaagacgaattcgaactgggatcagaagcgaaacagatgccgtgtaaccacatctatcattctgactgcattgtcccgtggctggttcagcacaactcttgcccggtctgtcgccaagagctaccatcagctagcggaccttcaagcagtcaaaacagaaccacccctaccagaaactacagaagcagtagtagtagtagtagtagtaacagtcgtgagaacgggaatgaaagaaggaatcctttctcttccttctggccattccgttcgtcaggttcaagctcaagctccactcaaaaccgtggaggcacaagaaactcggatacaagcgatgagaaccataactaccatcaacagcaacatcaacaatcatatatgggttacagtggctggccttttgattactaaaagtctaaaagtgagctaaaacaaatctttggtctcactttggtctctttacttaaatatgcttgtgattctgcatatgccttgtgcttcactctctatctctctcactctcttttatcaacataaataatggagaactgtatttgttactgtagattttctttctctgttaaaaacgagttcatcattttctatatgctttgttaaatatgtcattttagttgggtttttgaaaatggttgaaatagatttttgagttgatcgataaataaataaatgaaaacgtctggacactcttgagcgatctatcagtatctcgtgatcttcttcaatactaataaaaaaagggaaaagaaagagaagagagtcgtgctcataaattaacggtgcagagcgattgaacaaaaacaaaaatatcttccagaaaaagccatttttgattgcgtataatgaatacacgaaattaaaatcattacttgccatatatagtacactatttctcagcttcactcactctcgagactcgtgtatgttgatttacggtttgttcaagcaaaggtgatcatcaattcccaattttttttacgtcactattttcgattcactccaatggcttgcgtgttgctgatttcttgattttgtggttcttgagttagtctccatctgataagtaagtaaattatgtgattgtgatctgggttttgctaaagttttgatttttattattgttgtttagagaatgatgaatctaggatctctttcgttgagtacgagcaagtcgagtaagccaatg

SEQ ID NO: 31205 - DNA, 3000 bp, Unknown; identical to SEQ ID NO: 11376
  misc_feature (1)..( 3000): 2750-1469P.txt file - cDNA_ID_3039778; gDNA_ID_2214493; Annot_ID_183728

SEQ ID NO: 31206 - DNA, 3003 bp, Unknown
  misc_feature (1)..( 3003): 2750-1469P.txt file - cDNA_ID_3039813; gDNA_ID_2214494; Annot_ID_183780
ggttgattgaggtattgattgactgaagagcacaattctgcatcaccttcagctcttggctcctgcaaaataatttagaaatagagttctgagagacaaacaagatcaaagatataagtgattaaggtgaacaaacatacaaacatatctttaagaaaacaaacaagtaacctgcatccagaagaataacttgcggtcatcactgttgaacttcagaatatacaccctgtctgaggattgattaaccttttcaaatagagcttcatctgggaaaacaatttgatcctataaataggtatggtcaaggagaaaacttcgtaactggaacatctggtagcaacaattaataaatccttcagtttttgttctattcatgcatggcaaaaaataaaaaaacctcctaggtggatagagctaagaaatttgaccgtcttgggtcacgaatccactggtatagcaaagacttgatactaggagaatctctagtccttttctaaaattcaaaaaaacaagtgcagaggatacatcttctactgtattctggtttcgatcaagccactggaaatgaatcagtccctcgtcaccctaaaagaaaggataacaggattaaaaaacctaggttaacatttacagagaaccagtaataaacgtgttctgacaccaacaattagattccgatatgctttaacttcaataggaaaagctgatacactccaacgttcaatggaaacgaataaattcaaattactaaatggaaactaaaagcgtcgacattactctagctatgcggacaagtccttttcgtgcatcagggacaactcttgttccctgcaaagacatcttcccagcacgaaactcaagcatgatctcctgccaaaattagtccaaacataagtgtaagaaccttcgtaattagtctaagaacaataagagaaagataaacaccacctatagttacctgcatcacgggaaacgcttcgcttgaactcataatcaccacctctttctagtgaacactattcagtaaacagagaaatcagaataaattcagcttggtgctcttagatcaaggcttaaaacaagttcttctgcaaagtttattgacaacaatcatatgtatactaaagataacgaaatccgtgaaaattgcaaaaccaaatctcgaacagagcagattgaagcgaagataacaaaacgctagggttaccaatcttcgtagaaattgaaaaaaagagagagagagagagagatttacaaccttaaggctagtgtgttgacaaggttaaagaataccttagcagaggaaagttcgcgagtaatggattttggagagaaagaaaacgcttctcgtttttttttttctttcaattgcgtcgtctcttgtgttttttctttcttcttgtataaacaagggcccctataaggctacaaacaacaattcatccgaacaactccaagcccaatccgaatttttcttcattaggcttttaatttttgggtttgctgcaaacaaaacctgtaagtcaatttcgtttacaaatctaccattcatatccgaactatacaagttaatcatatgaactctaaagtcatccgcaaaataaacttcggtcatatcgatgacgtgacatcgctaaaaaggacatgaatttcattagtttcttgtgccataaaacataacaaaaaatgacatgaaaattaaagaaaatatccattgaaatatcgatttgggggaaacattaaggtttagagagtagttcatttggaagaattcgatatgggaaatgatggtatcgtgatccacttagattacagagtggttcgattgaggtcatattattaatctatattaagagagtcaaattgatttagagggtttttcgaaataactatcttttttatataaattttaaggtgcaaatgattgcctagaattaagaagttgaaagaattgaatgagcattcatctaatattttaccatttaaaatgaataagttggaaaaataatacaaccatttcaagttggaaaaatgaactaattattaaaaataaagttataacttgttcatctcatatttcgcagaggaatgagttgaatatcgcagaggaatgagttgaatagtattcaacttttttttttcaactcaaattttctattttttttcatcgttatccaaccatttgcagccttaatatattcagttcaagtgaatgatcagatcacttaacttagaaaactcacattatttattgcaaacttaatcacttgattattccataatctaattaggctaattctctaccaaacctctctcatatcacttaacgcagccaatatctaaatagtctgctaaattctcaatcatccatctttctatacaaaactaaaaagttaaattataaagtctacaagaaaagttggaaccctagtaaacaaacatacattttacaaacagaaaaaaagcacttgagaaaaagtaatacaatgaggtccatacacgtctgatttagctgtaatgttggtacgtccaaagaaactcaccgtccaaccacatcactacttaaccactacgaaatttccatcttattattcttctttatcatttcttattaaattcaatttaacttcttattttaataaccaaataaaaaagtttcaacaagaataaaaaaaaagtaaagtgttattcatatattcgacagtgacgaaaacaagaaactccaatcaaacccaaaagcccaaaacccagaagaacaaaaaatctctcttttgaaaattctccttttgcaaatcattcaagtgaagcacaatcatcttcttcttcttctccagcttcatcaatctcttctagactttttgcgtttacctgaaaaactgttttgatcgtaagtatctgattgcttcgatgtcgctgtcgaatcagattcccgtttactctcgatgaccctttgcttcttcttccactttttttccacagttttctgataactcttctcagatg

SEQ ID NO: 31207 - DNA, 3000 bp, Unknown; identical to SEQ ID NO: 11406
  misc_feature (1)..( 3000): 2750-1469P.txt file - cDNA_ID_3039817; gDNA_ID_2214494; Annot_ID_183779

SEQ ID NO: 31208 - DNA, 3000 bp, Unknown; identical to SEQ ID NO: 11403
  misc_feature (1)..( 3000): 2750-1469P.txt file - cDNA_ID_3039833; gDNA_ID_2214494; Annot_ID_133537

SEQ ID NO: 31209 - DNA, 3000 bp, Unknown; identical to SEQ ID NO: 11410
  misc_feature (1)..( 3000): 2750-1469P.txt file - cDNA_ID_3039833; gDNA_ID_2214494; Annot_ID_183772

SEQ ID NO: 31210 - DNA, 3003 bp, Unknown; identical to SEQ ID NO: 24852
  misc_feature (1)..( 3003): 2750-1469P.txt file - cDNA_ID_3039843; gDNA_ID_2214494; Annot_ID_183769

SEQ ID NO: 31211 - DNA, 3003 bp, Unknown
  misc_feature (1)..( 3003): 2750-1469P.txt file - cDNA_ID_3039855; gDNA_ID_2214494; Annot_ID_183763
aggagatggatccgatgttacatttattaccggaaaccgaagtgtcggagatggatggaccactttccgatctgctactcttggtaaacatctttgactcttttaaaaatcttgtttatataaaacaagactcaagtggtatagtttggggcatagtgtagactttaggaccgtagaatttttgccttttttttgtcaactaggaccatataatttaattttaaataattatatatgaattttctatgaaattaaaaagtaatattttaaatcttacaatctttggtttaggaaaaaaaggtgaaatagttgtgaacataagtaatcttgtatggttcttggagccatatttgttgcaatgacaaaaattaaaagcgataactaaagtggttggtactaaatcgagatagtaatgcttttcaaacttgcttttgtcacagcggtttccggcgaaggattcttggcgagggatataatgataacaaacacagcaggacccgagaagcaccaagcggttgcactacgagtgaacgcggattttgtggccttataccgatgtgtcattgatggttaccaggacacactttacacccactcattccgacaattctaccgtgaatgcgatatttatggaaccattgattatatctttggaaacgcagccgttgtcttccaaggctgtaacatcgtttcaaagttgcctatgccaggacaattcacggtaattactgctcagtcacgagacactcaggacgaagataccgggatctcgatgcaaaactgctccatccttgcgtcggaggatttatttaatagctcaaataaagtgaagagctacttgggacgtccgtggagagaattttcaagaacagttgtaatggaatcttatattgatgagtttattgacggttcgggttggagcaaatggaacggtggggaagcacttgataccctttactatggcgagtataacaataacggtccgggttctgaaacggttaaacgggttaactggccgggttttcacattatgggttacgaagatgcctttaacttcacggcaacagagtttatcactggtgatggttggttgggaagtacttcgttcccttatgataatggaatttaacatttttttttgctagaaatgtatagggtttgtcttcatataaaaatctaattacaataattaataaataaaaatctaaataattctatggtttgagttatttctcaaagctgtgtattaattaagataagctggcaaaatatgtatctttcttgaaaagtctaaagcatgtctttcttggctttatctgagtttccactttttaagaacgagaaacccatgcgaccatgtctttttgaaagttccaacactttaaattaaaacatgcttgacaagttgtgttctgtcagattcagtggcatattttatttttatgaagacggtgctgctaatcaaatgcttaaaagacggtgctggtgatacataactaacgattgcatttttgttttaattctttgtttatatacctccttaattgtattcagagttgaaaaacaaatttgtatacacatacggtagccagtcgcatcttcttggctttgcaaaaagtgggttacaaagatagcattatacacatagacggatccataaattattgtacatcgaaagataatttttaaaatgttaagatagtatatgtttggggcaggttttcgtaaatcgtaatccaccagatcattacatttgtttgtagtcgaaaacgttgttgtttttggattactattgagcaaaaagtagacaacccaagcaaatttaactcaactgtgttaggtgttgatgattttgcttaggaatggacagaaaaaaagttgtaatctccaatatgtaagctagcatctgttattgcgtgaggcaaagcaaacaacgactagcatcctcgcttgtgtcactccaaacaactttagagctaacttaagtgataaaaatatggcacaagtacttgctgcaacagcaacaccattcacgtaatataagttacacgtattaataagggattcgtctaaaattcggtgataaaaaaactaagatacaaatatactattacaattgttttttttgttttttttgggttgaattgttcaatagaattatgtaacattcccgtgacaactcttttcaaatgggatttgagatgtttcccaataaaaaatgtttacgtctagtcacgagtgtgtctcttcaatagtcatcacgtgatcataacttggcatttgctcactctgaagttttacatatatccaccaaaaccattgttgttgcctcttttcgagtctggtgatgtggtcacttactcacttactcacttacctatatgatcttaagccctaaaaagataaggaagcaccaaactgatagagaccgaattaataatactatttacttttcattattgtcttttattagttttattgttttttcttatagctagattttcctttgtgatttgcttgttcgccaaggtgtattcctatttaacgaagacctatgagtttaatagagatcatccattaagatatcaaaagtggagttgttattttactcgaataaacgaaataggagattgacttcgttttgatttttgaccaacaactctagtctagcaataatgtatgatacaaaaaaaatggttgctaaatttagaaggctcaatttcttttcaaaaaattgacatcagcccacaaaactctcctgtccagagcagatatgttcaattgtagaaattgcaacaaaacagtaacaaataaaactgaaaccatggaatgaagacaggggagagaagacaagaaagagccaaaaataaaacgtaaaaaggattcatctttccttttaacctctctgccttggccgccttctaaggcagaggagattcatttctttctctccccaagaaaaacaatacaaaatttcagaaaatttatagtaatttcagtatg

SEQ ID NO: 31212 - DNA, 3000 bp, Unknown
  misc_feature (1)..( 3000): 2750-1469P.txt file - cDNA_ID_3039865; gDNA_ID_2214494; Annot_ID_183758
tacaccggcaaaagcagagcaggtgagcagatttgaggaagagacgtgggaagaagatgcaattgacaactcaaatcctaagggtacaaggaaagaagccgttgaggtgatcctttatttcggtgttattgacattcttcaagactatgatatcaccaaaaaactagagcacgcctacaagtcactccacgcagatcccgcgtccatttcagctgttgatcctaagctttattcccgaagatttagagactttataaacaaaatattcattgaagacaaatgagaatgaatttaagtaacgtgcaacacctacacaagttcaaagaaaaagaattttacggtacatcagaatctcaggcatgggtttggcatttaattttttgggttttgaatgtcaaatttttaaacccttgaggcccctacacacgatgagatcgcacggcaccccgcaatgttgctcgaatccaggatgttgaagaggttgccggctgttttgatgaatttttggggttcactcattttttaaagaggaagagagttttggtgcttcctcaaaagatagtgtagatattaggataatgtttcttcattttattgttatatatggcgagccgagctgagaaatacatggacaaaagagtaaatgttttagcattttgtttctgcttatgattcattactcttaatctttatatatatatcgataggctttttgtaaatagtttctttttgtaatattgttttctactaggatgatccaagctaacgatctataatacctacgtttttcataaatagttgttcaaattataattatacaatttctgttattgcttcaagccatccggcaacatgaaattaacaagaggaagtccttataggaaaaaggttaagtttgtccaccggcagcttgcacataaaataaaattatcaggtgaatttcaaaaatccgtctcgaacatatacaaattttagcaaacggcatgatccatcaataataaaattaatgttttggtgagtgaacctaggttgtgcaaatgtgtactactcaagtagcgcataattttagtgaggggataaattacactagaggaacacgagtacgtagggtggtacaacgagtacaatccaaattggagaagtcatcattgttagagaattaggcagttggtaccacaaattttgtgctgaaacttttcgacaaaaacgataaagaaaacacacgttcttttaaaattattttatgacatgatcttgaatcaattcccgtttaggctatatataatgattcaaaccacacttgaaattttatttttcctacattaaatcaaaatctccatattgataagattgtgaggctggtttacacgggattgatgaaagcctcaagagtaaaaaggtcacctctctcccttcaaaatttttaggtgccaaataggtgcctcgagggaaaaccatttcggcacctaaactacaagctgacatttgtatattcttgtgtctttagcgaggaaatcatcacaaactgaattatgacgtagaataaaacaaatttaaacaaaatacaaatttcgatataaaactagaaaattcatctaattcattggagtcaaatcattttaattagctttaaacaatctgtcttcaattgaactttggccgtatgacgtggtatgagtgagttcatggccatagaagcacctctaacttagtgtgaagagtagaaagaggagagagacgacaagtattaagaggttcgcacgtactctctctgccgacttctaaataattaaatagaattaaaagtaagctacacaaagttgttatacgttataatcctttttgtcttaataaagataaataattgttacacgtacgttataatcttggattcattatggagttgaagagttatatcatctttattttttttctctgaaaaattaccttcaaaagtcatttttttttgtaactttactttcgatatccacaaaatacagagaaatcctgtgaagtcaaaataaccttcaacataactctcatatatttatttatgaagagtatttatttatttatttacatacattagattttaaattataagaatttattttagtctcctcatcgcgagaaatttgatttaatattttatttaggtttcataatttataaacttgacgatggtgatgacatgctatattgcagagtattttttatttaaggggaggtaaatggaggtaatggataaagttacaaaacatggtgatttggtttcctgccgaaaaacattttcctaatttttttcaaattttcgaataaccctttgtttataactgcaaaattgggatcttgaaccaactcttttacctatgaatttttgggtttctaacgtaattatatttgtagcttgacaaccaatctctcaagtagccccttctcttcaaccaacctatgaattatttaagttactatgtgttcttcattttggttttgggatttggttttataacttatttcttgttgattaagaaaactctcaaccaaacaaaataatggagggtgagagtgagaatcaaacccagagtggaatggataaagagcattagcatcatcaaaactttaaactcaattttctaaatttgtctaacagataattgttataaaaaaagctgtaattctaaaaaccacaacaccagaaatattaaaaaaaaaaaaaaagataaaaataacatatagaaagaacaactaagcagagaatgaaaataaaaaaaaacaactaaaaagaagttataatttataacgtatctgtcgttaaatctgttgaatcgttcttacaaaacacaatcgttacaaaagtcaattgggttcccacgaatcggtggggcccatcacgacgaggtctcttcacataatctcatctcttcttattgatttcacataaagtgttttgtaagaaaatgtttcaatgaaagatttgtctgaaaatttcaggagaaaatg

SEQ ID NO: 31213 - DNA, 3000 bp, Unknown; identical to SEQ ID NO: 11396
  misc_feature (1)..( 3000): 2750-1469P.txt file - cDNA_ID_3039869; gDNA_ID_2214494; Annot_ID_183753

SEQ ID NO: 31214 - DNA, 3000 bp, Unknown; identical to SEQ ID NO: 11417
  misc_feature (1)..( 3000): 2750-1469P.txt file - cDNA_ID_3039872; gDNA_ID_2214494; Annot_ID_183751

SEQ ID NO: 31215 - DNA, 3003 bp, Unknown
  misc_feature (1)..( 3003): 2750-1469P.txt file - cDNA_ID_3039876; gDNA_ID_2214495; Annot_ID_133563
ttctctgttttttactcttctccagattcgtttcgcagagaaatcgaaggtcttagctcttatgagccagttattacccctctgtgctcagaaatctccaatggttagtctttttatttcacctttttaccaactcctgaagaaaacagagttttgatcttttcatcttaatattagaaacagagttagtgtataatctgcataaaacttacggttatcgattcttgtttatgcacgcaggaaccatttgttgtgacagaaccggtttgagatctgatatttgtgtaatgaaaggtgatgttcgaacaaactctgcttcttcctcaatcttcctcttcacctcctccaccaataacaacacaaaaccggaaaagatcaaaccttacactagaaaatgggagactagtgtgatggacaccgttcaagaactcaacctcatcaccaaagattccaacaaatcttcagatcgtgtatgcgatgtgtaccatgatgttcctgctgtgttcttctccactggtggatacaccggtaacgtataccacgagtttaacgacgggattatccctttgtttataacttcacagcattacaacaaaaaagttgtgtttgtgatcgtcgagtatcatgactggtgggagatgaagtatggagatgtcgtttcgcagctctcggattatcctctggttgatttcaatggagatacgagaacacattgtttcaaagaagcaaccgttggattacgtattcacgacgagttaactgtgaattcttctttggtcattgggaatcaaaccattgttgacttcagaaacgttttggataggggttactcgcatcgtatccaaagcttgactcaggaggaaacagaggcgaacgtgaccgcactcgatttcaagaagaagccaaaactggtgattctttcaagaaacgggtcatcaagggcgatattaaacgagaatcttctcgtggagctagcagagaaaacagggttcaatgtggaggttctaagaccacaaaagacaacggaaatggccaagatttatcgttcgttgaacacgagcgatgtaatgatcggtgtacatggagcagcaatgactcatttccttttcttgaaaccgaaaaccgttttcattcagatcatcccattagggacggactgggcggcagagacatattatggagaaccggcgaagaagctaggattgaagtacgttggttacaagattgcgccgaaagagagctctttgtatgaagaatatgggaaagatgaccctgtaatccgagatccggatagtctaaacgacaaaggatgggaatatacgaagaaaatctatctacaaggacagaacgtgaagcttgacttgagaagattcagagaaacgttaactcgttcgtatgatttctccattagaaggagatttagagaagattacttgttacatagagaagattaagaatcgtgtgatattttttttgtaaagttttgaatgacaattaaatttatttattttattaagttttttttggtaagttatttattttattaagttttgtagtatatcgtcgttattcgttaagataataatcaatttgttttcaatattttaggaaatatttgaagcacaagaaaagaaatagtaggtggtcctattggacctatataaataaactaaaatatttattgaatatcaaaattttgtaattgataaagaagtttggacttcatcgccgctcactcctctctcatcaactatcgcctttctcttgttcgccctaatttcagccgcttcttgccgttttcttcgtcggagaccagtggccggtggcttccgtagcattggaactggtttttttgtccttgtagtttatgctttgtcttgtagtagtagagatctcgtccttgattcagttagttttggatagatctgagtaagtgcttggttgattctgcagatctattggccctcgtttggggaatttttcggtttgtttcaagggatgacttttgtttcgttgaggttgcggtaggagcggttagatctgttgatcttttcccgaaccttgcctttccctccgtctcttgtctccttgcttcagccatcaattcccatttggattgccccatttcttttcagaggtttcgttatgtttttgttgtgatagtcttctttgttggcagtcggtctctcctccttagtgtagtttgttgtggttgttagctttctcctacctttgtggtgttctctcacgatgaaggttctcggaggctaggcttctctctttgtcctgcttcagatcttttttgatagctttttgaagacttctatttagatgtatttagacgcctcagtcgtcaccgtcgcacccggaggcttgttcgagtttattccagtttggttggcttgctgggttatgaagttcttggttctggtttcgagagattggctctctttatgataggaggtggcagattttttttcggggtggccgtgggcagccgaagtaagtctcatcgcaagtgcttatgaggaggaggtcttatttgccgcttgtagctattgttttctttggtttttagtcttgttgtctctgtttatgtatttgggttcgttctcttacgtttagggtccaatttttgctgctttgtgttttagtttcttttgtttccctttcatagggctatgcttccggggatatcttcgttttcctccggctttgtctccgagaactttaatttcgttcgtcggctttgtttctcttgtttaggcatcgtgtaattccctggttccacatcaagtttatcaatcaaatttcagtttgagtgacaaaaaaaaaaagaagtttggacttttgttgtcatatgtgtttattataaatagcccaagataagaaaggctaagtggcccaataacaaacaaatatatatatcgaaataggcttcttcgtctcacacgttattgaccagaagagtgaagaaccctagttcccaacaaggtgacgatg

SEQ ID NO: 31216 - DNA, 3003 bp, Unknown; identical to SEQ ID NO: 31215
  misc_feature (1)..( 3003): 2750-1469P.txt file - cDNA_ID_3039876; gDNA_ID_2214495; Annot_ID_183813

SEQ ID NO: 31217 - DNA, 3000 bp, Unknown; identical to SEQ ID NO: 11426
  misc_feature (1)..( 3000): 2750-1469P.txt file - cDNA_ID_3039901; gDNA_ID_2214495; Annot_ID_183816

SEQ ID NO: 31218 - DNA, 3000 bp, Unknown; identical to SEQ ID NO: 11436
  misc_feature (1)..( 3000): 2750-1469P.txt file - cDNA_ID_3039914; gDNA_ID_2214495; Annot_ID_183808

SEQ ID NO: 31219 - DNA, 3000 bp, Unknown; identical to SEQ ID NO: 11424
  misc_feature (1)..( 3000): 2750-1469P.txt file - cDNA_ID_3039922; gDNA_ID_2214495; Annot_ID_183803

SEQ ID NO: 31220 - DNA, 3000 bp, Unknown; identical to SEQ ID NO: 25513
  misc_feature (1)..( 3000): 2750-1469P.txt file - cDNA_ID_3039926; gDNA_ID_2214495; Annot_ID_183802

SEQ ID NO: 31221 - DNA, 3003 bp, Unknown; identical to SEQ ID NO: 26981
  misc_feature (1)..( 3003): 2750-1469P.txt file - cDNA_ID_3039929; gDNA_ID_2214495; Annot_ID_183799

SEQ ID NO: 31222 - DNA, 2655 bp, Unknown; identical to SEQ ID NO: 26982
  misc_feature (1)..( 2655): 2750-1469P.txt file - cDNA_ID_3039933; gDNA_ID_2214495; Annot_ID_183797

SEQ ID NO: 31223 - DNA, 3000 bp, Unknown; identical to SEQ ID NO: 11445
  misc_feature (1)..( 3000): 2750-1469P.txt file - cDNA_ID_3039965; gDNA_ID_2214496; Annot_ID_183841

SEQ ID NO: 31224 - DNA, 3000 bp, Unknown
  misc_feature (1)..( 3000): 2750-1469P.txt file - cDNA_ID_3039971; gDNA_ID_2214496; Annot_ID_183839
aaatggcctcagagaatggcgatagcaataggagtcgctcgagggatacagttcttgcatatgggagtagcaccaggaatctttgggaacaatttgaagatagagaacatcatgcttgatgaaacactcacagtaaaaatcagtggctatactattcctttaccatccaaggtataaaactttgttttatttcttcttctattaattgaatctaagaaaatttaatggcatttctaggttggagaagagaggcctcaagccaaaaaacctcggaggttgttgttgtttcttaagatatgatcaaatgtgttctcttctatcaaattttgaaacttgttaatgaataatgtgcagtaatgaagatagagagaaagaagatgtgtaccagtttggagtgatactactacaaatcatcacagggaaagtagttgctgcaggatcttcagagatgggaagtttgaagcttcaggtctgttctgtttcagtcagaaccttttcatctttaagaatccgacacggcttacaaatttagaacctcaatgttattatttcctgcagctggagaacggtttgagagatgaaccatcagtattgagcagcttagcagatccatctgttaaaggatcatatgcttatgagtcgttgaggacgacagtagagtttgctatcaactgtctttgcgaagatcagagcaagcgtccttccatagaagacgttgtgtggaatctacagtatacaattcaagtgcagcaaggatggagaccaagcagtgggaatcatgaatcatccatgaaagcaatatatgaatgaaatgatcataaagagaggcaaaaactgtagaaacaataataagtttcaaacaagtcaagatgtagtttcatggactacctgaaatatcttttattagctaacttagtaatctgtgaataaaaagcaaaaggagttgaaaaacacacaaagacatgtaagagagtgtgtccagctttgctcgacaacattgcagactcttctgttgtattcgcgcttgctttcgctgaacattcgtgcatctcttaaaacaaatcagcagtctacaatcttgctaacctgcttgatgaagacatcaaaatcttcaaaaaccttcacaggttctttataacaagaatctctgtgcctggaatactatagaaaatcccaaaagttactgcaaacctctcactatgctcacgtctaacctctccatctcaaccacactccgtgtttcgggcaatctccaatacagaagtctctacctcatccagcattctataaacttcctttgttatgacttgtatcgctagctaaaaacaagtgcttgtgttccacataactataataaccatagctatacccaggttaggtaagatgtcgaaaacagcaagtggctttgccaagttacctcacctagcatacatactactgatcaatgcattttcgctcacaaaacaaattttgttacaataccattggcttttactagcttcttacttcttgaccaatctcttgagcctccaagatagataggcacaagaagacaggatcatgacaaacgctcgatgatcacaaacacatacacaccagcttccttcattcgagtttgatatgtgagctctcgtagacgcacgttccatggcgtcgagaagccaccgcagcgacggtcatggatattggcactttcgatgagcttggcgtgtggggtatttgtttatgtgtctatgaaccatttattggcaaaagggtatcgaccaaacaagatggtccatgtggatgagcctggttataagtttttggctgtgttgtttgaagttgttgtcattgccattgttatgatatgggacacttgaaaaaaacaccaattgactcattgatttctcaggtttgtaaagaaaggatgttgattttgaattgtttatagcaatcctcgtattgtagtgtactttgtagtttgtagcatcaaaaataacaacaacaatagtagaagagatgtttctctttttttttttttcgccagaagagatgtttctctcttattccattttgacaaggtttatcttaacggtacagtataaagatgggcctataattgttgagttgggcctgtagtggccttgtaggtgttgttattggcttcatttgggcccgccactagaacaccaaatggaccaatgggtgatttattttggatatcagtagaccaaaaattatatcaaattataaatttgggtctgatttgtatcagtggactgatatctttgatactcagtatcatgtgacgttgcagcatacggttggtcaatattttcgctcaaatcagagaaaaaaaaaatctttagtaatcttatgttataatatattaatttttgaatttgcaaaaaaaatttttttatacttaaccggtctcaccaatataatcatatttagtaggagtatcataaaaaatctcaaataaaaatcaaatattataaataatactaaaaaattactcatgatactatataagtatcaccccatatcatgctcttagaattgtgaaacttataaaactggtctttttgttaggcaatggtgaggcttttttactttcaggtttaaaaaacatgttgaagcattagagtgttgatgaatataagtttccctagtaaatagtatcttcagtctcagtcgtggaaggtgtagaaatgggaaaatctcatagaagaagtaattatgagtcatcgtaaactagaaagaagacgaaaagatagcattacgatagtattgatgacgttctggtttcgtaattaaagtgttttcatttcccaatacaaatgacttttgatatttcttctctaataaagaaagtcgcttataaatctcaatcatagcgagaagttttcatttcttctaaacttattcaaaaccctagtttattcttacaataatccttctgatttagctatggaagattccggcatgaaatgtgtctttgtaactactaatatg

SEQ ID NO: 31225 - DNA, 3000 bp, Unknown
  misc_feature (1)..( 3000): 2750-1469P.txt file - cDNA_ID_3039975; gDNA_ID_2214496; Annot_ID_183838
tctgactattaaggaagctccggtaacccaagctggtgatgataaaactaaaaagaggaaactgaaaagtttggatagtaccaaaagaagtcataagaaacgatctcttggggatcagtcaagtggaaaaggagaggttgagtctttggcaatgtcaccaacaggaaaaggtaacatctgtttttttttctttctctattgtggtctatggagtatatagctgatgttattggagagtattagtcaagttacatttgattgtacgatcagcttttattaagacattataagggtgatgttattcttgaagtaacgttcgaaactgaattagctgagaggcgtgagactgtgagagtgcccttaatctgtttctatgctccatagatcttgaaaagggagaaaaaagtgctgctacgattgaccaagagaatgatcttgcacttgtggatgatgagaacgagagtcatgaagaagatgttcgtgtaggagcaatagtagaaggtaaacattttttttgtgtttactgatttacatatctagatattcgtacattattataccttgattagctccaagtgcttcgaaaaatcttttaactgctgaatttttagacatcaatcaatctgctgatgttgagaacgaagggctcaacaaagatggtgttgatggaaaatatgctgatgaggctactacatctgtgaaggctgctaagaaaggaaggacaaagaaagacaaggcagccccgactaaagaagatactgaagttgcttctagctcaaggaacgttgatcacgatgttgttatcagagagccgcaggagaatgtaagttagaagtcaaagaagaaaaagtcttcgagcattgtggtagaggaggcttaagtatttgtcatctgatgcatcattgttctcgtttcttcctttattttttcctctacgttgctgaactttagtgctttttctagtttaagaaacttgtttcttctttctcgtgaggtttttggtattacctatgaggattttctcaacgtcaatgtatctaatgcttatttgtcatgtgttgaagttgtaaagttgatcccatgaagcatattttaacgaactaacgatgccattggcttttactagcttcttacttcttgaccaatctcctgagcctccaagatagataggctcagcctcgcaacctcctctgatatgtgagctctctcagacgcgagttccatggcgtcgagaagccaccgcagcgacggtcatgggttctccgccgatgatgactagtttggttaaacgtatactgtacttcgatcttatatgaaagtaaggcccatgggcctggcccaaagtatttgcgacgcataagtccaacatataagggagtaagaccgatgggcctggcccagattatttgcatctgccatttagtgcattgtaaaatttagggaatagacttatacgtacaaccaaacagattcgtcttcttctggtgcggcaagaaatcgccggagaaacttccgaccaacgtgtcggagctgataagaaatagtgtcatgtcacaaattcagagaatcttctcgatcgaattgccttcactggttcctctgcaacttccatctcggatgtaagtcgctccactgttatcacaggttgcagagttgtggaaatgaattgtgttgttattcatttcatgtagggagactcatctatggtatgttgttccagatgaagtgaaaagtatatctcttttaaaacactactctcaaattctgtcaccatctgagaatgataaagttcttcagatgcgaggtaataagcttcagaagaatgctttgcttgctcgcacattggttcgcaccaccattgctagatgtatgttattagccattggagtttcctagttaagttttgtttgcagagcattgactgtaatgtttatatttttattttctagatcagacaaacaatgtggtcgatcctaggaccttgatattcaagaagaacatgtatgggaagcctgaggtgagactgggacagttatttgggattacactagactcatcgtctcggcttatatgtgtttaactttcaattacaggtagattggcagagttataagaactgtgatagcccaccattgcattttaacatctcccacacagattcattgatttcctgtggagtgactgtacatgttcctgtaagtcttttgttaaggcaaatacatacagttttgtcaatgttttcttgttttataaatttgaacacttgcagtttactacgattgtaggttggtattgatcttgaagaaatggaaaggaagataaaacatgatgtcttagcattagcagaaagattttactctgctgatgaagtgaagtttttgtcagctataccagacccggaagttcagcgaaaggagtttattaagttatggactcttaaggtagtttctactaacaacagataatactatatttaagattctgtaaatcgtttcttctcgaaagttaaaaactgttgtgatggttctgtttccaggaagcatatgtgaaagcattaggaaaaggcttctctggtgcaccttttaataccttcacaatccagtctaaggctggaacaaatggaggctacaatctttgcaagtttttttttagactttcatcacactctggaattgaatagggtgcttttatcaaatgcgattagttgttgcattgtacactttgtaaaaatttcctttgcagtgtctttttcatttccttttaagaaaaggtttttgcaagtatagtgtataaatagacagtagcgatataattttgagacgcttgaattgttttctttagacatctgaaatgtctgtcgattcacaggagaagacaaagaaatgcaacggagaatggaagtttgccctattggagttggctgattctcattatgctgcaatctgtattgaagatgatcaagctagtggaggtgcagttacagttgacataggtcctatg

SEQ ID NO: 31226 - DNA, 3000 bp, Unknown; identical to SEQ ID NO: 11446
  misc_feature (1)..( 3000): 2750-1469P.txt file - cDNA_ID_3039977; gDNA_ID_2214496; Annot_ID_183836

SEQ ID NO: 31227 - DNA, 3000 bp, Unknown; identical to SEQ ID NO: 26986
  misc_feature (1)..( 3000): 2750-1469P.txt file - cDNA_ID_3039984; gDNA_ID_2214496; Annot_ID_183834

SEQ ID NO: 31228 - DNA, 3000 bp, Unknown; identical to SEQ ID NO: 11451
  misc_feature (1)..( 3000): 2750-1469P.txt file - cDNA_ID_3039988; gDNA_ID_2214496; Annot_ID_183832

SEQ ID NO: 31229 - DNA, 3003 bp, Unknown
  misc_feature (1)..( 3003): 2750-1469P.txt file - cDNA_ID_3039992; gDNA_ID_2214496; Annot_ID_183831
tcaatgcctagtttcctatatcacgttaaaatatataacacattgttaattgctttcgcagctttcagcttctcggactcacttgcttcatagtgttcccaatcctctaatcctacaatacaacaatgctttagaaccctagttttggaggcaagagatagtccactgcaatgatttagaacccttaattctattgttagaacgtccatgaagcaattaagcaaagattaagctatagaataaacttttctaactgattcaaagctctaagacgaatttcacaaacaagtaatacgcataactttaaaaccccaaccttgttcatcatcatattccaccggcaaaaatcaatcctgatgcacgaaattaccaaaacaaacctctcttcgacaagaaccaatcaccaattcagttttatccaactcaattctcaacctccaatgatgtactcgtcccgaaattaggacataacttgtgattgtgaaattgtgaggaatctcttataatgctggatctaaagtgtctgtgattgtgaaattcttacagtcctcaattaatcacacacgtccccgagccctaacttgcacagcaaacaaacacacagaaaaagaggggtgaaccaaaaaagccgagaaacggttagtcaactaacaaatcctctaaccacgttacttcctagtgttaaagcccatttagagcccatttctgttttcattttcggataacaataagtcaaatcaagttaatcaaccacagtaaacaaatccgaacgttgtaaaaaaatcaacaacggtcatgagtgaatttaagttaattttttatcacgtgattaaaagaaacgtaacggctaataccaacaagtaacaacgttcaaaattctctacttctatataataagaaggaaactcaagtacattcttccccaaccgaatggccgactttctcatcatatttggaagagttacagaacgataaaaatgagttcacaagctttttttttttatctttaatctctcgtagtgctaatgttaaagcggattttttgtcacgaaaagttcgtatccaaccgcttcatattacatttgtaaacaacattcttcagaattgtcttttttgagtcctaattaattttcggatgacaaaaaaaagaaaaaaactctaagtacactcctctcttgttacagccaaataaaatgtttgagatttttcaaaattcagtctaattatatccctctgctaattagattgtcgtcaatcacgtgatgttaatgtttgtaggagatactcaatttcaaggttagatagcctctctctatcttattcatctcagatttggatttacttcttttttttgcagatttactatttgcagaaattacctgatcactgttttcaatatgtatttttggttttctctttattttatcttccaacaatttttattatttttaaatattccaacaaaaaatttggattcccaattcaacttcaatggtccatgtgccttcaatattatgttagaagtcaaaatattccaacctgtgtactttccattgtttattaatattttgaagtattaaattgtttttcttaaaatatcacatttataaggttattatcaaaaatatcactatatattagttttttttgtcatcgcgattttaattagagcacaaaacgaggcaaatttgagaaatgttgtttatataagtgatatgaagcgtttcagtgcgaacttttcgcgccaaattatgcgcttttatatttacattacaagaaattaaagataaagaaaaattagttaattctttcttgtcgctctgtagttttccaaataagctgagaacgccgacaattcttttggagaagacaccatattcaccagatttgaacagttcgtaaaaaaatgctacaccttgattatcggccaatcatacacttcatcacctagattgcagcttctacttcgacttcactattaatttaatatatcaaaactactatcaaaacttttggatttatcagagtatcatagacacaaaacattaaggtttggattaactattttggttttagagtatagttttaaatgatatggtttatagtttagtgtttagggtttagggtataaatttaaatcttaacaaaatcttctaaatataataattaaaaatttaatactttaccaagtgtcattagctcaattggtaaagatcctacgtgaagtttagaagtcgccggttcgagtgacacttgggacgaaattattattacatgttgtggtttcggccttgagagaattatagatttcggtttagaacttcctgatatttaagaaaaaaaaatcacatttacggattagaaagattaagttaattttccggtttttgttaaaatccgaaaatattctgctaaattaatactccaaaaacaataaagcttttataccttttagataaaataggaaaatggtcttaaaaccaatggcatgaaaatttaaatttctcaattattagtagatatacaaaaaaatcgttgagataaataatacaataataaagactttataaaacagactaaattaatattatagctgtattttgcctttttaaaatagaaagtttcagcttagctgtatttgttgtttttatcaaccagctttagctgtataagtttaaacaatgactttcttacagaagatgcattaatatatctcattatgttatcgtacataagatgcattaatatatatcatcatgttattgtaataatactgtgaaaatagcatatagcccatagtttatgtgccacttgaattatatgacatgttcactcatcaaaaactcacgactaaattatatcattatgaaagaaatattaaacaaattgcaaatgggaggacatcacgtttcagtatgtatgtgtctatagatatgtaaaggcaagaacgatagcaatatcccaaaaacctcttaaaaatagtctccgatctaagcagacatg

SEQ ID NO: 31230 - DNA, 1592 bp, Unknown; identical to SEQ ID NO: 11442
  misc_feature (1)..( 1592): 2750-1469P.txt file - cDNA_ID_3040000; gDNA_ID_2214496; Annot_ID_183829

SEQ ID NO: 31231 - DNA, 3000 bp, Unknown
  misc_feature (1)..( 3000): 2750-1469P.txt file - cDNA_ID_3040023; gDNA_ID_2214497; Annot_ID_183874
ttgatgtagcgagagagatccttcttaggaggtaaagctccaccaataccgaattgcttaggcctcctctcgaatagagggtttgaaactttctcctggagaaatcagaaatcaaaacacaaaacttcagcaagaaagaaaaaaacaacaacaaagaacaaattgaatgttcgaaaacctaaaaaagaagaagagaattggaaatgaaacataccgcggtcttcttcttagcagctaccttcactcctttcttcggggcctaaaaccaaatcgtggcgtgattagattgataaagtaaccacagaacatttgtgacattgctctctacgcaaatttctagatggattcataagctatatcaactaccaaatctatcaaaagctaaatccaaagcagataagcaatgatggtgttaccaccgagaggaaatcgaaacccatgtgtgttcatcttcaagcgagaatgcatccaggaaacactaactctatcgtgaaggatctaattcgatgattctactatgaaagcaaacaactaacagatcccaaatgaaacgaaatgaagatggaaggaagagagatgataccattgtcgtcgtccaaagctccaactccaaatggtttctgcgaaaggacggctgagtcgaagagtatcgttttctagggttttgccttttatatatataccatgtacattgatagggcttctctattttctctaattaaaataataattaaaaattgccagcaaaccgtaattacaaatatacccttattaatctttcaatgtgttacggtctttttaaaccggtggttaacatggcggaaaaaatgagaaaaaaccggtttaacattttccaccagtgatgaactttctcaaaagagtttattatatacgaacctagctactagccaaagtcttacttttctcaaaaccaaacgttaatgaaactaccatttgatgtatacatatgggtagaaaacaagccaccgacacctttgtcactcattgggtgagctcttcctaaagaagatggtcttttccaaattccaattcagcagcatgtgtagtagtagtttcgtggatctgtatgtattctcgaccgcggttacaactaacgatttataactaaggcgttttagttttacgaatagtatttcgacctcgtgttatcgttcccatatgggagatttatatctttctctatgagatgtttgtgagactgtatgattttgtacatttgagtttttggaattgttttcgtcaatttaacaaaaataattggtgacaacaaaaaaactatcagtcttagtaatatgtgacgtatttcttatcaaatttagattgaccatgtaaagagtttagcaattaaatccaattacattgcttgtgtacttattcatgttgtaataaattgtagatttacaactatgacaatcctatataacagaacaaaaacaaatacgtatttgaactttctagtttacactttacacgaattacacgtgataaataacaggtagatttatgtcaatgtcatacatagcctaaatcaactaaaaagtaaacaatatagttcaaatgtatatatatactagataaggtccgcctatttaggcgggtgtacccgaaattttcaaatactcgaacggatataaactttaaaacccgaaaaactcaaacccaaacccgaataggtatgcaaacatatctcaaatataagtatatattagttatatttatacttatatatagaaaatattagaatttttttggatattttagttatttttgtgtatttttagatatattcaagcaaaactactcatgttgttttgggaatttttgaaaatttcaagtaatttaatagatttgcacacaaaatttgatatttcaatatataaataactcgaacccgaacccgaacccaaaccgaacccgacccgataatatttttttgtttaaaaatacatacaaccaaaatcttatttctacccaatttctttaagtaataattatattaataaaacctacagtctaatttctacagcaataaaacttacagctacagtcatcacacctacaacaaaaattctacagcagtaaatctacagttacagacaaaccaatcacccacgtaatctcgtaagttaattttacatcatgcaaattaatattaaatgagttaaaattaataaatgaaaataattgaaaagttaaatcctataagctaagctatttttctcaaagtgttctattttcacttatgattacatgagttaaagacaaatttgttaattttgcttttgttgaataaatgttaattgtttataaatatatagacatataaattagtatatgtaaatttgtttactttttaagattttctatttttttaaagaataaaaaagttaaattttgaatgacacatgtaaacatctaatcgtttgacttgacactgtgccaagtcaattttgaaaaccatactttatataataagatatatatatatatatatattttttgtcctcatagttcaattgtatatatctcaataatttttttaatcagaaaaaaacaaaatacatatatatccactaattctgatttgataatgcgttcacacttcatatttatcatgtttatcttttataaagaaaataaattagtcaggtcaggtttttagtaagatatatgtttatgataatatctaaactcgaggagatgataaaactaatattactcaggttgaaattaaaatctaatgcttataaggatgaaatgaaacaaaattcagggagtaaaaagatataaaaaaaacttgcaattgaggtctcatattcttaaaccttaccaaagaaaggcgagattaattaatcctagttagtcaagtaaatcatccaattagataagatcacgtgtcggtcgatgtacgcttgaatcctcgtttcgatacaataattgaagtgtgtcatgcagagattagagagatgtgtataaatg

SEQ ID NO: 31232 - DNA, 3003 bp, Unknown
  misc_feature (1)..( 3003): 2750-1469P.txt file - cDNA_ID_3040027; gDNA_ID_2214497; Annot_ID_133601
cgtcaccttcttccacttatggataagcctcttcttccatatttgatcagataactgaagacctttaatttgactgattaaacgaaactataatgaattaaagtaaaaaactcgcaaagtgaactttaaactaaaggtttatggatgattggtttgttcttttttatttacgaattcttggatatctaataaaagagaaacaagaagcaatcattatttgatgttggattggtgaaagaaaagtctttgtagtgtagctgtttttctttgttgctgatgaggtcagcgattattaggtccaaaactcgtgcgtcaagagaattgagtgagctctctcctttttttgaaatattgggcgaaggacactcctccatgcatttaagttatcaaaagcattaattagacgatggttcaataaatgagtgagcatttagtgggaaacacgagtgtgatacggacacgtaaaagcattaatgcatgtgtttatagatttggtgatgacttcattgtctgactctgtctcctctttttacaagacaaaagatttgttgctgattcatctctgcctctctggtctgtgtgacacacactgcctaattagtgttattctgtatctcagctcttgcttactagcttatcttagtacttagtagtaaaacattaatgggtcattatgtatatgtccaatgaatcaccactttaaacattaatggatcacttgctagcatcttcaattactatataacaatttaactagctatagtaagaccattaatctagagatcatatttacctatcctgagtccatgtgtggactgaggaggattatacattaatcatagaccatatatataatatacacaatcaactaatgaaagagggaggaatggtatcaacatagggaccttttttttttccatgttagagaaagttaggacaacacgcaaagccctacgtgcactctttcattattcctctcttcttttgcccccaacagtctttgacgacccaccttgcccttttgacccttctctctcacgcacatgtatgttattaattcaaatggttcttttatgcttcggcatttatcatcatgatatacatacatatcgatcgatagaggaaaaaaaaaaatcatttatgtagtagaaaatttacagatatatatatatatatatatatatcgtataatgtatatcaatatttgaatttgaagagtttcaatataaactgaaacaaagttaagtgtagattattattagtgaggaactagtggatatccagtttattttggtatataccggtaattcattctaatgaagtgaaagaatatggatactgtatttttttaccatgccatagagtagatgctagctaaagattagtcgtaagagaggtctaaggtcttgcttgtcaacgcgtgaccggcttcataggatcctagcaataagacaatatggtacgcctagcaacctagcacttatatatgtagagtttgtgaaatttagggcagacaagcccccacactaaaaaaacagtaatatggaataaaaaaaagctttcaaaacttagcagttattagacaaggtattgtttggccctagctagcgatcgtttagctctcttcactctctcacttttttagttcaacccttcttttgcgtgagatgccatcatggcatggtatggttcttttgccttacgtaaaacacactcacgccagcacacacacacacacacataacatatacggatgtgcgtgtgagctagtcttccattaatgcaatctttgggcctatatatacaaacctttccataaccaaagttctcatactacaaacgcccctcatgtgcttggaaatgcgggtgagaatctccatgttggagaagcagggcacgtgcaaaccaacaaacacgaaatccgtctcatttgcttatttgcacgtacttaacttctccaacatgagctcttcacccattgatgttatatatcccttaaaccttattgataatgtgtttttcgttgttcttgactagctcttcgttgtttgtgtgtatatgtgtgttaaatcatttgtgttcgacggttgattaaatctttatagttctcatatatgtaagtgttgctttggttattttgaaccttattgtgtgctgaccaaaatgtagcgtttctagatgggattgacggtgcacaatgcacatgaaactaaaagggtaatttcaagctctgtcttcgccatatatagttctcattgagctctttggcttgcattaattacgagagtgttttcgaacttgtggttgtatacttcactgcatggaccgttattcgtttcaaattacctacagagttatacatttagcttttgtgatggtttttgcagcatatgtaacgcattgatcagaggttcatatacacaaaatggaacgaatatatggagagtcccatgatatgtaagatcgaattaatcacttgtttgaagatcagaaactgtactttagctactttaatctctaattttgtcattttcaatttttattctggttttacaataatgttagttttatcttcatttttataaatctttttttatatgtgtaaaaatggcaaaatgataaaacataggaaacttataattgagacctttatgattttaaataaatttattattcaaaaattttaatttcaaattttatattaattgacaaaatatatttcaataaaactgttcagaactataataggatttaaaaatgttaagaaaattcgtatttttttccttcattagtagtgtttataatagaaaaaaatcaatcaatatttctaaagttgaaaataaaataacagtgctacgatatattttaaatacattttattaaaatatttgatctaaacagaagaaattgtgtggggaaaatcgacgagagcttatcaattcatctcacactcttcttcactctcttctctctacacacacacacacacacacacacaaaatg

SEQ ID NO: 31233 - DNA, 3003 bp, Unknown; identical to SEQ ID NO: 31232
  misc_feature (1)..( 3003): 2750-1469P.txt file - cDNA_ID_3040027; gDNA_ID_2214497; Annot_ID_183873

SEQ ID NO: 31234 - DNA, 3003 bp, Unknown
  misc_feature (1)..( 3003): 2750-1469P.txt file - cDNA_ID_3040033; gDNA_ID_2214497; Annot_ID_183869
ctcatctactgcaaacgaggatctaagcttacacctatccaaggtaaatctcatcatgtatatattgtaaactaggattggagttcaaggtctcgtctaagcttttgtttgatatatgtggacaggtgcagtggcgagagtgacatgtgagagaactgatgaatatggttacgaagcggaggatgtgacggtgcttagccaagcgacggatgcaaagggttatttcttggcgacgctttcttcgtcggaggtgaaggattataagaaggtgatcaagatcaaagagtgcagggcgtttcttgagctttctccatctgacacgtgttcttttccgacggagattaaccgtggaatcagcggagccattctccaaaactatcgtctcctagaaaacaagcttaagatgaagcttttcaccgttggccctttcgtcttctcctctgaggaaactcaggacaagtctatccccaacggctactaaatttaacaatgttttttttttttctttttcagtttctaatgccctaatgggtcatattggcccatatatcataatatatttatgtatttagtggctttttgattgcataactcacacatgcaacaattactgaaaatatactgaatatctattaatgcacgtgatttttaacttttatacacactatagataaatcaaagatcaaaattgcaatataattacggaatccaatatcttctaaatttgaaattgtgagtaagaatatatatttatgctgcataattatagtgtttatacagtgcataattacctccgtacgttaatgtagtttccaataagcaaactatcaaattattacactttaatgggacaagtgcttcgtataatagtgattattaattactacagaagggcacaagacaaaattgagagtcaaataattaataaacacaactcgaaagaaacttgccttaaatatgaagaaggcacatgctttttccgcgtaatttgaacaactagtgctagtgggttttgcttaacagcttaagtagatacattacacaaaattttgaaaattgagtcattaaaatatacaaattatcttaaatatgcttgacttttacaaaagtggtttaaattttcttgagttacgcaaacgggccaattcctttggcattgcatgaattttcttcacgcgttatactttcatatcaaataaaacgtcgccgttcagagatacactttttattcagtccttggacttggatatggaacacggtttttagttgatcagaagtcaaactcattgtcctatcttgccgaatttagaggatttatttaaaaaatattaaataaataacgcatgataatgataatttataaaaagtataaccaaaaaaatatctcttaaagaaaagaaagaaaacaaaatgtagttttgagtttattggttatctggatttcggaagatatatatgattcataattttttaggagttaaatttattttttaagactttaaaagaaaagaaaaaagttagtagacattgtttcccataaaaaaacaccaggtctcttaagtctcaagtctaaaccatttttccttttctggtcagataattctatcacacatgcttgaatttgaatagaaagacaacaaaagatggtttaaaaaaaaaaaaaaaaaaaaaaaaagacaacaaaagacaacactgggaacatatttacccaaaattcgataatggacaagctacattcaatctatgcttatgttttcgttgcatgcgaatgcatgttgtattacgtttatgagggttgtgctctacgatgtatactcttcacatgacaatatgtacactaatctacattgataatacatatatttgttaagttcaaatagcattatcacaaatgattaagctatatgtatgttgtggtgaattttccataaataatttgtcatctgtcaataaaattttaatgtatattctataacggaattacggtcagatacatgtgtaggtaatgaattaagtaagatattaatatctgtcgacaaataaaagcatcaatatgtatgtacattctcttaaaactgattcgatttcattgtgtcactgtgtatattgtatagaaacatatccaaatacgtatctcatgcctgtcctctaacttaaaaacaaaagaaaaaattatcataccagccaatttaatgcacaagattaactaattgatcaataattggatacgttacaactctataaaatcatatccattacgctttgggcaatggcaaattggcaatggaagtaaaatcaaaagttaaacaaatgaattaccatttgaaacactccaaattggtattcgtgtccaaaataatttttccaaatgtcccatcattctaaagtttttcaccttatgcatggaaccttcctagtatatatacagttctaaaacgaattttatttgcaatggtctatcagagattataatgtcaagatcttgactttttgctgatgtgtagtgtaatgtgctgttttaccaacatgttatatatataatcgaattttttcttgaaatgcctaacgttggttgacaattttatattacgaaaacctttccctgattatgcatattcaaattgcggtaacagaagtttggtcaaaatttgactttcatgtaaaaaaaaaaaaactcaattgaccttaaacttaaattaaacacccatttatatataattatcacggatggaatttactccttaattacagtgattatttatctaatttttggtgagagacagatctatgcgtgtgaatattatcacaatatggtatatatgttgaattttttgacaccgccacaattatatatgtagtatgtacacacacattatcattgacttgaatttgtatgtatattcaaattcaacgttctcaaaaccctatatatataatccaaaacatttagcaaaatatctccaaaccaaaacacaattaagctaaaaaaaaaaccaaaggatg

SEQ ID NO: 31235 - DNA, 3003 bp, Unknown; identical to SEQ ID NO: 25528
  misc_feature (1)..( 3003): 2750-1469P.txt file - cDNA_ID_3040037; gDNA_ID_2214497; Annot_ID_183864

SEQ ID NO: 31236 - DNA, 3003 bp, Unknown
  misc_feature (1)..( 3003): 2750-1469P.txt file - cDNA_ID_3040042; gDNA_ID_2214497; Annot_ID_183862
aaccggagctccgatcagattatttattccggcttgaggaaaccaaacaaaaaacaaagagcaaaagtgaacagatgatgatgatgattaacacagctcttatttggccttttttcgttttttaaagtttttactcctacttaaacaaacatcaaattaagctctttttttcttttcaattagtagctgtaattaacacacattttataatagtgaggaaataacagcttagggatacctcaaaaaaaggtttgaaccacctgtcacatgaaatctactgtcacatatccttgttgtggatattcactgattttttttaaaaaagttttgcctttggtaatgatacaactattcacttgaacaaatgttgatattggcagctgttagtttgcaaaaattaaatatgctaacatgcgcatataagaaatgaattatacgaaattttgattcgactctctgaaaacaaaaatattaggaaaatggtcatgtacctcttgcttaatttaacactagagattttattcaaaagaaaaaaaattaacactagagataatcagaacataatgggccagacatcaggcctttttacgaattacatatgggccacattggatactccgcaatcacataaatgacgtgagaggaagaggttggtggtggtagttttgtgagtcgtcactctttttatacttttaaaacccaaaaaaaaacgtacaagaagcagcgtgaaacattcaaattttgatggttctttgtttcttaattagtactagtattaattaaagtctgcatttatacgaaattgtctgattataggtcctaagagtaagagacaacacaaatcgtcaatttaatctaaaaaaagggccaaacatacgtataactgtttaaaaaaacttttttagttgtttaaaaacttataatcatgaaaagagaatccagcggtcagaatttgttcaggggttgagagtattactacagcttaaacacatctctgccatttattgcaacagcaatcatctcgcttgtaaaccgcatctgattgcgtcctctgaatttatttccccaaataaactctgtatgcttcataaatttgagcattgactttcccattttggatatgatcatattgttgttgtcggatgagaaattcgtacgtagcaataatttaatgttttcccacatgaacgattaataatttcggaatgattaaaaaagatactaatatatatatatatatatatatatatatatatatactttaacaacaacaaaaaaaaacagataatatatactactatatcgaacattacgttatcgaatgcatatcgatccgtgctctttataaagaaacctagagtgtctccgtctctctcactacattctccactgttcacattctctctctctctctggatctctagacaccaatacgcatagtgagcagagatcgtgatggagataaggtattggcggaggttaagaggataccaaaggctagatggttctgccaagaaggcgagctcgggccggagaaatgtaaagcgggtcaaaatggatcccacacggaagagacggttttggaggatcaagatagtgccgaagctaaggatcttgaaaaaggcgtcgcctaagaagcttttaacgtggcttcgagatgcttacgtcaacatgatgctgcgcctagcgaattctcgggtcgtcggatcatcgtacgggtacggcgaatatgggtacgggtcgggtttggcgtcgaaggagtatgacgagaagaagctggtggagatttacaaatcgatattgatggctcaggggaatctcgtgcaccgtgacgtacctaaactgtcctcaaattcgattttactctcacccattaggtaatttaaatccatatacataaaaaataaatggttatcgatgtcaaagttgtgatatgtattaaacttatactcttattaaatatcaaattaataaaagttgattccgaataaaatcaagatttgcatttacgtcgtaacttctaaccacctcaatttaaaattcttagttagttcaggggacgtgttgtcattgagattaatgcgtgtttaatatgatattgttttggttgaccatttaggcttttaattcgtatctttacgtatagttgtgattcgtaaatccaagtaacgaccaattttataacattgtacaagttacaagtattacgtagttgattgttcaaagcaccgagttttaacgaaccgtcattgcttacatcataggcaagtcaatgataagaaacctaatcaccaagccgtaatatatagcgtgaagggaagctgtctgggttaatagttttcatcaaaaggtgccaaggctttgtatcatgcgcaggtgtggtccattgtgccaactgccaaccccggctcatacatccaaaagaaaagagttttttaaaattaaaattaactgatatctattaaaattaattaagtgatatagtactatactgtatagcagaaaatataaaagatgatggcacttatggaatgctgatgggaccagaatttggttggtctgattcgtctggctgagaaagaaagtataatttatttatttttttagtaaacgaaatttgttattaaaaaaataagagccaagtaaaaaatatttttaaaatcgtatatattttattatttatttttagcttccggtaaacaaaaaaacacagcctttgttctgtttctctgcgatttcttcgatgttcctcttcttcgttttgattttcagatttgtttaactcggtcgttgcgttgacttcaaatttcttaaaagagagagagagagagagaggagatagttcagaaaatctgtcagacttgggatctttctcggcaatgcgacgcttgttcgccgcgaaatccctctcccgagaggatacaacctttttgtcattctcttcttcttcggtgacgcgtttcctcaaggctcttcttcctctccgttcagatccaagagatg

SEQ ID NO: 31237 - DNA, 3003 bp, Unknown
  misc_feature (1)..( 3003): 2750-1469P.txt file - cDNA_ID_3040052; gDNA_ID_2214497; Annot_ID_183857
aatgttctttaatttataatctagctagtataaatcacatatcctatttcatatgcgagatatgaacaacaaagtagtatacttaattgaatcaataataatccaaattaaatttatatggtttagatcatagagaacctaaatatctaaaactaacaaagtctaaaccacctcgattaattgggaataggatgataatataaagtctagattttgttttagttcaaaaatcgaaacaaaatcttactgtaattaacttactacgttcccttactgaagattgatcaccacacggtaaaaaaaacaccgttaaaaggttaaaccaaaaatattgctaagaagacattatttggttagttgaatgaaaaattagggaatgggaagtgtgaaacctacctaaaatatggctatgtagatgatattcattgaagagagagagaatatagaagtgtaaaaagagaaaatggtgccagctatgaattagaaggatcaaagctttctctgaagctgtcatctatctctctctttccttatagtgctctgtttctctccacattcacacactctccctctctctctccattattaaatcacttgttgttgtctttcttttttcaaaccttggaagcaaggaattcttttttgatgatttaatcgaaagcttcttcctccaaacaaacatcaatggcggtttatcctaacgttaatggcgataagaagcactggtggttcactcacagaaaggtataagcgatctctaacctggaaatacagttcttgattcaaagatcatcatcaatcatgttaactttttttgggttttctcagcttgttgataagtatataaaggatgcaacaactttaatggcaagtgaggaggcaaacgacgtcgcttcagctcttcatttactagacgcagccttatctatctccccgcgtttggaaactgcgttagagctcaaggctagatctctcctcttcctccgtcgtttcaaggatgtcgccgatatgcttcaggattatatccccagtcttaaactcgacgacgaaggatccgcttcttctcaaggctcttcttcctccgacggtatcaaccttctctccgacgcctcttcccctggctcctttaaatgcttctctgtttccgacttgaagaagaaagtcatggcaggcatttgtaaaaaatgcgacaaagaagggcaatggaggtaatataacttttaactctcttttttgttttacttattactttcaagcaaaacgcaatcgttgatttttaaacgctgtttcaggtatgtggtgttgggtcaagcttgttgccatctaggactaatggaggatgccatggttctcctacaaaccggtaaacgcctcgcctccgccgagttccgtcgccggagtatttgctggtccgacgatagcttccttctcctctccgaatcctcctctgcttcttctccaccacccgagagcgagaacttcacccatctcctcgctcacatcaagcttcttctccgtcgtcgcgccgctgcaatcgccgctctcgacgctggactgttctccgagtcgatccgtcacttctccaagatcgtcgatggccgtcgccctgcgcctcaaggattcctcgccgaatgctacatgcatcgagccgccgcttatagatccgccggtagaatcgcggaagcgatcgccgattgcaataaaaccctagctcttgaaccctcgtgtatccaggcgttagaaaccagagccgcgcttctagaaacggtcaggtgttttccagattcgcttcacgatctagaacacttgaagcttctctacaacaccattttacgcgatcggaagcttccgggtccggtgtggaagcggcacaacgtgaaatacagagagattcctgggaaattgtgcgttttgacaacgaaaacgcagaaacttaagcagaaaatcgcaaacggagaaactgggaatgtcgattattacggcttgatcggagtcagacgcggatgcaccagatcggagctcgatcgagctcatctattgctatgtctcagatacaaacccgatagagcctcttctttcatcgaacggtgcgagttcaccgatcaaaacgacgtcgattcggttagagatcgagccaaaatgtcgtctctgttgctttaccgtttgattcagaaaggatacaccgccgtgacagcgatcatagccgaggagcagaggaagaacgccattgctcacgctcaaaagattgaagaacgcaaaccggttgaaaaatccggttctattaagagaaccggaaacgctgaaacgaaaccggtaaattccaatgcgtaccaaggagtattctgtagagatctcgctgcggttgggaatctactaaccagggctggtttcaaccatccaatcccggttaaatacgaagcgctcacctgctaaaaaatattgaaccgaattttttatcctaccatgtcagccactggaaacgtcgtcgtttccgtagattcgtcttcggacagaaaaacaaatcattcagccgtcaaaaaagaaaataaaataagaaaatatatatacatttgatgtatgaatacaaatgaaacaatgtatttaggtttggaagattattccaactacaagaaaattttgtcactttacttttatcttcaatgttcgtctcctttgtttcttcttcatcttcatgtgcatataaaacgacagaagcttgatttgcacgtaaattaaaatactagtatcaaaactttttttttcattttattatcaaaattatctcttaagctattgagcactaatttattttttattattgagttctcgagatttgcctagaaatagtcgatgagtctggctcacgtcagtaatattcggatgagtccttatctataaagtttggctgccatttgatggtattgggatgattaatttaattaggcaaataaaatatagatggtgaaaactaaataaaaactattcacttgctgtataataatg

SEQ ID NO: 31238 - DNA, 1020 bp, Unknown; identical to SEQ ID NO: 11457
  misc_feature (1)..( 1020): 2750-1469P.txt file - cDNA_ID_3040056; gDNA_ID_2214497; Annot_ID_183853

SEQ ID NO: 31239 - DNA, 3003 bp, Unknown; identical to SEQ ID NO: 25541
  misc_feature (1)..( 3003): 2750-1469P.txt file - cDNA_ID_3040073; gDNA_ID_2214498; Annot_ID_183894

SEQ ID NO: 31240 - DNA, 3003 bp, Unknown
  misc_feature (1)..( 3003): 2750-1469P.txt file - cDNA_ID_3040084; gDNA_ID_2214498; Annot_ID_183906
gcaaggacaaacctggaccctctatacttgaaatactctgcagaaccaaactcaggtctcgaggagaaattaagctcttgctccttgaaaatctctctcgccaccgaagagcttgagaccacaacgcacttagaagcaccgagacgtatctccatgagtgggccatacttgtgagctaaactttggaatgagacaggcaatactttgcctatcaaatgaaggtggccaatgaatggtaaagctggagggctctgtggcagcttcgtagcagccaatgaaccttgctctttcaagaaccatttgaagagagcataaagcatgaaaggaaaagctaaggatgtgatgagaataattagtttagtgtttagttttaaatccattgcaggcaggtattgatacaatttttgaagtatgcttgtatttatatccagacacagacgaatcttgtttattagatgctcattgtaaagaaaacaaaacaacagatgtgaccttttaccaaatataaaatgtgtgacgtaacatatatgaaaattgtttgatgggaattaaaaaaaaaaaatgattagaagtttttattattcgaaggcacttcctagattgtgacaattacagatacacacatacaagaacatctgcaatttctaccaacaaaccaaacttctgtacaactgtttaactacaatatcctgaatcaagaagacatcctcatcatacaaaaagcctaaaagtaaaagggatccaacataaacccgtgaactatctaacagttatctcccatatgatatatcatcagaagatgaatttcttcttcttttttatcattagaaaaatgatagaatctccctactatatatcatcacagagatgattacctctttctagtgaatcaccagaggatgatgaatcatcatcgcatcgacattagcgtcctaactcttttctccctttctgctcttttagcactaggagtgctcttcattttctgaatctcttccatcacaaccttctccactttatcaatagagttgaggagcttcttctctggagtgagggcatcttcttcccctgtgttttctcttgtgatgtcgagcaaaatctgatggactttagcagttgagggtggccaaggacgcttgaatccaatagatggaccgggagtaaccatagaatagtcgtgctcgagatgagcacctgacaacggtactagagaatcaagaaccccaagttgttgtggagttggggtctcaatatctcggccaacaccttctcccatacgagctctccttctctcaatagcctgcatataagagtttgtaaatagccagactaagcaagccttttggtaacaggttatgacttatgatatagttaacaaagaggctaagcaagcctgttacagaagactaatctagcttataagcagcagattctgaaccaatatgcaaatcacaaaccagatataaacagatcacaaattagctatatatcaatgaaaaaaactccagttaaatctaagaataagcagacaaatccaaaatgagactaggtttagtgaactaaccctaacaacggcagaaatatcacggaggggcgttcttggataccaagaaggtaagacagaatttgaagcacgagcccttccacgccttgtaacacccaagctcatgttctctcgtccctgtggcgatctaaattgaatttgacctcttctaccaccaccagtccgccgaataccgaaattacccctcacaagcccacctcttcccgtcatagatccttgaccaattgacccaagtcctcctgtagcttccgatggcactctctgaaccggagacccaaacaaattgtgctgtgttgctggttcgtcaagtaaaataccatgcgagcgtctattgagaaatgcggctgggtaatcaacttgcctctctattcgatctcgtgcttctggcatttgtgattgagcgctgaagaaatcaaacaactatgccattagaacacacccaaaatcgaaatcgcaacattaaaacccaagaactcagtcttgttctccattgttaatcagattttctcgaaacctcataaacaacaagaaaaagagatcaactcttcgttttcgcaacaaatctccgtcacatcacaaagaacctacttgaacaaatcaaaccatggatttacctatgaatcttcaatagattccttcgtgatagctcggaatggcttcgtgaacggtaaagtggaggggacaaaggagaaaaagagagaaaagcttttgagagagagacgatctggcaaacaaaatttagaccattttctaggcgggttttgtaattgaaaatgaaaaatttcgagctcgcacgtgtcaaagtggtttcacctgtgtgaaatattttgaatttttcatctcacgcgggataaatttcgttttttttcaaagcgcacattgtcacaattcgtcaaattctttgtcagatttcaattttgcccttctgaataaaactgggcttgtggcccaattctatttacgtacgcattgctttcaagatcgaatcctcaccgttaattgtcataggatccaaccgctgctttttactaataccagaaaaccggattggctagttggtacggtctaatgatacgataacttgctctgattatacgaaaacactcatcaagaaccaactctaattaatgttttcttctaattatagttaaaacggattgaaccggacaattccataattttagtcggcttccggacaggccttcgtgggtttggaatttgtggccgacaatgtattgtcggtttaagacttgtttagggtgtatatataagactgttgaacgaaaaaaaaaaaaaactcatcgactcgatcaaattcttaagacgacgattacggagaacgggagagaggtaatagaagagtttttcgttccgaattttgttttgtttcattgatttaattcttggaatttggggtttgtttttccgatttggtgatg

SEQ ID NO: 31241 - DNA, 3000 bp, Unknown; identical to SEQ ID NO: 11494
  misc_feature (1)..( 3000): 2750-1469P.txt file - cDNA_ID_3040092; gDNA_ID_2214498; Annot_ID_183902

SEQ ID NO: 31242 - DNA, 3003 bp, Unknown
  misc_feature (1)..( 3003): 2750-1469P.txt file - cDNA_ID_3040104; gDNA_ID_2214498; Annot_ID_183896
actcgattacaatctgttccacaaaaataaaaccactgaggcaaactgatgatctaagattcatattctttttccaggaaaaaaaaaatggctaagggtggttgaatatcatactgaatcaactttgctgttaaagatagctccgctaattcctgtatcctcactacactcacagaggccacagtccccctggtgtgacagacaactggtgctcatctctactgactttccatcaatttttgaatggtttaaccgatgaacatagctgtcaccaacataatcccagatttgttgtgttcgcaaatcaagagaatagcagtgatgcgtttctttccagtgcctaatagaatgcccttccttgtatctaaaattggaaaacagaatccactgtgaatgaacttccacctctaaagaagataaaagatgtggatataaattcaggttaactaaatcttagaaaggcaaaccaagaattaccttccacaacctacgaagccacagacaaggcatgcccatacattctcagtttttccacaaatagaacagtttaatatctcatcttgctgttgacacaatcgacaaacctacaaacgaaatgagcatgttgtgacacaagtgcaaggtatttgttaataaatggatgaatcagattcattttatggaacaaaatgtattagctgagggaacactgccaataaatgaacaccgaaaatgcaacactaacccatcatataaagtggaaattcaatgaaaggaatgaaggagaaccactcacctgacaagacagataagtccatttcgaagtgcaagaacactgaaacgagtgatcacaaagagtgctaactataccactggtgtcaggatctaatctctctacaggagtcaaatcccaaatatagatatcagaaaaaaaggtactgaagaattcaaagtgataataacatagaaaacgtcttctttagcacaaaactcaccaagacatattggacacgtaggtaactcggtaaatccagtaggtgcttctgcagcaacctcatcaaattctgtgtgttccaccgacattacatatagaatatgacaaacctcagcctaaaacccaaagaaaagtcaatttcatgcaatcaaatgaacataaatacaaaataaacgataagctcgtttccatattataacctcagatggtgcgaactttttcccattcaagttgttgtagaaaccatcagcttcggattgatcagaaaatgtgataagaacactatatctatcttccattccatcgttcctgataatttacaagaatcatcaaatcaacataatcattctcgtcaaatcaagtaatcacaacaccaatgaatttcttgaatttgatcatctaacagataatgaatggaactttcaacgaacctgatgaagaggatgtcggagacttgggagatgcgggaatcacagaaacggataaaatcgagagaggagagataattgggaacagcgacgatgaagagagtggtggatcgggagctagggttaggcagagagctatgtgaagatttgcgatagagatggatcaagcctttgcggtcggtgagtttgagagatggttgtatgagtttaagaggaggctgagctcttttcgatgcgtaagtgaaacctgattcttcttcttcaacggagattggtctctcggagtcaacggaatgaactctgaggatgaacatcgccagaagcgggaaagagctcgacgacgaaagcttaagctactcggagagaagaaaagagacgacgatgcttcttctttctgattttttgattcgtcgttcttccgatattgagatgcttcaattttgtgttttgactcttattaatgggccttagccagtgtcatttgttcgataagtccgcccaacatgtcgatatgatagtgttttacagtatatatttttcccaatttatataagagcagaaatatgggcttttggttcggcccatataataaagacgacgataaaaaggccattatgagacgaagtaaacaataatatccctgaatgcttttttgagctgtcagcagcattcttatcaacaaagacgagacgacagtgactgttccgagtagcaccgctaaaacagtaagaggtgtgtgttggggtgagagtcacgcaaggaaatttcatgcatgttaaatctgtgtttttttgtagctaagtttactgagatttatatcaaattactttattgttcgttgttcttgttgatgtttagttttgaaatgtgtatgttaaaagatgataaaagggatcttgcttttgtgtttgtactttctttgttatacttattagatctgctatgtgaaatgagtagtgttaactgattgattctttgttttagtttggatatagttcgaggaatgacaacgattgtgttctaatgagccatggattttacagtttcttttatgttaatgctgtgttagaactttttaatgatgatatttgaataacaaatttgttgaaactgtgaacgtgatatgttatactctagataatgtcggaagtagagggcgaaaaccgggctatcgtgtgtgacaatggaactggaatgatcaaggtaaggagaaaataagaacactctctattattaatttgtgatgcgtcgtttgttttccaaacacaatttacgcatttgtattgcgtttacatttaaaaatatcataattttgaaatataattataacaaagtcaaaatgtcaacaaagaaactttctattttcaattttcatttaacaatacaattttttttttttctagtgagcttcttctatgtttgagtattgattcggaaaaatatgcaaaatgtaaaagtaaacaaccaattaatgcacattataaaacaacgtggcagatctaatgattggtaaaacatattgaaggcaggatatgctggagaagatgcaccaagtgttgtgttccaagcactgtgggtcgtccaccacatacgggagggatg

SEQ ID NO: 31243 - DNA, 3000 bp, Unknown; identical to SEQ ID NO: 11484
  misc_feature (1)..( 3000): 2750-1469P.txt file - cDNA_ID_3040112; gDNA_ID_2214498; Annot_ID_183891

SEQ ID NO: 31244 - DNA, 3003 bp, Unknown
  misc_feature (1)..( 3003): 2750-1469P.txt file - cDNA_ID_3040116; gDNA_ID_2214499; Annot_ID_183927
aaagataacttttatgttactacaatcgtatgaattagttccaaagacaattcaagagttcctttatccacgatacaacgatcactgttcaaatcaacgagacgagctgcaccagagaactttccatcctttggcaatcgaatcttagcccgacctatggcaacttctccatctgatgttgcaggatctctagaagaatgttttctaaacaattctaggtaaagatattttgcaggagaatctaagggaatcgccaattctgtattatacttccaatagttgcctttggaaacccatacctgtgttgtgtatggttctacagggtctgtccatgcaataactttatagtagtttggatgttgcaaaagattttggtcatcggttgtgcatgcacgtaatatcttcacgattagctttgtttctatgtgatgatcaatctttctcttcccttcgcgaatcagtctccttttttgtctccctaagtttgtcattgagactctggctgttaggtcttgtgaattttaaatatatatatatatatatatatatatatatatatttctaggggaaactaaaaaaaaagagtatccttttatttcggaaaatattttataaattgcgtttgagatgaacaggctaaacctaacgaagtttcatcataatccaaacaatttaaataagtaatactaaaaagattctgagaagcttaagagtaaacacaatatacatcgtatcaggaaaaatatatatagttagaggcatatatatcgaacttatttcttttagaaaaaaattaagtcactagctatggcttttgcttggtgcgtacgcaggtcagcatctaagttggcttccgcatgtggtcaagcccggtctatctccgccgttgtgaaccgtccgtctcttgctctcaacccgtctccgctgagtcctttcgtctctcgtggctttctttacacgatggctgttgataagctgagctctgagcaaacccttcaccttgtgattgactccgagctcaattctgctttgcaaaccgatgatcccaatttggtaaaactttcacatctttgctcaaaatttcattcctaacaaaacataaattagtatcgtttagctttactttgcgaataagtttctgataatattcttacgagacttttttttttttttgttctgacattctattggggtttgtttgggggcagaatgaagagatggctccaggaagcttccctttgaaaattagagacaagcctggagatcagagtgtaacattgacagcatattacaatgacgaacgtattcatgttgatgtaggaatgccttatcttggtgatgatgtcattgatgtgtttggtcctaataatgatgaactaagttttccactagttgtgactgttatcaagaagaacggagtcagcatagagtttacctgccaggcttatgctgattatattgacttaacagatttaactgtgcatgattatcagtatcaaatgggagaaactgactggcctcgtttcaagtaagctctttgaattcaataattaatattttttagagatgggcatgagcatagacgtttattggtgtgtgtttccatcgcattttgtagaaacttggacgataatctgaagaaggcgttccacaggtatctggcgaccagacttgacgcaaacataacgaaactcttgcataagtacatggtgagcaaaataaagagagagtacttgctatggttgaagaatgttaacaagtttgtggatggatgaaaggtaataagtttggatattgttaaaaaaagtctcttcttgtgttagttgatagcattcaaatgtgtttttagcaatttgcataatcttttgagaacatttgaatgtgtttaaatgactttcaagttctgatgtgagtttgatattcacttatgcttcccaattaataccaatccaaacttaaatccaaagatatagataaaaaaagaaaagaaaatgataaggagtagaggatcatctaatactatatatcagaaaggtgtaggtataaaatgttcttcatgaatcgtatttttggtgtgtgtaaatttctctttgtccacataagaaaaagaaagagggattgaagaagaagagaatgctagtttcttccactctgtttatcaaacagtgcataataatctatataagtgttaggaaaaaaaatgggtgtgtttgcaaaatagtcactttttcaaacttaattaggaaaatagtcactttactattcataatttgcaaaatagtcacttttcactgtttgattcgtacacttggattgtacatcacttttagtgtacaaatataaaatgtacgctgtgtatttttatatatatttgtacactaaaagtgatgtacaatccaagtgtacaaatcaaacagtgaaaaagtgactattttgcaaattatgaatagtaaagtgactacttttccaattaagtttaaaaaagtgactaaatagcaacttaagccaaaaaaaatctatgttcaagcacaatgttttgagaatttagggtaatgactttcaagttgagatacgagtttggaattcacttttaacaatatgttcttcatgttcttacttataatttaccttactcaataataataaacatatttatttatttttgtcatttattcacttcaataaaaatttatttatattggcacctgatctgattaattaagtaaatcaattaagaaaaaaaaaactaaaaaaattaataaaaatattttgaattttacagattttttgtaatgcaatttgttagatgataaatttccccctaatatttttggcttgatttagaatgttatttggttcgttgatttgaattaaccatcgaaccgaaccgggctgatacggagcctcaacttcaatcgctgttaaaaccttaaaacccttgaaactccattttcttccttcactcacagaagaagagagaatcaatcaaatcaaatcaccatg

SEQ ID NO: 31245 - DNA, 3003 bp, Unknown
  misc_feature (1)..( 3003): 2750-1469P.txt file - cDNA_ID_3040126; gDNA_ID_2214499; Annot_ID_183920
atcgatttaaacacatctactaaatctatagttcacaagtagagaataaaagaagcatcaaagtatctttagatttcctagttaaagtcctgattcttctgttctgtcagagaatctcaaagtgattcaaacgatcaaattcttgagctatatttgtaaaaaccaaagctattcaagtggtggataagcacaaagcgttaagattatgttaaaagtaacattaaaccactaatggagattgaagtgtaccggagctctgttgatggcaccgacggtggaaactgcggcggccatatctcaagactgcgacgagtatgcgtcacaacacaagaagctgaagagaggaattagattggtagaagaagaagcttagagagatgttggtgtgagcaagaaactgagagatttataaagcgagtgatcaacaaccaattcgttatctcttcgtcttcaaggcttaactctctgatcgccacacgatgcggattggccaagttgccacgaggaagatgattaggaggattctattttgattggtccacgtggaatatgtttatgaggttgtcgtcaaatggctaatctgtgccaatggatttgttttttttttcaagtgaagattataacattatttattaccacatatgctttggaaaatcattgtttttttttttttttttgaggattgaggtaagccattcatatgtgatcaagatacttctacactcttcttcatacgataacattccaaaattttggataatgacattgcttatcgataataatgttccaaataaccgatgtaaactgattggtggagagaaattggcttagccaatagaatataattctaattttgttatatacaactctagatacaacaggtatcaagtatgtggttatcaaattaaccatattgtactaaaccgctaaaaactaattaatgcaactttttctttacacaaaatgtaaaaacaagtgatgcaatgcatacgtaagatttgataaatatatagtttagaagatgaagtaaagatagtcgaggctaagatagcatcatgcaaaatatcatatgctaaaatatgaaataagattatagtgtttaaattcatagtgaaaatatgaatatatcagaaattcatatgaatttacttgttttaaaataaaaatgataactatatcatagtttattgttccctcaaagttactataaaaacaactcatctaaaactatatattcacaatcacaagcaatcgttttctacactaagctataaaatgaaacacttcacttgtctgatcattataatttctcatcctcttcattattttcagttttctcaaccattctctcatgtggaacgagccatcatatcatcaatggacaaaaccaaattttaattttaggcttcattcgctgccgacgaagcaatatgtacatgttctacatgcaagacaagagaacaaagattactgatatgatattaaactattattgatccatatataagacatgttgaagaaccaaacgattgataataatgtggtggagctactcgcacaatgctaaatgttaactgtatgtgacaaaattagcaaaagtttgcgtgccaggtttgattcttagtacacatacatgacttttaacatactgaggttagaaaatgaagtacagtaaaacctttataaattaataatgttgggactgcaaaattttattaatttaaaaaggttttaatttatcgataaattaatattttttaattatagagaaattttcctaatttggtaactttttaaaaagttttataagatttttttcattatagaaaatatctttctaaaatcaattacaagtacaaaattatatcatgtctagaaaacaataccaaattttttttgatacagtaacacattagaactaaatttcaaataagaataactacaaatttaagtaaaaaaaaatcaaaaacatttcttacatataatgtatatatatagttgatacatttatgcaattattaatttatgatattgatgagactatatatttacataggactttcaaaaaagttattatcttattaatttatcgatgtgttacactttttacattggtcctaacttgggatctggtgaatttattaatttatagaggttactaatttatcgagtattaatttatggaggtttaactgtaaaaagagttgaggttaccattgcaataaaatatgagacaatgtgtagaggaggataaaagattgaacaaaaagaagaaagccaactagtttttgtcaaaaggataattttccatgtgcatgcaagtatgcaaccacatcaaaatcataaataaacattgtctaaaatgtttctaataaaaatagatgtaaagaaaattcatcagtttaataactagggtttaagagatatttacaaatactaaccattaacatcatatttaatatgactttgtaaaatctatgatcaaataacatgcaatttttttaatatgtaaaataaattatctcaaaatatttgattgaatatataccctttaatttagcattgattttaaaaatccaacaattttctatagtatattttgtaataatgttattggttcctaaaaaagatggtcacatcattcattaaataaaatgaaataaagaagtgtttccttcgtcgcattgaataaaataaagtaaaccttccaaagacttttcattgtcttcgcctgcgagcgctaaaattatctccgagcattctcaagttgggtgattcggtacggattactgatttgggagagaaaaaccctagattggaattagattctgggttcttgggctaaaggtttcttcatctccttcgaatcatccttttgtaagtccagtggatgtgaaaacccagtactcactgattctttttattaggaattttgtaaggttttgggtagagttttcacagttttgatgatactaaaatgtgggccactgggtctagagaatg

SEQ ID NO: 31246 - DNA, 3003 bp, Unknown
  misc_feature (1)..( 3003): 2750-1469P.txt file - cDNA_ID_3040159; gDNA_ID_2214499; Annot_ID_133634
tgtgccatacatttattaattggtgtagcttacaaactttccaaattatatttcaggaagcttgtaggattctacctgaaatatgcggtccagaaacctaccccaaagttgcgcaagtcctgttagaaagggataaccctgaaacagctcttatggtcttgcgttggtctggtcgtgatggtgtatcagaattggtttcaattggtgaagctgtcacagctcttcgtgtgagagtggaatgtggtcttttgagtgaagcattcacataccaaaggacactctgcttgaaagtaaaggaaaataatttgaaaaatggagctgtgaaacatgcgtctgatgatctagacatctggagttggacggaatggatggagatacttgtcaatgaattctgctgtctttctattcggagaaacttggttgatcgaatcattgagttaccgtggaacccagatgaggagaaatatctgcacagatgcttattagattcggcaactgatgacccctcatcagctgtgggtagtctcttggttgtcttttatcttcaggtaagtaattatattttcaaactttaaataacttcacttgaacaatgggctgagaattgtttttcagaacgagaatagctttagcaacaggcaaatagatatttagacagcagcttaaacctcccgagctttaagctacatattgaaaattttaataagggatctcaatgatggctctgtatagaattagctcattctatagagactggtatatgttctcgtatttgatgtgtggcttcaacaatcttttataattcgagcttggtgtagtctgggatgttggttaacaagcatgaaattatttgaacaaccagggaaactgcatcactatagaccatgcttattttctggaaagttattatcttttgtatatggtctttctttgactagaaattactggttgttcacattgctgcagcgctaccgttacatccaggcataccaagtcgatcttaggcttcagaaaatcgaagaggctttcgtatccgacaatcaaattggggaagaagttatgttcagaatgcgatcacagagtcattggagaaaagagttagttgtaagtatttcagccaactttccatgtacaagtggatccttccatagttccttgttaaaggctacatcctcacatttgcgttttagtgcttaataacctgttgatgcttgcaggattgtctagtattctgaaacttgaatgtacaatattacttgatactggctttttttaactggacatttaaacctcccgtgtctctgctcctttgaaacaggatagagccatagatatacttccagtaattcagcagcagcaagttagatctggacaattttctgagatggaagatgcctctgaaggagcaaaaaaatctgatcttcctgatgcacctgacatgattacttcttcagttccctttgccactactaattccgtttttctccaaagtgctaacaatgccagagctagagagccagtggctaataatggcagtccttttcaacctggtcatatgataggaaacgcgtcccatgatctttcacatggaaggttatttacaaacgcaaatagaggacaaaagagtgaagttagaagcgtaaccaagaatctgaaattcggtgaaatgtcaactccgttcaaagatctaaatagagctcgtgggaacagccagctccaagggaaaaggactgaagaatcctctccagaagtaaatgttgatagatacatagagaataatatgagctctccttatctccgccgaatcacagctaacaatcccgtgacagtgaaatctagcagcaaccatctcaatggatcttcacagaaaccggaatccaccttttttggcacaaggatgcaaccagacaaagataactttgttgatttggatgatccaatggacatgtcttcgaggtattcctctcttctttatctcttagccatttgttcctttctgaatcgtgccattaaagtagaggacactggtattgtttggtataaaactattgttaccgtttggtttgaaaataaagtccagtttggtttcagtctaaggaactttgtttggttcttatgtccacggcttttagtcttatattggatgagctacatatcaattgtgtgtattatgaattgcagcttaaaggacaacaacaacaatgtcttggccacggagagcagaaataacagtggtggattgagatggcggtcagatgaaacaagcgatgacgaagatgaactgactagttttggttccatgccggtgaagggaaggaggagacgtagattcgcagcaagatgaaatgaaacaaacactcgaaaagaccatcatcaattatgtttaaagcatagagaaagagagagagaggtagagcaagttgtgtaaagaggggagagagactgttacagtgagcgttgttctcctgttattttttgtgctgaattttgtgtatttcttctctagtctaccttttttggacagttattttaaagatatcattgtgatgagcggagtgatattattattatgagtatgtttaatttcttatattggtgcagctgattgttgaatcgtagaagttataacaacacattgagattaaatcattttctttttacattcacaatttcctctcaaaattttaatttttaacttttttattatttaccaaaactaataaatggaaataagtagcataagcttgttccaagtttctgatatataaatagggttttcggaagagagaatagggtctcttcctatcgttccgtcactttttgttccgatttgtcgacaaggtaaaccttaaaactaaatctttcaatatagcataaccaatgatccgaaaacctaaatctttcattctctgtttctgccttggatctgtattgaaattcataatctcatattaggttttcgtgttacttaattccgcaggtgtttgttggatccatatcatg

SEQ ID NO: 31247 - DNA, 3003 bp, Unknown
  misc_feature (1)..( 3003): 2750-1469P.txt file - cDNA_ID_3040159; gDNA_ID_2214499; Annot_ID_183930
ttgaaaacttcctttttttcttttatatatttttactccataagcaaaataagtggtagcaaacaaaaccaaaaaatgaaaaaacacaatcgttacaagcaacgatgaaaatccgccagtaaaaacgaaaccgaatgatttagcggatatgttccttcttctactttgtgggtttcattttctggtaacgacattcttagttctaccgcagcacatcaaaatctaaaggtttttacatatatatgttttgtctggtgttgaccgtctcatggagattaaggaaagaaccagaccttgatgaagattgaaagaaccatttgcagaccaaatgctgcagccattacaaccgtgatatcattgttcgtctcgaggtaagaccgtagattcagggcaacaaaacacgatgatgcactaccagctaagagtataatcacccatctcagaaactctactggaataagcaatggaagctgcaaaatagaacatcctgagtgttattatgcttaaacagtatgaagtataaagttgtgatatcaagttaggttgatttatgtcattgtacatggtcattgaaagtgaagttaccaaaccattgtgtatcaagtatatgcatttgtctttagtgttactgatcatcaattgattaattttaacagcaaaagagaccgaagttactgaagatacttacagaggttggaacgaaaatgaagagagagtatccccaaaggcaccagaatcttagaagatcagctttggaccccatataacggagtgcaaaataaaatcccagaggcacaattattgcatatccatatattatagatgctgccaaattcatatagttcacatcaaagatccaaggagcattactgtcggttcgtttcttcacgagatatgtagcacaatttccgagagaagcaagcacaaacacaagcgtagtgcagatccagacaagtccatacctaacagaagcacacacgagtcattaatcaagaataatttgtgaaaggcctagcttttagccaatctttagaggataacatattatgatgctttctgttcatttgtccaagagaaaatgaggatattttaatcaatcgcctgaagtaacataggagtaaatgaatagcaagatcatgctttcggaaaggtgcagaagataacacttagaacggtaacaaattaacggcatgactgagcaatggaccgattaaagaaattcgaaagaactctctcatggtaagtacaatcaccaagaagagtgaaggagaaaaaggcattaaaagacttacaaatcagggtttgcatcaatcttgttgaaaaaatctccactagtaggatataaagagctcattaatctgttcaaaacaacgtccgtgtccacgtcgaagtattgggtatatgagtagacattaaaaaagcccttccagttgtttgatggctgttgtgctggtccttctactggagcagataagatatatcaccatataagacagaacaaggtgaaaacaaaggtatataggatcttgacatccataagaaaaacgaggttgactcacacaagtattctttcaaccattgtactgattcatggtgactacagataaaaatatctcctaaaaaaggaatctaaaaggagcatatatacctgttgggctctcaagagtttgataaccctttgtattgtttcctagattcggtggaaatatttgcatgcttgcagaagggcctgcaataatgcagaagacatacaacactcaatgtctttcactaccggaaaagttctttgcaaaagataattcaagcagaaactagcaaaagaacacaccttcattgacgcttgctattggtacatttgtgcttctcttgtcgtcgctgatcacagcctaagaatacagatgtttgtatcagacataataacacggggatagtcaatccattcactcaaaacatttatcttagcggattcaatccaaaatgaagctatcatgcaagcatttaaactcaaatacagttttgtttttcatacgaattgtctcctaaaatggtgaaaaaacttaaataaaacgccttaacaaatatagaaacccagaaatgcaaataaggaaatcgtccattgttctatgagtgtgaagactttaggcatcatcgtggacgcgaaaaaatatgacaaaaaaatctgaaaagtttcaaaattctacttcctaatgtaacacttgagacagaacaacaaacaaaatgatggcatgaacaaaaaacgttaattttcccttcacacaaacaaggatcatagaaaaactcaatcaaagagcttattgatggtgaaatgaaagaagcaatagatgtaatatagacttaccggaactgaaccaagcaaatggcttgattgtagattagcgaacgactcatccatcgatcaaagagaaaaagatatcaaagaaaaacttagaagataggttcttctaatctcattcaaaaatcgataagatcggaaaaaaggtcgtccctttttctgaatttttaaggtttctgggtttgcttctcctcctccgtcgtcgtggaagcaattgggaaaggaagagaaactaaagaaagaacgatccacgcgctttcttagcaagtcggtaaaacacgcgctgttcactttcggacacgtgatttgccgacttgggcccagacaatcacaagattcacacaagacttcaaaaacaaaggcccatatttaaattttgacccgaatcgtgatttgccgacttgggcccagacaatcacaagattcacacaagacttcaaaaagaaaggcccatatttaaaatttgacccgaattaaacaatccgacttgacccgtttgaggagaaattcactcaacagtgtttcctctcttcgtcttccctcccgagaaagctcaacggagccctagactggttttatcactctcgccaacaccaaccacgctttttctctctttacctccatttttgtattcgtcaccggagtagatg

SEQ ID NO: 31248 - DNA, 3000 bp, Unknown
  misc_feature (1)..( 3000): 2750-1469P.txt file - cDNA_ID_3040202; gDNA_ID_2214500; Annot_ID_183966
ttgattatgaaactgttgatgttcttgacgatgagtataatcatgggctaagggagacgcttaagaactacagcaattggccaacgtttccacagatatttgtgaaaggagaacttgtaggaggatgtgatattttgacctcaatgtatgaaaatggtgaacttgccaatatcttgaactagtttcatccgattttcttctctatttctagttgtaactccaaacattcattatagagaaaacatgcttggattctcttccatagttacagattcgttttctgttttccgcatttataaaaggttacagattctatacaaatctaagagtaggtttaaaacgcataaccatccactaaattcacctattttgtggtcatttaaccaatgatttttttttttttttttttacactaattgtccctttaaatatatatgttgaaacaaaacataattggaaatggagttaagtaactattgttacgttaaatgatttaattgattaatttagtagcattcttattcttgtagcacgtttattagagaattattgttcttctttgacataatctttgggtgaactaacacaaaatattcattttaagtactaaattctcatttgtaggatgaatatctcaaaaataacacaaatattctatggtattcatttgttacaacttatatgagtaacaaacgttcatgaaaattgaaaaatatgatgatgacgaggttagtttatgggttgtattttctttttattttttttttggaaactgaaaaaaattaaatgaacaaataaaacaacaagtcaacggtctcaaaaattcgattacataaaaacaaaacaataaaaaaatataagtcagactgtaaaataagttgataggtgttgattctgaaaatcacacaataaatttgtttaaaggggataaacaaatttacttaactctctctcgctatttagtgaccaaaggctcaatgaaaagaagaacaaagttggttagagacaaagttagggttttgctcaagaacaatgaagaaaactagggttttattattaagtttcggatccttagaatagaggacaactccctcccccctccccctatttatacattattaagacgattaaaagatatgttaaactttcaattcttcgaggcttgaatcttctaatttcctttatcttcgaagacttgctattttcaaaggagaaaacttctttttcttcgaattaggaagtcggctaggcggtctccctacttggggctaaagtcggcaaatgacctccttattttggctcattaacaggctaaaccgggataccccggtttgattacaatctcagtctaattcgtaattcctctggtttaagccggtattgtcggaggtgctaattcctgcaccaacaatagaaataaatgtagtcgatgaaaatgaaattttatagaagttagtagattttacttttaggtacgattctcttcaatgtgttccctctcgctgtgattgattgatactctgatggtaaaaatctctctttgtttgtatccgtcttattcacagccaaagatgaagaacaatttaacatttacaccaaaaaagatgaagaacctagcgaagagtgcattcgtgtctcacaagggagagctcaagagcattttcgtggtgaagaagcttcacttgacttgggtcatgtcgccaagagttttgctcagagagaacaaccgtctttagttgggaaatcgcatgataaggaatcaatgaagagaaaaagagacgaatgtcaaaaagggcaacaagctaagaagagaaagaagatgagtggtagtactagtgccaatacaaaaaaaaaaaaacttgatcgaatcggtttggccatcataaaccatagcataagtttgttcatcgaaatttttgaaatatctaagttttgaacttaactatgtttttgttaacaataataattacttgtatcaaccagaaacaacaaactgaaatttaggcagaagttagtggattttgttgcattaaaaataaaaatggccgatgcctaataattttttacagcccatacaagtaagcataattaaagctctaaaaggtaaaaagatacggtaaaagagactctctctcttaacacactgttcatctttgagagagagagtggtgatttccggttaaccggaatattccatctttttgttttatatagttttccgactttgtttggattctgtttttcttagtcgatctttatttctgtttatctatcttaatttgtcggctaagatacgcttttttcctttttgttcttccctctttctacagcttttactcttgaatcccgtttgcttttatcagaattagtcatcgacttgatgtttctccaatgatagagtaatatcttcgccgctatatcctcaaagtgaaggattaaagacctcttcgttaggttttaggtggagcttcttcttggaggtgggattgagttcgaagtcttctaagactaattcaacagttgctatggctaaaattgtggaaagaaggtctccgaagcatgattccaagtctctatctactaatcgccggagagaagaatcaagtcagatccaaatcttagtcggcaagaagaatcgagatgataagagaagagtgggcccacatatgtgcttaacaatacacgttatggggttacgtgtcattaatgttattgggttcatttaatctgggcttaaaagaggcttgtatcatgttgtaatattccgatctgggctttcatataatgaaatttggccgacaaaaaaacaaaaagcccttttaggtagtactaagcccaaatcgtaagagaaacaatcgggaatgacaataatgtcatcgaaaagcagattctgagatcgaaaagcagagatcctatcctattgtttgattgttgatctgattatcctggggatcaaatccggctagctataagaactccggtgaagccgattgttcgatg

SEQ ID NO: 31249 - DNA, 3003 bp, Unknown
  misc_feature (1)..( 3003): 2750-1469P.txt file - cDNA_ID_3040210; gDNA_ID_2214500; Annot_ID_183962
ggtcatggaatctaattcagggttagtcaaatggaagttcctgcttaagatgcattgattacattgcttatcatgagttaataaaagttctttacagggagtggtatgattcaattggatataagtaagtctaaaggttattatcttactgtggctaacttgaagaggaaggacgtagaggtaattataatcaagttatgactttggattaagttttggtttctgttgtgtttctgcacagtccacagtacactgttttacttgacataatgtttgttcaggtggaactggatattgatgtgaaggttgtcttgtatgatactaaacaatcatcctacaattgttccttcagcaatggcgagtgctcattcaaaatgaatgaaaggtcccctgttgaaaattatgctgtcgtaacttcaccagcactgggtcaggtatgtactcgtaatacgaaacactaacaatattgttactgttattattattatgactcttagctgaatgaatgtttgtctcactgccttagggagtatccatcgatgatgaatggtatatcgagttgtcatatcaacctagattgattgcatatggaagcttcacaggtaaacttttcaatcttttcaaagtcaacttgattattggatttaagcatttgttagtttctctgtaacaaggaagcaattacatgtagtattattgcgtatgcaggtgtgttgctttccttcatgctggtagctatacacttctgcaacaagttaaagtgttgtggtggagagggatttttatccgaagatgattcagtgagaacatgtctacttgcagacaaaggtgacaatgattgttgtaatgatgtcgaagcaagtaacaaaagtctctgtgccatttgttttgatgctccaagagattgttgtttcctcccgtgtggccattgcgtctcctgttaccaatgcggaacaaagtaagttttttatcaactaagtacaacttctggattgcataattgtaatggtaatgtgtttaccatattgggattgatctaaaatattgaacgttgtgatttgacaatatttgcaggataaaaagaaccaaggggaggtgtccaatatgtcgaaagaaaataatgcatgtgaagcgaatctatacagcttaagatgtattattatctgtccaatgtgatgttgaatcgttagagcattaataaaaatcatataatttgatattgacaaggctcaggtctttctttgcattaattcgtttcatctcttaaccatctttgtgacaacaccattggttaactaccatagggtaggcaatatagtgaaccattgtttgttgactcacatcacaaaatggttcgaaacccgaatcgataattaaggatttcataaattaattgttaatttctgaataaattcggattttgtatatttcctccgtttcgtaatataagtagttttggaccaatttttttgtttcacaacataaattgtttttaactttctatgtaaataatatattattttaatattttttgattatttatattatgtaatctcttttatgattagctaaactttttaaaaataaatatttttaatttgcatatttttatttaaaacaacgtatattgtgaaatgaaaagagtataaattattgattaaataattaaggactgtaatttattttattaaatttaatattcttttccaaattctccacatattttataccataaaaaaagaacaacacccttacacacataacatatccgaatcagtggttcttcgacatcacacgatggtatagggaaatgagcttccacgtcaacaagataataatctcttcgggactatacatttacaacaaaaagaaacaaatcttgtggtcaaagtttccatacgtagcttctcttctctacactcacgtccaccacaatcctcgtgctccttcctctaaacccgtccgattcacgtacttttactatcttttctcaatccaacagctcacagtccacaaacaaatttcaaatcgcgtcctataaaatcccctctcctctgctccacactctctcaaaaccctagaaaaaatggcaggaaccggagttgtggcggtgtacggcgaaggagccatgacggagacgaaacagaaatctcccttctccgtgaaagttggtctcgctcagatgcttcgtggcggtgtaatcatggatgtcgtcaacgcagagcaagctcgaatcgctgaagaagctggcgcatgcgccgtgatggctcttgaacgtgttcccgccgatattcgagctcaaggcggtgttgcacgtttttgttagttgacatggtcatacttaattaggagaaaccattacataatgtttttaggcactgtattttttttttgttaaaataaacattatgtaattaattgtgcaataatacattcaataattgttaagataacacatatgaataaacaatttcacataagtatattgaaattgctaagttcaatcaatatattttgttttagaatactaattaaacactaaaacttaacagttgattaattttaacttactatactgttaaacttaacagtttaattaacgttaaccgaaggataaaattggaatttcacgaaagaatctcttcaaataatataataaaaaaacaaaatcctcacagacacaaacaaaagtctgaaaaataatgttattattttatataataaagttataaaaataccctcaagactctggtcgtcattaccgttcaaacgacggagagaaaagaagaagactagccggagaaccaaaatcgaacgataaccgttacactaataaacttaccctatcatcttatctttcatggattcacttcctcacaaattctcaggtgttttattttatctttacttatcctataaatctctagggtttcttctatccaattcatttcttacctcataattttttttttgttatctctttctctaagaatcaccgaaatg

SEQ ID NO: 31250 - DNA, 3003 bp, Unknown
  misc_feature (1)..( 3003): 2750-1469P.txt file - cDNA_ID_3040214; gDNA_ID_2214500; Annot_ID_183960
aatgtatatatggctggtttttgaacttcatgagaacctttattgtattgattagaagtgttgtctttgtatacttcacattgatattttgaaatcaaagattcaatctttaattagtacctatgtttagtcaagaatttattgtagctttgattgtcattgaattctcttttagacaatttattgaactgattcatttctctcagggatggccatattatctcaacagtgggtcattgttgaatattacatataccgttaaaccacaaggttctgcggttcagcttgtggtcgatgaaggttagtaagtattgtagtgttttcattttctatgtctgcctgttggtttgatgttgtgtcactgaggctgtgatagcgttaaaatgatgagcacaacgaaaaacctaaaagattgacaataacgtatctaaacccatttcccgcgttgttttctcgcaatcgagacttcattcgtataaagtatctactgaaacgtagagcaaaccctaactagaaatgggaaataactttgaataaaagaggaaatataggagatggaactcttcttgtgagcgatttttttttgtttgaaagtgttaccttttagggatttaaactgattatgtcaaggctttctcaattcataggacatcaaggcgttcctcagtcggttttgaacgaccctgcatatcgttacaatgtttggtcgtggaatctaattgaaggttagtcaaatggaagctcctagttaaaatgcattgtgttgcaatgattaccatgagttaaataaaagtcctttacagggagtggtatgattcaattggagataagaaagtcttcaagttattatcttgctgtagctaacttgaagagcaaggacgtagaggtaaccactactgatcaagtatttggattaagttttggtttttccactcttcattgtgttacttgacatgatgtttgttcaggtggaactgaatattgatgtgaaggctgtcttgtatgatactaaacaatcattctacaactgtaacttcagcaatggcgagtgcacattcaatgcaatgtcccttgttggaaattctgttgtcgtaacttcaccagcagcgagtcaggtatgtattcgtaaaacgaaacaccaacagcgttattattatgactcttagctgaatgaatgtttgtcttactgcctcggggcttagggagtatccattgaagatgaatggtatatcaggttctcatatcaacctagagaaattgcatatgtaatcggcacaggtaaatatttcaatcttttcaaagtcaaattcatagcattggttagtttctctataacatgtagtattattgcatatgcaggtgtggtgatttgcttcatgttggtagctatacagttctgcaacaggtttcagtgcagtggtggagagggacatctaaccgaggatgattcagcgagaacacgtctacttgcagacaaagatgacgatggttcaagcatgggttcgtgtgacgattcttatgcaaacgatgatgctgacttagaagagtttatgggaaatgatggtgaagcaagtaaccgaagtagacgtctctgtgccatttgttttgatgttccaagagattgctttttcctcccttgtggtcattccgtctcctgttatgaatgcggaacaacgtaagttattttgtccacgaaggtctttaagaattgataatatacaactagacatatcaaaatcacttgattgatctaaactttgaaacgttatgaatctgcaatatgtgaaggatgcaagaagctgatgggagttgtccaatatgtcgaaggaaaatgaagaaagtgaagcgaatctatacagtgtaagatgaatcaaatataaatctctgacataatgttgaatctatagagcattaataaaagttatattggtattgccaaggctcatttctttctttgcataactatttcatttcgtccctgaccatctttgtgataacactcattgtttgtcgactcacattccgaaatgggatcgaaaccctgaaccggtaagtccagtgttggtgcgtggactaaatgagttggtacttcttgatgactttggaatatgcgtaaaggtgggattgcaaagtccaaatctatctccacctccaacacacaaccatctccaatgcacaaatttctgtatctttgttggtgatccaacttattatttttgttctttattgatttctcccacggttcttatcttcttcttccttttttattgtggttattgttcaagctcaaagaaattcaagcatgtatcataacatttttgttagttgacatggtcatacttaattaggagaaaccattacataatgtttttaagcactgtaattttttttttgttaaaataaacattatgtaattaattgtgcaataatacattcaatcattgttaagataacacatatgaataaacaatttcacataagtatattgaaattgctaagttcaatcaatatagtttattttagaatactaattaaacactaaaacttaacagttgattaattttaacttactatactgttaaacttaacagtttaattaatgttaaccgaaggacaaaattggaatttcaagaaagaatctcttcaaataatataataaaaaaacaaaatcctcactgacaaaaacaaaagtctgaaaaataatgttattattttatataataaagttataaaaataccctcaagactctggtcgtcgttaccgttcaaacgacagagagaatagaagaagactagccggagaaccaaaatcgaacgataaccgttacactaataaacttgccctatcatcttatctttcatggattcacttcctcacaaattctcaggtgttttattttatctttacttatcctataaatctctagggtttcttctatccaattcatttctcacctcataaatttttttttgttatctctttctctaagaatcaccgaaatg

SEQ ID NO: 31251 - DNA, 3000 bp, Unknown; identical to SEQ ID NO: 11525
  misc_feature (1)..( 3000): 2750-1469P.txt file - cDNA_ID_3040228; gDNA_ID_2214500; Annot_ID_183954

SEQ ID NO: 31252 - DNA, 2281 bp, Unknown; identical to SEQ ID NO: 11517
  misc_feature (1)..( 2281): 2750-1469P.txt file - cDNA_ID_3040253; gDNA_ID_2214500; Annot_ID_133637

SEQ ID NO: 31253 - DNA, 2269 bp, Unknown; identical to SEQ ID NO: 11526
  misc_feature (1)..( 2269): 2750-1469P.txt file - cDNA_ID_3040253; gDNA_ID_2214500; Annot_ID_183944

SEQ ID NO: 31254 - DNA, 3000 bp, Unknown; identical to SEQ ID NO: 11550
  misc_feature (1)..( 3000): 2750-1469P.txt file - cDNA_ID_3040280; gDNA_ID_2214501; Annot_ID_133672

SEQ ID NO: 31255 - DNA, 3000 bp, Unknown; identical to SEQ ID NO: 11540
  misc_feature (1)..( 3000): 2750-1469P.txt file - cDNA_ID_3040280; gDNA_ID_2214501; Annot_ID_183996

SEQ ID NO: 31256 - DNA, 3003 bp, Unknown
  misc_feature (1)..( 3003): 2750-1469P.txt file - cDNA_ID_3040284; gDNA_ID_2214501; Annot_ID_183995
ttttgttttgtggtataatcacaaaatcatacagtataataaagacaaccagatactctcaaaatcactaaactcggcattgctgtttagtgattatcaaaactatataaactgttcatagctaatataatgtggattttagtttgcgtgttaaaatattacttaaataatcaaataaatatattttaatcataaattgcaaaattagatgaacgttggttttcatgttaaatagaactatatttcctaataatgtacagaaaaaagccataaatacaaactttcactataaatagaaataaattcgttatcgattcacatgggcggagacaaagaatatatttagacacagaatatattttatacgatatgatttttagtctgttgtcctttaggtttgaagagaggtgggaatgattggatcggcttctcatctccacttcttccacagtgtccaacttgagaaccgaaaaataattggagagataggaatcgtttctcatcaaattcccacttacttatgttaagccacttaagtagtggaacaataattcaaaacttataataatattcttttacccaaaactcttttcatttgaccaaattagtaatcgagttggtaattactagttatgtatacattctgacattcactatccaagttgttttccaataagtagaaagtttaaagtatgcgtagctcgacattaattaattagcttctgttaattatatgattaaggacggttcataaaatagtatttaaactgctttttacaagtagtttgagttttagcaatcatgtgatgattcagataaatttatatattttaaatttatattgaagcaatcgttaaacgaagttgaaaatgcgttaataaagtatctgacatatggtaagtttaatgggtgtaagaacaatatccactatctactaataacattactcaagtgtaacgacatggtgttaacaacattacaacaaattttaagcatgtatataagaatatacatgaactcaattttccttgattaaactagtcatggaatcaagtaaagagatccaatattgaagttttaattatcaacaagacaaggcaatataaattctaatgatggtatcaaatatgaggtgggataatattgagagaacgagagatagaccgagatcaacggtacaaatgattaccaaataaggataattgttttttgacaattatatcgatcaatctttgattttaccaataaataatgttagttttcaaaatattcttagcaaggaatggtaaaattagccattagttcccaaacatttgtttagctcaagtgtcattacaaaattcatttttatttgctgagtattatatcgatgttattagtttcagttctcgttcaattctgtttgttgataaaaccttttatgctcgttcaattctgtttcgaaagagaagtatgaacctatttttaatattggttggaagttggaacagtctatagatcaaaactctaaaattgcttggtacggttaaaaaaaaatattcccaagatttgtaaaaaaaaatagtaacaatgaaacaaaattagggttttactgtacattcttaagtcttaatacggaagctctttacggtgtggagcccagctcagctcgggacccaaaacctttcctaatctgaagcatattccatagaatgtaccttttcaatttctccattagtttattttagtattttcttttcataaaatctcgttacattttcaaaaaacagttatatagacatagacggaaaaaaaaaaactaaattttttttgtcgaacactttgcagcatgtgtattggttcggagctcatgagaggcccgtacaggcatacaatcttttatatgtctcttgagtcctgactcttgtttttcacaatatatattgatggactactaaaaatagtaggagaacattagttgcttaaatggtttgaggagttatgtgaacaactgaacataacatttttgttaatcatacatgaagataagtcttttttgaaaatatatctcaattaatatatagagaatttgagaaagcgttagcgttcctaatttcatatatggagtatagcatagtttataacacgggactgctatagaacatctataataatcccattaaatttttagcgatcgatttacaaattacaaatctatagtaattgttcgatcggttgatggaattactacaacgagaaacaacaatttgattttgttgactagttaaattctaatatacatatatatatatataaaattatataccaatattagctttttgtcggtatttaccaacacaattaactataacaatagatattgtaataaatcacatatcatatagatatatcttattaacacgatatgtaagataattgctctaaaataaaaacttctatagtagtttatttttgtcaccaattgaatatttttccttttggggtggaaaatatttgtggtatctcaataagcttcttgtgtatcccaccccccaccatggcattcctacaatttaataaagccgtattttcactttcactctgagtcatttttattatattgtcattttcgacaaaatcgaatttagattgtgcattatatattctgacgaaaacaaagaaagattgttgcattaatttaatttaaaaaagttgattgaaaacgcaagtctcgttcatctcctccaaatgttctttttctttttttatgttctttctcttctaaaagtccaacagcgacaacataggtttctctctctaccatggcgtgtctatataaagcaaggtcgtcgattcataacgaccatctccattacttctccataacctttcaagaaacaaaaacaagataagatctcttcagattcctacactccaacaaatataagtttcattagattctttcttagctagagaatgaaactgattgagaagacgatgagcatgaaccagtttaggactatg

SEQ ID NO: 31257 - DNA, 3000 bp, Unknown; identical to SEQ ID NO: 11537
  misc_feature (1)..( 3000): 2750-1469P.txt file - cDNA_ID_3040288; gDNA_ID_2214501; Annot_ID_183993

SEQ ID NO: 31258 - DNA, 3000 bp, Unknown; identical to SEQ ID NO: 11542
  misc_feature (1)..( 3000): 2750-1469P.txt file - cDNA_ID_3040292; gDNA_ID_2214501; Annot_ID_183992

SEQ ID NO: 31259 - DNA, 3003 bp, Unknown; identical to SEQ ID NO: 26998
  misc_feature (1)..( 3003): 2750-1469P.txt file - cDNA_ID_3040296; gDNA_ID_2214501; Annot_ID_183991

SEQ ID NO: 31260 - DNA, 3003 bp, Unknown; identical to SEQ ID NO: 26999
  misc_feature (1)..( 3003): 2750-1469P.txt file - cDNA_ID_3040300; gDNA_ID_2214501; Annot_ID_183990

SEQ ID NO: 31261 - DNA, 3000 bp, Unknown; identical to SEQ ID NO: 11544
  misc_feature (1)..( 3000): 2750-1469P.txt file - cDNA_ID_3040308; gDNA_ID_2214501; Annot_ID_183987

SEQ ID NO: 31262 - DNA, 3000 bp, Unknown; identical to SEQ ID NO: 11533
  misc_feature (1)..( 3000): 2750-1469P.txt file - cDNA_ID_3040312; gDNA_ID_2214501; Annot_ID_183986

SEQ ID NO: 31263 - DNA, 3003 bp, Unknown; identical to SEQ ID NO: 27002
  misc_feature (1)..( 3003): 2750-1469P.txt file - cDNA_ID_3040316; gDNA_ID_2214501; Annot_ID_183985

SEQ ID NO: 31264 - DNA, 3000 bp, Unknown; identical to SEQ ID NO: 11547
  misc_feature (1)..( 3000): 2750-1469P.txt file - cDNA_ID_3040320; gDNA_ID_2214501; Annot_ID_183984

SEQ ID NO: 31265 - DNA, 606 bp, Unknown; identical to SEQ ID NO: 11567
  misc_feature (1)..( 606): 2750-1469P.txt file - cDNA_ID_3040341; gDNA_ID_2214502; Annot_ID_184036

SEQ ID NO: 31266 - DNA, 3003 bp, Unknown; identical to SEQ ID NO: 25568
  misc_feature (1)..( 3003): 2750-1469P.txt file - cDNA_ID_3040351; gDNA_ID_2214502; Annot_ID_184028

SEQ ID NO: 31267 - DNA, 3000 bp, Unknown; identical to SEQ ID NO: 11556
  misc_feature (1)..( 3000): 2750-1469P.txt file - cDNA_ID_3040359; gDNA_ID_2214502; Annot_ID_184026

SEQ ID NO: 31268 - DNA, 3000 bp, Unknown; identical to SEQ ID NO: 11562
  misc_feature (1)..( 3000): 2750-1469P.txt file - cDNA_ID_3040368; gDNA_ID_2214502; Annot_ID_184020

SEQ ID NO: 31269 - DNA, 3003 bp, Unknown; identical to SEQ ID NO: 21256
  misc_feature (1)..( 3003): 2750-1469P.txt file - cDNA_ID_3040383; gDNA_ID_2214502; Annot_ID_184013

SEQ ID NO: 31270 - DNA, 3000 bp, Unknown; identical to SEQ ID NO: 11554
  misc_feature (1)..( 3000): 2750-1469P.txt file - cDNA_ID_3040395; gDNA_ID_2214502; Annot_ID_184010

SEQ ID NO: 31271 - DNA, 3000 bp, Unknown; identical to SEQ ID NO: 11569
  misc_feature (1)..( 3000): 2750-1469P.txt file - cDNA_ID_3040417; gDNA_ID_2214503; Annot_ID_184060

SEQ ID NO: 31272 - DNA, 3003 bp, Unknown
  misc_feature (1)..( 3003): 2750-1469P.txt file - cDNA_ID_3040421; gDNA_ID_2214503; Annot_ID_184059
cactaatggtttaagttttttagatttagttacgtttttttcttggtaaataggagaaatatggtccaatggtgcgatctaatggcgaaagttcgaaacaaaagcacgatttcgatataaatgccgagttgttcaacagtcaatggttttgtaggtactttacacacatctttagccttccttccattgtctgttaatggaggctttgttccaaacttagtcttgtttgtgtgtgttctcttgtggtgaggtacttaatattttctatttgcagcttatgtaatgcaactatgacctgcgagcaggattattttgcccatgtctatgggaagaaacaccaagagaaagcaaatgaggttgctgatatggactactcgaaacaacaatctgaacatccagcagttgacaagaacaatttaacacaacaacccgacttagatatatatgtcgggttatcaaacgactatccatggttctgtaggtaggtaatcttacattgtttaggacattattgggtaaacctagctcaaaatgtattgttgtttgtgtgttctcttgcggtgagattttatgaagacatgcattaaatatgatttatttcgttccagcttgtgtgacataaacgctaccagcgagcagactttgttagcacatgccaatggcaagaaacaccgagtgaaagttgaacgttttgatgctgaacaacagaaacgacaatcaacacaacattccacggtggataagaaggactactcaaaacaacagatcgaagtcgatataaatgtcgggttatccaattgttatccatggttttgtaggtaatctcttgatcacatatttcacctttccactaccattttctatatcacgttagaagaacggatatgcgcttttgatgtgagattagtgatctgttaattatggaataattgaggaggattgtctacaatttttaggagtataataatgtcgttttagaaaaaacctatctatttaactttggatttgtcaatgacttattgaaactttgtgtccttagtaagagtgttcacaaaatctacatgccacctgagttagttagtcgtaactaggataattctaagtaggatatgcatcagctattattgagtaaagtcgtgtatatggttggttttgcaccattggtatgggttcatggatttctctttgattctgtactgtaataaataaagaagatttctgtgtttgttcttaacatttccctttgggtgagatttcaagagttaatgctttgaatatatctatttggttccagcttgtgtaacgtgaaggctacatgccagcagaatttgctatcccatgccaatggcagaaaacaccgagaaaatgtcgaattgtttgatgctacacaacaacaacaattagaaaaaactacagtggataaaaaggatacaactgtcaatgcttcggatggtaattccgaacaaaagaaagtagatttgcttgtctcctcaggtgttgcaaatggatattcacaggctcacaaaaagagaaagctagagacctgcgatgaaacatggaaaagggaggtagttcaggccgaagaagcaaaaggagggggtgagcaaaagagtgaatcaaagaaagccaaaaagcaagacaaagagaagaagagaaagaaggacaagaagcagactaagtcagactctgatttcgagcatgacaaggaagatatcaagcagctgttggtagcttactcgaaggaagagcttgttaacctcatatacaagactgccgagaagggttctcgattgatctctgccatccttgagtcggctgaccgtgacatcgctcagcgcaatatatttgtgcgtggctttggatgggacacaacgcaagagaacctcaagacggcttttgagtcttatggggagatagaggagtgctcggtagtcatggacaaggacacgggaagaggtaaaggttacgggtttgtgatgttcaagacacggaagggagcgagagaggcattgaaaagaccggagaagaggatgtacaaccgcatcgtggtatgtaatctagcatcagagaagccgggcaaggctggaaaggagcaggatatggctgaaccagtgaatattgatctaaccaagatggctaatcaaagtgaagcagtcttgcccgggatcgaactgggtcgcggacatgtactcgagaagatgcaccaccaacaacaacagactatggacatgttcggacagaacatgcctttttatggatactctcatcagtttcctggttttgatcctatgtatggtgcattaagtggtaatcaaatgttagctggtctaccaaactatggtatgtttggctcgggtatgatgacgaaccaaggatcaatgttgccaccaccgaatcatttaggcatggcagggcaatattttggtgatggggaacaggcttggcatcagagatagctgagatcatttggtaaggctttgttatctctgatatattaatcaggcttccaattttcggttaggctaattactaatctggtatcttcaacctatattatacctggcatctatgtaccaaactaaaccagcttttttgggttttcgagttgtgtgaatatataccaaactaaaccagctttttggggtttgattcgttttgaattctatagttttctgtttgaattctggtttactcgatttggttcggtttataccaaaattaaatgccttgaattcccctggatgcattgctaattgcaataccagctctacaaacatcatgccgtctcatttctaaaaactaagaaaccttgtcgtttttagcgttccaaaacagcgcgttgtctgatacttgaataaacaaactctacattgaattagttcttctggaaggcttttaaaaccctagctggtaccaatcttaaacccctctccgattttgatttctgcttgaaattgttttccccgagatctcaatttcgataatcggaaaacgaaaaagatg

SEQ ID NO: 31273 - DNA, 3003 bp, Unknown; identical to SEQ ID NO: 25572
  misc_feature (1)..( 3003): 2750-1469P.txt file - cDNA_ID_3040440; gDNA_ID_2214503; Annot_ID_184047

SEQ ID NO: 31274 - DNA, 3000 bp, Unknown; identical to SEQ ID NO: 11589
  misc_feature (1)..( 3000): 2750-1469P.txt file - cDNA_ID_3040463; gDNA_ID_2214504; Annot_ID_184077

SEQ ID NO: 31275 - DNA, 3003 bp, Unknown; identical to SEQ ID NO: 25582
  misc_feature (1)..( 3003): 2750-1469P.txt file - cDNA_ID_3040471; gDNA_ID_2214504; Annot_ID_184075

SEQ ID NO: 31276 - DNA, 3000 bp, Unknown; identical to SEQ ID NO: 11592
  misc_feature (1)..( 3000): 2750-1469P.txt file - cDNA_ID_3040475; gDNA_ID_2214504; Annot_ID_184074

SEQ ID NO: 31277 - DNA, 3000 bp, Unknown; identical to SEQ ID NO: 11584
  misc_feature (1)..( 3000): 2750-1469P.txt file - cDNA_ID_3040483; gDNA_ID_2214504; Annot_ID_184068

SEQ ID NO: 31278 - DNA, 3003 bp, Unknown; identical to SEQ ID NO: 25577
  misc_feature (1)..( 3003): 2750-1469P.txt file - cDNA_ID_3040491; gDNA_ID_2214504; Annot_ID_184066

SEQ ID NO: 31279 - DNA, 3003 bp, Unknown
  misc_feature (1)..( 3003): 2750-1469P.txt file - cDNA_ID_3040509; gDNA_ID_2214505; Annot_ID_184093
gggatgtggggttcataactacgcaagcagggcagaatgcttcaaatgcaagacaacaagagattatggtgcgtaaatatatatatcctctctttcttcttttaaaatgttattctattgatttcgaacttttgaattgatatattttcctctttttgatctctaggtggcgtctaaatggacgagaaagagctaatgaagaatctcttgttttaattatacctttcaacaagtgtttctactttctaacatgcatgacgctttcttacgttgacttgaaatcaattgaaagtttagactcgtgcaaattaacgtaagtacaaatagttgcaaacaaaattttgaaacaattaaggcatcaatgagaccttattgcaaaaacaatcgagatacatagattattgacgatattttattttttagtacaaatatacgatctttagaggaagaattcactagaaatttaaagcaaatacaaggtatttgcaaatacgaaagttaaattctactctttcgatataccattttgcagaagcaattttaaagtacgctgtaaaaaataaagtaagttttgtatttgatctaacacttgtagctccagcactaacaactattgtgcttctacagtcacaatattaaaaagtatgggcgtaacttacatccgaaatatagttcgaaaatagaaatttgtcacacatttacaaggagcacattgctcaaatataataaagaggaagggacattctccaaagaatttcatgaaaccattctcagatgttttcaagataacacgtgtcttttttattttattttataacatggcatacctacactagataaaaacgaagttagatggcgtttctagtctcctgaggctggtatacatattcccaactactgcaagatgcactatctattcttctctctctctctccctctttcaaattatgaattaagaaatctaaaagaaataaaaaagagaattgaagatagtgttgtaacctgcttagaccatctccaatagtatttcatttttcactttttccttcattttgaaataaaaaatgaaaaaatcttctccaatagtacttcatttttatcttcaaaatgaagatttgaatagtgtatcttcatatttgaaggtatactattcacaattttgaagatgtgaacttttctatttacaaaataatccttaaaattctaacaaaattttattttgcaccaaacaaattatttatttttattttaatccaatcaaactaaaatgcaaaaataaattatttatttttatcttccttttccttatagattatttgtgggagaattatatgtctacaattgtatcataaatatatattttaattaatgttatgtaatgtgattttctttataataatgtattttacataacattaattaaaaagatatatttatgatacaattgtaaaagaagtgggttaaagttataaaagaaatggattaactaatgtataattgtatttgcttattattataaaagaaattggttaaaattcataagtttacaaagtaaagggtattattcataattaataataaaatagagatagaatatatttaagaatattccttttgaagtagaaaatgaaagaaaccattggaaaagtcttgtttcatttttgtcttcaaatttgaagaaattctaattttgaagaaaaatttgaagctaaccattgaagatgcccttaaagagagacgatcgcctttaaccaccactacctggcccaaaccaaggtcactgtaggttcatcgaatcaagctatttttacaaaacttttaagtttcagtctatactatgttcaagaattattattcttacatttttttgttaccatatatagctacgtacatatcaaaaattgtactgtacatagagcatcagcaacatatgaaatatttcacttattgacggatcaatccacgaatgacatcggtcatataaatatcaaacctaatatatatgatccattatatgatttacatgttctgttgattagaatttagaacctatggacttttgagtttttttttctctcttcgacttcattaaagaaaagaaattcatatgtacagatagatttaatataataatagtgtgtgtaatcctataaaatgtaatttaagtaaaaaccaacaaaattgaatatatcaaaattaaaaaaatattgaaaattgagggctattacgtaccatcagactaacataattgacatgtatcagaaactagttttcaattagaagattatttttgtataatcgaattacaaaaatttcagttttcttaaaatgcatgcgagatttgaatttttttatatataaataataagttgatagcccttaattttaaataagttttagaatactataggacaagttttagaactttgtactttttgcaaaaaaaaatccaattcaataaggagatttctccaaaagaaacaaatctaactaatttactaaatccaagatgcttctaaaatgttttttatatagtcatgcaattacatttcattattttctatttagcttttctttgtcatctcgtattataggggactttcttgagttattcattgtaatttctcataaataaatactaaatagggatttgaccatctttgggtcatcggattattctgatactaaggtaaagctggcataggattttattgttcaaacatttataacttttgagtaaacaaaggatagtggtggtgtcagcttggcggagcatgcctgacatgtgcatctcatcaattctcctttatgtttatatccacacttggatctatattgtttatcttcacgcatggttttaactttactacaataatttttaaaaaaatatgtacaaaaataaataaataaaaagacaaaagtgaaaaagagatgtatgtgaagaatatggataaatagtgaagacaagacagttattgtcttgcccttgagacgtatctaatg

SEQ ID NO: 31280 - DNA, 3003 bp, Unknown; identical to SEQ ID NO: 27007
  misc_feature (1)..( 3003): 2750-1469P.txt file - cDNA_ID_3040513; gDNA_ID_2214505; Annot_ID_184092

SEQ ID NO: 31281 - DNA, 3000 bp, Unknown; identical to SEQ ID NO: 11599
  misc_feature (1)..( 3000): 2750-1469P.txt file - cDNA_ID_3040525; gDNA_ID_2214505; Annot_ID_133737

SEQ ID NO: 31282 - DNA, 3000 bp, Unknown; identical to SEQ ID NO: 11607
  misc_feature (1)..( 3000): 2750-1469P.txt file - cDNA_ID_3040525; gDNA_ID_2214505; Annot_ID_184088

SEQ ID NO: 31283 - DNA, 3000 bp, Unknown; identical to SEQ ID NO: 9217
  misc_feature (1)..( 3000): 2750-1469P.txt file - cDNA_ID_3040606; gDNA_ID_1972022; Annot_ID_178098

SEQ ID NO: 31284 - DNA, 3000 bp, Unknown; identical to SEQ ID NO: 9215
  misc_feature (1)..( 3000): 2750-1469P.txt file - cDNA_ID_3040610; gDNA_ID_1972022; Annot_ID_178097

SEQ ID NO: 31285 - DNA, 97 bp, Unknown; identical to SEQ ID NO: 9206
  misc_feature (1)..( 97): 2750-1469P.txt file - cDNA_ID_3040614; gDNA_ID_1972022; Annot_ID_178094

SEQ ID NO: 31286 - DNA, 3000 bp, Unknown; identical to SEQ ID NO: 9211
  misc_feature (1)..( 3000): 2750-1469P.txt file - cDNA_ID_3040626; gDNA_ID_1972022; Annot_ID_178109

SEQ ID NO: 31287 - DNA, 3003 bp, Unknown
  misc_feature (1)..( 3003): 2750-1469P.txt file - cDNA_ID_3040641; gDNA_ID_1972022; Annot_ID_178103
caacaatatttcaatgtagacgtaactgtcaaccactttgaaatgtaagtaacaggtgtcagtgagaatattgtgtcgcaaatgtcaaataaatgaatacgtaatagttaaagattcatttgatcggggcttactagtttagtaggacccttacaataaattagataaaatcatttatgtgaccgctaaaaattatacgtgggagaggattttttttgtataaagatgggcaaaagtagggtatgcattgttcatatagtgttccctttagactaagaaacatacacacaagtcacaaggccatgttctttgttaggtgttatattatccgaggatgtgaaaatacgagatgtcgggatttataattcccctaatgaatccaaaactttatgtatagtttactgttcggagtttattgaatgtcgtatttatctaattttctgaaccaattcttaacgaatccaaacgtataccttataaccaatacggtccacatgtcgtttaggttactacattattagaacgtaacttacacaaagaaaatcgaaaacaaaaaagaaacttgcatgattacgaagttggcagtgaattcttgtggttagcgtaatagcgtgatccaccatgccccctactttgagcatgatggatcacattaaaccgacgctgaaagaaatttaacggctaagccgacgtcgaaggaaattatggaccatgcgtcaaaatttgtttgggagcataatcacaaaaagaaaaggagaatcgtaagaattctgaccgaaaaatattttaagggggtcactccatgaaattcaaagattttgaattctttctccaagaacaaaccgggaaaaactcgaatctatctaccaattaaaccaaaacactatcgacaattgcaatatatgcccatatttgggattttattttacatatcagcaaccaaaaataggggttctgcacaaaatgcaacttagttttttgttaatggacacccattccccaaatcctcttttttggaagactttttatggacccattgcccaaatgttctcggatgcaaacagatctttaccataacttagaaggctttcctactaatatccaacatatcctttttgcttacgagatatatggagtgggccacttgtttgggctcaaaatatatatagagtaaaaccaataaggctatgtgtgagatgattgaagaaatagcttactagtggcccactccatatatggggttttaagctttgtagttagtacaacataaacaaattgtacaaaatcatgtatgcagtatgaaaagataataaaacgttcgtcatatctcttagaagctctctttcaagatatctcggaacatataaagcttgaacatattctctataaatatgttagggcctatctacaacctaactttgtttatcacttgccatttacccggaagcaatgtcaacaatttctacctcataagttttcggagagtatccagagtctgttagtatttgtttgttgttctattgtttcaaactggtggtgtagacgtgtagtgagtgataataaacacaagaagtttgttatcaaaattcaggaaccatatatttttctatttgtttttcaaaggcaaagaattgtattcaaaggccaagaattgaattgaaactcgaaacgtccacatcgaaatggtttggataaactgctaaatgttttaaatgactgtttccctcttgaagagtcttttctttgctagccgtagaaaataatccatctgattcggggccaaggacgacacccccggactcctaaattcattttttttttttaaattttttttttttttggaagttaagaatgaaaaacatatccccacgtcaaagctcatctatattctgaaactattagagatatcatacgtgttaaattaagagcgattttaaagaaaacattagttctgaatgaagacgtgtgttcaatggatgaaatgcgattcagttcaaaataataacaatatatatatatatatatatttatttatttatagatattcatatatatatataagaaaatatatagatatggtcatatggatatggttgtggacttgtgatgcgacaaaaaaaaattgaacaaagtggatctggttaggtggccagcatcttttacggaagggaaaagttggatatattacaatatttttggtggaccatgagcaaccccaccacaaagtgcatgtgaagtgaccacttttctgcgagctgatccaactaatcaataatggtaacaaatacaaaaaataaacgctctaattttatttcagtcaaatgtttttaataattttccatgtccgaaaactttaaaatcttttattattactaagttaagaaaattgcaaatgtaagaattatttgtttctaaatagataatattaataccaaattgatattccaaaacatattattttcttgtttgatttgattgataatctattaactgataaacaacaatgatagaaatatgttctctaattcttcttctctagcattcaaaaattcacatccaacaaaaccataaattttgtaattttagatacaattttacactaaaaattaataattgtaaagcttgtaattatattcccaaactttattctataaattaaaacttagcattcatattgttgaatatgacttttgaattttgttagtgggacccttttatacaataagtggcggctacaacgaaaaatcaaagtagggaccaaaatgatacaaatcgtaataacggggtcaaaataacataatccaaacttttaaatagcataaatacaacaactctcaagacctgtacaagctatttcacctacttcatcactcatcaccagcttcgcatcttcttctccggcttgatcttctctcgtttctagatctccgacgatcggaatatcaaatccgatcgattaattctgtcaatcacacaaaaaccgaaaaccaaaaaaaaaccatg

SEQ ID NO: 31288 - DNA, 3000 bp, Unknown; identical to SEQ ID NO: 9207
  misc_feature (1)..( 3000): 2750-1469P.txt file - cDNA_ID_3040645; gDNA_ID_1972022; Annot_ID_178102

SEQ ID NO: 31289 - DNA, 3003 bp, Unknown
  misc_feature (1)..( 3003): 2750-1469P.txt file - cDNA_ID_3040653; gDNA_ID_1972023; Annot_ID_178137
gcacctacaagaaaagagttacgtaatggttctttggctgagagaactgtgaagaaggaagaatcttctggggatgagcttctggagagcacaagctcacccgacactcttaacaaattcactcagaataaaagacagtcaaagaaggtgatcactgaactactctattttctcgtaatgacttcatatttgacatgatttggttacatatttatttttgtttggtacacttcaaaagtaaatattcagtaaaaatatttgatactgttattggtctcacattcatttgagttattttgttttttgcagtcatgtaaagagtccatctccaataaagaaaacaaggatggtgatgaaccctgggattccaaaatggattggaaacctttgaactttctggttgaagtggcaaatgggacaaagcccttgaagtcttctgcttctcaagggtcaggttcaaaatctgagcacgcgaatgtatctcgcaatcaatttcaagggagtaaaaccaaaactaagaataaaaagagaaaatgtaaacgtgaggatgacaagagtaataatggtgatcctacaacatcagaaactgttactcctaaaagaatgcgtacaactcaacgcaaaaggtctgccaccactttaggcgattcaaggaatttgccacaaccagatgagtcaagtgcaaaacaggagaggagaaatggtcccgtttggttctcacttgtggcgtccaatgatcagtgagatttttgctctcatatctgaaactatttcctttcatgatctttctctctttcttcattttgtttctcttctcttggtatattgacaagggcttactggttacagggaaggaggaacttctttacctcaaattccagcaaattttttgagaataaggtaggttacagtttaggtattctttgttttatatatcctgtgttgtcgctgcatcttacatagtccctcatttttctgttatgaggaattcttttgttggggaagataatccaatgtctcattctgtgatagggatggaaatacaacagtttctttcatccaaaagtacctcatgaggaagctagatctcgagagtgaaaatgaggtaagggtctttatatgcactatggcacgagaaaggatagaacgtttgaatataatggaacttatatgtttggttgataaaaaatggacatacttatggtttatgttcagatagagataaagtgtatgggagaagcggtgatcccaacgctgacgctttacaatttagtggatctatggctccagaaaagttcaaaccaccaacggtttgctgcattggtaggttcttctgcaaaggattttacgatggttcttgtctatgctcggaagctaccagagtgcaacatgtaaaggactttaaagactcatgttgttgcagaagaagattctgtggagacagggtaatcttttcttttcggtttatggaatctctcaaagcattacaagagagaacattactagaactacaggagcagtcgaatgtgttgtgaaattagtattaatatttttttctatagacgaaatatacactcatgagtcgcttttctgtgcaagaaaatacaaaatttgtttcccttttctttcttcttcttctactatgtgtcctctctggacttgcatgtaacattgttgtcactttctaatcaaatgttgtagtttaagatgttttagattgatttatatgcatttatttgggtactacatcatttctatggaaactaaggttttcaagaattactgttcaagtgttgactgtggatgacgaatgtagtagaactgtgatgacctatatggaggtagaaaactaccaaattaactacataaaacttatctgacaaaagacgaatgaagttcattatcactattttgtgttatcgtgagtaccactatgtggtgacaaccatcatgcttaatatgagtaacatatttatataacaaattgttatgatgttcaaaaaatgttacgagtatgcaatttaacagattctttttaattcatgctttacatatagccatgatgcttaacgatatccaaaagaaaacaaaaaaaaatcattgaagagattgcacctagactagattgcctctcggatgaccttgtacatgtgttgctcttaagaaacgtaatctatgcatcataactaaaggaaagttatacatgtgttttaatatcaattaaaattggttgattacatacttaaactagtaaatcacaatctatgaataatccggactctttttaacatagacacatgacacatcaacaagtagtgtgcaacatattctagaggatggtcatcttaggtagtattcattcaaatgattttggatcaaaaagtaattgaaatcccacgtttattggttcggttcactccttgattagtcaagtttcatattaacataattttcatcgaaattctctttagcattattcgaaaaaccaaatatactgtaatactagcaagaaaaacaatagttttgacatatcttgcttcataaccgaatatctcattacaaaataatccatttttcacgtttagataatcaaacgaaccctcacagaattttctacacaatgcaaaaaacaaaaacgaatttcatcgagtatatcacgagttatggtcaaatgaatcgagtctaaaagcacaacaaatatgaccaaagcatctaatccacatccactaacttactcatcccaccatctacactccttctttctctgccgtcgataaaatttgatccaacgattaatattcaaacctgagaaaagagtagcgatccgcgtagtcattgttttaaccaatcagaagccagatatgaattgccgtctaatacacatctaactatataaatcggacgtttccaatgatcctcttcacaatcctcataatcactttcgaaattacatttacgctttcttgcaatcaaattttccgatcttaagttcagaagacgatg

SEQ ID NO: 31290 - DNA, 3003 bp, Unknown
  misc_feature (1)..( 3003): 2750-1469P.txt file - cDNA_ID_3040666; gDNA_ID_1972023; Annot_ID_178132
ggaacggttgtggcaattaaaagagcacaagagggatcattgcagggtgagaaggagttcctaactgaaattgaattgttatcgagattgcatcacagaaaccttgtttcgttgcttggattctgtgatgaagaaggcgaacaggtactttgtccaaattcctcttctggttgatgtccaaaacgtttatatgtatctcttattgcttgtattgttaagcgtgcagatgctggtttatgagtacatggaaaatggtactttgcgagacaacatttctggtatgttttacttcttcactgagtcatctatagtggtgcttgttctctatgtgaatcagcaaagactacccaccgatgttcactgttcttaatgtgaattctttggagatgacttataagcagcatagatgatattgtgtgcttttaagttcggctctattcctcgtgaataacaatttacatacaaatatgtgttttggcagttaaattaaaagagcctctagactttgcgatgagactacggattgctttaggttcagccaagggaatcttgtatttacacacggaagctaatcccccgatatttcatcgcgatatcaaagcaagcaacatattgttggactccagattcaccgcaaaggttgcagattttggactctcaagacttgccccagtacctgatatggaaggcatctcacctcagcacgtgtctactgttgtaaaagggactcctgtaagatctcattcctgcattgcttctctaaagtttttttctcaaactcatgactgagagttatttgtcgacttgcagggttaccttgacccggaatatttcttgactcatcaattgacggacaaaagtgatgtatatagtctaggcgtagtgttgttagagctctttactggaatgcagccaatcacacatggcaagaacattgtgcgagaggtaattctgagtagataataagagcgtgtgttttccttttaggcgttatataaattgtgtggaatgtttgtttctgtcagatcaacattgcctacgagtctggttcgatattatcaaccgtggataagagaatgagctcagttccagacgaatgcctcgaaaagtttgcaactttagcgctgcgatgctgcagagaggagacagatgcgaggccttcaatggcagaagttgtaagagaactagaaatcatatgggaactgatgccggaatctcatgtagccaagacagcggatctctctgagacaatgactcatccatcatcgtcatcgaattcttcaatcatgaagcatcattatacatcgatggatgtctccggctctgacctcgtcagtggagttgctccctcagttgcacctagatagaaactttcttcgactcatacaccatacactgtttctttgattattcagtgtgattttgttgttgttctttctttgtacaggaaaaatgattgtaagcgatgtaacggtatatgttgcagacattttaatatgtctgcctttgtgagttatctgttccgcttcttatgtgttttgacttggatcatactggatttttttaccttcgaatcaatataacagtcttataattatacgtacactttcccaatgttatacaaccaataataataccaaaaaacacattacaaagatttggctcaattttgttccttattgaataacatatacatagctaattaatatcataaatactccttcgttgttgtttaacataaatatggcttcactaggggaacgagcgagctgcttaggtgcatggacattacttcgttggtcgaaccaacgagcttgccaccaatgaagacggctgggaccggctttgaacaccctagcctcataagagccttctctatctctcggcattcagggtccttatcaatctcgtggatcttagggttaacaccaagatcttggaagagaacttgaaccgcataggacaaacaacaggagctcttggtaaatataaccacccctttttcggacgacattctcataactttgtccattatcttgcataaggtgaagaagaagaagtatatggattgaaaggagtagctagagtctcaggctatttataacaggagggaagaataactgaataagaatccacatacagagatcacaagaagatcgttgaaaatgttcccaagtccgactttattatatatgagcaagatgattcgacgagaccgaaccttttcttcggcagcctttacccttttgattgtaaggaccaataatatgaatgatcattccatatattttctcttggatacaaagatgcggtctcaacgatcctcctacaagttgctaaaaagagagtgtattcgacgttgaatatagatagatagatgcttcatacttttggaccatttgatttattctgcagattccatgaatatcggacataaggaatcttggtgacccaaactatgcaacaagaaaatcaacttgcattcaacttttcatagctattccaacttggttgggtctcttaaaggcaaaagagctcacatatttttgtatccttaacaaatcttgccgtaatgttgtttcttttgttcagattatggttttaatgtttaatcaaagcttgtacaagtgtaacgtagtatacacataacgtaatcatgatcaaagaagggcaagaatcatatgagaccaaaaaaataatgacaagccaaggcaatgggaaaggaaaacaaattcagaaaactgaaatgaagatgaagaagagcagatgatggagaagagaatcagattgaccataacagtggatcgagcttgtcagtcgtttttcgtgccatatagatatgatgagaatcaaagaggggtatacaacgtgatgattttgaagggtatagttgtcattcttcttactgtagattctgattgaggggtaggtaatttgatttcgctgtagaaattgattggttttgggaaatattcaatccaaggatagtgtcgagcaaccatg

SEQ ID NO: 31291 - DNA, 3003 bp, Unknown
  misc_feature (1)..( 3003): 2750-1469P.txt file - cDNA_ID_3040670; gDNA_ID_1972023; Annot_ID_178130
tctttcctcaacgcttcgtttaaagctgtaacatcaaaaagcaaatattgaagaaatgcaccaaaatgcatacaaagaaattagcttcttttttttttgtgcttaccattacgaagctgagcttgttgttccattgcttgcaacctaagtttcagctctgtgttttcgtttgctagtccatttgtgtctctctggatcaatcaaaacaacattgaaatcaagatctgtctatgtatgtaaaacagaggaaagaactttcctattctgttgggatcaaacgaggaatcgccgaatatggaaacctggtagagagtaagctgagcagagagagtggtagcttcggtttgaagagattgaactttgcgctcaagttcttgaatgtatcgagcttttctctctttggatcgagctgcagattgtcgattcgctagaatcctgtaatcaaatccctaatttcattgcaattcttcaattctgtggaaagagaaacaaatttgaagaagaagaagaaggaccttttggcgcgtttgggatcgatgttccaaagctcagagagtttttcaggaggcatagctttcttagcgtccatgatatcaccggcatacatggcgcatccagcgtcaacggaattgctgtgacggtggcgaggacgagaggaaggaggaggaggaggattagcagcgccggaaacggagttggaggagagggaaggattttgaaagggattgggattagaggtgaggctatcgacatcgatgaaagaagagaagagatcgtcgtcggagggaaggtcgtcggaggaaggtggtgcggcggaggagaggggatccatgaacatgaacatggacatatcgtcggagcgagatcggcggtggaaggaagaagatggaatcggatcggcattaggaattggatcggaggaggggataatagtggcgccgggctttgggactggtggaggatctgatttctccatttttttaagagaatctgagagatgaatgctttggttgtgtgaataattatgattattattcgcaattgagaacaatgtcaatggagataatgatggagatgaagaagacgaagctctttctctctctctctctctctctctctctctatcaaatgaaatgaaatgaagagcgtaggagagaaactcgactctgtgaggagagagaagtgacgtcactaactataaaattgcgaaattgagttgatttattaataattaaaaagaaaactagttgatgaaaagtaaaaggcacattggcacgtgaaccatcgcagcatcttgtctccctcccttttttttttatttttttttcctttttctttgtattttatttaattattcgatttcatgatttaaatttgtttaactttaaatcttctttgtagcattcattacaagattctgtagttgcttcaacgaaatttattaatttaagctgttatggcattacatctccccacgtctgagtgtatatttttgtatctttgagtcaaaattttaacaagtaaaaaataggcagaaagccttgtatgaactgagagtctgagagaatgttttgtgggataataagttggtaacttggtatggaactatctatggattgggaaacaagtaaaattcacttatagtgaaaaatacttattggttggatctaaatcatacggaggccttaattatcaggcccatacaagaagacaagtattgttttgttttaagaaatcctcgagcatataatgcgcctgtagtggacaggaggatgttttgggccttctcttaaattggcaattgggcatcactttgtttaccggtcaaaataattaaaaagatggtcgtattgatcgctttaagtaataagttttttagttaagtctctctaaattgtcttaaacgcaagtagtggaccggcatcatttaatagtgattcaaattaaaaacctaatgatgcttacttttaccagctaaagtttcttttgtcttttttttttttgttttattattatttatcaacatacttgtgaattgtgattctccctttttttatatataaataatgaacatacttaagatatagtttctcccatttattgtcacctaacgggtattttttaaaaccaaattctgttggaaagttcttctctaaacataaataatatatagctcatgtctatgctttttaatagtgcccattgtatttcttttcttatttgagtaatttattccagctgtttcttttttttccctctcgtaatgatacgacatagtgacatacatcttctgtttcttctttttttgttcaagaaaatcataatgactacaggtaattaatcacacttctacaaatcagttgataatcagcaccattttccaataaaagtcgatactttggaaaatttcgtgacttttagtatcgtgggggccaaaatgcacataaagatacgatatcgatgaccaaattgccatatactatatgattccaatataccaatgattgctactatttgctaatggtatacgtttttaaattttaattaatacataaaaaaaaaatcaaggtgggataaaaaggtaactttattgacaatatttggaaattcatcgcacctggcaagagatttacctactgtcattaaaaaaggattaaaaaaacgacaaaaaggtcaaagacaggtcagacaaggaatcattaaacaaaggaagaaaaatagcaagtagaatggttttgacggaagaaggtggtgaagttatggcggcggcgcaacggaaacttatgatgacgctcttccgtcggtctcatccattacctgaaatagtcaaacttagaaaatgtcgtattatcactcttcaatgctcccacccaataccaactactttcctctttctttgtcttgtgtttcttacttggtcatggccttttccttctaaactctctctctctcgagatttcgttttttccttgggtctcctctgtttcctcctctctcgatatg

SEQ ID NO: 31292 - DNA, 3 bp, Unknown
  misc_feature (1)..( 3): 2750-1469P.txt file - cDNA_ID_3040678; gDNA_ID_1972023; Annot_ID_178121
gaa

SEQ ID NO: 31293 - DNA, 3000 bp, Unknown; identical to SEQ ID NO: 9235
  misc_feature (1)..( 3000): 2750-1469P.txt file - cDNA_ID_3040710; gDNA_ID_1972024; Annot_ID_178176

SEQ ID NO: 31294 - DNA, 3003 bp, Unknown
  misc_feature (1)..( 3003): 2750-1469P.txt file - cDNA_ID_3040720; gDNA_ID_1972024; Annot_ID_178168
cttatatatacaaaatatttgtgtgccaatgtgattaccattcaatttttttgctatgtgtgtaaatttgaacttatattagtctttttctactgtggttgtgtcaagttttgttcctttcggaccgttattcttggttcttttagacaattagttaaagcggttaatacattttaacctgattttgaatgaagagaaaggcagaaagataacttgctaaaaacataactaacagtacaactagatcagaaatacagtttccttttctgacggaccactattcttcattttatatatcacttctagagattatttctgacattttcaaaatcgtctgtgcttcattgacgacatgaaaaagggaaaggcctgcgattcgaccacttttgctccaccgttggggtctccaattattttgcgcctctcaaaaattgttgtaaatctatagtatccgcacaagatttgaggttaaaggttgctagctttttttttgagtcacggactcacggtggacaacattttaatctggtaatataatgtttctgcattaatcaacattttaatctaagatgtgaatgtgatatcatttggttgaaatgaaaaattcgttcttgggattatgatatttggatatactcggagtcgactataagtctatagttatcaatacctttcttcaggtacttacacatttgtacgtccgactctaaatactatagattttgctgaaaacataatttgatatagtatacacgtaaaatgaaacttatcagcttccgatatgtcttccgagaaagaagatctgatctagtgatctgacaactccgtttagtctcacttggccacaaaatgccaaataattaaatgaagcagtattgaaaaatcaggatcttatgtcgaaagctgacccaacaagcacacagtatccaaagaaaaagcctgtctaaagttacaaaaaggacttattattatcacatgtatgcaatttgcgtgtataagaatattaagaactggagtggagtgaccatgctaataatatctagtgcataggtaggggcacatgccatgcatggaccaacaccacaacaaacgaccatgagatatgaatggcacacatgtacattcccttccaaaaagaaaaagcataaggcccattaatcggcccaatattcttcgcctgcacaaaaaaaaaacctccagatcgaaaaaaaatcgagaagcgaatagcggaagaacagaaaaagggaaattctgagaatcaaatcggaaaggtagaagaatcgagtcggaaaaatggaaacgacgaagagtaacagcagcgagtccgatgtcaacgccaaatgggacgcttgtctcgatctcactgctcgtcgctttgtctactcttccctcggcggcgctttcgccggtcttctcttcttcagttcggtgttttccaatatcccccactttattcttatgattcaattccgttcacatagtgttgattactgattaggtttctgggtagagaaactgagaattcatgatcatttagggttttgagtgttgttccgatttgaatcatttaggatttattaggtttaaatggttttttgtgttttgacgattaattgttgcgttgtgtgccctagggagtccggttacgagatgggcgtcgattgcttttggtgctggaattggtattggttctgcatacacagattgttctcgtgtttttgatgcgtcttcttcaacttcagctactttattagcagctcccaagagtacggagacttctgtatctcaggttagtcggaatctagttttgtgggatcgttttgttcgtaacagttgaagttagaaaagatgctaatttaagagggtttcatagtagcttagagggaaatatgatttggaagaatggttacagatttgtgagaacatatgcatctttagtttttagctcttaatagttcaatattctgaccattgacatgtaagagttttgtcgctgttgatcttacgagcaaagaacaaatgcctgattgtattgtggcatagagtatcacgactggactacgtattggaaattaatgattagtaatcggatatcttacttcatcactatcatagttagcaagttactaggtgttttggtaggtgcaaacatgtttaatcttgttccaatgtgtatgcatttggtcgaaagcaaatccgttcatgtttctagtcatcgaagtccttacaaagtagaatcaaattagctgagtgtgtctgtttttatcttgttgattgattacaggcagcagaagagtgaagacaacgaggaagcttggaggtaaaaaaccaaacattgatagagttacattacgaaatggtaattgatcttgcaggacaaggcttttgagataacgccattgttaaaaaaaaacttttgcttctcagtgtggttttgtacactgatgtcaaaattgttaatgacccactcattttttttgttttgaaaaatcttatgttcttttacttgagaaataattcctccggtttgatttgtttgcctctactgttccttcattcatcaaataatctcctcacatatcgactaagttacaggttttaaggattaatgatatgtttttagctgctactaaattgactgatcgagtagttttaacaactcaatccatattttatctaatttataattttagtgttgttatttttttctgtttttgcggccttaaattaaaaatatacatataattaaacaaagccaccaacgcgttaacaggcatggttattcactcatcttgatgacctcaattagaagcctttgaacggctcagattgcatatttgtagccgcgtcttagcttaatctattgccacgtgtttccgataattattttcttaatacttaactgctacggaaaagtcataattaacactctatagagcttccgaagaacgacgctgcgacgagagagactaatagcagaggaggaagacgaagacgacaatg

SEQ ID NO: 31295 - DNA, 3003 bp, Unknown
  misc_feature (1)..( 3003): 2750-1469P.txt file - cDNA_ID_3040749; gDNA_ID_2684091; Annot_ID_189949
gattgttatgcattagtccccggcaacgagtttcttgaattttagttatacgtatatactgtgattatgtattatgtatatactatgatcaagtgtccaatgatccaactgtgtacaaagttttgtagtaaagttttaatttacacacagaatttgttagcataaaaatttatagatttgatcaaaactgatttattaaagatggttattaaagtagattaaagtggagttattgttataaacgatgagaaaaatgcattacttataaaaatagctaaatatagtcgacacactaaacttgattatcttagaaggtttatgctgatatcttttctatattatgtaagcttccccaaatatctctgtgagctgcatgtgaatgaactgtgtagagctagagaagcttcttatagaaggaatttgaccttcgaaaatggaaacccgaaaatatctcatgtgatctctgttttgggaatgaggtctactttaatctttctgatcgttctttgtcttttttacaattatcaacaacttttatttatctgctcgtttttcgtctgttcgttttttgttcttcttgcaataattggtattacaaattacgaaattaccacaatacgaattattgtttttttattcttcttcttttaaagtaagaaatccatatccctatacttatatttcgaaattacataaaaaaactaaccttgtattttataaaatattacttaggaataccattagaaatagaatttaaaggtccaaactaattcagttcattaaaataaacaagtcaaaactttatttatgcaatttaattataaaccaaaaagatgcatttatgggtttaacttgttgacagcttattttattcatgaatttacgttgaggttgttgcgatttctactttaagcaaacgggaaacatctcacagttttgacttgtgatcttttatcctactcttattggttctaaagtgcatacacgtaagcgtatacataagcactcgcatttcacagtagccaatcgattgattctaatctttgaacatgtaatacacttcatggccactctttttttccgggaactatcttttttttttgacatggaaaaagaccattttttgatttataacgtgcatactgctgtgtcttttttctaaataaatagtttttatcaaatatgtaatcatactagggaaaatctcatcaagatcatacgtatttttgtacatgacttttaaatagtatattcgccgaaaaatacgttgatgtctcggaatttgacgcctcaaaaacattagaatatacaaaatcaagtaacgagtttgtaggttgaaactaaaatgccacgtaatacagtgcgtagggtccattcgatgtttctagatcaaagtctacacactatagagacttccagatacagatacacattcgaaatcatcaatgaaaaataacaatttaagtatcttcttatcctaatgtgtgtgtgcttttttttagtcaactattttgtgtatattgtaagatgtatcatgttatgacatgagtatgttgctacgtgtcgtgagatatcgaacccaacgcagatatgagtatgttgagctagtttcttcttatgaaacaatcatatatgtctataatgaatagatcacattatctgcctgaaaaaaatcccgtatattactcgacgaaatataaatacccaatgtagctgattttgctttctctggtgacatatccaatttggctaaatttgttaactagtctattataggtttataatagatctagctatgttaaagatactaaagcatcagttacataaatttttggcgcgagtttatatcttttggaattaaaaataagagaatttaaaaataagaagatcattttgtttggccacaggagttctgaaaggtcaggtatgatttttttcttgctcgctcttatgattttgtttttattaatgggttttcaaataagaaaaactgtttttcgaagcccggttcagatccattgttttttgtaaaatataggcccaattcaccataagtccatgaccaaaacaaaaataagatagaaccaatactgaaccaggatcttctctcgctttcgtgatcaatgtcgccaagcttctcgagatcatgtggtcacgtcaattgtataaatacaattattgacgtaacacaatctctacagttccatcgaaatatctcgaaaatttccagttaattctggtaacgtgaacgtatcttccacctcttcaacctacacagctttctagaaatttggctcgcttttctaagtcctctgtatttttttgcacgtttttcaactaagtttcaatatgaatcatttcttctataaataaatgatattttcatcaggtaatgatacattgtgccgaaataaaacgtcaatactcattagtcaaattaattgttcacataatttaaaactgtgttaatccatccagttattttcttacaacaaaataatcttttccatcaacttttaaaataattaaacgcagtgctaagaaatctaaaatcttgatttagaaatccattatggtttctggtcaactgaaatccataatttcctttaacatccaaaatccaaatttgctactatgataatagatttcagacgattttttttcttttttcaatcatagagtccacacgaatatttgcaagttactatataaaacactataatggtcaacagataaaaaaaaggcgaatgaagatatgttacgtaaaaagaaaatactgtaattataaattattactttaaaaagctttaaaatctggccacatgtttttaaagagtggtgtgacgtaacgactagagtcagcacaatccattattgtatcataaatattctcatctataaattacctaaacccttacaggtagtgtcccaaccaaacaaatcgagaaagacgaacacttacaaaaaaaaatctctttgtgagctttagcgatcgtaacaatg

SEQ ID NO: 31296 - DNA, 3003 bp, Unknown
  misc_feature (1)..( 3003): 2750-1469P.txt file - cDNA_ID_3040772; gDNA_ID_2684091; Annot_ID_189964
ctatggagccaccgacatgtaaccgcgtttcaaaatgggacccactttccccgttttatcttaccttttttccttcaaagtatgttgttatttatatggagctgatccaataaattctattcagacattagaatgcaaaaacgaattgttattttggaatcttgaaataatcaccaatcatattttaaggacatatacctgtatctgtatgtgtgtgtttacaaataaatacgtacacactacgatggcataggatgcggctatgagagccgacgattgtgtaattaattaacttctgatttttttggctgattaattaagaaacctacttgtttattttgcatttatttagctaaaagtggttatatatatcggtgtaacccgtttgaataaactaccagttcagttttgaatgatgacatatatgacattttacgcaaaaataccacggtattattagttttgtttaagtttgaagttttataggttaactgtatgtttcgttatctcttcgtttgtttgttttgtgattaatcatacatttcccaaaacacaatatattataaatgctgaatggtaccttgtgtctgtttgcatattggaaatttctggagcaacctgatcccttctctatcaaagaatttaattgataattaatcgttggcgatagcacttttacaaacattttccctttacttgtcaaaaataattatcaagcagaaaaaaaggaaataatgaatcaatttcgagaatcattgaaacagatagtaacaatgttttggagttgttttgtttttaatttctcttcaaagtgaaggctaaggacaaacgctatgcggaatagttttctattgcgtatatatagtcgataataacaatataacatggctaattttgtgttacatcaatcatccaatcttcatatattgtggcttattctatattacattattacaataacatatattttacgtggcttttatgttcgtacgttgtttttatgtgatgatgctatgtcaaatcatccgtagtatcttttttatttgatgagtacaaacatataaaacaaaattgcaaatatttcaccaccctcttacactttatatatttaggtacatgcagatttataaatccactaaataaatatgcatgagctgtgaaacaaaacaactcagtgactcactcgacttatatcatacggaatataagaaaaaatcaaatgaaatttaccaaatttaccataaaatacagattttgaagatcaaataaaagtagaaaatcttatcgtgagtgggatatttaaaagtacaaaatttgcctcgtattgacacaattttaaccttatcgtggttggcgtgtacaagtgggcaactggtctcctaataatgcgtttggtaataaatgatcgtgattcttagaaatatctttttcgcaaaaacattagtctatggataagaagataaattaaccaaatcgatgagtgtaaaaaaaacaaaaccaaatcgaggacatttgtgaagaaactcgtcttattccaattaggggacgatcactcgttttcttgcgagaggaacttggcctaaaccgaccatttttttctcatggaatttgatcatgtgttttttgtcctcctttaaacagttcaaaatttgatgaataaactacaaagtcaacatttttacacattcagatctgcatccaaaacacccatattgtaccttctatattcatgattcttttggtcataatcatgatgttttgtttccactaaactttatgatgtttatataaattccattgacgctataaaacaagctcgatacatctaccttaaaaaagatcattaacttttctacataaaaaaaaaacagtccccgtaaaaaaaaatcatttactatcgacaaaataacctttaggaaatctcatgtttgacctaacacattttttcaaccggttcattaattctataaatgtcaaaatactattattgaacatcttctaatatttttggtcaactactactataaagcatcttctaatttttcagtcgaccaattagtgaacttaattaaaagaaataaatgtttgtttttatgcaccgccaagatttcatatatttttttatgggaagaagaaagagacagaaagagaggtaaaaaacattaaaaagtagaaagaaaacagagcgtgaagttaatacgattatagtactagtaattagcagtagatagtactaattagacatgtacccatgggaagcttctcttcgttctccccccttaaatacgcttaggcatctcaactaatttactctctttcttttgtttatataccaaagccaacggaagtgtttcttaattcattttttgtttgttttggtttaaataattcagtgtctcacgagctgtgtcgagattggatccatacaaaatctgcacgacgcctgcttcttcactctctcccactgttccagcttcaactctcttgatatacagagagagatagagataaagagagagagagtgagagtgatagctctcggagaaattgaagaagacacaatctgattagtattctccaatattccatcaactttttgctgagggaaatctccagatttataatcgtttgtatatatatatatacagagcagcgtagaaaagtacgatttttgcttcttttcctcactcttattcatcttcttgattttgattcgatttggtgtttattcgcttgattaatttaagggttgttggggttttttgtccaatttttctgggttttcgttcgatttcgatttccacgagtttaccaatttcgtctctcctcagaatttgtggatctgcttatgtaaaaattgagtctttttacttgttttgttcgaatttgtttacaaacgcgtgatctcgagtttcagagatctcaaagcttaaatttttataatctgatggacttgttttttatttacagggatcttagatttatagcagcaacaaaaaaatg

SEQ ID NO: 31297 - DNA, 3003 bp, Unknown
  misc_feature (1)..( 3003): 2750-1469P.txt file - cDNA_ID_3040782; gDNA_ID_2684091; Annot_ID_189961
atttaaagcaatgcatgctccctaacatggaaaccaaagcgaaagttctaagaattgatgattttgagagatacttataaagctataaacaaaagagtacagattcaaatagtaggattcaccttccatattagttctctcatctcaggcttcagaacccaaagcttggatagccaggctctcatttctcgttggcctacagagttccccattgaccatgggaaattgtaatgatctctttctttatcaagaaatgaagcgaggaaatcgatatcatatgaaaatccattcttccacatattatatctcttcgatactccattcacatcctcttcgcggttttcagtctctccacctccattcatccgtgtcctcttctctttcctggtaaggtctgaatagctcaaagtattatcttcttcatcgtgtgtttcttcttccaaatcttcagaattttcatcatcaagagcaagaagcccagcacggcaaactcctttgtgatggtaaccaggcgccatatccaagcacacgaacccaaagttttctttgttcacaaaattctgggtaacagccactgttggttcaagattaaggatacagtgccaccaaccacttggaacataaatcgtttcgccaggtagtagtgtgcactcaatcggtttgtcttcgtccgcaagaaggggataatagtctagccaccactgtacagggattgaaaacattaagagggatacagtaaagacgaatcaaaatggcagtgcttaaacagtttagcaatatacctgcagagatgagggtgtatcaatgctgacatcaccctcatcttcattgacatggactgtaacacctagaggcacttttccagggggatacaatgcccacctatttaaaacattatgacatcatcatcagaatgagaataatattgcaggaaaggaagaaaaattatttgtatttttgtccataaaggtgtctaccttttccgaccgcaaagcagggtgttccaggcgctggtaagagctgggtcaacatgccaagatgcaccagacctctccggaccaactataagccatctgtatggaggacgactttccttgtctaagatctcaaaccaatcttcttgaaacaaatggggcacactatagtctttcaataattctggagcagcttctccaaactacatgaaatgttgaatccttcaaatattctcaccacaaagtttcggtactactacaactctatcactgacgtgaatgaagtctaatataaatgacaaaactgtttctcgtaccttgtcatcgaaaacgtatagaggatcttcatcccgctgagttttcatatatgcgatgtaatccttgaacttcatggaaattttgttggggctcctctgagatattctaaacgggacttcaccatatttctctgagagttggtcgatagtccacgtattactggctggccaagaatcagcaaggccagaaagcaaaacctaaatcatagacaggaacaacatcacatatctgaaaatgttttaacagatcaaaatctcatgtactagcaaagattggaactttacaggtttcttggcgtcgtattccttagaaaactcatccaaggagatatttctcctacgttccacattcccattatcaaaagagaacccgtcaagagatgtattacacctatagaatcgtttatacaagtacaacgacatgaatcctgtaaaagcgcagagtaagtgagcaaaaaaaaaaaacgatcatatcataagagtatggaataaaccaagtatctaccatcaaaatgaaaacattttctgtatgcgtcattttcttgagtaactccttctctgtatatcagaaaaccaatcagtcattacaatttaaagataagcaaagcaaaagtcacatatctaaagacaatttgtatgtatcattgaacatggtaatttcaaagtacttacagatgcaatgttgtttttttccaagaacctttgtattcaagaggaccttttgctcttctgagacacaaactcatccacaatggttcttcattacatagaatatacatcacactgtacatcaaacatatacacataacagattaatcacaaacaatgcctcaacaaaatcctcatctgttcataataagaccaaaatcctgacttgctaagaattcgaattgatctagttagactctagttttgatcaattctttgatgttaattcgatcaataagttaatcttaggaagagaattatagaaaacctgctgacacaagcgaggtgagcaatatctcggggagcaaggtattcgagaagaacacagatggtctcatctggtagaacactgagactaccgagagcatctggtcggcgatctctttgtcctaacgtcgtcattggctataagcttcaatggaatttcgatttctctctctgcgatctgattgcttttttactacctggaattttgaaaactcaagctttttctccacgcggtggcgcgtgatgatccgagtcctcgtttcgtcaccgagtgcgcgtaaatgctttggcgcacgttgtacgcgttaacgatatcgaattaagttacggcgtcgtttcaacgatagaatctgataagaacctcgcgtttagcttacgcaaatcgtttctaaaaggataaaaagaggaaacgcaaaactcgggaacctcaataaataaaacgacgacgttctaaattatgggccttacgacgcagataactaaaacgacacgtagtctttcaattatgggccttaaggcggcaattttttttttttttttttgaaacgagccttatggcggctattatataatcacaaaccgacaagtattcttcctcctcatccaaaactataccaagaggttccaaagtatcactctctcttcttccactatcaattatgggacgatacactcaagttgagtgactcaacgttgcggaatccatcatcatcatcatcgtcatcgtcaaaaggatg

SEQ ID NO: 31298 - DNA, 3000 bp, Unknown; identical to SEQ ID NO: 14236
  misc_feature (1)..( 3000): 2750-1469P.txt file - cDNA_ID_3040786; gDNA_ID_2684091; Annot_ID_189960

SEQ ID NO: 31299 - DNA, 3003 bp, Unknown
  misc_feature (1)..( 3003): 2750-1469P.txt file - cDNA_ID_3040790; gDNA_ID_2684091; Annot_ID_189959
attggttgattagctataccaaacacttcactgttcctttggttgaattttatgctctgatgctttcattttaagttgaaacttcaaactctgacgagatcattaatttaaacctgtaaagtgtcaaatgactaacgagtgtctattgcttaaatagttcttttgaaatgtatttttatttttatataatcaaattgatgattgatttcagaccaggtaaagtaattggctttacgcagtccaataaactagtccgcttttaaaattaaaaattgataaacaatcaatctacgcaacaagataagagacaagagactttatgatcttcaaattgatgagaaaagaaagcaagtttcgattacacagacattgaaatcgataacaacaaagaaataagaaaagagaaaataaattaaaaagagataaaaagatgattgatggttcagacttgccacaaatatgatgaatgaataagcttttgaagatgagcgaaatggcaagagcgacctcttagatggattaagaaaaacatatggacgagaaagagaagaaattccaaaccctagaagaaaactagcagtttcactcaaaagatcactgctgttcctcggtcggttttggcgctgctgcttccttgatctcatccgcagcatcatcctaatataatccccaccgttacagaatttagtcaatggaatgcgaatcatccataacagaaacaaagaaagaacaaaggtgcggggattatatgaacaaacctgcatatcagatgtccagagagtgagattgtcacgaagaagctgcatgatcaaggtactgtctttgtatgactcttcaccaagagtgtccaactctgcaatcgcctcatcaaaggccttgacgatacataacaacaacaaaaccagtcaaatttatgtccaatgaggtcaagtgttaaaccaagtccaatcacattatcataattgaaagatgagtagattgaaatacctgtttggcgaggttacaggcacgatcaggagaattgaggatctcgtaatagaacacagagaagttcaatgcaagaccaagacgaattgggtgtgttggagcaagctctgcattagcaatatcctgcacagataattacacatagagactataagctcaaaacctagacaatctcaagatcttattcgagaatacacaaatccctaatttaagtctcattatactggaaatctaacaaaccaccatccacggatcacacactagactcaaataaactagatctgagattcggaatcaaacctgagcagatttgtaagcggcgagtgtatgttcggcggcgtctttcctctcttgaccagtcttaaactcagccaagtacctgtgataatctcccttcatcttaaggtaaaagaccttggaatcaccagaagcagcggcagggatgagtctagagtcaagcaacttaaggattccgtcgcagattccggagagttccgtctcgatcttagacctatattcacggatcgccgtgacgtggtcatcgttaccacggctctcttccttctgctcgatcgatgaaatgatacgccacgaggcacggcgagcaccaatcacattcttataagcgacggagagaagatttcgctcttctacggtgagttcatcgccatcaacggcggcggagactttctccataaactctaccatctcttcgtacctctccgcttgctccgcgagcttagccatgtatacgaactcttcacgcccagacgccattgttgtttctagagagaatcgatctaaggaagaagaatcaaagagggaaagatctgagatctgatcaaaaagagagaaacggtttcgattagagaatcgggtgttgtaggtcaagcgagagaggacgatgaatgagtttttgtgtttaatgagggaaagtgataaatgcgttttagaggaaaagagtgaaatttggaaccaagatctaatctgggccgttggatttgtggccggtcctgctttttaaagggggattttttttcacctcaaattaagaacaacataaatacacttttagaaaaattggtaatgtgattattggataaaatttggtcaattaacaaaataattggtaatgtgattttgctactattagtataggcaccttaaggaattataaaattttgggtctagtggttaaaataggggctagttttttgtagatttgttaatatagttatttactaattgtgaaaagaaattggagttgtgagattgatacaataatggaagcaagttgggttaacaaaaatggagacagctcagagggacacatgtgtgttgtgagcatgtcaggggatccaatggaccctttcttctccaactcagctttcacatttttgtgattgctcaaacggttttttttttcttctttcaaaatttaaatacttcggaggttgtctattcttcaaatcttcaaacattcaactaagtacgtaggcgattcttacgagctttttaaaatcattatgttcttaattatgtggttgtatttgtactgaagtaatttattaaaatactacaatatttgtttttcctttttccgttttgcttaatccaatgcttatccagttatcctaatccatgattatgttttttcctatcttactcctttttgttaatttgttttatttgcattagttttcttgatgattatgttttacattcaatgaaataataagattactctatacttttctagcataaatattaactatacaataacatgtattcattgaacgtatagtcatgatatatctaaagatcatacgttagaaaaaaccgtcatataaaaaaggcgaaaattcggatatgttcgaaaaagatttgtggttaatctagctatatagcgtacgcaagtagatcaaaagtttttgataagtattgagataactcctaattataattagtcatttagataatgatgatccttatctaattagctttcttatctctatg

SEQ ID NO: 31300 - DNA, 3003 bp, Unknown
  misc_feature (1)..( 3003): 2750-1469P.txt file - cDNA_ID_3040810; gDNA_ID_2684091; Annot_ID_189950
aaaatccaaatttgctactatgataatagatttcagacgattttttttcttttttcaatcatagagtccacacgaatatttgcaagttactatataaaacactataatggtcaacagataaaaaaaaggcgaatgaagatatgttacgtaaaaagaaaatactgtaattataaattattactttaaaaagctttaaaatctggccacatgtttttaaagagtggtgtgacgtaacgactagagtcagcacaatccattattgtatcataaatattctcatctataaattacctaaacccttacaggtagtgtcccaaccaaacaaatcgagaaagacgaacacttacaaaaaaaaatctctttgtgagctttagcgatcgtaacaatggcgaacgaggtgattcttcttgatttctggccgagtatgttcgggatgaggacaaggatcgcattgagggagaaaggtgttgaatttgagtacagagaagaagatctaaggaacaagagtcctttgcttctccagatgaatccgattcacaagaagattcctgttctcatccacaatggtaaaccggttaacgaatctatcatccaggttcagtacattgacgaggtctggtctcacaagaaccctattcttccttctgatccttacctgagagctcaagctaggttctgggctgatttcattgacaagaaggtatcttatttcctttgtgcccttgattgaataatgttgaaattgaacttgggatttcataaaaattgaaactttagttgagtttgctagtgattggctcaaatttagggttttgcttgtagactcgtctttgagcttgtatgggtttgtctgatgttataatattacttgagtttgtagttgttagggttagagatctcacctccaaatttcagatttttcttgtggactcatctctgagctagtcagggtttgtcttcttagatagtttaatgttatgttacttgtgcaatttgaggtttttacatactagtttcgctagtagatatcatctttgagctttgtttgggttcatcttagatagtttgatgatatgtttcttttgcaatttgggggtctctaggactggttttgctttgtagacatcatctttgagctttgtttgggttcgactgagttctgacatagcttggtgttatgttactctgtgcaatgtttcagctgtatgatgctcagaggaaggtgtgggcgacaaagggtgaggaacaagaggcagggaagaaggatttcattgagatactcaagactcttgaatctgagcttggagacaaaccttactttagtggcgatgactttggctatgtagacattgcgttgattggattctacacatggtttccagcatacgagaagtttgctaacttcagtatcgaatctgaggttccgaaactgattgcttgggttaagaagtgtttgcagagggagagcgtggctaagtccttgcctgatcctgagaaggttactgaattcgtctctgagctcaggaagaaatttgtacctgagtaaatatgtttctcttgtcatatggttcggacttaagatgctctctgttttactttcgtgtgttgtctttcttaaataatgcagagcatctgtgaggtggtttgagtgtagagaatgtatgtctttgctgtagcagattcctgtgttttctggatttaatggcttgtcctagtttttatgcattgtaactatgagtttaattaatgatcgttaatctataatgattattaatttgttactttgatatgtaattacgccaatacgactcttctacctgaccaagcttatcacgccaatgttgctgtaaaagacaatagtgcagtttggcgattaaaacctccaacatcgagaatggtaagccggtctggatctaataagcccaaattggcatccataagcccaaattgaaattggcatccataactccatattgtagtcaattggaagttatgtggttgatgtgatcattagtgtcggtatgatcagattagccacgggtttagtgtttcttgccgaatttgaattcggtagatcaaataacattactatgatccgcacagttcatgggatttgaatttgatttacgattacaacaacgatattaacacagaactatcctgtaatttttgggatcgattagtaaattttaaaatattatttcaaaggctttatatatataaagaatttagagtataaacatagataaagcattatgtatttataaatcttatgctgatattgaaaaaataatggtgtatgtgatatatttaatagagtgcaatactctctcaataaattagtatagctgttatcactccttgtgtaaatgcgtatttcttgtacatgcatggtaagtagcttgtcctcgtatgtaccggattgtaatgtttgatatcaaatcaagggaatcacgtggtaaatgtacacccacctaactgagagataataatacaaacaactgtgagtaggtggccacgccaaaagtagagactgatgcagcaactaagcaaagtattacttcactcgatcaactttttattttgttaccttcttataaatcaagtcgatttctatattgtcaagtactaattccattctaatctcttacatatacgtttaaggtttgaatcagagcaaaagataatcacactcttttatattaagtgatgttttcactagttgcacacatatgacaattatttaacaaagttgcaaaatacattttaaatcgttacgggtaaaagcttactgtttaaaagatttatatatggaccataatatgctttgaaaaaagctgatgtgacgtaacgggaatcaaaatcctttccacatcattttcttcccctataaaacaaccgtcactcactccttctctactataacacacactcgcttgttcacgcacaacaaaaagcaagaatatataccactttgtgaacttcagagatcctatagcaatg

SEQ ID NO: 31301 - DNA, 3000 bp, Unknown
  misc_feature (1)..( 3000): 2750-1469P.txt file - cDNA_ID_3040823; gDNA_ID_2684091; Annot_ID_189945
ttgagagaatgatagtatcgtattgtgttccatcgtattatataccagtgcgatctctagacacttctataagaaacctacatcagtggctgaaattttgggttgaaatttaatggtttcgtcaatcatacagattgatttatttctgaattaatgtgtttctataagagtaccaattgatttgtttctgactgctgatatgattctaaattataacggtatattttaaaaattccttaaatatgagcagaataatagtatataaggtaaactgttccaatcttgtcgaacaatttgtggatcaaaattatcaataaattgcttctgtacggatcgatcagtgttttcgcagtaatttaggtttcgaattacaacaaccaaattggatcggttaccaaaaacaagttgtacataccatagatagcatggaaaatatcacacccgtattaaatatttgaattaaaaccactaaaaagttgtttataagtgtatagttgtgttagggcttggataatttatgtgggcaatttgggtctgaataactttttagattagcccatgtagcataacacccacccaacagaacacgccaccaaacacccatattttatttgggaaatatgggcttcacttttgtaacaaacccaataacttgtgctacatgggctgggctaatctcaagacacaactctacacgatgtaacaagctaaactcatagtttcgaatctgattggaatttaattttgtaaagtaaaatattacggattgtttaaaaaaaagaaattgatcttcggtgaatttttatctgctataaaaacagaacaatagttaattacttacttatattcattcaaagttaaattccaaaatgctgaaactcaaatggacataacttaccccagtcgaaatagttaactatatattaccggcggtaaaagctgagataaaataactaatctgttcaaactttgtatatacttaatttcaaaggcgatcaaataaaaaacagtcaggttcctgagtcaagatttgtagtcaaaaccttactctgatccgttatagccaaacttgactttccctttgtatgttcatcagtctattaatattgatatcaaaactgtacgtacaataacgtactgcaccaaattttatcaacaaacaaaaaatagactatacataattacgtatcaacttctaaaagttgtagtgtagtgataaatgataacggattgatttgtatttaccttaaggcttaaactgatccatatataattttattcttcatatgaaaattttggtaaagccaatataatttttgtgtggttggtaacaactgaaaataattagggctatcgcaaaagtacaaccgtacaatgaactaatttgcaatttctgagaagaattttgttagtgaaagtctgagtcaacaaaacaaaaattcagggaattgaatgaatgattgggtccctttatgaaactccccatgaaacatcgtatgtaactatcagtgacttcttgtgcatcatgctgaacttctaatctcttttttttttttttttttctaatctcttttaaatagtaaaatctacaaaaatatgatccattactcatttatatcaatatttaaaataaaataaaatctatatatcaatataattcaagatgcaaacatttaaaatttaccttacaatgatgtgagtatatgttacctcctattttttatgttttaaaccgtataaaattttcatatgctgttggctgtggaaaaagggaaaacatggttattaactaaaagccccatttgggatgttttgattagaaatttttatcttgaaaaaataaactaaagccattagtgttttctttgtcgatggaaaaaaaagacatcaccttttgaagaaaaaaatgacatcaccttactattttctagaagcataatcaaagacgattatattttgtcataacgaaatagtgtggggggacgtgcaaaattctactcacgtgtaaatacttggtaagttttcagtagttttttcttaggctgtttcacgtgatgtaacaggatttcatcaaagaaggcgtgctttgacccaatctaatgaaaatacactatgatttttggtaattttaatacttttgatggtgatagtgatatataaattttaatgtttggtccttcaaggctgctagattttattaacggtcaacatgtcttaatgatcaaaggtcctatctatgcacaaagccatgtgcttttcgattgatctcagtaaatgttgaatgattgttgctttgtataacaaatagttaccttgtttaatattctcaacaataggttataaaaataattatatgtagttaatctttgattttaaataattactattaagttattttcttgcagtttcaaaattgttttaagtttaccgttgctgttaaattctaaagaatatacagaatgcagtaattgtttcatcaacagatgtataaaaagtctttaattagtcaaaaaaattcttcattcataaaattcattggtaagcatttctagactagagccgtaaatattttcggccaatataataattaggaaaatatttattaggaattcaacgaatatgataaaaaacgttggtcgtcgaaaatgtatcatgacgtcaggaagaaaaaaaacaagaaaaaaataggtcgtcacatatgttttcatgtaggacaagattacgattataaaatcgtttcaaaaagaatacgaaaaaatttacttgaatgagtcacttcagtaccccacagagattatatctttctctctttaatctctctataaatacctaagtatgcaactatgcatataaatctacaaaacatctgaacacccaaagacacaggaagagagctaaagctgatatatactaagtactaagatcatttgatcaacctaatcatcaacaccacaaaattttcttttcttgtttctctaatcgattaatttagtaataatg

SEQ ID NO: 31302 - DNA, 3000 bp, Unknown; identical to SEQ ID NO: 14241
  misc_feature (1)..( 3000): 2750-1469P.txt file - cDNA_ID_3040831; gDNA_ID_2684091; Annot_ID_189943

SEQ ID NO: 31303 - DNA, 3003 bp, Unknown
  misc_feature (1)..( 3003): 2750-1469P.txt file - cDNA_ID_3040833; gDNA_ID_2684091; Annot_ID_189942
aatcattggttgtagacttgtagtgtcttttttttttttttgttataggttcgttgtagtctctgtacaattatactaacagaaaaaaaaaatatatataagaacagaaagtacacaactgtaaaagaaaagcattaaatatcatatacttttaaaccaatgagggaactccagtgtcatttttggcccgacatcactcacataattgaaggaaccagacacccaaataagtcgaaacaacttgaaaccaccctttgatattatccttacatttttttgtcttcccccgaataaattattttgtgggatattttatcgattcaccacctgaatataaagattggattgtaatctcttcttatcaccaccttgacaaattataaagcaataatctactttggtctttataaaagaagaaagaattttggtaatcttataaccacattgtttcttagacaaagcaatataagtcactttggtaattggtattaatcgtatagtccttctttctaattaatcgtcaaatgtatatttctcgacataaactaacctacattatagtttttttgggctatattctgatatagtattacctactacaattatatggggtttaagttaaaccgtttaaccaaccaaaaaaaatatttatatgatttttttggcccgtacatgtcggttcttgtttctcaggctgtccctctatggctatccaatcgcttacgtccgtccaaagaagattttattcatatcgaataataaatgtttagttgttattatatataacattattattttgggtaaagaatctaacattatagttcacatcaatctttaaaaaggaacctacatgcgaaactattgtgttctttcaaatatatttctctcatcgaattgcctcctacgtggcttctcatgtaccaccacccctcaaggctcaacatatattataacaagaaactttattcgaggataatgtctgtgtatgttctaaatagtgaatatagttaagtattaataatgtatctcaattattatctatttatgaaaattgaaatgctgacaccactgtattagactgttattctgttagttaataaggctaaagttaattgacataatgtgtatgtttacctctctagatttacaaaaaaaaaaaaaaaaaaaaaatgtttacctctcaacagaactaatcagttatcgctactgtaaactaagaaaacgatttaattattatcaagattttaaaattttatcaaatattccttacaaattatttttttgttttgggatatcattttccttctcccatatttttgggacatctatttgataaattcttgaatacaaactgaaattaacacagttgtgttgtggtatagatacgaactgattttagtcggcaatattagttaagaatatttaaccagaacatgaaaagaaaaagaaatcatttaatcctttgaaaaatatttaatgcggtattcaggtgagtatcatatttatcaacaattatttttatagcatgaaagtatttccgaaaaaggagtaacgggcatataaccaacgtggaacaataacggtctcaagaatgcaaaacccacaaagatattattaattgctgattctttgacagtgacagctgcctccgcaactttcttagtgaacgtgtcgattttgttatatgaccccatatgttaataatatgaataagagtcaagtattttgcctataaaaaaaataagtgtcaagtatagaatctttaatttccacacaaaaaagagtatggtctaaagttgatgaacaatgaagtatcgatccatttttctgtaaaactatttgtagcagatttagcaattatattccactaaaaatgaatcttgatattgtttggaatcttaagtttttaaatgtgagagcaccccaacagtaaagaacataatccaaactgtatgtttggataactatatcatttatgatataatgcattgtatctttgatataatatttaagtaatctgtcttaagaaaactatatatggaccacaaatttatttttatgtggttattcataaacactttcttatatataaccgtgaaatatcgcatatttgttccatggtctgtccaaggttgagtctagtttttgataatggcacctaaaatttgaattcggatcaaaatatcatccttctaattaagtggtccgaatttaggtatttatataaacactttataaatcaacacatcggagatatatacaagtatagtatgtatgtggtaataaagagaaacactaggatcctttcgaaaagccataccatacccctttcgaaatttcaagttcattctgcgaacatttaaggacataaagaacgaattagattcatcggaccggttgacgaggtcatggttggtcgccgggtcatgactcatgagttgttataatcaccgaaagtaggtgatgaatacatagaggaggcaaatcagcaataataataaaaaaaaggatacttataaattatgagggaaaactagtacgcaactagtgattatgttgtcagccaacaaactcccataaaatatcaaattcctatcgctctcaaatattgtatgttttatctcgataattcttctttaaatttgacttctgtactttaaccccaaaaaccaaacattgacgtccatgataattaaaacaaaaacaaaaaactgttgacaaaccattttaaacgatttttttactatttagcaaataactaatcacaatggaggctttcgcaaatatcgtcccgatatattcaattttattgatatagatacataaaagagaaaaaaataagtgattagctttagttttgaacagttttgatcgtacgtcgttgtaagatctttatcatctcatctgctatatatacactcctccgagtacataacccaatgtctcagccttcaaagctatcaaaatcaaaaaaattctatcaaacaaggaaatatatcaatg

SEQ ID NO: 31304 - DNA, 3003 bp, Unknown; identical to SEQ ID NO: 31303
  misc_feature (1)..( 3003): 2750-1469P.txt file - cDNA_ID_3040833; gDNA_ID_1620813; Annot_ID_169157

SEQ ID NO: 31305 - DNA, 3003 bp, Unknown
  misc_feature (1)..( 3003): 2750-1469P.txt file - cDNA_ID_3040859; gDNA_ID_1972029; Annot_ID_178223
gctcacagacttgactctattacagatatagtagtaaccattcattctcactaaaaccctattcctgccgtcagattgaaaatgcaaaaaatccaattcaagatttgactctcaaaatctcaagccaagaaaccaatctgcacaaggtaatgccaagtgaactttctgattatgttttttctcattgattgagattgatcctttcctccaaaagaatcaatgctagaaaaattgcagtttcaacgagacccattgttgattgtgtgcgatatgtttaactttctggatataaccaattttcatatttttgctggatatgattgcaggatgcagctgcagaaaacaaggagaaggcaaagctaaaaatgagactcaggggtatgcaagcacgcttagatgcaatcagtctacggtacaagcagtctgtgcaagaatcagaacttatgaacaggaagttcaaagaggcatctgctaagctaaaggagaagttagcatcaaaagcactcgaagttctcgacctcaagaagcaactctctgcttcttcaagaacaatgtgatgagcttacatcacaactcttaagtagttgattcacggctagtaaatgtcttaaagctgtaaactgttaaatgattaacgtcataatcacagagaactgatgtgattatggaagagtccaatacatatataaattatgataggtagattaacaaattacatggagtttatgctaaagtaattaagaggagaaactaagggcattttggtccaccgctcttggtcttccagttgttatagcaaggacatacttgcttattgccataagtacctgggggcacacacaagcacttgttacaacatttgttgcagaagaacaaacacggcttcttgtattgtgtattcgagcatctatctccacaccttggcccgcactctaataaaggtggaatagcggatttagtttcgcattcagcacaaacattaattaaaaactaggctagtcagtgggtttaccttggggttgaagactgccttgagtagtaccgtactgccaaaatcaacaagaagatgcaaaggatgttaaaaaggttttgtagattcgatgaaactctttttttgagtagtgatgaaccgagaaactcacttgagagttattgtgatgcggcagttgtggttgcgactgtggtggttgtggttgtcgagcaggagattccaagtatataggctgtgttttattcagggacgtataagataaagttgataaatgtgaacatagaggaatagagtgttgaaacacttacatgcatatgggcagacagaagaagatgtaacacaacaatggagaaaacaatgatgctaagttttgttgccattttctgaaaacagaaatgattgtaatgaagctcaggtagattatatattttgcagactaagctcattatgaacaaatgataggggtccactatatatagtccaatttccaaatactttttaatctagaaaatatatttctcctgtcactgatttttttgcaaactagaagagtagaagccattaataaaattattgtctaaatatactcttgtttttttataaaacttttcaacggtctaacgataatgaaattcatggattgaacaaccaatcactaatcatatgtaaaaactaaaaactaattttaaaatacttaattactgattaaacaccagaattatgtaagatatactacatttcccctaaaaaatatctgaagttgtgattttgtttatgcatggaatttgtataacaaaaagtttagtaagtacaaatatagacttcatgttcccaatcttggacaagtgaagcagagagccaaagatgtgataacgaacgaaacgaagaatagcacatgtgtgtttctactgctttctaaccctatctctttctcgtgactccacttttttcccttatactatttgttttaaatcttgtgatttgtttctaaacgttcttggagacgaattttgtaagaaaaagacacgtggtgagaaattttgggattcgaagtagatttctctgtaggcttccccgtgacctaattgtgattacctgccaagccattttgcatgttcagaattgttttgtttggtttaaaatgttcagaaagttcttgtgtctcacattgctgggcctcttcccttttctttgtcttgggcctttaactttttcttctttatttctgtatccatattttgtgttgggcttaggcccaagttgtttgtatcatcataaaaccaaaagtcattaacatgaaaactttttgacaaaatacattttacatctgatatgcaaaaattaagatttggatttttgttaactactttgatattattaactgtttgagacaaggaaaaaaaaacaaatatttattatttaattgaaaggctttaatttagttaaggatgaggaagatgaagatgatgatgattcgaaaatgaaggtggtggatactgcaaatggctgctgagtgctgagacactctcgaaccccacaaaccctaaggatctcctccgaagatttccactattactggaagtgatatagatacgttgcaacaaagaagaccacacaaaaacgttattgagcagccgtgaaatcgatttaccaattgaagcttccccccatggttggtctctatccgtctcttattctacttttcgggttcagctgttattgattgaaagatttaaactttataggtatttgtgttcatcaattgattctgtttgcttgcttcgaaaattggttgtggctgaacatatatatcagtgttcctttctctttatttgatttctatctatatagtttctccaatcttagcatccacattgttgtcactttgagagtactatggaagcttaaagtagacaactttattgaggttgaaaaatgcatgaatggaaagagagaacggacttaacaacttatcaagtatattttggttgcagatttgactttccctgatg

SEQ ID NO: 31306 - DNA, 3003 bp, Unknown
  misc_feature (1)..( 3003): 2750-1469P.txt file - cDNA_ID_3040866; gDNA_ID_1972029; Annot_ID_178217
atggatattctgctgaaactcgatttagacgctactagaaggttctttgatgcattctttgatctgcaacctcattactggcacggattcttgtcttccaggctgtttctcccggaactgttggtcttcgggttgtcgctcttctcacacgcttccaatacctcaagattggagatcatgacaaaggggactgttcctcttgctaagatgatcaacaatttggtacaagatagagactaaggaccagaaacttagacatataagtacatctgttctttggttcttgaccagtagtatatccgcattgcaagtcgttggataattgtgtataaaccacagatcataacctgaatccttgtgaaatcaaattgttactactagttcattaaaattaatactttgtgctgcattgtgtttcaccaactcttgtaaatccaaaactagaggcaaaatgtaataagataaaagagtggattttgaacacaaaagcaaatctttcaaactccttccgctccttaatatttgatgctttcgtgaaagtcttatatttcatcttcctcgaaagggtctctttccggataatcaccaacctgcaagccaacatcaagttcatgagtagcagaaaatggttttctaatcacttaaactaggttaactactaagaacccaatccatactaggtccaaaccatgtccagaaagtcaaactcgcccaaacgttagcttgagagtgataacacccttaggcattagctagttctatagctaacccatattcgactccagactcctaatatcaaacttggaaaggtaaaacccgcattgacatctatttgagaaacagcaaatactactatacgatggatgatgtagaatgactaaccagttctatgaaatgtaataaatcatttcacaagcaaaatgaattaggcaacggagaagctaaggccttaaagaaaaaaaatacctttactttgtcaggcctgaccataccaccttgaagccgagggcactcaaagaatcttgttcctttcaccctgcaaatgtaagccagtattaaatatgtgggatctgacaaccgaacttccacaaattgtacttatgatatgaagtatgaacatcatgatgttaagaaaaagtctatacaagattaagacgcttaaagtgatactagcacaaggttctagaagcaagaaaggactgttacttcaatttgtgatagagtttaacgttaatgaatacaaaatagcatcaagatgaaagaattaacatacatgccatcatgttttccaaggggctcatcatactgaattccaacccaatagccaggacccaacgactctgctcgtccaacatatttgaccattcctcttttctccccaggctcaacttggcatctatctcccaccttaacattggaatggttaaataaattagaagcataacgagttgagaaagagcagaatcagagaggtcaggtctcacaaagttaacaaaaaaccatgatatttgcacagagatcttccatatacaaaaagaatgtttctgactaaccttgatatttgcgcagagatcttccatatagttctctttcgtctgttgaaaggataaaattggaagaagaaacataagaacatttgtattcttgaaagacttagtcttaccccaaatacttctccgcagtgactaagctaaaaacttcagtttcgctgaaagtttaacaagaagcaacatacaagtttggcttatattgatatatccgtttgtcataccttagcctcagcagcaaccggattttgagaaactctcttttctttgaatttcctaaaactgtctggaatttgaacacaagaacatacaaccatcaaacgaatccaacatatattcaaagtcacttgatagaaaaacttgtctcctttgagacaccgattacaggtagtagagaatttaccagttcgtttagcataatcctcctctgagatgttatacttctcaaccagtgacgtatcttcaagccagcctccagttgtgaccgaggaggggtcaagatctatgatgtgtaaccgaaacctattgaaagcagcagaaaagaacaatcagatgaaatgataaaacaagaagccatgtcatgtaattgaatgccatctatcaagattacagtgaacagagatctatttagtcaaactggctccaagttctctaaattagccaaccttttgcaatctctacaagctatgaagaaaaacagaagttacccatcaaaaggagagaagaaaccaagaggtctagaatcatcactgagaactgcaacctttgagccagagtcatcatagagctctaaagccatggaattaacagatgtaccacatttcttccatagcttttctttcacagcttctacactcatctacagaacaaaattcaaacaaaaaagcctttatagatagcactacattgaaaaacagttggaatcagtactgaatgtaaaacgagactcacttgcggagagaaacgagcgtccgcagagaagcttttaaggttggcgtgagtaatgtgtagatgtacagagtcatctccttccaactgtaaacgcgaagttgccattttttcacctctagacctgacaaaaaagctctgttaaatcacttatctcaatgaaatcaaaaaaaaattcgactttctcgaattgggtaacaaaagacgcttaccttcttagctatttctgggcaaagagtttgacttgtcagcagaaatcgaatcgaatctcgccggatcggagacgcaccgctgagaatgtagctgagaaacgagagagacgattaataaaacgacgtagttttctctagtgttcaaaaggtcattagactcgttagatttaggcacgtgtatagtcgcacgttaaacactgtgtactcacccgcaggttagtataaatcctctaatccctggtctaaacaaaaaggacacgagagaatccgtgaggaggaggaatattccggtgatg

SEQ ID NO: 31307 - DNA, 3003 bp, Unknown
  misc_feature (1)..( 3003): 2750-1469P.txt file - cDNA_ID_3040869; gDNA_ID_1972029; Annot_ID_178212
caaatccttgaatgcgtacaaggtgcgacattgaaatacctgctcatactgtcacatcttcacctacacacacatgcactcaaacactcaaacatgtgttttatcccttgagaagcattttctgatatctgtgattagcgtattctttgattgagtatgtgtctcctacagtatgtctagttactaacttcaaccaaatgaccatggattttccttgctgactctttctttttaggctgctctggctgccaagagggctagggagttggtaagatcaaaaagcgttttgaagtcatcctcacttcctgggaaacttgcagattgctcatctacagatcctgcagaatctggtatgcattaaccaatatgaaagtgccttgtaagctgtgaaagttagtcagtttattgacatctatctcctatgctaccagagattttcattgtcgaaggagattcggctggtggcagcgcgaaacagggtcgtgacaggcgtttccaggtaaaaaaaatcattctgctcagcgtgtcactaacaggctctgcttctattttgttagtctgtaacactgtatttcgatctatgcaggcaattcttcctttgagaggcaaaattttgaatattgagagaaaggatgaagcagcaatgtataagaacgaagaaattcaaaatcttattcttggccttggtcttggagttaaggtaatatatcctttttcatatcctgctgtttgttggtatgttcggaaaactcagtttgacataaaacttatttcagggagaagattttaacaaggagaatctgcgttaccataaaattatcatcttaacagatgcagatgttgatggtgcacatatccggacacttctgttgacctttttcttcagatatcaggtactagtttagtttgataaaacattagttgaagtagccttgattgctgattgagttatgtgaaatttaatgaaatttactttctacagagagccttgtttgacgcgggttgcatatacgttggtgttccacctcttttcaaggtaagctcttagtatctataatcttatgcttcagattgaacggaatttttttctaaagctagtctctctgtgaaaacgatcaggttgagagggggaaacaggcgcactactgctacgatgatgcagctcttaaaaaaatcactgcttcgttccctggaaacgcatcctacaacattcagaggttcaaaggtaaaacatcctacttctcacatcatgaatgtgttcttttggaaaggataaataactatgaaaagtaatgtatagtagttgttatgtgttagctattaagatactcttgagtgtgtgcataacgaaatctagattagtctcaactattggattctatgtaatgtttcttgcttttgcatctgcaggtttgggtgagatgatgcctgcgcagctatgggaaacaacgatgaatccagatacaaggatattgaagcaactagttgttgacgacgcagcagaaacgaatatggtcttctcatctctgatgggtgctcgggtaagccaatgaattgccagactcggactcatgataatagtcaataaactggcataactcatcgtgacaatgttatgttctgtgtatgtttcaggtcgatgtcaggaaggaactcatcaaaagtgctgcgactaggatgaatctggagaatctcgacatataacacagcttatagttattgcttcagctatatacaaacaacaaagaaacgactctggtgaaatgcaaagggagacatcatcatttcaaggttaaatcatatagtcacaggccaacaggattttgttcttcttctggcctataaaggacaaaattcattgttaggattatctctttcaatgtcaaaatttagcaattcacaaggctctttgttgggcgtttctttccattggaactagaatttttctagagacaagagaaatttgcattcactaggtatttactatatattatgacttcaacaatttggcattcctgaaaatcatgcatgcgacgaagttaaaactaatgattagaaggaagatgagaaggtaactattgtgcaatgaatatcttctctgcctgttgtattgattttaattgtattcgaggttaagttttgactgatgttttactagcgatcgcagagtgatcgataattaacaagtttatttttcgatttggtaggtatatagtgaattaaacatgatttttgttcttcctgaacaacctaaagcagtgttatgaacgcatcacgcatgtaacaaccagtcaaccatattagtgtgactttaattcattgaataaatgaaatttttttattttcaacaaggcttgtaacggttgataaatctactcagaaaacttctttttgtttgtcttgcaaatacaaacgatacgtttcaactctttttttggcgtccaataatacttcttaaaaaataatttgtttattgtcatgagctacacgtgggaagacaagtcctatccattattactacacactactccaacatttgcccacattttgaaaaaaacatttttttgtaattcaattattcgacacaaccaatcccatctcttgtttcacttccgccctccatctttcttcgtgattgagagaatcttcaacgaaagaaagcaactttttttgggtgaaattcacagaacaaccaaggtttttcttcttcttcttcttctccagttcctacaggtttactcttactcatcttcatctttgtctcgttcttgctcttcaatttctggtctttttgttgttcttgtcttctcgccaaatatactaagatctaagttttatatcattgtaattatcaccaacgaactgttaagaccaaatttgattactcgaaatggttttgggtttagggtatgaagaactgatcaaaagattcaattttttatgaagtcaactttcatctgcaaattgagcaatctcagatttcgattgtgtttcagaatcatg

SEQ ID NO: 31308 - DNA, 3003 bp, Unknown
  misc_feature (1)..( 3003): 2750-1469P.txt file - cDNA_ID_3040874; gDNA_ID_1972029; Annot_ID_178210
ctatatgaattgcattggttttaattttgttccaagctttttgtttgacaacagttttgatacttcggaaaagagaagtaaataaatataaacataggaagggaggagctacatgtctactatttttattttataagccaatcagagcgtttcatgtcataccccactctcacctctcgggcaatttcacacccactctcaccaatcgcgtgatgagcgcgtgtatacgttttctgtgggttctaacccaccaaatggcttgttttgaaacacactcgctcctttaaaaaaaagcctcgagtgcgtgatttcagtgtctttctcctttaattccaattcaaacccaaccgaaatcaattgaatttttcaaaaccatgtaaaccgaaccgaaattaaaacacaaacgacaaactagcaattgtcacttccactattgatccaactccgacgaaccagattgataattttgattcgattccacacagataacatatagtccaaaccaaacgcaattcataagagagccaaattattacgctatgttcgaagcttttttaacttgccacaaatcaattcacaaaataagaaattgtgctcagaaattttcagaagaattctcgatcataactttatgcggtggtggtggctgtgaatagccaacggagattgctccatgagaaattgaaccggcatcgccgccggtttcattgtccacatagtaactccgattgctgtgcgagtttatctcagtctcccttattgcggtaatggtgaaaccagtccacatatattttaatcaatggattattgggctttttatattaggcccattaaattcatccggcttttaaataaaatgagttttgtgatagtccgagaccattgcattcctcagtgaatacaacaacattatctgtcttactaaatgtaaatgaccatatcaacaaaaaaaaatcgacttgtttgtcaataaataaaaattcctcgatttccatattcatataaaagaaatagataccaaattgttggcaaaaacaagcaaataatacatatttgtggggagagaaacaaaaaaaaaagctacactttaatagaaagctaataacatattgttgacttatgataacttgtaacgtgacttcacacgcgtagtagtattacttaaaacttaggtcacgtgaactggatacttatgaaccgagtcaccccacgggttacccaccaatgactcgttagccggaatcgttctcaatgctctccacacaatactattacatttaaaacccgacccaaacgccaactgccaaaccctatctcctcgtttgacccgacatttagcctccacgtaagccagctcgtaccacagcgacgagcttgaagtgtttccaaagcggtgcaaagtcatccgagacggctcaagatcaaactcactaagtccaagacctttttcaaccgcgtcaagtaacgctctaccaccagcgtgaatacagaaatgcttgaaacatagtttaaaatccggaacatatggactaacctttaaccggaaaagcttactctttaccaaaaagaggataaaccggagtttttcagataaaggcaaaacaagcggaccaagtgctgttagattcgtctttaacgtgtcaccagcaacaaccgttagttctttagagagtgcgactccaacgatacctttactatcttctttttgttcagcacaagtgtagtgtttatcgctagagcctttgtgagtccttacaatatgagtcaattcgtacttagaccggactcggtcttgactccggtttgagagcataaccgcagcgccacctactcggaatagacagttagggactaacattgaccggtcgttgcctcgatacatgcttagagtcatgttctccgtactaacaataactgcgtaggtattagggtttgcctttagtagatttgtggcgaggtccacggagattcctaaagaaagttcaagaagctatgaagagtggtaaactctaaaaggaaagatagaaactggggagttggctgataaagatggacagtaacgattgcgtaatataaatttatcggcctcgtcaagccccggcgctgcatcccataccggagagattgtaagttttgacgtcggttttaagcttgtaccggtttacgatcatggacgagagagatgggttagggttaaacaagctgcagtttacgatgaagattccgacttctctcggttcgattccggttttcttaaatagtgagttaagagctccgaagatgactaattcggattcatgtctcgcctcgtacattgatggagttggtggagaggttaacatgcaacgtggggagtacgtatcgtctcctaaaccggaccggtttagtatcctcgtcatgaattggattgtttcttcggtgtagagttgagcgcctttggccatgttgaagaacgtttcggatgagattttgcaagaatccgtgggttggtgacatgagaaatccactaggtaaaccggtttagaccgggtggttgagtaggcatagaagaagatggatatcaggagtaaaccgatcttgaccggaaaaggagagaagaagtcatggtgaaagtgaagtagatcaagttcaaagagagatagaaggatgagtataagcaaaagaagcttgaaatctgccattgcaatgaacatatgagaaaatattgggcattgggtgggttttaatttataagcaacgtaccttaccaatatttatgatatgaatagagatggcgttaagcgcgtttgtgccgcggaaaatgtggtctgcgttttaaggttcacctattcaaacaaaattcagagacatcgaaaatgaaaaatccttaatggttttttttgggctgcaaatcataatcggaatttatttaattgaagtacaagaactttgggccgggtgggtttgagtaacccggcccgacatgagtacccgtaaaacttgtttgaagcagaagaaaacatg

SEQ ID NO: 31309 - DNA, 3000 bp, Unknown
  misc_feature (1)..( 3000): 2750-1469P.txt file - cDNA_ID_3040882; gDNA_ID_1972029; Annot_ID_178203
cagaggggtaagggaaacagaggagctgaggagcaaagacaaagcaacttgagataagagagaagataagaagatagataagcttaggcttcgatctcttagcgcaattcccacaagaagttttaacccggaagacataaggaaatagcttcttagattcgtctactttgatctgtgctacttttttcagattctgcctcatcctttacttgttattcaagtcatataaatgaagaacatagagagagagacgtatgcagaggaacttttttcctttgtgaacagaatttgtcaatctatctccttggagacgtaagggagagaagtagctagagaggaaagagagtagagagatcaagtagacgagataagagagagaagttttgtgggtgttgttgtaagttttagctttgaaatcagagtatttatttagagagagacgttcgcatactattctttggaagagagagacgtaatttggtattgttggttaagagagagaaagttactaagtcttgggatgtattcgatcttcttagaaaggggaatgaggagacgtgtgggagaacgagaaagggacttaggccaaacccatcattcatcttttaggcttatatatgtttcttgcatcacaagattcctttatccttaaatcatgtttggtaaaataactaattattcgtcttactttatactcgtgattagttgaaatcatcctatcagtgacatgttcaacttccttaagtggaatttatgtcttaatcagcatgaaaagagaaactgctttaagttaaatcaagttattggacaccaaatattttctatgttagtgtatatgatgactcaaacaaaattcaatgtattatttctggcgcgctggagtcttatgttatctgaggtccagctcattgtgatctttattttagacttaacaattttataggttgaaccggaaataaaacaattttaaaaaatcagtgaaagactgcatgatccaagactagtttatggttcaacacaataaaatccaaaattaagttgtcatatatagcacaaatgccattgaaacaaaaatttgttttatagtatgattaaaattatatattggtataaataattgatgagaccaatctactcatagggatgaccaattaagaataaagaatttcaaattgttggacattttaatattataaaaaccgcggagaatgtcatgggaaaaggaagaaatgatcaaatagcttatggaggcgttcttaaaggtcaaatacatacaaacatgtcattatatcaataactacaaacaacatctagtattaatttttttttttttgcttgccaaaagccaccttctgatgcactattatttgatatataacacgtttaatacaaaatatagacccaagggaaaataaaaaagttggtaggcgaaaaaatacttaaataagaatttcataaagagaaaaactggtgggcgaaaattctagaatattaagaatgaaaaataaaaaagaagaatatgatattgattaatcatgttcagcagattaggaatatattatcttctatcgtataatctaaattcatgtatagttcaagttatgtagaaatttctaacgtcaatataaagtattgtgacccacttttagaccaagttcgaagagatgtaaaggtctaagtctctaataagatctataaaattcattgattaagaagggttatatatataaactgtcatatacattaaacagaatgagaaataatgatggtgatgccaatattttaccaaagtttttgacactaaattattgacgtccatattttggtgccctcgtgtaatctttttaggttacatgttgagacaattaattatgattttttttggaaaaaatgatcgatgaactgcaatataagtacgcaaagatgatcattggagaccgagactttgctttatagggattgcgaatttaaccatatccactttttgacgatcatgagtaacgcataatacattcagatgaccggaaattttctttgttgagttttatagtctacgaaacgaaacaactttcttctcttaataattaaaatgtgatgttttaaaaatacaaagaaacaagagatatcctcatggtcatgggtatcgaccaaaataaaaatagtgcatctgtttaatacgtacacttgtcttaatcatttgcttacatgtgtgttagttcatatgtcaattttgagtttgctgtataaataaattgtattaattaaatatgacataattataccttttatattatagaattcataagaaaacaaaacttgagttcttagggttagtttaagaaagttcataaaagtcaatcattattatataataagtcttgtggaaagcctggatattatttatttcacttcctaaaatccgttcctaattggtattttgagagcatgatatgcgatatatgtcttacaatattgagattgctaattggtatttgcctagttatgtccatgtttatttttatccaaagttgtgtatcatatactgtgtctgtttggtgtgttatgacttatgacccatgtgtgataatctcatgtggtatggccgtatggatgatgtgcatgaacataaaagtaaaaagaatcatttagagacccaaaacaatatagggcttcaaaacgttgggccgggtttgtttcagagccctattatagatagatgggtctgaagaagtctgaacaaacaaaaacatgtctatcatattagccgtcgatcctcattagacacgtggacggttgatatactgccgagttcggtatcgtcgcaaattttgatctttcgggaaaaagaaagaaaagagaagaaaacaaatcgttgaaaaagtaagtaagctcaaggcgcgacgaggaaaaagacgaagaagaagaaagtaacaatctttagtaatcaaagtccaattagtgaaaaggggttttcttgtgagaagagaaagagaagctatg

SEQ ID NO: 31310 - DNA, 3000 bp, Unknown; identical to SEQ ID NO: 9251
  misc_feature (1)..( 3000): 2750-1469P.txt file - cDNA_ID_3040885; gDNA_ID_1972029; Annot_ID_178202

SEQ ID NO: 31311 - DNA, 3003 bp, Unknown
  misc_feature (1)..( 3003): 2750-1469P.txt file - cDNA_ID_3040893; gDNA_ID_1972029; Annot_ID_178200
gcataacatcatcaactgaattgttagagagctattgggtcaaaaatagaattgattattcctcattaatctgaatctggatataccttaatgttaagatagtcgctgattgcgtccagtataaattgaatctcatcttcatgaggttctggaagtgaagtgattgaagtattagagtctgtagtgcctgctactgttcttcccaaccacggtaacataaacacaacgcggccatccttagttttagggactatcaaccccatgccttcaggagaatagtaatcaggcagcacgatgtgtacaccgctgcttggacaaatcattggttttgtatcttcatcaatcattttcctaatggaatcacagaacggtcctgccgcattaacaactacttttgcatagctgttaaattcttggcctgtcaaattgaaacatctcatcaaaaactgcacaaatcatgacagagcagaggtatactgaattgcacgaaattgctagtcgttttacctgtgagattgttacgaattcgggcaccaattattctcttagtagcatcatcagtaataagcgagacaacctcggcatggttgagaactgccgcaccagctaacgcggcagtacatgccaaacccacattcagacgtgaatcgttcatttgcccgtcataatacacaacagtacccctcaaattcttgtctttccctttccttgcaagagtggggaagagctcaatagactcttttgcagagtaatatctggacagatgcaataaccgtggtccagcaaccaagtcatacatcttcaaccccatccagaagtagataacttcgaaccaatcaaaacaaggtgtcatacagggcagagcatgacagagatgtggcgcattctcaatgagctgtttacgctcctcaagagcgtgaaatacaagcttcagctgtccataatcaagattgaaaacagctttctccaagtaacgaacccctaagtgtaaacgagcactaaatcaaatggtgtatcaagagccgcaaatgtaatacatatccttaacatgtatgttccttcaattattgaattaacaaacaaaaacacaacaatgagtggcaaaaaccaagtaactagctacaaattcttcaatataatttcgtcaattgaatggtcataccactcaattccaactagtaaactaagaaatggtttaatattaccagacaattcagagagcttcttatacgaaattcggaaatccacgccacatagaaaattcaaaaattaaaagtacctccatgaatcagctttgtagatcgcgaagaagtcccagaggagaaatcctcgcgctccaccaaaccaacacggaggccacgtgtaacagcgtcaagagcaactccagaaccggtggctccaccgccaatgacgagaacatcgagcggatcagaagcggtggctgcaatcagagcagactcttgagcagatcgagacggtacagaagcggtgggatcaccaagcctacgcctcaacgaatctagaatcggaccacctcctttgtcgctggaggcaaccgacggagacaggtagacagcgccaccggatgcagcggcaattacggcagctccggcagctaaacggcgaatggaagcgagagacatggaatttaggagagatttagagattgggtgaagaagattgcgttgggaagcgagagacgatcatgggaaagaagaagaagaaaatgattgcgaatgatatcaaaaaatggaaatagaaatctctgtaatggaaactatatcgttttaaattactgtttcaccctcacaactttccatacatagaaggtaagtgaagtggggatggtttggtcatttcatatgaatagagagttccgagttctaaggaatggtttgagtgggctgcaagagatttttcttataggctttgtaagtttttgattaaaaactgttttgtacaaacaatagtgtttttgattttttaagaaaaatagaagtaatttgtgcgagttaatttaataaactagactaacaaattataaaattgaaaataattatttcaaaatatggaggatttgcaagtgagtttttgctagttcttaaaatgtgcgaatcttgctctcttaagattggaaatgtttaggaatatagtcagtaagacataactaaatatttgatcattattagtattaaaagagttaagccatactaaatatttgttttaatgctattaccgtagagggtatttctctattgtaaataaactatattaattaaacttctgtataaagattacaaattaattatcagaaaaatgaatgaccgtaacgaaataaacgaaaaatacaaacttctctctgattaaaaaaacaaacgttagaaattgtgattatttattgtctcgatttaataagagattcttgaatttaggtgacaaatttaatcattaattaatcatccttttaactttatgtaatttgtccatcagacaaagagatggatatacgatgtcgtaatagccgcatcttcttctaatcaccttttttaagattagtttatgtaattaaaaaaggttaagtgtgacagtttgggagaattaccagaggatgaaggcgatctcagacatccatgatttgcctcttttgtcttctttaccttattcgtctctcattctttgaatcccctttccctttctctcaatcttcctcacttacatttcttatctcactccctctctcactttctccttcaatgttctctcctctgcgttttcacgaaacagagaaccttatcgttccgtcttcgtagacattgaaatcgatagagaggtgattcattactttgattcgcgatcggattctgatcattactctttttcaaaaatcgatagattcttctccgatttcgtaacaccgacacgaatttgtttttggctttttctggtttttgcaggtgttgatttgattaggtttaatattgattcggatgaagggaagagatg

SEQ ID NO: 31312 - DNA, 1451 bp, Unknown; identical to SEQ ID NO: 9258
  misc_feature (1)..( 1451): 2750-1469P.txt file - cDNA_ID_3040936; gDNA_ID_1972047; Annot_ID_178236

SEQ ID NO: 31313 - DNA, 1045 bp, Unknown; identical to SEQ ID NO: 9263
  misc_feature (1)..( 1045): 2750-1469P.txt file - cDNA_ID_3040944; gDNA_ID_1972047; Annot_ID_178270

SEQ ID NO: 31314 - DNA, 3003 bp, Unknown; identical to SEQ ID NO: 18229
  misc_feature (1)..( 3003): 2750-1469P.txt file - cDNA_ID_3040948; gDNA_ID_2684224; Annot_ID_191895

SEQ ID NO: 31315 - DNA, 3000 bp, Unknown; identical to SEQ ID NO: 9261
  misc_feature (1)..( 3000): 2750-1469P.txt file - cDNA_ID_3040948; gDNA_ID_1972047; Annot_ID_178266

SEQ ID NO: 31316 - DNA, 3003 bp, Unknown; identical to SEQ ID NO: 18229
  misc_feature (1)..( 3003): 2750-1469P.txt file - cDNA_ID_3040948; gDNA_ID_1621111; Annot_ID_171790

SEQ ID NO: 31317 - DNA, 3003 bp, Unknown; identical to SEQ ID NO: 18229
  misc_feature (1)..( 3003): 2750-1469P.txt file - cDNA_ID_3040948; gDNA_ID_2684224; Annot_ID_137530

SEQ ID NO: 31318 - DNA, 3000 bp, Unknown; identical to SEQ ID NO: 14769
  misc_feature (1)..( 3000): 2750-1469P.txt file - cDNA_ID_3040952; gDNA_ID_2684224; Annot_ID_191901

SEQ ID NO: 31319 - DNA, 3003 bp, Unknown
  misc_feature (1)..( 3003): 2750-1469P.txt file - cDNA_ID_3040952; gDNA_ID_1972047; Annot_ID_178259
tgtaaaacgtttttccgtcaaatatgatttaaaaaaaaaaaaaaattgttactaacggctagtttacccccaaaaaaaaatgattttactaacggaggagaagtgtttcgaaaattcgacaatgattaagaagaaagttagatcaaacgaacaggatcacaggaagaaggtacaacgtgaagcaatcaatgaggctaaaataaaatattgagaaatttgctcaaccatatgatttcattaatatataataatgaataacagttctatcatataaataaataatttataatccaccacatgacaacagatgggttttcccattttatttaactataaacagtattttgctctcacagatccacaaggacaagcatattcaaggatgttttagttcttaaagaaaagataaagagagaccagacgcatagtggtaacttggtctacaagttagagtggccaagccggagaaggacacggtgccacgaagtgttgagaacccctcttaggttccacaccgactccacattttccggttgaacattcgccgccgaatcaacctgcacatttccacagttttctattaactcttgtcagaagccatttatattagctgagcaagatgttgaggctttaccgctttggcgatgacctctgtagtctgtgaaacatcaatggtggcttcaaacaacacccatgcccatttgtcactggagctgtgttctgagatgtactgctttcctggttcctgcgttctagaagcttccacccagtttttgcctccatccagggatatgtccactctttctatcccgcgtccacctcctgaaaccgcatatcctttgatacttacctgcaattttttttttttaattgaattagctcttgctttcctacattggtcagatcagattaggtagtgaattccgcgttctaacctttccaggcttcaccatttgcacatcctccacagagcagattgcactctgttaacaatgataaacgagtatggggtcaagactcaagacaaactaatgttcatttacaaattctactatctgatcaaattcataaggcaactggtccaaacaagtaaaattttcagtataccagtagaaaatatgatcagtcgattcatcaccatcatcaactgttttcatggaagaatacagaattacgaacttcgcaagaaaattggaaaatcttaattttgtagcgcatataaacgaaaaacgtcattacaaagtcaagtattctgtaagaaagaagggaaagttgtatttacctgaacagggaaatccatttgcggtctcctagaggaccagttgatattatcccaattgacagagggtggaaacattttgtaatctttttgcatgaagaatccctacatcacattttgatccaagtcccttacaatgttagaacagtttctgattgctaaaaagagggtaaaagccggacactttagttgagacctggctttcttcagcgatgacattgatggaatcaagccatttgaccgaacgagcaccaatcacaccagggacaaccacccttaacggaaatccgtgatccctgttcagggtcttcacagaagaaacacgttttccaacaaataagcacatttccgagtactcactcatactcacatgtcaaacaagtgatgatttaaacacaagtgagactaatttaggagagcgatatcaaacctctccattcatctcataagcgagtagaacatccgcttcaggatttgtggcttgacttagagtgattgacgccttataagggcccccattttcctcctagagatatagaaagagcatagacttttcatgggaattcataacaaagcataaaaaggtggaatttattaatatatatctaccttacagcgatcaacactaacgaactcaacatgtctggctcctaaattggtagaagcagtcagctttggtatccccacaagctcaagaacatcggccagtttcgccccaccccagacagctgaaaggcaaattctttcaagacaagtatgtattgaaagcatgggaatgggagaaagagagacgaaccgttgccaatagcagaaacatcccatccaacacctctaacattcctaactttgctcatggcagtccttctgttaccggcacactgcattgaaacaaaagtgatgttaaattaaatgtggagaaaaactaaaggtagaagatttactcaaaggaagaatgaacctgaagagtagcagtaacattgtactttgggagggacctgcaattttgaggaggaaacaagagtggtgcttgatggagagatacaagatcaaagttggagaatgtaaagagaggcaaataaataaaggtacctgatgtctttgataaagagctttctcgggttctggatcaatccagtaagggtgacggagtagctggtttggcaaaagaaatagcagaaatgagcggaggaggcaaaattgaagatgaatgagagtgagagagagacctttgaaggtgatcaacaatggggatgggaccatgatttcgcttgtagaaaaggtcgacgggagtgacataagatgagactaaggccgagcggggaggctcggcgttgaaaggttcctgcggatcacccaaatttagatgccatgaagaaaaaggctatatcagactagtgactgattcgattggaaagagagaagaagaagaagaagaagcttaccttggcgttgaccttgagagaagggtgacgaggtggttcctgcgagtattccgaaggacctctaattccaggcattcttctttcgaggaggagataccgaggaaatgacgattgagtgctttcctttgtgacgtctctctcttcttcaaaggaaaactatggaacggcgtcgttttaggtttgcgtctcttaatttgtggataacagacagagcccaaattgagcccaaacaaaaacaaattgtgagagatggcggtggccaaacttcacggcggaggtatg

SEQ ID NO: 31320 - DNA, 3003 bp, Unknown
  misc_feature (1)..( 3003): 2750-1469P.txt file - cDNA_ID_3040956; gDNA_ID_2684224; Annot_ID_191902
tctccttggcgatcagcaaggtcaggatccgggacagtccaccacccctgaccatggtcctgagcttatatttagtgaagtggaagacgagaaaccaaaagaagtagatttgcttcctgcagtggagagacataagagaattgctcagttgcaagcaaagctgatgcaagcagctgcagagggtgctgttcgggtcaagagacggaggggccctcacagaggcgaggattttactttaactcaagcactcgttaaagccgatttctggctcatcttcttctccctcttgctcggatctggttcgggtctaacggtcatagataaccttgggcagatgagtcagtctctcggttacgataacactcacgtctttgtgtccatgattagcatttggaacttccttggacgcattggaggcggttatttctccgaactcatcgtcaggtatgatactgtcccagaagaatgacaatgacatttggctgtggaattgattgtggttcgaaatgatttgcagggactatgcgtacccaagaccggttgctatagcagtggctcagcttgtaatgtcagtaggacacatcttctttgcatacggatggcctggagctatgcacatcggcacactattgattggacttggctatggtgctcactgggccatcgtcccagccactgcctctgagctctttggtctaaagaagtttggagctttatacaatttcctgacgctggccaacccagcgggatccttagtcttttcggggctgatcgcaagttccatttatgaccgcgaagcagagaggcaagcacaaggatccttgttcaatcctgacgatgtcctgagatgccgaggttccatctgttacttcttgacgtcactcataatgtctggattctgcctcattgcggccgccttgagtatgatccttgtgcaacgtacgaagccggtttacacaaatctctacggcaaaacccgcaactgattttaagataccatattacgaaaatatcccaccaagaaaagaagctgggttctttgagtttcatacctatatatatgattgtgttcatcatcttattctttggcttggtcttccacttccccatacatgtgtatttggttatgtaacgattttttgtgtccggtgttgtgtatggattttgaattcgcatttgtaataattgtattcacattattcatattctccagctacaaggtgtctttgtgtgtagatgtcaaacaaagacctaatctgtgtctgtctctgttttaagtgccagacgccataagatcttggcgcagggaagactcgtcgtcctcaaccaccatccacggcaatataggtccctatacaaaccaaccacacggtcaagttaaggtccttggatggatgaagcacagaatgtttagataatatattaccttcccttcccttatgaccttgggatatggtcctgtcatatccacgatggtggatggttcagccactcgtatacctccgtctaccacaaaatccagaccctgtaaaaggaaaccgaaacagagaatagagcaaccaaagatgttctttagtcgctgagaaagagtgagagctataaatacctctggtccatatatgtcacctattgcggttgggtcgatcatccattcattttctttaggccctttcacactgtcattatttaccatacattacacaacttggtcgaagagtccacagtctctctgtagctagtgacgagattttaaagaagaaataaaccttgtgcaaatcaatggggcatccatctgctgcagaatagcttggcagagagcatcatcagatatgcggacacccacgtttttcctagatgcatatttcacacttgtggtgccataacctacacactgtttgggtagttccttgcttgcagtcaagatgaaggtatactgttaaaaaaaaaaaaaatgccaaagatcattgataagaaaactgtttggatattgcgaatatgttgagtatccattagaaaacaagagaagaagaggctctcacaggaccaggtaagcattgcttgacagctcgaaaaacgttagcatgaccatgaccatcaccacgaggaaagcccattgtaaaagtgtcaatatctcgtaaggaacggcataagatgctaagtggctgcataagttgagatggaataatcaaactcaaacctatggaggattcaaattgagcaaagcagaaatatagaacaagtgttccttgcttgcttaccttggaggattcaatctttttaatcctaagaaagagagagagagacacacacgggctaacacgagtcagctcaaaggattggattggaatagaaaagcagcaagagtgagaggtaggtagctaaccttcggagacgctcaacagcggaatggtttttacaatcacaagcaatggcatatctacggagaaacagaaattcaaaaaaaatgcaaaagaggaggaagaagaagaagtaaagaggagaggaagagcttgtttacacggtatcagtgggaataacaccaacagctccttgtttgagaaggtcaatgacaggttggagtttccaggaatcaacaccacaaggatcgacctcgatgtacaccaattccccctccttggtgaaacgaggagtagagtatttgagacgcttagggcttctcttggccgccaacgcgacgatgtatctccgtggagataaagaggcagtgctcggaagcgttgatggtcgccggtgcgtcatcggggaaggaagtagaagaagacgcatcgccgccatacctccgccgtgaagtttggccaccgccatctctcacaatttgtttttgtttgggctcaatttgggctctgtctgttatccacaaattaagagacgcaaacctaaaacgacgccgttccatagttttcctttgaagaagagagagacgtcacaaaggaaagcactcaatcgtcatttcctcggtatctcctcctcgaaagaagaatg

SEQ ID NO: 31321 - DNA, 3000 bp, Unknown
  misc_feature (1)..( 3000): 2750-1469P.txt file - cDNA_ID_3040956; gDNA_ID_1972047; Annot_ID_178258
ccttggcgatcagcaaggtcaggatccgggacagtccaccacccctgaccatggtcctgagcttatatttagtgaagtggaagacgagaaaccaaaagaagtagatttgcttcctgcagtggagagacataagagaattgctcagttgcaagcaaagctgatgcaagcagctgcagagggtgctgttcgggtcaagagacggaggggccctcacagaggcgaggattttactttaactcaagcactcgttaaagccgatttctggctcatcttcttctccctcttgctcggatctggttcgggtctaacggtcatagataaccttgggcagatgagtcagtctctcggttacgataacactcacgtctttgtgtccatgattagcatttggaacttccttggacgcattggaggcggttatttctccgaactcatcgtcaggtatgatactgtcccagaagaatgacaatgacatttggctgtggaattgattgtggttcgaaatgatttgcagggactatgcgtacccaagaccggttgctatagcagtggctcagcttgtaatgtcagtaggacacatcttctttgcatacggatggcctggagctatgcacatcggcacactattgattggacttggctatggtgctcactgggccatcgtcccagccactgcctctgagctctttggtctaaagaagtttggagctttatacaatttcctgacgctggccaacccagcgggatccttagtcttttcggggctgatcgcaagttccatttatgaccgcgaagcagagaggcaagcacaaggatccttgttcaatcctgacgatgtcctgagatgccgaggttccatctgttacttcttgacgtcactcataatgtctggattctgcctcattgcggccgccttgagtatgatccttgtgcaacgtacgaagccggtttacacaaatctctacggcaaaacccgcaactgattttaagataccatattacgaaaatatcccaccaagaaaagaagctgggttctttgagtttcatacctatatatatgattgtgttcatcatcttattctttggcttggtcttccacttccccatacatgtgtatttggttatgtaacgattttttgtgtccggtgttgtgtatggattttgaattcgcatttgtaataattgtattcacattattcatattctccagctacaaggtgtctttgtgtgtagatgtcaaacaaagacctaatctgtgtctgtctctgttttaagtgccagacgccataagatcttggcgcagggaagactcgtcgtcctcaaccaccatccacggcaatataggtccctatacaaaccaaccacacggtcaagttaaggtccttggatggatgaagcacagaatgtttagataatatattaccttcccttcccttatgaccttgggatatggtcctgtcatatccacgatggtggatggttcagccactcgtatacctccgtctaccacaaaatccagaccctgtaaaaggaaaccgaaacagagaatagagcaaccaaagatgttctttagtcgctgagaaagagtgagagctataaatacctctggtccatatatgtcacctattgcggttgggtcgatcatccattcattttctttaggccctttcacactgtcattatttaccatacattacacaacttggtcgaagagtccacagtctctctgtagctagtgacgagattttaaagaagaaataaaccttgtgcaaatcaatggggcatccatctgctgcagaatagcttggcagagagcatcatcagatatgcggacacccacgtttttcctagatgcatatttcacacttgtggtgccataacctacacactgtttgggtagttccttgcttgcagtcaagatgaaggtatactgttaaaaaaaaaaaaaatgccaaagatcattgataagaaaactgtttggatattgcgaatatgttgagtatccattagaaaacaagagaagaagaggctctcacaggaccaggtaagcattgcttgacagctcgaaaaacgttagcatgaccatgaccatcaccacgaggaaagcccattgtaaaagtgtcaatatctcgtaaggaacggcataagatgctaagtggctgcataagttgagatggaataatcaaactcaaacctatggaggattcaaattgagcaaagcagaaatatagaacaagtgttccttgcttgcttaccttggaggattcaatctttttaatcctaagaaagagagagagagacacacacgggctaacacgagtcagctcaaaggattggattggaatagaaaagcagcaagagtgagaggtaggtagctaaccttcggagacgctcaacagcggaatggtttttacaatcacaagcaatggcatatctacggagaaacagaaattcaaaaaaaatgcaaaagaggaggaagaagaagaagtaaagaggagaggaagagcttgtttacacggtatcagtgggaataacaccaacagctccttgtttgagaaggtcaatgacaggttggagtttccaggaatcaacaccacaaggatcgacctcgatgtacaccaattccccctccttggtgaaacgaggagtagagtatttgagacgcttagggcttctcttggccgccaacgcgacgatgtatctccgtggagataaagaggcagtgctcggaagcgttgatggtcgccggtgcgtcatcggggaaggaagtagaagaagacgcatcgccgccatacctccgccgtgaagtttggccaccgccatctctcacaatttgtttttgtttgggctcaatttgggctctgtctgttatccacaaattaagagacgcaaacctaaaacgacgccgttccatagttttcctttgaagaagagagagacgtcacaaaggaaagcactcaatcgtcatttcctcggtatctcctcctcgaaagaagaatg

SEQ ID NO: 31322 - DNA, 3003 bp, Unknown; identical to SEQ ID NO: 31320
  misc_feature (1)..( 3003): 2750-1469P.txt file - cDNA_ID_3040956; gDNA_ID_2684224; Annot_ID_137537

SEQ ID NO: 31323 - DNA, 3000 bp, Unknown; identical to SEQ ID NO: 9265
  misc_feature (1)..( 3000): 2750-1469P.txt file - cDNA_ID_3040964; gDNA_ID_1972047; Annot_ID_178252

SEQ ID NO: 31324 - DNA, 3000 bp, Unknown; identical to SEQ ID NO: 9259
  misc_feature (1)..( 3000): 2750-1469P.txt file - cDNA_ID_3040971; gDNA_ID_1972047; Annot_ID_178249

SEQ ID NO: 31325 - DNA, 3000 bp, Unknown; identical to SEQ ID NO: 9282
  misc_feature (1)..( 3000): 2750-1469P.txt file - cDNA_ID_3041013; gDNA_ID_1972049; Annot_ID_178330

SEQ ID NO: 31326 - DNA, 3003 bp, Unknown
  misc_feature (1)..( 3003): 2750-1469P.txt file - cDNA_ID_3041052; gDNA_ID_1972053; Annot_ID_178370
ttaaccaaatagttcaattaatggaagaggttcagaatctggtcttcggagttgtcatactatttagaaatctggtcttataatctgaacaatcctaatcccacggttcaacaaacttttgacatggatcaaacatataacaaaccattaacgataaaagactcaaatcaagcgaattaaaaaacaagactcaggtcaacaaaccatattagcctacgttgcatcacgataatgaagaataacttatagatccatccccttttgtctcctaattcttaattttttagaaagagatcattattgttctcggatggagatatttagaaaggcaacgattgtacgtctccgtagccacaacgacaaatacctaagtgccgatgaagatcaagaatccgttcatcaagatcgtcgcggcacaacaaaaaacactagatggacggttgagatcgtacctggatccaatgtgatccgtcttcaaagctgttacggcaaataccttaccgccactaatattcatttcctccttggagccaccggcgaaaaggtaggtttatctaggggagattgggttacaagaaaccatctcaaatcaaaattaggattctttttcaataaatttcttgaaaaacaaggcatccaaatccattgataacatttataaacactttgacaaagtaaatcttgcccaagagatatttcaaatgtttaacaacgagaaaacccattcttatgactatagcgcaaacaaaaacgcataaacagaatttttttaaacgtggaaatgtttcttgctaaacaagccgtgtgtgtttcatattcacaaggtacttcaaactctacccgaaaagttggattcatctgcggagtgggagccgctatcagacgatggtgtacacgtacggttcaagagtcgctacggacaatatctgagggcaaacaaaggtgtaccaccgtggagaaactctatcacacacgatattcctagtcgtacggtcacacaagattgggtcatgtggactgttgacgttcttcagattcgagttatcaaagatgatgcagagtctacccacagttcttccactttttcacggattgaggtactactactatatacactacacatacgtgccaataccattcttctgaaaatactagtactaaacattcatcgatacatgatcagtcagatgattcgtttattgtgagtttaccactcaagtccgaaggaaggctaatatattacgagaccggagatgatagtgggaacataaataaggaaataggagaaaaatcattgatattccatggaagcgagttgatagaactaaagaagaagcttgaggaagaaacagagatggaagatgttatgatttggtgtagaaatcctttgaacgaaaagctttgtcctcttcaattgcatcttcctcctaacaacgcaactatgcacatcatcgtctttccttcttcttgcggtactaaacttacctccttcttcattgttaccattatctataatcaaaatattgtttatgcattcctaatttttttcaattgaggatttcgatttccaattaaaactttaggtatattcgagacattgggagtccagagttgttgtttttccgatttcttttggtcggaactctaatgaaaaatccgacacatagttttcttgaaagtctcattattcgtcacgtcagcacaaacttttattcatcccaagtttaactattttaatacagcctctaattgtgtttttgattttttgattttttttttttcgcagagattgacaagtgattgtcaataatatattatcaaattataaccaacttgggaagaagaaaaaaaagattattttgttatttgtgtacgaagaaagaagtcattgtgaagctaatttattcttcatattccaatatatgatagttgataagtacatgtatagttgtatatacaacataatgatctattcgtttaacatttttcttttaaaaatcttggaatgaaaatactgtatgttacctagaattcaaatagaaatcacacctaacgaactagttggtagtagaatcttataattttgtttaatacacaaaataaagtcagacaatctgaaaatgacacataatatgtttttgggtggaacctttttaactctattatgcaaaaacataactttttgggaataagaaaagttgtaaagcaaccaaaaagctaaatgacatatattttttctttctcttaattactgcatattctagaatcctactactagatcttatccttccactttttttttttgttacatattaatttgtcttaaccaaaatatacataggaaaaccttatagggacattatatctatttatgtaacattgatggacgacacacacaatggaccatgtgatattttagttcatatatcaataataaagttttgatcattattattataattatatttgctcgaccatgatagtgtatttaacgtcaagtgtgggtccaatttcggtccaaggatgctgactagaaattagcatttttatagttttctcctaataatatactatttaatgcaaacggcctgtgacgactgaattgtcctctgtctggccccgtgagcttcaccgcagcttttagatattttctttccccgttctttcggattttttttttctccccctctcaagcaaagcattatcgctattgctctgccttgtgagctgcgatcacctgtttactggtaagtctctcctcgtcttctccttcttcttctctgggagatcttctactgttctctctgtgagctgatttgtttggtttcctccatagagctgatcatatcatcatcgttgggaactgacgagatttagtctatattggtgaattatttttgtttatctggttttgattttttgaatctgtgactttagagagaagaacactgcgacgtcgttaaaagtaggttgagagcgagaaaggccgagagaatggagatg

SEQ ID NO: 31327 - DNA, 3000 bp, Unknown
  misc_feature (1)..( 3000): 2750-1469P.txt file - cDNA_ID_3041056; gDNA_ID_2214712; Annot_ID_189909
cagcagaaggcttcatgggctttaatagtttaggtaatgggttagggggaggacagaaggggcttgggttgggcccaatgcgaaaaccctgaggcagcattaggtttagccgccaagcgcatcttctctttgtcaccaacgacgacggcgacggcaaaacggacttagggtttacagctgccgaattgagggcgtcagagacaagatctaaccaaacgaagtttgtttgcgatgaggctcggtctgcagaagttggatcttccaaggtaaagctcttcaacagctccggcgtcaaagcaaagctccgatccagaggggaatagggagatgccggtattgacttcaaggggagccgaggagagggataaaccacggaggtcgcaaagaagataaggggagaactagcacaagaagtgaacgtgttcagaggtatggtggtcaaggtaatctttggatacaaagggagaaaagacaagcgaaacatgggaacacgggagaatagagaacaccagatgacatagccattgagaagagagcgacaagggaacgatagctcccggcaccggcgagcaaacggctctaccggtgccggaatttgtttggaagctttggcctcgatgagagagaatgaatgaaaagaattcagtttaaaaatgtcaaattggtgttctcaattttcaacatacccaataatacaactaaacaatattgaaggcccaataccatatacacgatggcccatctactgcctgatagtatgtagggggtattaatgtcattccaacaagtaggggtagaatcggtaataaggacacaaactcgcctctttcgctttgtctctctcgtctctaagcagtagcagatctgagttttggagagttcaaaggaagaagataactccaataccagaggttcgtaacgatgtgagatttttctctgttgtttatgaagtcttagctcaatttgatcttccaatgaatttcgttaaaatttgctagacttctatcagcgcctgtagatcgatttaggttatgtactctcattcacatcggtgggaagcgatcaatcttagaatccacgttttataatttctcgttttgatcttgtttttttcacaacttgtaaacattgcgatgttgattgtgttgattaatcgcttaaaattgaggtctgagtttaaataatccttgtgcttaccatatggtcttggctgtgataatttgttaattgttctgcttaataatctaacactttgcttcggttaatgtctggatcaacatgctcatggttgtgttccctgttgatttgtattgtaacagtgaaagcattcaggaaacatgcctcctcagaagattgaaactggtcatagcgacactattcatgatgtggtcatggattactatggaaagcgagtagcaactgcctcgtctgactgcacgatcaagataaccggagtaagcaacagcggtggatctcagcatctagctaccttaaccggtcatcgaggtcctgtctggcaagtcgcttgggcgcacccaaagtttggttcacttctcgcttcatgttcctatgatgggcaaattatattatggaaagaaggtaaccaaaaccaatggacacaagctcatgtcttcacagaccacaaagtatctgtcaactctatcgcttgggctcctcatgaacttggactctccttagcttgcggagcatctgatggaaacatatcagttttctcggctcgagctgatggcggttgggacacgacaaagatagaccaagcacaccctgttggtgtcacttcagtgtcgtgggcaccggccacagaaccaggcgcactcgttagctctggtatgatcgatccggtctacaaactagcatccggcgggtgtgatagcacggtgaaagtgtggaagttctcgaacgggtcatggaaaatggattgtttcccggctctcaacaagcacacggattgggtccgtgatgtggcttgggcaccgaacttgggtctcccaaagtcaaccatagccagtggttcagaagatgggaaagtgatcatatggaccatagggaaagaaggtgagcaatgggaaggtactgttttgaaagatttcaaaacaccagtgtggcgggtctcgtggtcgttgaccggtaatttgttggctgtttccgatgggaacaataacgttacagtgtggaaagagtctgttgatggagagtgggaacaagtgactgttgttgagccatagattgttgtttgtttgtttggttatcttttgttttgtggtaatatcaaaatgtggtgtgttctgtatacaatttctagggacctgtttctctctatacgtttctcaggaaagtatattcttatgtattttaatcagacaacagagattgcaaaagaaatgtatttttcataaaactttttaattccgataatgagttttttttactggtatgatgtttttcacatttttacccttttatgagattccgattttggcgtaaattcattgtagtttataaccaaaatttaattgatttcaatataaactcatttttaactaattaatactttaaaaatttaagcctgttcaaccttagttaattgtgtttttaatcgatcaactaattttcaactcattaaccagctcgtttagccagccacttgataaattttaatgctcaattaggcataaaattttgatttacgaaattttgccgatggcgctcaaaaaatgctaatccggctctgcatcgatttataatatttaccctttcaatactccgtgtagttaagaggatcgagggtatttgcgtcattaacagtgataacaagtgctaaagcgatgaatgaagcgcctattttcacaattcgaaatctctctccccccgctttggccccaaaaagttttttttttttttttttaattgctaagacaaatatccgaatctcagaaatttctcgtcctctttctctgttttttgtttctggggaaaatg

SEQ ID NO: 31328 - DNA, 3003 bp, Unknown
  misc_feature (1)..( 3003): 2750-1469P.txt file - cDNA_ID_3041056; gDNA_ID_1972053; Annot_ID_178358
acccagcagaaggcttcatgggctttaatagtttaggtaatgggttagggggaggacagaaggggcttgggttgggcccaatgcgaaaaccctgaggcagcattaggtttagccgccaagcgcatcttctctttgtcaccaacgacgacggcgacggcaaaacggacttagggtttacagctgccgaattgagggcgtcagagacaagatctaaccaaacgaagtttgtttgcgatgaggctcggtctgcagaagttggatcttccaaggtaaagctcttcaacagctccggcgtcaaagcaaagctccgatccagaggggaatagggagatgccggtattgacttcaaggggagccgaggagagggataaaccacggaggtcgcaaagaagataaggggagaactagcacaagaagtgaacgtgttcagaggtatggtggtcaaggtaatctttggatacaaagggagaaaagacaagcgaaacatgggaacacgggagaatagagaacaccagatgacatagccattgagaagagagcgacaagggaacgatagctcccggcaccggcgagcaaacggctctaccggtgccggaatttgtttggaagctttggcctcgatgagagagaatgaatgaaaagaattcagtttaaaaatgtcaaattggtgttctcaattttcaacatacccaataatacaactaaacaatattgaaggcccaataccatatacacgatggcccatctactgcctgatagtatgtagggggtattaatgtcattccaacaagtaggggtagaatcggtaataaggacacaaactcgcctctttcgctttgtctctctcgtctctaagcagtagcagatctgagttttggagagttcaaaggaagaagataactccaataccagaggttcgtaacgatgtgagatttttctctgttgtttatgaagtcttagctcaatttgatcttccaatgaatttcgttaaaatttgctagacttctatcagcgcctgtagatcgatttaggttatgtactctcattcacatcggtgggaagcgatcaatcttagaatccacgttttataatttctcgttttgatcttgtttttttcacaacttgtaaacattgcgatgttgattgtgttgattaatcgcttaaaattgaggtctgagtttaaataatccttgtgcttaccatatggtcttggctgtgataatttgttaattgttctgcttaataatctaacactttgcttcggttaatgtctggatcaacatgctcatggttgtgttccctgttgatttgtattgtaacagtgaaagcattcaggaaacatgcctcctcagaagattgaaactggtcatagcgacactattcatgatgtggtcatggattactatggaaagcgagtagcaactgcctcgtctgactgcacgatcaagataaccggagtaagcaacagcggtggatctcagcatctagctaccttaaccggtcatcgaggtcctgtctggcaagtcgcttgggcgcacccaaagtttggttcacttctcgcttcatgttcctatgatgggcaaattatattatggaaagaaggtaaccaaaaccaatggacacaagctcatgtcttcacagaccacaaagtatctgtcaactctatcgcttgggctcctcatgaacttggactctccttagcttgcggagcatctgatggaaacatatcagttttctcggctcgagctgatggcggttgggacacgacaaagatagaccaagcacaccctgttggtgtcacttcagtgtcgtgggcaccggccacagaaccaggcgcactcgttagctctggtatgatcgatccggtctacaaactagcatccggcgggtgtgatagcacggtgaaagtgtggaagttctcgaacgggtcatggaaaatggattgtttcccggctctcaacaagcacacggattgggtccgtgatgtggcttgggcaccgaacttgggtctcccaaagtcaaccatagccagtggttcagaagatgggaaagtgatcatatggaccatagggaaagaaggtgagcaatgggaaggtactgttttgaaagatttcaaaacaccagtgtggcgggtctcgtggtcgttgaccggtaatttgttggctgtttccgatgggaacaataacgttacagtgtggaaagagtctgttgatggagagtgggaacaagtgactgttgttgagccatagattgttgtttgtttgtttggttatcttttgttttgtggtaatatcaaaatgtggtgtgttctgtatacaatttctagggacctgtttctctctatacgtttctcaggaaagtatattcttatgtattttaatcagacaacagagattgcaaaagaaatgtatttttcataaaactttttaattccgataatgagttttttttactggtatgatgtttttcacatttttacccttttatgagattccgattttggcgtaaattcattgtagtttataaccaaaatttaattgatttcaatataaactcatttttaactaattaatactttaaaaatttaagcctgttcaaccttagttaattgtgtttttaatcgatcaactaattttcaactcattaaccagctcgtttagccagccacttgataaattttaatgctcaattaggcataaaattttgatttacgaaattttgccgatggcgctcaaaaaatgctaatccggctctgcatcgatttataatatttaccctttcaatactccgtgtagttaagaggatcgagggtatttgcgtcattaacagtgataacaagtgctaaagcgatgaatgaagcgcctattttcacaattcgaaatctctctccccccgctttggccccaaaaagttttttttttttttttttaattgctaagacaaatatccgaatctcagaaatttctcgtcctctttctctgttttttgtttctggggaaaatg

SEQ ID NO: 31329 - DNA, 3000 bp, Unknown; identical to SEQ ID NO: 9245
  misc_feature (1)..( 3000): 2750-1469P.txt file - cDNA_ID_3041090; gDNA_ID_1972029; Annot_ID_178197

SEQ ID NO: 31330 - DNA, 3000 bp, Unknown; identical to SEQ ID NO: 9296
  misc_feature (1)..( 3000): 2750-1469P.txt file - cDNA_ID_3041094; gDNA_ID_1972067; Annot_ID_178430

SEQ ID NO: 31331 - DNA, 3003 bp, Unknown
  misc_feature (1)..( 3003): 2750-1469P.txt file - cDNA_ID_3041096; gDNA_ID_1972067; Annot_ID_178429
tatacaacaatctcagaaaaggaaaaaaaaagaagcacagttgaaagaaccaaaaatggagaaactaacttttctcagccttctcctgcatttcgtcgtcttcatcgcttcaacgataccgtcttcatcgttcctcttgaatgatcgcacctttgagagatcgaacttgccgtctacgcgcgcggagaagctgatccgtgagctaaaccttttcccgcagcaggatctgaatgtgatcgatgtcgctgatttgcctctcactgctgcggagggaccggggattgttgaacggaagttcgtattcccgaatatacttgccgatggtggccctactgtcgacgatttaggtcatcatgctggttattacaagctcccgaaatctcgtggcgcaaggtttatatctgactttagattttggttcataggtatatagaagcttgcagctagctcttgactaggttatgtttgattcgattagaacattggactgttggtgacgtttttctaattggaatctcaaagtagtgggaatagattataaatgtttgtttgctttgtttgttgatttgtttgcttggtgtgtgttagcatgttctacttcttcttcgagtcacggaacaagaaggatgctcctgttgtgatttggttgacgggagggcctggatgtagtagtgagttggctgtgttctatgagaatggtcctttcaagatcactagtaacatgtctcttgcttggaatgagtatggatgggatcaggtattattactttctattataatcccaaaccgccttaatattccagattattgcacatgagagttgatagagagtttgtcttgcaggtttccaatcttctgtatgttgatcagcctgttggaactggtttcagctacacgacagataaaagtgatatccgtcatgacgaaactggagttagcaatgatctttatgattttctgcaggttaggtcactggatcttctcttgaattcctttctatactgcacttttctgctttaaagctatgaattggataaacaacaactctgttagactgttttggttttcttgagtcttcgaaaaaatgggaatctgcctttgtttgcttagctgtgtaacaagatcttgatgaagtttgctgatgttacctcaggctttctttgcggagcaccctaagttggcaaaaaacgacttttatattactggagagtcatatgctgggcactatatcccagcttttgcttcccgagtccataaaggaaacaaggctaatgagggagttcatattaacctaaaggcatgtgactatttcttgtttctctcttaaggtgttaatggaagtctgtagtactcacaagtataaccttgcagggattcgctattggaaatgggcttacagatcctgcactccaatacccagcctatcctgactacgctttggaaatgggtctaatcacgcaaaaagagcatgatcgcttagaaaagattgtcccactgtgcgaactatcaatcaagctttgtggtacttactcctttattccttatcaatttatctttaaaattgctctgtgtttgatgaatcctgaatccgtgtttttgttttaccaggaactgatggcacaacttcttgtttggcatcatatcttgtctgcaactctttgttcagtggtgtaatgagtcatgctggtggagtaaacgtaagcccaaaagaactgctcaatttttattgctcgttggatttctagatataattcgttctggcaaaccatttctatccttacttgtagaaagaaattgtgtttcatatttctgcatttgaagtaaggaaacaaggctaatgagggagttcacatatctttgtgtagtattacgacatcaggaagaagtgcgtgggaagtttgtgctacgatttctcaaacatggagaaatttttgaatctgcaatctgtgaggaagtcacttggtgttggggacatagactttgtctcctgcagtacttcagtctatcaggcaatgcttgtagattggatgaggaatctcgaggttggaattcccacgctcttggaagatggaatcagcctccttgtgtatgctggagaatatgatcttatctgcaactggctcggtaagttccaaaacatagataatcaaatccagacatgaaaataatgaaatagattgatttgaactgttgagggaaacaaaattggagcaggtaactcgaggtgggtgaatgcaatggagtggtcagggaaaacaaactttggggcggctaaagaagttccgtttattgtggatggcaaagaagcaggcttgttaaagacttatgaacaactcagtttcctcaaggtcggcctttcttgcataataacaacagtcgttctttggttctactggttttcttatagtatgtaacaacaacaaagggtttgatgatttaaacataaaaacacaggtgagagatgcaggacacatggttccaatggaccagcctaaagctgcattgaaaatgctgaagcgatggatggagaattcacttatcgaagatgctactgtgactgttgctgctcagggaggagaggaactggttgctcagatgtgatcacatcttcttttgcgttgcatgaaaacaaaaggcagcaaacataaaacaatgtgtgagcaattgacgttttcttctgtaatttgatctcataagtcataagaaagatacagtatatgtaggggttgcccaatttcgttataaaatcaaactctgctgacaccaaaaacataataattactacgaaatgtgttatctatgtttgtttccgaaataacgaaatgtataaaacaaaacttaaaacgttgtttatacaaaataaagccgaggtaggcttgcaagagtaatgaacaggttttgatgcggtttatgtacatgacacatggcaaaacatgattggctacatgaacgattttatctaacaagcaagatagagatgagattaggagacaaggagcaatg

SEQ ID NO: 31332 - DNA, 3003 bp, Unknown
  misc_feature (1)..( 3003): 2750-1469P.txt file - cDNA_ID_3041098; gDNA_ID_1972067; Annot_ID_178428
actaacttatgaggaacatcgtcttcgccacgaatttgacggatctcaaatggagcggatttccctataataacaaagaagtttgttcggtttggttttaccatttgttaactcaattacactttattgggagaggaagtcttttaagttttaacttaccagctagtatagcatcaacggtaacatctagtctttgatgaacacgacactcagttctcgatatcatctctacagcacaagtgaatgtcggaggtccttttctttcaagaattgtcttctgcacttttcttttccttgcttcttcatcaccaagagtcacactctgggcaaaataaattcaaattaaggttagagaagataaacaacagaacaaaataagaagcaaagttgttgtctaaggttttacctcaattccaccaataagaatctgcaaagaaggatttttgattatgttgtctatagtcatcccatgagcagttgcaacaagctgaacacctcgttgagcaatagtgctagcagctaaagcttcaagctcagttcctatctcgtcaatgatgattgtctcaggcatatgattctcaaccgcctcaatcataacctgcataaagaacttgttaatacagcaagatccttttgattccatcctacaccatattattacaaggttataaagttgcgagacatacatcgtgctgtaaattcacatttggaacttgcatccgcctggcacgaccaattccagaatgaggaacatcaccatcacctccaatctcatttgacgtgtcaacaatcactacacgtttcctgtgttcatcagctaacatccgtgcaatttctctgtacaaaacaaaccaatcttgtcatataccatttatcaatcacagttttaacagaaagatcatcacattataagttcatattgatgtacctgattaaagttgttttgccaactccaggagatccaatgaccaagatggatcctcctccttcaatcaagtctcttataatttctgcacttccagagactactcgacccactcgacatgttagaccaattacttgcagtttgcgattacgtatagcgcttatacgatgcaaagatctgtcaatcccggatcggttatcatccgaaaaatcaccaacctaaattcaaaacattttgattcagacacagaagagaccataatcagtataagcaagtcttatcagtcttgaagaactgcaataagctaaaacatttgagaaattagttgcatgtcttagatcagagacacacatacctttgataccgcaagctccagatcctggtgtgtcacaggctgctctgagatcacccaatcgccggaagggaatctagcaagtggctttctccctaaatccatcactacttcgatcaattcctcaatcgcctcgtgcttaacaagctccttcctcgtcgccggaggaagaatctctaggaaagcgtcgagctccaccgtaggcggagccgtcgtcggtgacttccgtgatgagatcgatgaatcagatgacggtgaccgaacatcgaaactgaatccatcagatggtctccgaacaggagacggtgacgacgccggggatttcgatgaagcgattctctgacgcgcaccacgtgtccgacggaatgaggaagaggaatcagatgaaaaagcggttgcggtggctgagattaaccggcgcgaagcttgccaggagctgttgatgtcgatcagaactagccgcgaattcaacgccctcatcacgattaattaattattttttttaattatgtactttcaaataaaaaatgaattaaataaaagattctgtcttttcgttttagctactggtgtgtatatctgtctggaaagcagaaatgaagaagctaaaaaggaaaagctgaggaggagaagagctatgaagcacaacgaaacgacaacgttttgagtattagttcttttttcatttcatttttttggaatatgatgatgcgtgaagactgaaactagtggaagattccaaaggatcaaagcatctaattacacagaaactgcatctgtatagaacaaagtagggtccattgtagagggaaagatgataacatagccgttcaagcaactggttcacgtggcgccacgtggagagttggacaatcttgttgacacgtgtctgactatggagctaccgtttattgccaattcgtttggaactctttgacaaatttagcccaaagtcggagttggtgtttctcgcacggcagatgcaaaagtcgtcaactttttagctctgcaaattgagatttgaaccaaaattgctgactaaattaaaccaaacaaaaaccagactaaatgaatgaaatacaagtcaacccaaacattgtgtatctacaacgacggttccttaatttcttgagtcatcttcgttttttagccgaatgggcttttaggtgctttacaaatagtggtttaggattgggccttctaatcagaaacacaccttgtagaatattacattcactataaaatgtaaggtttacattcacgtgaggcccataagtgtttttgtaataattaatttaatatatagtgtaaacttaatattaatatcaaaccgaccttagctcagttggtagagcggaagactgtaatgggtaattccaaagaaatctttaggtcgctggttcgattccggcaggttgaatatttttaacattttatttcacttttaaattatctgggacccacactcatccatcttttgcttcacattcaactcgcgtgcctaaccgtcgattactacgccaaacgttatctttgttgtaacgtaacagattcacccactatttctcatatttcgcaaaatagccccaactttctcgggcacgtatcggaagatatttctgtgatagttcctgccacgtgtacattctctcctcccccaaattgttgtatacaacaatctcagaaaaggaaaaaaaaagaagcacagttgaaagaaccaaaaatg

SEQ ID NO: 31333 - DNA, 3003 bp, Unknown
  misc_feature (1)..( 3003): 2750-1469P.txt file - cDNA_ID_3041106; gDNA_ID_2214468; Annot_ID_182903
ggtatgttatcgatttgtatgtaattttcgatcaccataattgtaaactaagttaatcactcgtttgccaaaaaaaaaaaaagttaatcacttaaaaaattgccacattttctttccaggagcaaacccttccatgtacgcgtcatgcatcaaaagtcaaggtacttatgattattggcttttgtacttatggaataggacatttcgaccctactgctccattgttcttatgttttcttctgcattgttgtgaccttcaggctcaagcaaatgcttgtggtggggcttgcaaaacctttcagccaaatgatgcagatcatgagcatggtaagataaatcacagtcaaagatgaaatgtaactctttcggttttcattgttggttctaggaatctcttagcgtgatcacccttattgacttttttgtttcattttcagcttccgggagctccaacgctaactcattgcaaagaaatgagaaagccaacagtaaaaggttgggtctctcttgatgtttcaaccattgtcttataaaaacttttggacaatcttgttatcctggatttcttgcttttctttataggagagtttctggaaggaagaatcccgccaattccgaggtattagatataattggcagatcgggagagacatgtcagatggaagacaacattgacaacaagaagttggtctctgatagtgacaatgatgctgaaaaccatataaatgacaatgtccaaagcaaaaggtttatttattcaaagcgattagataacgtaaatatatatttgtatttcactatcttatttttgcttcttcttttttgggttgtttttgctacagatattgtgcaggaagacagagtagcagttctaagactcgagaagccagccaaacagaaaccttgcaaaaggtggttgacgccaaagaaattaagggggatgcaaggtttgtttaactgcctttttccactttcaaatttgggaatagcattcaaagtggatgaagaatagtggaactgacttgtgagtatacactttctctgtttcaaacaggttttctttgacaaagcattctgactggttaaaatctcaagaacctgagccatctgaaagcctatacgagtcaaggttggttaactgtcctttttccagtttcaaattttggactaacatctaaagcctgtgaagactattggaaatgactagtgattttgcactctttgtttcaagcaggttccctttgagaaggcgttctgcccggttaaaatctcaagaacctgagccatctgaaagcttccatgactcaatagagacaaccaagaggaggaggtcggcaataaggttaggctctgtttataactactgtacccttctgaaggttgatatagtgcgatatgatcttttgcaggtctgctatgtttaatatccaagagctgggcgttattcaaaacttgaacggtttacctgatgatcaagagattgctgcaaaggccaggtttgtagaagcacatgttatttccttttccactaacatatccctgaaccaagtacacttatgccatttgcggtgttttctttttctttctttgtggatgtcatttcagatgctctgcacgtgaacagtctaccgggtctaaacccgaagcagtagaaccacatgacacaaaagagataatcgggaaaagcaggttttgtagtgatagataattgtctgtattctgcagtattacagactaaagtgttaagactgttatctaatgcgattttattttccgcaggatatctttgagaagacagtctgcgaggtttaatttccaagagctgggcgtgactgaaaacttgaatggtccacatgatgatcaaacgattgctgcaaatgccaggtttgtagtagcttcacatgttctttccttttccaatcctcttgacttataacttattcataaaccaagtacatttatgctacttcctctgatttctttatggatgtcattttagatgctgtgcaagtgaacagtctatcgggtctaaacccgaagcagtagaaccacatgacattgaagagagaatcgggaaaatcaggtttgtagtgaatatagatcaattttctatattccgttaaagtaaagacgtaagaatttttatctaaactggtatacttgacagagtctcttcaagaagacaatctgcaaacattgaaactccgagagccatcaaagaacctgcaaatccgcctttgcatgatgacaatgttgaggagtctagtcagatatcatgttcagtttcaatggagcttaaaagagaatcaaagaagaaaccaacaggcgacgaatcagaggaaatgagaaaaacaactgttggaagaccttcaaggcaagctgctgaaaaaatcaaatcgtacaaggaaccttcacttaaggagaagatgcgagggggcttctgagtcttgctaagatcgaataccctctcgtcagcctcgtatgtattggattctgcgacttcacttttgttcagtgagctattgctcaatgctgtagatcacaatgtatattcgtagttgcttgtagataaagctagcgagtggtcttgctactgtacatgaagcggattggacggtttaattcggtttgatggagaacccctctgtgtactctgctaagtaaattctttcacaatctcatttgtaaaggggtgaaataatattttcttcatttttttcttacagtaaataaattagtaaaaacaagctctctaattatatcatgggtaataaaactcgagcggtggtaaaacaaaaacctgacagttttgagttgacaacgaaccccataattcaaagattgggagacagtgaaaagtacacaagtgaatcacggtacgcaatctaccgccttatttcttaaaagataattctaaggatttttgttcttttcttgttgttttcctataaaaggtttaataattgttactttaaaggttttgatttatcagataaacgaatg

SEQ ID NO: 31334 - DNA, 3000 bp, Unknown; identical to SEQ ID NO: 9293
  misc_feature (1)..( 3000): 2750-1469P.txt file - cDNA_ID_3041106; gDNA_ID_1972067; Annot_ID_178424

SEQ ID NO: 31335 - DNA, 3003 bp, Unknown
  misc_feature (1)..( 3003): 2750-1469P.txt file - cDNA_ID_3041114; gDNA_ID_2214468; Annot_ID_182906
cgttaagagagcgaggagcgcggttgtgtcgttagatttagatctgaatctacctgccccggaagatgagaatcgggtcaacggattaagctttgcttcaaagcaagaacacgaacaagaacatgaacaaacacaacagaagaaacagagagaagaacaaaagtctcttgtcttgtcttctgctcctacattggtggattgccattactaaaatcaaaattcattaatacctaatcaaacaaaattaagcagaaattgatgaaccatttttttaagaaagttactgattccttgctttgtacaagacttgcaagattcttctctcttttttttcctttcttacttccttaatttcaaaggaaaaaccatatattatacaaatatatatactcccattaggcatatgcaatgctttgtaattacatccaagttaatgtaagatcttttggttacacaatataaataataaaaaccacattcgtttactattggggctttctcataaagagaccacattcccaacatccttctttgtatatatttaaatgaatcaactaaaatacatagaaataaaaaatttctctatactattattttcagttgatccattcaaatcattttctaaaaacttatgtcacgttcatgtatacttttagttaaagaatgtttttttttttttggattggaaaaaaaaaaagctcaaaccttttaagaaaataaagctcatgaaaagagcgtgacgggtccaactcttttttttggttaaatttgcaatttaaacagattacttgttcatgttgacattgaaatagcaggtcgagagcgagagatcaaaatgcaatgtattatgcccttaatttatgcttttatatattttgtttattaatgtcacatatcttattatggatatactttgcaacggatcacaaatcttaccctgaaatatgcaacctgttaccggaattgaaatttcataacacactattctcagctcttcaagattcagtgtttcattcgtgaagacgaatgcatgttgttctagtctcgatacgagaaactgcgtttatgaaaataagaaaaagaagaataaattagcatgggcttgatttacacccgtccgtcaccgaaatgggctacaaataaatcatgggcttttaatattctaacttagaagaaatttggcccattgcttaaacacgaggcacaaaccatatattttttttgagccaaaaaaaaaagtcttgatattttagcattttgtcctttttggagacagtggtgtcagatagctgacaacctatataaataaataaataaaatagagttttcttttactcttactttctttattagtttcataataatatgtgtaaaagtaagagttggatatttttcgttttaatttctgccttcgaattagttacgcatacaaagcataagagacaagagacatagcgtaccaaaaaagaagaaaatagtgcaaaaatatcatatagttttctggtacgcctcatcaattccacccccgtacaccataattatatagaatttcaatatcgaaatgtcgacagcaacaaaattcaacatgtcgaataatattgttttaaatattccattttactagaagatgaaaaaaagagagaagaaagtaaccttttgtctttgtcaccttgacttaaacagtaatacaaaccccacaagtaaattattcaagttcaaatcgtagttaatgtttatatttgagaattgcaaatggtttaaacgaaaaccaaactacgaattacaaatttgaagaggacttgtactagaaaataaatagagaaaagaagaataataaatagtaacagaaaatgggaaagatgatgattcgtgtggaccaagtctctcctcccctttagcttgccttattggtaaagtatcctcctgcaagcaaacgtatctgtcactccttttttattttctttcaccttctatcttattctcattaattcttcttttttggtcaacttcatgtatagaaaataataccaaaattttttgatatagtaaaactattagaactgaatttcaaacaaaaataatacaaatttaagcaaaaaaatattaaaaataaattttaaagaatatttttacatataataaatatacatagttgatacttttatataattattaatttatgatattaatgagaccatatatttacatagaacattcaaaataattattatcttattaatctatcgatatatatcactttttatactagtttttggaatcttaataatttattaatttgtagaagttattaatttatagaggttttactgtacatgtcagcatttaacttttgataagcacaaaaccattacatattttccaaccagattattttctatttatcctagcgtttgtaaatctttgaactacaataatttatcaaatacaatataagatttttatactaaagatgtatacaatgcatttaacattaaaggaaacaaataaactctaatcttttaaaaaaatactttaccttttaaaaagagttattaatcacataagcaatatttaatttttcattatttttttcatcatctgtctaacatattactttttaaaaaatatttatcgttggatacttacttttcagaccacacactaggactagtggttcctttattttactgcatagaacgacaacaaaaagctaagcagtaacattttttagggttttattactgcaacactcaaaaatgagaaattattattaaaattgaaaatgaaaaatagtaatcgcaatccgaaattactttttttctagccttctaggaactcgaaaagaaagcaaatttcttgcaattgaaggtacctgcttctctttttctggtttgtctggtttcatattaaaaaaaacattttgacaactatatttctggtttgtctgaaaaaattgagaagaaaacctagaaacaaatacggtcttttttttttctttttatg

SEQ ID NO: 31336 - DNA, 3000 bp, Unknown; identical to SEQ ID NO: 9298
  misc_feature (1)..( 3000): 2750-1469P.txt file - cDNA_ID_3041114; gDNA_ID_1972067; Annot_ID_178418

SEQ ID NO: 31337 - DNA, 3003 bp, Unknown
  misc_feature (1)..( 3003): 2750-1469P.txt file - cDNA_ID_3041118; gDNA_ID_2214468; Annot_ID_182908
agtgttttcgagattgaagacaagggaccaagaatggtacttctacagtgcattagataagaagtatggaaacggtgctaggatgaaccgagcaactaacagagggtactggaaagctactggaaaagacagagaaatccgccgtgacattctgcttctcggtatgaaaaagacacttgttttccacagtgggcgtgcaccagacgggcttcggactaattgggttatgcatgagtatcgccttgtggaatatgaaaccgagaaaaacggaaacctggtggtactgtattgtccaaattactttcgaatttggtttatctgataatttccaaaagatctcaattctttgtttgggtgcagcaagatgcatatgtgttgtgtagagtcttccacaagaataacattgggccaccaagtgggaacagatatgctccgttcatggaagaggaatgggctgatgatgaaggagctctgattccaggaatagacgttaagctcaggctagagccgccgccagtagccaatggaaacgaccagatggaccaggtttgtgatttcttcttactctggcttcattacccaaaccttattagtttcattcaatatttcttgtatgcaaaaaactctgttgaaatactctctttcttagttttccattgggctgagtgagtttatttaactgcattagtctatttatgaaccaatctactatttcaacgttatttagtgcaaatgtacaaatttatctgatgcatcatttctcttgtttcacaagatattatatttattatctgcaaaactctgtgttgaagtgaagcttctcctaataactgtttcagcgggctgtgacgctagtaactccatttagtctgtaaccaactcttgtagaaatcaaccttataggtttatctgatgaatcaactctcttgatttagaagatatctgaattttcggtggtcttttttttttttgtttcttgggctttattcttaatcatactgattacaagatcgttcaaactttgcatcctcatttgaccagcaattttactgtgcatcatatgaactcacttaattgatcagtaaatgttgaccagaagtagaatgatttgttgttttagtgaaaatgcagttttaatccttcatcagcaaaattgattgaagcatttggtttcagataatttatgcgtcgtctggggttcacttgtaatttgttgtaggaaatccagtcagccagcaagagtctcatcaacatcaatgagccaccgagagagacagctccactggatatcgaatcggaccaacagaatcatcatgagaatgacctcaagccggaggagcataacaacaataataattatgatgaaaacgaggaaacactcaaacgcgagcagatggaagaagaggagcgtcctcctcgacctgtatgcgttctcaacaaagaagctccattacctcttctgcaatacaaacgtagacgccaaagcgagtccaacaacaactcaagcaggaacacacaggaccattgttcgtccacaacaacaactgtcgacaatacaaccactttaatctcatcatctgccgctgccaccaacactgccatctctgcattgcttgagttctcactcatgggtatctccgacaagaaagaaaagccgcagcaaccgctacgtcctcacaaggaacctttgcctcctcaaactccacttgcatctcctgaagagaaggttaatgatctccagaaggagattcaccagatgtctgttgaaagagaaactttcaagcttgaaatgatgagtgcagaagctatgatcagtattctccagtcaaggatcgatgcgctgcgtcaggagaacgaggaactcaagaagaacaatgctaatggacaataaaggctctaaaaacatctctccaggttacttcttattgcccttcgccttttatttagctttaatctccctaatactatgacccatctacatagctcctctagacagattgcgaactgtgtgaatctctgttgtaacataggataaaacggattcgagcccctgagctgagtgttttatccttcttctttttttgtgtggatgttcttgcatcttttgagaacattttttaggttgctccattgtcatatatcatctatctatctagtcttttcagacaaaaactatctttaagttgtctcgagaatgttgtcttcataacacactgagccttctctggggtagtagtggttaggtacgagggcataattgtcatttcctttgcattatcatttagatttccagacaagaagaactttctttgtttaaaataattgggaattatgttcggtctccggtaataccgtggttaatggtaaggatattttcggctaggattacgaatgtggatgcgtcagcgacgttagaagactttcgttacacgtaatttgcaataattttaaaaaagcgaaaaagtgtttggtacgattttttcaacttcaaatatattctctatttatttactctattcaaacaaaattgcatatagtatagaattttagtcatcttgatatttattgaagtggataaatcttcatttgcgcgaaccaaccaactacctcaacaaattctagagactttaaaattgatgactagtgcaagacttccacgtgtcagtttaataaagactgtcacccgaaaacagtcacagccagtcacatgatatgctctcgcggcacactttcctggaatattaaaacctcacggcgtgaaacttctttcgcacattttctagctacggtcgcttagctccgattggttcgtcgtcaccatcactcgtcttcaacgatttgcttcttttttttttctctctatttagtcccattttcctcaatttctaaaccccttatttcgaaatcattgttttgctctttcttttgattcgaattcgacagaacagctcttttaagttattcataaaccttgtgtttgagttttggtccatcgagtatatg

SEQ ID NO: 31338 - DNA, 3000 bp, Unknown; identical to SEQ ID NO: 9292
  misc_feature (1)..( 3000): 2750-1469P.txt file - cDNA_ID_3041118; gDNA_ID_1972067; Annot_ID_178416

SEQ ID NO: 31339 - DNA, 3003 bp, Unknown
  misc_feature (1)..( 3003): 2750-1469P.txt file - cDNA_ID_3041151; gDNA_ID_1972067; Annot_ID_178389
cagtccccagttgagatccctggtgttagcaatatggatttcttgaatatggcattcaatgctcggaaaagaaagcttggtcagccagagcttgatccaatccaggtgccttatcgaattaaatgacttggatttggtttgcactgtttcttacttgttgttgtttgctaaatggtcccaattgtagaactgtctatgtattatgtcttactgatatcacatggctcatgcagttctacagccacttggtatcaaaactcgaagttgtgaatatgaagaccgattttctcaacagaaatgtcaatgaaggatttagtggtggtgaaaggaaacgcaatgagattctacagttagcggtaatggttctgcttcccttgtttctcagtatccataaggactgcatatgataagaaacaaatgtgattagagaaggtagtggattactaagcttgttccatgctacagtgtgcaaaaccacaaggctaatagttaggaatttcaggatatctgggtagattagcttaagcagttacaggttttaccataagtagacgcggttattgcatggcagttagtattctattacaagtatttgactgcagttttagctaaaaagacatggcatgttatatgtcttcatatctctttatattttcctgatcttgaaatatctgcctcccaaggagtggtcatttctggtttatcgataacatgagaacactattagtctcctattctttgtaagcaatatatggaaagaggtcatggaagtacgctaatgcaacgttttcctgtccttgcaggtccttggagctgagttggctatactggacgagattgattcagggttggatgttgatgctcttcaagatgtggcaaaggcggtgaacgggcttttgacaccaaaaaactctgttctgatgataacgcactaccaacgcctacttgactacatcaaaccaactctcatacatatcatggtgagcattgttgccaaaccagccttctttactggctacacaatgatcatatatattttggtaagctcatgtatgtttccttgggtttcaggagaatgggagaatcattaaaaccggagacaactccttggccaaactactggaaaaggaaggctacaaagcgatatccggttagttatcgcggatcatacatataacctgtcttccttctttgagagaccatggttattatatgggacaaatacaatggaagctaaagctgatgattggaaactgaaatctatcactacaatctttgacccgtagttttggtttgcaatttgcatgacaaactactttattgggatgtgaacagtattccacacctttttgtaactaacaagtttaaaattcagttaataaattttgttattataaatgctcttataaagtttgagactttaagtggatcaaatccaatcaaacctagtggttacttacattacttgagaaatttgacaaaataaaatttaatttgattattctatcgcctgctgctgctggaacgagttggtaatagaaaacaaattcataatttatgacaagaagaacgcaaaattcgctgatgattattaaacccaaacgcgtttttcaaactcgttcaatcaatttccttcatcatcttcatcttcttcgtaattgacttatcgaacaagattacacctccctttagctttttatgcaaatgtagtgcttttaagcattctctcgatttccctcccttattttccgacaaataccaaaccaatattgttccttttcttttcaatcccagatcgatctctttgttttcagacaatttctgttgtctggattcggttcattgcatcgttctttgtgttgggttcgtttaaactttcgattttcccattttgaaaattttgatttttttcttgtggcagattgattgttgttgtgcaagattcatccgttgcatcgacccgagtagggtttttgcttgttccatcggtgttcggagtttttaaaatcattgcctgatccggagtgatcaaatcctatatattgtcgttgcacaagagaaccaagtcttagattataaagagatttgactttcacttttagtgtctatgatcattaggaatgagatcagatcaggtcaatttgtgttcttttgatcagatcttgatgtggaaagcttgatgctgttgattataagtagagagatattttgatgggtaatgcttgcgttggaccaaacatttctggaaatggtttcttgcaaactgttacggctgcaatgtggaggccacggatcggagctgagcaagcttcttcttcttcccatggtaatggacaagtttctaaagaagcagcttcagaaccagctactgatcaagtccagaataaaccccctgagcctatcacaatgccaagctcaaagaccaatcccgaaactaaactgaaacccgatctagagatccaacctgaagaaaagaaggagaaagttcttgcagaagaaaccaagcagaaagttgttcctgaagaaagtaagcaggaagttcctcctgaagaaagtaagcgggaagttgttgtgcagccggagtcagcaaaaccagaaacaaagtctgaatccaagccagagacaacaaaaccagaaacaacgtctgaaaccaagccagagacgaaagctgaacctcagaagcctaaacatatgaggagagtgtccagtgcagggcttagaactgagtcagtgttgcagaggaaaactgaaaactttaaggagttctattcattagggaggaaacttggacaagggcaatttgggacgacgtttttatgccttgagaaaggtactgggaacgaatatgcgtgcaagtcgatttccaagaggaagcttttgactgatgaggatgttgaagatgtgagaagagagattcagataatgcatcacttggctggtcatccgaatgttatatctattaaaggtgcttatgaggatgttgttgcggtacatcttgtgatg

SEQ ID NO: 31340 - DNA, 3003 bp, Unknown; identical to SEQ ID NO: 27198
  misc_feature (1)..( 3003): 2750-1469P.txt file - cDNA_ID_3041155; gDNA_ID_1972067; Annot_ID_178388

SEQ ID NO: 31341 - DNA, 3003 bp, Unknown; identical to SEQ ID NO: 27200
  misc_feature (1)..( 3003): 2750-1469P.txt file - cDNA_ID_3041159; gDNA_ID_2684220; Annot_ID_191827

SEQ ID NO: 31342 - DNA, 3003 bp, Unknown
  misc_feature (1)..( 3003): 2750-1469P.txt file - cDNA_ID_3041167; gDNA_ID_2926133; Annot_ID_197034
ccgagctgagaatgaggatggaatttccaccctattctaccttcaaagaatttatgaagatgaatgggtgaattttctggagcggatgcgtagagagggagcagagaatgagaatgatatctggtcaaagaaggttagagatcttcgcctctgggcttcatataggggacaaacattgtccagaacagtgcgagggatgatgtattattatagtgccttgaagaaacttgcctttcttgattctgcttctgaaatggacatcaggatgggaactcagattgcccctgaggcacgccgttcgtactacacaaatgatggtggggataacacactgcaaccaacaccttctcaggaaattagcagaatggctagtggtataacccacttgcttaaagggtctgagtatgggagtgcaatgatgaaattcacatatgttgtggcatgccaagtttatgggcaacataaagcaagaggggaccatagagctgaggagattctgttcctgatgaagaatcatgacgcccttcgtattgcatatgttgatgaggttgacctgggaaggggtgaggtcgagtactattcagttcttgtgaaatttgatcaacaacttcagagagaggtggagatctatcgtatcagactgccaggccccttgaagcttggtgagggaaaaccagaaaaccaaaaccatgctctaatctttacacgaggagatgcgattcagaccattgatatgaatcaagataaccattttgaggaggctcttaagatgaggaacttgttggaatcattcaagacttactatggcattaggaagcctactattcttggagtccgtgagaaagttttcactggttcagtatcttcactcgcatggtttatgtccgctcaggaaacaagttttgtaaccttaggacagcgtgttcttgccaacccactgaaagtgaggatgcattatggtcatccggatgtatttgatcggttttggtttgtgcctcggggtggaattagcaaagcctcaagagttataaacatcagtgaggatatatttgctggattcaattgtactttaagaggtgggaacgttacacaccatgaatacattcaggtaggcaaaggaagggatgtgggtttgaatcagatctctatgtttgaagccaaggtagcgagtggtaacggtgagcaagcattgagcagagacgtttacaggttaggtcacaggctggacttctttagaatgctctctttcttctacacaacggttggctactatttcaacacaatgttgatagtatttactgtttatgcattcttgtggggtcggctttatctagcacttagtggtgttgagaaaatagcaaaggataggagtagcagcaatgaagctcttggtgcaatcttgaatcagcaatttattattcagctaggacttttcactgcacttccaatgattcttgaaaattctctcgagcgtgggtttcttccagcggtttgggacttcataacaatgcagctgcaacttgcatcgtttttctacactttctccatgggaactcgaacccattactttggccggactatactccatggtggagccaagtatcgtgccactggaagagggttcgtggtggagcataagaaatttgctgagaactacagattgtatgctcgaactcatttcattaaagctattgagctcgcgattattctgttggtatatgcggcttatagcccgttggctaagagttcgtttgtttacatactgatgacgatttcgagctggttccttattacatcttggattatttctccatttctgtttaacccttctggcttcgattggctcaaaacagtaaatgattttgatgatttcattgcatggctatggtctagaggcgggttgtttacgaaagcagatcagagttggtttacgtggtggaatgaggaacaagagcatctgaaaacaaccggagtgtggggaaaactgcttgagattatacttgatcttcggttcttctttttccagtacagtattgtgtaccatcttcgcattgcagagaatcgaaccagcattggtgtatacttaatttcttggggatgcatcatcgggattgttgcgatatacatcacaacaatctatgctcagaaaagatattctgtcaaggagcatataaaatatcgattcattcagttcttagtaattctccttacggttcttgtggtcgtgatgatgctgcagttcactaaacttacagtagttgatttgttgataagtctcttggcttttgttcccacaggctggggattgatttctatagctcaagtactgaaaccgtttctgttatcaacagtggtttgggacacagtaatctctgtggctcgcttttacgaccttttctttgggctgatagttatggctccagttgcattgctttcatggttgcccggttttcagaatatgcaaacacggattttgttcaatgaagcttttagcagagggttacagatttctatcattctcgctggcaaaaaatccacttgaagcaaatattgggtatggttcagaataagatcttctttatatgttacactgattactattaactaaacatccattaataagactgatttcatcatatttgcagggttcttaaagtttttgaaatgagttggtctgagaaggttgggcgatatccttttctctagcaaaaaaagttttgcttgaagcagcttatggtagcctggtttaatatcatcctccaccgttttgtggcattgctccaggttaagcctggtttttcctcatggtggttagcattttggagttgattgtttgaccttggtttggcttgtttataaacatataaggtatgtatctatcttcatttgctttggtgactgattttatttgtcaagaccttacgattaaatacataattttgtcatatttgcagggttcttgatttgttgagagatggtaatatgagggagcttagaaaaatg

SEQ ID NO: 31343 - DNA, 3000 bp, Unknown; identical to SEQ ID NO: 9313
  misc_feature (1)..( 3000): 2750-1469P.txt file - cDNA_ID_3041167; gDNA_ID_1972068; Annot_ID_178511

SEQ ID NO: 31344 - DNA, 3003 bp, Unknown; identical to SEQ ID NO: 31342
  misc_feature (1)..( 3003): 2750-1469P.txt file - cDNA_ID_3041167; gDNA_ID_1621185; Annot_ID_174384

SEQ ID NO: 31345 - DNA, 3000 bp, Unknown; identical to SEQ ID NO: 15416
  misc_feature (1)..( 3000): 2750-1469P.txt file - cDNA_ID_3041184; gDNA_ID_2926133; Annot_ID_197059

SEQ ID NO: 31346 - DNA, 3000 bp, Unknown; identical to SEQ ID NO: 15416
  misc_feature (1)..( 3000): 2750-1469P.txt file - cDNA_ID_3041184; gDNA_ID_2926133; Annot_ID_138826

SEQ ID NO: 31347 - DNA, 3003 bp, Unknown
  misc_feature (1)..( 3003): 2750-1469P.txt file - cDNA_ID_3041184; gDNA_ID_1972121; Annot_ID_179012
gatcttgctgctgctggtatccaaaatttatcagatttggtaacatcaaactcctcaagaattctttcctttcttggtttctttaaaaaaaatcatcaagaatatgtttcttgattcattctttttttctacaactttcccactctttaaacattatttagcttcatgatttttctacgcagagtgatgatgattccaagaatcaaatgctaagaaagaaagagttgttgcttcaaaacatagaccatgcagtgaatctattcctcatctacgttttgacattatccatttttcctggattcttatacgaaaacacgggacaacacggactaggtgattggtatgcacttatcctagtagcgacatacaatttttgggatttgttcgggaggtacgcaccgctggtgaaatggctgaagcttgagaatagaaaggccctaacgattgcggtcttgacccgttatttcctcgttccggcattctatttcactgcaaaatatggtgataaaggatggatgattatgctcgtttctattttgggattaactactggacatctcactgtttgcattatgactatagcccctaacgggtacaaggtaatctatctactctccctatgctgttaaccaaattaatttgaatatatctagaaacttagattagttcatatttagaaaacaaaacacattatctttacaatttttttgtgttataccctttgcttttacgatttgaaaatataacacaagttttttttgacatataaatacaaacactataataaacaaacgacctctaccttcatatttaatctgattttgtattttgtgaagggtccggagaagaatgcattagggaatttgctggtggtttttattttaggaggagcagttgtaggaatttctttgggttggttatggcttattggcaagaaatatgctttctgagttctcatcattttgtgcaattaattccgatgaatctgactctttatggcaaaaaatgagaagcttggtgcctcgctcgaacctaactgtttattcatgaaaaaagaagaagaagagaatactaacacgtaaaactttcgaaagcttgaagtgatgaattcttatttcgatgcttcaccaaattataaaatttcactttttcaactccacaatttgctgtatctattttagttaatattttagacccatttgatcattttattaactattttctaaaatcttatatggtgttatttaaccatagatttttatagaaactaaatcctaacagtctacttttgtttgatcactgattataattttatgcattaaagtttagcattgttccatcagatatttgtaaaacaaaattaatagcaaaataaagtcattcatttaagctagtaacggacggttttcttcgagagaaaaccagtccggagtagaagagcttacatgggaaaacatagaacctcgtgctcttttcttcttagcaagacaatcagcagagacattgtttaagtatgtaataaaagataaagaaaaacgagaaaaactaggctttgaagcattaaaatcttttcactccgaagaaaaagcggactactcatcaggagtgttcaaaagttgtgtcgactccttactatctgtctataaaataatgtcgaaaatggataaaaatataagaaatcgtattgcccataagagagcctcaacagatatttgtaaattatatttaagagttttaaaatttggtcttattaaccaagtgttcatggccaagtgctttcgtcatgttggtccagactagagaacacttcttttaatcatgaaaacttaactcattgtttcctttatgtaaacattttaaagtggcaaaagttttttcttaggtatctacaaatattgagaactagtttcggttacgatccaaaaaagaagtaggtgttatttagttaagattttaaatattttgctaaaataagatttcaggcattttcgtgtaatttacaaatacaaaatgtagtgtgtaatttagacccatatttcctttcaaactaaccgatcaaaacattgatcacaaaatccttgtgtgcaactaattccccaaaaaagaagaggagaatactaacacgtaataatcaatttgaggtgaagtgtttatttatttattttgctaaatatttgaggtgaagtgttattttgataaatgcttcacttatcctttttcttttttacaacaaaattagttcatccatttaaattagaaacggatgattttttttaggagaaaaccagttcataataaaagattttatatgaaaaaaagataaaactttgtgctttttctttttcggcgaggcaattaataccaatattgtttaaacgtaaaataaaaagataaagaaaaacgataaaagttaggttttaaaatattaaaattttataattctagaaatgtccaaaaactaagtcaactacttcaaatgcttcacttatccaacttcaccgattctcatcgagtctatttcatacatagtttttattttcatttattacgtttagaccgatctcacagatatgtggatatttaatgattaaggattttaaagaaagttttgctttcatactatatcgtcaacaagttgtctaaaaataggaacataaaaaaagctttcacactttgaattctttaaattctataatcttttctttttctttttgagtcttactttatcctttcatatttgctgtcacaccttgaaaaggtctattattttactcgctcatctcctctttttaagaatcttgttttgaatcttcatgaaagctttgctcgttaaaaaatcaacaaactcgttgactctgcaaaaccctcatgtgctaagtttcaagtaagtatctctagctcctttatttgctccccagcaaaaaaaaaggaacatagcatcatcttgtgtttgatccaattcttgaatcttgaaaacaggtttatgttcttttgagctcaatg

SEQ ID NO: 31348 - DNA, 3003 bp, Unknown
  misc_feature (1)..( 3003): 2750-1469P.txt file - cDNA_ID_3041184; gDNA_ID_1972068; Annot_ID_178479
tcaaagtgtttaaagttccatttcttgctttgtttgtgttttccctgttacagtgatattcttagcaatctcaaccttcatagaactactctgcgtgattttatatgcatatgtgttcccaaaactccccatcgttaagtattaccgaagaaaagccgcttctgaaggatctaaaactgttgttgctgatcttgctgctgctggtatccaaaatttatcagatttggtaacatcaaactcctcaagaattctttcctttcttggtttctttaaaaaaaatcatcaagaatatgtttcttgattcattctttttttctacaactttcccactctttaaacattatttagcttcatgatttttctacgcagagtgatgatgattccaagaatcaaatgctaagaaagaaagagttgttgcttcaaaacatagaccatgcagtgaatctattcctcatctacgttttgacattatccatttttcctggattcttatacgaaaacacgggacaacacggactaggtgattggtatgcacttatcctagtagcgacatacaatttttgggatttgttcgggaggtacgcaccgctggtgaaatggctgaagcttgagaatagaaaggccctaacgattgcggtcttgacccgttatttcctcgttccggcattctatttcactgcaaaatatggtgataaaggatggatgattatgctcgtttctattttgggattaactactggacatctcactgtttgcattatgactatagcccctaacgggtacaaggtaatctatctactctccctatgctgttaaccaaattaatttgaatatatctagaaacttagattagttcatatttagaaaacaaaacacattatctttacaatttttttgtgttataccctttgcttttacgatttgaaaatataacacaagttttttttgacatataaatacaaacactataataaacaaacgacctctaccttcatatttaatctgattttgtattttgtgaagggtccggagaagaatgcattagggaatttgctggtggtttttattttaggaggagcagttgtaggaatttctttgggttggttatggcttattggcaagaaatatgctttctgagttctcatcattttgtgcaattaattccgatgaatctgactctttatggcaaaaaatgagaagcttggtgcctcgctcgaacctaactgtttattcatgaaaaaagaagaagaagagaatactaacacgtaaaactttcgaaagcttgaagtgatgaattcttatttcgatgcttcaccaaattataaaatttcactttttcaactccacaatttgctgtatctattttagttaatattttagacccatttgatcattttattaactattttctaaaatcttatatggtgttatttaaccatagatttttatagaaactaaatcctaacagtctacttttgtttgatcactgattataattttatgcattaaagtttagcattgttccatcagatatttgtaaaacaaaattaatagcaaaataaagtcattcatttaagctagtaacggacggttttcttcgagagaaaaccagtccggagtagaagagcttacatgggaaaacatagaacctcgtgctcttttcttcttagcaagacaatcagcagagacattgtttaagtatgtaataaaagataaagaaaaacgagaaaaactaggctttgaagcattaaaatcttttcactccgaagaaaaagcggactactcatcaggagtgttcaaaagttgtgtcgactccttactatctgtctataaaataatgtcgaaaatggataaaaatataagaaatcgtattgcccataagagagcctcaacagatatttgtaaattatatttaagagttttaaaatttggtcttattaaccaagtgttcatggccaagtgctttcgtcatgttggtccagactagagaacacttcttttaatcatgaaaacttaactcattgtttcctttatgtaaacattttaaagtggcaaaagttttttcttaggtatctacaaatattgagaactagtttcggttacgatccaaaaaagaagtaggtgttatttagttaagattttaaatattttgctaaaataagatttcaggcattttcgtgtaatttacaaatacaaaatgtagtgtgtaatttagacccatatttcctttcaaactaaccgatcaaaacattgatcacaaaatccttgtgtgcaactaattccccaaaaaagaagaggagaatactaacacgtaataatcaatttgaggtgaagtgtttatttatttattttgctaaatatttgaggtgaagtgttattttgataaatgcttcacttatcctttttcttttttacaacaaaattagttcatccatttaaattagaaacggatgattttttttaggagaaaaccagttcataataaaagattttatatgaaaaaaagataaaactttgtgctttttctttttcggcgaggcaattaataccaatattgtttaaacgtaaaataaaaagataaagaaaaacgataaaagttaggttttaaaatattaaaattttataattctagaaatgtccaaaaactaagtcaactacttcaaatgcttcacttatccaacttcaccgattctcatcgagtctatttcatacatagtttttattttcatttattacgtttagaccgatctcacagatatgtggatatttaatgattaaggattttaaagaaagttttgctttcatactatatcgtcaacaagttgtctaaaaataggaacataaaaaaagctttcacactttgaattctttaaattctataatcttttctttttctttttgagtcttactttatcctttcatatttgctgtcacaccttgaaaaggtctattattttactcgctcatctcctctttttaagaatcttgttttgaatcttcatg

SEQ ID NO: 31349 - DNA, 3000 bp, Unknown; identical to SEQ ID NO: 9305
  misc_feature (1)..( 3000): 2750-1469P.txt file - cDNA_ID_3041196; gDNA_ID_1972121; Annot_ID_178990

SEQ ID NO: 31350 - DNA, 3000 bp, Unknown; identical to SEQ ID NO: 9305
  misc_feature (1)..( 3000): 2750-1469P.txt file - cDNA_ID_3041196; gDNA_ID_1972068; Annot_ID_178453

SEQ ID NO: 31351 - DNA, 3000 bp, Unknown; identical to SEQ ID NO: 9328
  misc_feature (1)..( 3000): 2750-1469P.txt file - cDNA_ID_3041267; gDNA_ID_1972069; Annot_ID_178552

SEQ ID NO: 31352 - DNA, 3000 bp, Unknown; identical to SEQ ID NO: 9329
  misc_feature (1)..( 3000): 2750-1469P.txt file - cDNA_ID_3041271; gDNA_ID_1972069; Annot_ID_178550

SEQ ID NO: 31353 - DNA, 3000 bp, Unknown; identical to SEQ ID NO: 9327
  misc_feature (1)..( 3000): 2750-1469P.txt file - cDNA_ID_3041275; gDNA_ID_1972069; Annot_ID_178549

SEQ ID NO: 31354 - DNA, 3000 bp, Unknown; identical to SEQ ID NO: 9330
  misc_feature (1)..( 3000): 2750-1469P.txt file - cDNA_ID_3041283; gDNA_ID_1972069; Annot_ID_178547

SEQ ID NO: 31355 - DNA, 3000 bp, Unknown; identical to SEQ ID NO: 9331
  misc_feature (1)..( 3000): 2750-1469P.txt file - cDNA_ID_3041300; gDNA_ID_1972069; Annot_ID_178541

SEQ ID NO: 31356 - DNA, 3003 bp, Unknown
  misc_feature (1)..( 3003): 2750-1469P.txt file - cDNA_ID_3041304; gDNA_ID_1972069; Annot_ID_178540
cccaacatgcatagtgtttgacacaacaatatatgacagctaacttttaagtataattcgaaatgaactaaatcgttgattatacataagtttaggttatgagtttttgtcttttgcaatctattaattaacaattggtttgtgaccaaattgttcgttgagtgttgtaagaaccaacctatttcaatcagtttcttaaaaaaggaaagggaaggcaaaaaaaaaaagaactattagcagccttacttttctatgataatattagtcagtagggaaatatatatatatatatatatatatatatatatatatatatatatatataatttggaccgacgactgattacaataactgttaaagcttaaaccggcggaacttaatcttatataattaatatgattgtaattagctgtatgataattttatgttgttaatgatgatgtattaccttttcgctatagggtttatagattacatctatacttctgcatacaattagatattaataaagttataaaaacaaattaaactgaataattgtgtgtgtgttacgttgcatgtgttattagttatggagaaatatgatttacgtcttctgaaatgctatcaacgattggtttcagatttaaagaaactatctgaccaaaatcctgagatatcttaattagatatatctatttaaactttcaagttgttatatgttaaacagtaaatggcgttttccgtattactcatctagtagatcgtagtaagttatatacgtttttacaatgaaaggtttcggcaatgtaagttgtatacgtggtacgagtgagtatccatacttctaccggaaagaatagagatcaagaaaaatgaatataattaataaagctctaccgaggaaaagaagagtgaaggataatggagaaaaataagaaaaaagatgatgagatctgaattaagattttattattcacaattacaagaataggtacagtcctggtttgtgctaaaccaaattcgaatatcaaatataaattacttataggttcgactgtaaaatgagatatgaaagaaagaaataatatatgatgatgtaatgcatgagaaagtccaaaatgatcggcatatgggattaagcgattccatatagttaagtcaagttactatttcagataaatggataagtttgtcgtctatatgttctgttatctccaaacccaaatctataacattgcgacatttttgaatcgttaacggcaaaataagtggggaggggggggggaaggaaaaaaggaaggacactgagattttgataaagttcggtagccaaatttgtgcatgacttttaagaaaatacgtatgctgatccaaaaacaaacaactaaatagattttagtttgagaaaatcgaagtaacaaaattattatttaatatatagtgtgagaatttaacagctactaataattatcataacacgaattaagtgtaatagtaatatatgtaggaaaatggtttagcaccactcacttgattaactcgacttaaaccaaatataaagtaatatttatagatgtagttggttgtatttttgcaagctttggtactcgatatctaaatttttaatggaaaaattagtcgagtggtaattcgttatatataagaaaatattttgtttgtaattgtgcaaactttagcattggacatctaactatattctgaaaaatcagcggaatgataaaagttcggattttccttctttttatttaagtaaacataattggtgttctgaaaaccaaaagaaggaagaaggcaattaagatttgttaaagttcgtcacgatattgatgtcaagaaaaaaggaaaaaaaaaaaaaatcgtcacgatggtatcgtcaatttgtctagtggattttgaaaagccgtgtgggcttgactttgaccgaacaaggcacacgtatacatctagtactactgaagaaatctctcattagaacgcaaaccacgttccgcacactcttaatatactattagtctattactatcaccaactagttgtcattttttttgtcaaacgtgctaattaattcacaaatagaagtattaaacttcctaattaagcacgcctttactacatttcattattattatacatgtaatcaaccatttcttttatcccacatgtcatttgtagtcctgattttatgactttatgcatcaagttatctttttttttgtcactccatgcatcaagttatctaaacaacataattattgtctgaaaaatctaagatgatatacaacatatgtatttaattacacattaggcttgtttaacaattcttgattatttttactctttttgggtgagttcttgatggatgtcttgaattacaaaactacatattctgaaaatattaaccttgagtttaggccggctatgctataacgaaaaataaataaaagcaactaacccgacagaaatgtcaaccaactatccaaaatgaaaaacaaacgtggagagcgtcatattattagtaggccaatcacacaccaaatgtttgtttaacaaaaaaaataagaatgtcaaccaactatccaaaattaaaatcaagaatacatttcatatgtttccaatatgtttttcttaaacaaaattgggactaaagattggaccaaatacgtgtgcgggtggacccgatagaagccgagttgagtctaaagactaaaaagtaaacaaaaaatgataagaccatcacttagtttattgcatgaaaatgaaaagcacatgctcctctctctctcttctgcctctttccatctagtttcctcttaaaactccattatatatagaaacaaaatcttttctctcttcaacaatcccaccattaaaaaagaagaacccaagatcgactcttacttcgaatctctctcaactttcttcctcagcttacgggaacttccacacatatacatccacaagaacccatatcgaagattcatcctacatatatttacatg

SEQ ID NO: 31357 - DNA, 3003 bp, Unknown
  misc_feature (1)..( 3003): 2750-1469P.txt file - cDNA_ID_3041308; gDNA_ID_1972069; Annot_ID_178538
tatctggtggccgctcgacaagacgtaagtgtattggaaacttgaaggttcttatttccaagtgtactgtaatccttgtttttccgttgatggtcttacactgtgcagattttatgaaggcgtcatagattcctattgtactcgtaagaagatgcatcgggtgagagaatatctctgatctgctattcagttctgttcctcctatcagaatcgtgcctgtttcttaattgattgatgtggaatgtttgttcccccactggttgcaggtaatatattctgatggagattccgaagagcttaatctcactgaagagcgctgggagttactcgaggatgacacttcggccgatgaggtacaagtttcttctatttgttttggaataaagtgtaatcgccgtgcttaatgattttcccacaatcgatcagcaggataaggagattgatctgccagagtccattcctttatctgacatgtgagtaaatcggttcattactgtgatctgtgtaaagttgcaatcttgatcttctatggtattaaaggtaatagtctattccggttcttatgatgttgcagaatgcagaggcagaaagttaagaaaagcaaaaacgtggcagtgtctgtggaaccgactagttcctcaggtgtaaggtgtgtgagaatttactaaaattcaagttattgtttatatgaaattttgatgatgacttgttctgagaggattggcgtgtatattgatggtgatagatcctcaagtagaacacttatgaagaaggattgtggcaaaaggttgaataaacaagttgaaaaaacaagagaaggaaagaatctaagatcgttaaaagagttgaatgctgaaactgacaggacagcagaagagcaggaagtgagtctagaagctgaatctgatgacagaagcgaagagcaggaatacgaagatgattgtagcgataagaaagaacaatctcaggacaaaggtgtagaggctgaaactaaggaagaagagaaacaatatccaaattcagagggtgagagtgaaggagaggactcagagtcagaggaagagccgaaatggagagaaacagatgatatggaggatgatgaagaagaagaagaagaagagattgatcatatggaggatgaagcagaagaagagaaagaagaggttgatgataaagaggcaagcgcaaacatgtctgagattgagaaagaagaagaagaagaagaagaagatgaagagaagagaaagtcatgaaggagttacatagagttagagcattgtaagctaaaaccatttcagaaagattctttctgcttagacgctctggtttatctttcttagtagatttgttgatattgaaccaagttttagatgaggtcacctggtttgtgtttgtgtcttgagagtttgtgacatttgtaattcattatcgttgttacatagtataaaccatatgttatgagccacacgcgtttctctgtcggttataaaaattatttacaacgtgcgaatttgaaattctgtgcactattgatagagaaaccacttggaaattgttacattcaaccatcttggactcgacggcttgaatgactaatgagaccactaatccttgtccacatcttctctcattctcaaaagaaggtattaaataagttaatactcaacaatcaacaacttaaatcaggtgacaaaaaaagaaattacttcaatcatagttgacttcaataatcatccttctttctttgttaaatctcatatgtaaaatagatgtattaacttgaaacactgttcaaagattggctcaaaaggttttgcaaacgaaagtataaactataggagttttaatattctattttataataaaaaaagggactattcttaacttattagttactactgaatctaattttttattactttcatcaaaaatattaaaatcaattatagttgttttaaccacgtacaaataatattagtttctctaactaataattttaatccttttttttaattctcttttatctttataaaattcgctaccaaaagacatataaatctaacggtcaataatgttgtacttactttgctgaaaacaaaaaatataaacgaaacttttgtcaggaagatacatcaaattaatctttgttaaacagactgaaatatggatataggttcaggggactttcctattagcaaaaagatggggctagattttaacttttaaaagtcaaggtcaattttctcaactactcaccaattgtttttttttatgtggtatctaagtaaaatagaaaaacacaaatttagaataagataatgacaccaaggagcaacaaataaaaaattaaaaaagcattgctgattgctcatagatttgtttgtatagaagatcttaaatagcatacgtacgattactaactttttattaagttcttctagaactccatatacatatttggtttataaacttattaattagttaggaattttttatttttgttgatcttaaaattcatttagtaatttcgtattcgaagtgttataacttaaaaaaaaacattaaggttccatatggcaaaaataaaataatgtaaaagtccgattcacaaacacctttaattgaccattttgtttggctttttaatgcatttacacttatcacctaaaactttgaaactaatgtacttctctagtactgttctaagataaacttagtaaaatatctttcacaataaattcttcatttaccaaacccacactctttcaatatatcagaacaaaaatatactaatctaaagtttttcagtttgttcttttgaaaaagaaaagaattatcataagttgactcaccaactctttaccatggttaagtaacttgttttgaagtctctatatatacaaatcactaacgacacatcataacatactactctcttaagccctttcataaccttgtaaaccattaagaggctttgctcaattacaagaagaagaaaaaatg

SEQ ID NO: 31358 - DNA, 3003 bp, Unknown
  misc_feature (1)..( 3003): 2750-1469P.txt file - cDNA_ID_3041316; gDNA_ID_1972069; Annot_ID_178535
gttgctatctttatgagaatgggtcgtgtattgtatctttcatatttctatttacatgatacatgtatcgtgtactaaagaagcttttgagatggagcaataattgtggatccttttctctatcgatcgacatacattattttgcataatatgttcttctccatgagaatggaactcttgcgtttgtgtggttgtaagttgttagcaaagagaatgatgataaaagcgatggttcttgacctttccttgtcacagaatgtgactcacagtcgactctctttttgtaaggaaataaatgatttgttttagtgtataatccttgcatgtattaacaccaattatcgatgcagatggttgtatagtttgcaagtataaaacatgattcctcccctcggaaattcaaggctttattaagcctttaatctccccatgcaaaaactatccgcaaaatatgcaattatgataagatgtatattattatcacgttccaagtgaggctcaaattaaatattcttgtttactaacaaaagataggtgaaaacaagattttacatgtcaaataaaagatttctgtgagatgtatattcttatcattaaaatttaaaatcacttttgagttcatctctttatttaattctttcgaatgactcttgcatataatttgtatacttttaacgttattccttttctatctataaaaaaacgaagaatctgtgatgacccgtcacaactctttagaatcaaaattaaaacactaatttattgctttgtcctcacaatcgtatgactatgaattgaagtgtcttggaacaagatttaattataattatttctctaaggtataagtttcttgaaccttattcgcttttataacttatgcccaagtatacatacccttttctaagttttatagaataagtagaggagtgagctagtggtctcggtttagattaaaaaactatgtgtagatatagataagaggtctatatatccggagaatatatacctcctaagactaagatagtcatttaaatttcgtccattcccttcaagttaaatcacattatgtcatagaataaaaatttggtacagtgagaacgcagatataatcgaaacaaaacaataaatcatgagaatgtattaatgcgtgtggtggaaatagattgttgggagtggaggaacaaatcaggaccgtttgaaagatgtgaagcgactgtttgttctaaagccccacgtcacatcgcagggcatcacagacatagtaactgtgagatttcatacattattaatttggatgattttagtgaatccatttacttcgttgtaaaaagattactcaagtctgattagttacttttctaaacacaatgcttgtaatatattcgacaattctatatagcataatttttatgtgcatgttaataacaacattagtgactataaatgatagatggtcaaaagacttcaaaaacaaaaacaaaaaaaaaagtaaagaggaaaacaaataaatgtaaaagaaatgataatgattttgaaggggatgtatctaagagtagaggggagggggtgtaaatagaaatgttgtagggtcgaataaaattgtcaaaagtccggtccaaattattttgtccctcactaatcgtggctaccatgaattgatacaactttattccattttcttcttaattagttttacaagtatatcattatcataaataatagctggctcccttcactgtgttcgttgagtcttattttgtcttcttttccttttggtttttcattcttttgtgggttgggtaaccataatttgacatgatgttttaaattagcatatcatttatttgtaatatacataaagtttttaactcttctgtatataaatgtatgcacaaaatatctaacgatgtgtataagttttgtatagattggagtttcatttgtttgaatcatagttttgaataatgtatatagtattagtctatacgaaatgctgtatgaaatcataatgtggcaggtcataattatttgaaacaggttatcgtgcatgcttaaaatttataaagaaaaacagtgactattttctaaagctattcacaactcatcaggagtttgatactcatcctaagattgctactgaaccacacaattaaagtgagcgtgataatagtcgtgtcaaacaacaaacaatttctcccaatctttttactccattaatcgtcgttcgatcatccgataatcttttgaatccctgagcagatcataacaaaaacagagccgtgcgtgaacacaagcaaaccataccaacagtcgagaacatgaaatatttataccgcgattaattcttcacgtgcttcttctatctcgtcattgcttcgacgttcttttatatatgacgaggatcgtgttcctaatctctcctctagctttttttattcaattctttcattttcttcttcacctcctcatcatctccatcatcaacttgcttcatcattttttttagttttacttggcatgtaccagtaaagttctagttccaagattggccacacaaagttttaactaaagcaagcctgacaagtaatcacccctaaaagacggaaacgacacacgtttttacgtaacacaaaaaatggttaatctaaagcccaataaaaggcacattggttcacattaagaagaaggagcactgaaacaatgatttaagtatggtaatctagtggaccaccaataaaaagcccattaattcataggcccaatattaacaacctgcgtttggaacaaactcacttcaactacaaaactcgaccctttgaaataagaagaagaaatctcggtgagtttttttgtggagattgaattttcttatctacctccactattcaatcgcatggcgtcagaggcccattagaaaagtcaagccaggggttttggattagatcgttcgttcttcaatttaaaagttttcttctttcttgttcggaactcagaaacacgatg

SEQ ID NO: 31359 - DNA, 3003 bp, Unknown
  misc_feature (1)..( 3003): 2750-1469P.txt file - cDNA_ID_3041323; gDNA_ID_1972069; Annot_ID_178533
aattactttatatttctccagcaactgcaaggagaagctgaaggagtacgtgatagatgggtttaagtctcatctcttaccacttccggtaagataatatctttgctttatatgatctttttaatataaagctatttacaatcttaactaaatgtttgatgatttttcagggtactgtctacacagtgtgcggtgggcccccttgccaagggatcagtgggtataaccggtatagaaacaatgaagcaccgcttgaagatcagaagaaccagcaacttttggtgtttttagacatcattgacttcctcaagccaaactatgtgctgatggaaaatgttgtagaccttcttaggttttcaaagggtttcctggcacgtcatgctgtagctagctttgttgcgatgaattaccagacgcggttgggcatgatggctgctggatcttatgggctccctcagcttagaaacagggtttttttatgggctgcacaaccatcagaggtaaatatatgttacagaatatttaccactaatatattgtcttttgaggaacatgatctttattgctctctcttgatttgtttgacagaaacttcccccttatcccctcccaacacatgaagttgctaaaaagttcaacacacctaaagaattcaaagcaagtgtggacagttgtacatttaaatttaatagactcttataagttataactgcattgcttattcatctgttataaatgtaggatttacaagttggacgtattcaaatggagttccttaaattggacaacgctcttacgctggctgatgctattagtgatctgccaccggtgtgtatctaaacttcagaactgccattgatgattatgttacaatatatctgtctgatcactgctctcttagtgctgcaggtgacaaattatgtggcaaatgatgtaatggattataatgatgctgctcctaagacagagtttgagaactttattagcctcaaaagatctggtgagcattttaaactcgtaaatttggtaggtaccactaatccaatactaacgtatctttcttgtttcagagacacttttacccgcatttggtggagatccgacacgcaggttgtttgatcaccaacccctcgtattaggagatgatgacttggaaagagtttcctacataccaaaacagaaggtgcgacatttttaaagtacttgcttcaagcattcaatgtataatcatttcttgttcatgtcattgtattcttattgttacagggggcaaactatcgcgacatgcctggtgttttagttcacaacaacaaagcggaaattaatcctaggtttcgagcaaagttgaaatctggaaaaaatgtggtataaaataaaccactcgcaaccttatcatttttctgctctagtttctttttgcaccttctatatgacatgtcttttggttttcacaggtccctgcttatgcaatttcattcataaaaggaaaatcaaaaaagtgagtttctccaactaatatgcttcttgtggatcctctttccataacgtaagaatgttaaattcattaaaagtaacacatctgttatctgaatttcaggccgtttggtagactttggggtgatgaaatcgttaacactgttgtgacaagggctgaacctcacaaccaggtaagcccttttgctttcatttcccatgtgtctgggtacgttccacttagaattctctagtggctggtttattaaaactggttgatgcagtgtgtaatccatccaatgcaaaaccgtgtgttgtctgttcgtgagaatgcgagattacaggggttccctgattgttacaagctctgtggaacaattaaggaaaagtaagtccttggttcttgctgcttttctatctatgtatatgattgtttttaaactggagatcctaatgtatgtaaaaactgggtttgaatctaaattttgtaggtacatccaggttgggaatgctgtggcagttcctgtaggggttgcattaggatatgcctttggtatggcgagtcaaggactgacggatgatgaaccagtaatcaagctgccattcaagtatcccgaatgcatgcaggcaaaggatcaaatctgattgacagtctccatcaagtcgtcatgatgaaactatctttaggaatcatacttcattttctagactttcttttaattttttgggttagcaagagctatatgctcaaacaatggcggcttaaactgtctagctctttcttgttggtttatctttgactttataatcatttggaaccattttatttcttatgatttttaatctcaagatttcaaattctattgcgtagacttcaatcctacgtgatgccatccaacaagaattaagaccaagcaaaagacagacaaaacctgttattgagcatccgaggtgctaggtacgtccgtgatctctcgacgaacattggttcgattttgcgtaattcagttgccaccgaccgaccgaaactctggtcaatgatcaccacttaccagcttttattagtgttattcattcattcgcaaaagctaagtaaattcgaaggcagttaggcccacaagcccatataatggtgaaagatttggttcacccaaataatgtccccactccttcggttgggcttttacgttataatattcggcccaaatttgatatctcataacagagcaaatttttcacatagaagaagcagagaaaccaattgatctactttttttttttttttgtttcttcctcttcatcaggcttgttcttcgattccctcacttaaagaagggtttcgaatttgctcgaaagattgaaaggaaaaaaagaaagaggtgaaccattctcaacataaatttgttgtttaggagatgtaagaatgataatttcttggatctaatcgcgttcagaaagtgagaaagttttaggattcataaatatctttgtgttcttctccaccctaataaacacattgatacagagatg

SEQ ID NO: 31360 - DNA, 3000 bp, Unknown; identical to SEQ ID NO: 9334
  misc_feature (1)..( 3000): 2750-1469P.txt file - cDNA_ID_3041331; gDNA_ID_1972069; Annot_ID_178525

SEQ ID NO: 31361 - DNA, 3003 bp, Unknown; identical to SEQ ID NO: 18227
  misc_feature (1)..( 3003): 2750-1469P.txt file - cDNA_ID_3041331; gDNA_ID_1621110; Annot_ID_171776

SEQ ID NO: 31362 - DNA, 3 bp, Unknown
  misc_feature (1)..( 3): 2750-1469P.txt file - cDNA_ID_3041335; gDNA_ID_2213666; Annot_ID_182092
aag

SEQ ID NO: 31363 - DNA, 3000 bp, Unknown; identical to SEQ ID NO: 9321
  misc_feature (1)..( 3000): 2750-1469P.txt file - cDNA_ID_3041335; gDNA_ID_1972069; Annot_ID_178524

SEQ ID NO: 31364 - DNA, 3003 bp, Unknown
  misc_feature (1)..( 3003): 2750-1469P.txt file - cDNA_ID_3041372; gDNA_ID_2214470; Annot_ID_182980
gaaatctgagttttggatatcggattgaagattaagccagagtttattgagctttgatatgtttccatggatgtctccgacgcagatcacagttcgtggtttttgggtcatcattagtcttgtttcttgcaatgcaatcaataattctaagcattatttgattcgatgatgtttgatagttttgtcaacaaaagtcaactgtttcaatggttatgattacataaggtacttcatcgcaaccgtcgaaatcttcgcgtgtaaacatttcagatcgtacggtcaaattcctatgtactcaatgacttttcttcattatttcataagaaaaaaaagactaattattattcacattactattacagcatcatacaattcttcaattctctcaatcgctcttcttgattctctcgtgtaattattattctgtaattgctctttttgacataaacatgttttggatattgttgtgttgtgtggagtataaaacggattaattttcttatagcggaaaaaactgggatgatgatattagctggctttttaactgtaataagatatcaattaatttgtactttcgtagtgcatgtggtaattaacataaagttttaggaggaatcaattaatccatggcaacatgtggtaattaaaccaactccattttaaaaattcttataaactacaatttatataagtcaatttcctgacaccggaagtatttttaaatattttatctcaaatttttattacttatttcgatggtggttcaaagaatatatacttgcccagagcatagcatgtggaaaacattggactgacttttgaggcataacttttttttttaaaacgccaacagaaatttttcttcatgatatattgatatgcttactagtttcttcacgtccctaattcattaattctcttacgttttctggtttgtgtaaataatatacattctttttctttgggcaaaaatataatattcattcttaaacggaaagtaacatggtataattgaatgagacggtgacgtatatacagccagactgcagtaataatattcgtgaatcgtgattataaattcataattacgtacatctccttcttaattaacttactcacgcaattccattcatggctaaaataatgtgctcttcaccaaacgttactaacttaccaattttatacacacatcatcttttcttttgataaaagctcttcccctttgtggtattgttcttaattacgataaatatcttcaatgattaaaacccaattcattccccttgttgcttctttaatcgaactcatgaggtggcttatataaatggtataattaatgtggattaaaattgtaccctttaattcatgtaatgtgtcatttccgtttcttcacgtaatctcaccgtaatctctatatataagcacacaagcaacacaatcgatcataaaccaaaaaaaacgagagagagagatggggaaggggggttggcttcttaactttctgaaccatgccaaaaatcaagaaagtgtggagaatcttgacaaaaacggtgccgtaaaggccccaagcagtgggtttaagatgccgttgcattacccaagatacacaaaggaggattatgaagagatggaagagtggagattggatttgcttctctcggaatacggacttcttgccttccatgacaatactctccatgagaagcgagcttttgcaatcgacacttttatatggcctcatcacccataatttcatctccttcatttatcttgtttatatttcttaagagtaacggagattgtagagatacaacattggaagagatgacaaaaaccgggatatcaatctaccggatatatatgtcacaaaaagattttagtatatttttagtaatttgatttctactatattctttagttttcattagatctctttatgttatgttatctatataagtttggctttggattttgcatatattaacctttccgttcaataaaatatagttttaccgcttcttatggtatcaaagccttcatccaaaacttactcaaatgagattgactctcatgttaaaacagagaaaaacagagaaaaaacaaaagatcattaaagtcactatataaacatcatgattcatctccatctccacccttaatttctttactagtccgttcgttctcgccactattgttgtccgtgattgtacttcttcataagcatcactgaggaagcaaattctaaaacaatagtatcttttaacaatcataaagtaaaacagtttttttttttttgttcttatatatatactacttattacacatttaaactttggttttgaacagtgaaaatgttgcttgcaatttttttaactttgtagaaatcaggcaagttcttaagttgacaaatgacatatactagtaattttcacgaacgttatcccactaaagtagtcatacccaaaacaaaattgtttaaataaaagtaacttaattatatcattgagattcgagtgaataatgccaatgaaatttaatattcattatctgacactctgaaactatgattaactacataattatttaatttaacgtttgtaccagctaatagtatacacgtttttatgacaaacatttttgaattttttgagttaaaaaataataatggttttcgtcgtaataggagaggacagacaattccaacgtgatatgtacgtttatcatgttacttagtcagcagatcatttcttcggattatataatagctatttagaaacattaaaggtgtggattatattatagtcaagtctttccaatatgaatattatatcatccaccaatacataattattgtcaaatacaagttgagtcagattagtcaaatacaggcaaccaagactcgagatcctcatcgtctctccactttatataaaccccaagtcagtacttctcataatataccaaaaacgaaactgagaaagaagttttatttattaattaatg

SEQ ID NO: 31365 - DNA, 3003 bp, Unknown; identical to SEQ ID NO: 31364
  misc_feature (1)..( 3003): 2750-1469P.txt file - cDNA_ID_3041372; gDNA_ID_1972096; Annot_ID_178603

SEQ ID NO: 31366 - DNA, 3000 bp, Unknown
  misc_feature (1)..( 3000): 2750-1469P.txt file - cDNA_ID_3041379; gDNA_ID_1972096; Annot_ID_178599
atatgataaatagtttaatgtcaacagtcgaaattccaatcctagaaatactcaacttcgacaaaaaaaaaaatggtaagtggctaagtgcaccagttcccggaagttaatccaaagagttaaatcattatttttcggcaccaaaaaatatgcgcagtatagtagatccatgatatagagttgttgaccaacatataaaggttatttttaaacatagtattatatattggaaatattcatctgatcatctctatgattaattaccatcatcgtaattaacgaagaaacataaacaaagaaatgatatgtctcatatggacgaagaagaaagattgaaagaatgggaagtatctttgcattttggcagttacgctaatccaactgacatccccaaagattctggcccctacgaaaccattgttgtcgctgtatgtatatacatttgattccttacaatattctaagtacataaatgttatggtaataaattgatgggtccttttagtcaaaaataataatattgcttgggcagactcttgtttaatagggagtgtatacatttaaggttcgaatgatcgcagaacaatgggaaacgttttcaactttttatttctgaaattttttgcgtcataaagtacaaagattccgtaataattaccattaactataatatattcgtaataaaattatctggcatggacattggagagggagacatacatacgacatatcattgatttaatggaaaatatgaggtttgatgagagacagcaaatcatttttcatgagaccattaaatcctaagtaagtgctgatgctggcaattaggtataaagtcgatatcctcttcctcaatcacgttcataatcatcacaattaagagttatattattaagagaatcaataaaattttgtgcaaaatttcttaatagaaagtaaagtttaaacggtgaagcatggaagacgtattcgattggtggcaaacgctttcaacacactattcgatttaagttttgtttcttatttgaacattaaaaactaaccattttgcgatcatttaacttacaaaaaatctggtttaagttgttagataaacacatcatcagttacacttattccgttgtagatattcagaatgttacataattttaatataatttacttagaaaacaaggacaagttgggatccataaaagaataattaaagaaaaagtatgggctccaaatgataatctggtgcacgcgataacacaaacaccggtttagtgggtcctttgtggcagagaagcacacgtcgagtaaggaaggatcaccctctttctatgtctttgatcggctcaatccccaccgtacattctaatctctacgatttggctttgcttcgaacaagtttattccttaaggaagttaacggaccttagctcagtttgatcacaaataaaaaaaattcaggtcgagctcaatcaaccaaaccgtataatactaactcacacttgaaatctgtttttgattattagactacatacaagacattagagacttgtaaaacaatatattggttttatgtcgattagtaggtaatctatctttctaaccctagctaattaaaacaacaaaaccttagcttgccaaagctcatccattaattgaaaaaagatctactaagtaagtatagttttgtatatactaatttgtgggacaaacaaaatttcaaaatggctaatgaggacaagatttataccccaccattaaaacaatgtgactagttatacatcgagttgatatgatggctagcttagaggaataatttatagtatactacattgaaataaaagtaaattccattaagagagaaaaggaaaaaaaaaaagtgaagaaaaaaaagaaatattcttgcttcgaaggcccgtagttgaagccgttggctgagtgggctactgctctttaccttcgtttttacgtttctcctctctcttttttctattgataactttcttttatcgaaagagaataacaaattcattagcaaaacgcttacttgagtacctctaaatttaccaaagtaaattaagtttgaccacttttatcggatacacgtcgaaaaacctataagatttacctctcttattattatttttctgttggatcacaattagtataatactttaaaatttatactagtaaagaatattgggatatatattctcatagtatatttattattagaagatcattttattattctcattttctcaattttcttcaatataagttatataaccgtggaccatagtttctttctttgtcaacaattatgtaatgtggttctaataaatgaaaaataactcaatagtgtgtatgctcagcaatggaatacctaattcaagtcattaaagagagagaaaaaaaaatcacgacgattggtaaatgttaatggaccaatggaaaaccagaattaaattaccggttaagtttggttcggaattgacggtttagacgggacagctgagttgttaacgagctgtcaccggattctacgggtcacccgttttgcttccttcatcagataataaaaagatccaacggttacaataatcagattctcttccctttattcctactttttatttttgattttttctttaaaaccctcactgtatctttttatcggttgttggtggcagttaggtaatttcacctaataacctttttttttttgcctgttatctctttttaatatacgtttcaatatattttaattattattaaaaagttcccgttatacgaataaaatagcatttaatatatttttgtttctggaaaatgtgtaattatctttatataaatgttcatatcagagcactatttctgggtttcaaaaagaaagctcagttagctattttctctaccacagaagaatctagacccagagagagagagagagagagagagagagatcagtaacgagagagtcaaagagaggagatttcagtgaagatg

SEQ ID NO: 31367 - DNA, 3003 bp, Unknown
  misc_feature (1)..( 3003): 2750-1469P.txt file - cDNA_ID_3041391; gDNA_ID_1972096; Annot_ID_178596
ggggcgaatgtgagaaagagggagaaatgtggggttggatttttaatttcgagttaatgttttagtgtaaaatgacttttcactatttctgtaaaaaataataattgatctgctagcattgaaatccaccattcggtggtcttttttcattatccaacataactctttttattacttattgttgtcatgtgctgtgtacttgcatggaagacaattagccagaggacacaatgtgtgagttaaatttcaatttcgagttgtgtatagttaaacagtatttatttgtgtgataataattaaatagagttgtggataatgcccgtaatggaacatggtaacaaaatggcatttaattatttatgatgacaagaagtttggtctgttctattaaatatctttgtaggatatgaacgccaagtgtcgtcttgagttctttatcaaatactaaaaaactctcgtctcgagttctttatccatacttctcaagtcccgagatttagtattgattagacacgacaattaaaggaaaactaaaatctttgagaaattatataaaacaaaagcaaaactgcaggctgtggggttcgaacccacgcgcacttatgtgcagaagaacttaagtcttcccccttaacctctcgggcaaacctgcgctgctgtttaaatattccatttttaagtttatttagtaatcgtatttctgtggtctgtgaaaattgagctactttcggcccaacgaaaaacttgcatatttaaacatataggcccagttacaactaaatcaaaagtatttatttttggatttacttaaatgtagtctttcatcctaacttctcacaaagacatatataaaattcatgcactctccttttatctagttggatcaatctcaagtaatttactgggaagaaataagaaacagctgctctctgttaggccttagtgttataccttaacaaattattaatgggctattagatattattttaggcccaattgaatcaagtactaatgcagatttaaggggggtgtattgacggcgttaaaacggtttctcaacggaatcgtacgtagtcacacgtgattttattgtttaccccggattggtcatgcgttccttcttttccacttgcgcggaccactcaatgacactctcttcttttgtagcagtggcccgacaccagaatgcagcatttaatctctcaaattaccattttgctcctacctcttttaccccttttggtattttgtgtcttttttctttctatttcgtgtgaaaaaggatctcttccttaatcgtattatttcttccgatatctacttttattctgttttctatttttggtaggttacatcttttttataaagaaaatatgagctaacacgacattagtgttgttaaccaaagaattggaaaaaagttataagagagataataagattctcttacagagactcacttcagtgaaaaaggaagaagcaagtggttcccttaagggaaaaaaaagtcacgtacgttcatatacaactttaatacgtactgtgtaactcaatagatcgtgcagtaatattcagtcgtattagtaagaaggaatttatttgctaagtaaactcaagcctcctttttctcttttttttctttttagtaaaaattaggctagtgttttttttgactcagcaacactctgcttaaatttaggagtaatttgacctattcctacgagtttctaagtgaattctgttggggtcaaagaagcaactagttgaattagtggaaaatcgtttcctttctttacgcatagttcacgttggacactcagtctcaatgctttcacgtttcacgtagcaacaacatatattcatcagtttgtgatcgtgccatcgtggataagttgcaattcagtgaaactctgcaccactttgtgcaattatttggccgtctaatctatttgtgagaattttacaatctaattgttctattatttcatttacttgtcatcaatttattatatttgtagccaatgaacgttgtaattaaagaaccaaaataaattaatatcttgaaatttgtaacagtcactagaagctgatttcttattaattgtatcactaaagtattattaaaaacggttacaaattatgataattatatatttaataaatttcgtgtgtcacatttcttttaaactacaattatgaatatctaaaactcattcatgcatatcttaaaatttgaattcaaaactttcttatcttatctttaggttcttaattaacagtcactaaaaatagtcaaagttttgaagtttatgaaaaaagataagagtataattaatggatacgcctcgtaacaaattcttgtaaagtatagataatatacatttgttaaatatgacacgtgtttattttttttttaaatatgatcaaaatatattttaactacctagatggtatgtatgtctccaattttgaataacaagtcaattgttattagaaatgtcataatataaagaagggaattaaatttgcaaagaaaaagtgaaaaacaaaggatttgtattttggagaaaattaaggactggatttgcaaaaacgaaaaagtaacttcatgtatattgtcttccttatagtctctataaactattatctcaaattttgtctggactctgaaactcacaagacttgactctggcttacttggcttcatctttttctctctggtaatctctcctgcaacttcaagctttcattttcaaataaatgtaatcaaatctgttattttcactcaagaactaattgagttctctatccctttcaattgaaattgacattaaaatgaaaagattttgaggaggtttcacctaccacaaccgaatcacttctttctccaaatattgtttctttcagtggccaagaatcacaatcaatttttgtatcttccacaggtaaattaattgtgattgaacagagaagaggacaagtgatcttggttcaaaagaaatg

SEQ ID NO: 31368 - DNA, 3003 bp, Unknown
  misc_feature (1)..( 3003): 2750-1469P.txt file - cDNA_ID_3041399; gDNA_ID_1972096; Annot_ID_178594
gagcttagaaatgccgcaaaatccaccaaatccccaaaattcaattcagttccagcatcctcatccttacaccacctccggcgaccaacaaactcagccgccgataaaatccttatacccatacgcctcaaaacccaaacaaatgtcacccattagcggtggcggttgcgacgacgaggatcgcgggtcgggttccggatccggttgcaaccctgaagacagcgcgggaactgacgggaagaggaaattgtcacaatggcatagaatgaaatggacggatacaatggttaggcttttgatcatggcggttttctacatcggtgacgaagctggtttaaacgatccagtcgacgccaagaaaaagaccggcggtggcggtggcggcggaggaggaggagggatgttgcagaagaaagggaagtggaaatcagtgtcgagagctatggtggagaaaggtttctctgtgtcaccacaacaatgtgaagacaagttcaatgatttgaacaagaggtacaagagagttaacgatattcttggtaaaggaatcgcttgtcgtgtcgttgagaatcaaggattgttagagagtatggatcatttgactccgaagttgaaagatgaagtcaagaagttgcttaattctaagcatcttttctttagagagatgtgtgcttatcataatagttgtggtcatcttggtggtcatgaccaacaaccaccgcaacagaatcctatttcgattccgattccgagtcagcagcagaactgttttcacgcggcggaagcagggaaaatggcgagaattgcggagagggtggaggtggaggaggaagtagagtctgatatggcggaggattcggagtcagagatggaggaatcagaggaagaagagacgaggaagaagcggaggatatcgacggcggtgaagaggttgagggaagaagcggcaagtgtagtggaagatgttgggaagagtgtgtgggagaagaaagagtggataaggagaaagatgttggagattgaggagaagaagattgggtatgagtgggaaggagtggagatggagaagcagagagtgaagtggatgagatataggagcaagaaagagagagagatggagaaggctaagcttgacaatcagagacggaggcttgagacggagaggatgattctcatgttacggcggagtgaaattgagttgaatgagttacagtcttcgggtacacgggttgacccgagttccgctaaggggtgatgctgattagtatttaggattagagattttttacaactttgtagtttctaatgttaggattctcacgttttagtgacattaggcagtaaattaaatcttaaaagtatgtactattgtagacaaaaggtctttaatcagcaaattgattaagcatgtctacttttgtagtttcaattttcgaataaggattctctcacgctgtcaatatttaagtggttaattggtaaaagtgagaagaaattaatcaatcgtacaaaggttaacacacatactaagggaaaaaaaaaatgacacacccggtgggactcgaacccacaatcgtttgattagaagtcaaacgccttatccattaggccacgggtgctctgcttgcactagagtattgagaaaacattaagaaacataattacaatcagtaaaactacccacggcccacgggcgatcctcgtttatttaaagaatatatgtttctctatttaataatttacccttcaaagcatcacaatggagagtttttcttctatttttaaccaactagagttttgtgtacaagtagttattaaagatataattcaagaactgttatgatatttgtaagaagaagagattttctattataaatacttgagtgaaagtttaggtaggttacacaatgtcaataatgtgacaaagattatttgagatgatagaacacaaaaaaatatcataccataccactatattccatttccatctagtgtttgagcagatattctgctttgtacatgtttcttgcacctacaataagattcaaaagtttaattagataccattggaactatagcgatagttgcagttttctctaaagttttcctataacatattttcggacatatggtaggagcatctggaagattatgaggatcaacaaatagcggaaaacaaattactgtatacacattgctttcaaaaaccaaacaatcttcgtcaaatgaattttgtaacttttgctgaatatgataccaagtggagtccaatgacaaacaatctccggtatgaatttagtgtcgtacgtgaagtatatataagttacaaatcatgtctttagaacaaatgatggaaagtgatatatcatatatacagtgagacacgatgcgatcaatcaaacgaccaaattaaaaaaaaaaattagtaacataattatgactcgttgttatatctaaaaatgacaggaaaacattggactaaaccatttttttcagttttaattgttgtaacacctgtttccaacgttttatattgatagtattaattattttcttcgttcacccgttacatcaattgaaaattgaattgttatcatcaaaggttttataattttataaattttaatcttacaaagacaaaatcattatgggaatatatatctgtgaaagaattttgataatatgtattttgttggaaagctgaaaaatatgaggtaacgtaggttattgactgtaacggaagcgaatttaactatgtttcggtttggattaaccaaaaccgaatagaataacgcaatttaactttggttcggtttggtttttgtgaattaacttttttttattccacccttaccacttgcctaacggagccgttgtgacggcccatccacttttgcgctagttcacgccttgacgccttctccttccgtttcttcagcctctcgccgctaattaacgccgtctctggttgctaccaccgccgtaaccctaacggcatttttaatg

SEQ ID NO: 31369 - DNA, 3000 bp, Unknown; identical to SEQ ID NO: 9344
  misc_feature (1)..( 3000): 2750-1469P.txt file - cDNA_ID_3041410; gDNA_ID_1972096; Annot_ID_178591

SEQ ID NO: 31370 - DNA, 3000 bp, Unknown
  misc_feature (1)..( 3000): 2750-1469P.txt file - cDNA_ID_3041419; gDNA_ID_1972096; Annot_ID_178586
aaaaaaaaaaaaaaaaaacaaagtgaagataaagaaatgatttttaatatattatagatttagagtctaaagcatcaatctttgataattaaattttttaacatcataataagaatttaattatccaaacgatataacatttgttcttcaaagcaaccaaaaacaatttgcaaagagaatcaacgaagtcttctagcttctctctcggactccagcaaggtgagaatatctccctctctgacaggtcctttaacgttcctcatgatgtaacggtccgagtcagtgaacttcactctaacctgagtcacttgaccccttgatccagtccttcccatcactttcactacaacagcgtgcttgatctgagaatccattctgattcaacaaaacaaaaacattcagagaccaaattttacaaaagaagtgaaaatccttagaaaaagagaattgttcacatttgaatcaagactgtataacctttataaaccaatcacagctctggagaacaacagatgcaaacaaagcagagaaaacactacaaaaacactaatcagtaaaagcaaaaaaacttaaagatcacatcatctaatgatttttaacaacttctcaattaatgatcaattgcaaaatgcagaaccaaacagcacttacaaatttgcaacacctgatgagttaagaagctagaagacgattgtatatatcaggtttcatttaactgagtgagaaactaggctcataaatctaacaagaaagagagaatcctacagatagattccaaagaacagagacaaggataagtagtaagagactgtaacctatccagtatatctagcagtgtaccttataatcagactacaaaagaaattccagaaagaaataaacttgaaaaccagtttataatatttctcaatcaacgtcagaaccctaacatacttaagctcaaaagcttggtttctcagtaaatcaggaactaaactgatatctaacaagccggagaggaaactgtaaagaaacagagcatggacattacagacaaaatgggggaaaccataaacgactctaaacgattacagaataacgacaatcagaagcaaaaacatatagtaacgaaacatatgtattgagtgagatcatgaagataacctttagagaggctctgcgatgggtagagagttttagcggcgataagagttttaagagcagagatcctagaaccctaattcgagagacgcaccaataattaactggtttcgtgagagaggacttataaaaataaaataatgtcgaccaaaagtcaaaaaaaacttgacccggttttaataagtgatcagttcagttaatctcagaccgaaccggttctttagtgtttcgaaagaaggtggagccatctccattcctctaccacgtgtaaccgttatagatttgtaacaattaagacctttagattttgtaacgatcaaagttgctaaaaaaaaaaagatgtctctggaggagctagatgctatttgctgaaagtttggctgaacatcattttatttgaacatttaaagttcacacatcagcaataacatagttcaattttttataaatctcgaaatcttgaatataaaaagaaaataattgatttggatggaaaagagtcattaatttgtcgcttaagataattttgttagagtaagattatcaaaatggtattttggtagcaagtataaaagagataggaaatctcggttgaaatattcaagaaattgtgtttttagttattatagagagatttatcaaaatgtttttgagttgttaatattattgacaataaatttgtttatttctaaaaccgaatcgtaagatttttcgagtattaaatattcgtagagagattaaatctctacatattttcaaatctctctttttctcttcatattacatattgacctcattagaatgtgggatacaaaagatgagtacatgacattcttgacatcaaaataagcataataacctggtcgaaacaagtggttttagacaaattacctagaaaaaaaaagctaatgtagtgaagaattaatatataaaagcacgtcagaatggtagctgtaaaagaaccttattacctcaagggttttgagcttctttccgtgcacctcaaccattatttcatacaaaaaaagaaccacaaattcctgcaccaacacacatatttgaagacctttaattttgagtggaaaaagatagtccaatagtttggctacacctatcttggactatatatattaaacacatttcgcaatcatccaaagactccatctcatacaactagacactacataaaaacgggtattctagcactcggaaaatgctatctaataataaagtaatgttgcaaatctataaagttgagcaagtagatatcacatgatcagtctaatttccatctcccataatttccttcatttgttgaattatttctctatcagtgtttgatcaggttagaacatgtggcgagctcatgactcaggcccattaacaggccagccgggatttcccggttcaatcgaattctcgattttattcacgttattcctcggtttaaaccggtattgtcggaggtgctaattcctgcaccaacaattagtccccccccagttcggcgaatccgagttgcttaattcgaaatttccgaacttagaaattgaatattcgatttaaatcttggaaagcgtgaattgatcattagatttccgaatcgattcgtatttcgaacgtatctgacacgtgtcaaatcaccgcgtctgtacgcgcgcgtgaagctcgggaaacgaagcgtcccgtaggtttaatgatgacctcgtaggtttgccgcccattcgcctttatttatattcgactaaaccctcgggaagtcattttccgccgcttgcaagaagaatcaaaggtagctctcgttctctcctttgcgacttattttgtactctcgattcttaatcgatttttccggcaatg

SEQ ID NO: 31371 - DNA, 3003 bp, Unknown
  misc_feature (1)..( 3003): 2750-1469P.txt file - cDNA_ID_3041427; gDNA_ID_1972096; Annot_ID_178583
gaagctcgtcagctcgtccgtctcaagtagctaatcagctcgcccttctcaagaagctcatcagctctcccttcttaagaaactcgttagctcgctcctcttcgtcaagcttctcaactcgttctcttcaccaagtccctcagctcgtcttcaagctatccagctcgtctttaatctctccaactcgcctttaagctcttcaagctcctcagctcgtcctcaagctcctcagctcgtcttcaagctcttcccatcacagcgaccatctcctcgtctagctatcagctcatccctcgactgcgaaactcatctacctcctcgcctagcggaagttcgtccattgactgcatagtccacctatctcgtcgtccagctcgtctagaccttcagcaaacaactcggtttgtccaactcgtctctctaccacggttcatccagctcatcgcacatctgccggctcgtcacctacctgccgacctacctccaacgatggcctagctcacttattctaatatgaactacgtgtggcttgatccctttctaagggtacgtaggcaaccttttacaaggttcagctataaaacgaataaactctattcttcctcggacatcaagatcgtcttccggcctcaagctcgtctttcatctacaatcggctcgttcttactccatttatgctcgttgaagaaatcatcctttgtaatccgtccaattcgcctaagtcgcgggctcgtcattaatagaaagattcttcttccttccctagagatcccattttcgtacttgtgtgattcgtgcatcaacagttggcgcgccaggtagggggatagctcgaagatatctctcaaaactacgaacccgcgacgaaccaaagtgacaacaaacggactacatggagcattcgataccgactcgtcaggctctggaagcaaaacgacaacgtcgatccccgggagagccagtcactcgacctcttcatccgatatcgcatcatgttctccgacctcttcatttccttggggtttagtaatctatcttggattttagggtatagtttttaattccattgcatttcctaaatgtttttagtattctatcttggctagtgtactagtctagtgtaccgaagtggtgtactgttctagtgttctcactttgtgtactatcatagtgtacgcatttggtgtactagtcttgtgtactaatggtgtactgttctagtgttctcacttggtgtactataatagtgtacccatttggtgtactattctagtctacttctagaatgtcaaagtatcaatccaaattataatacaatatatttcaattcaagtgttatgaagcataataataatctagggttatgactttgaattaggaatttatttatttacttggaattctaaattctagtaatctaaggctttagggtatagttttaaacttcattccatatgatatatggttttccttgggtttagtcttctctctttgtcttttagtgtatagttttgaatttcactacatttcaataatgtcttttagtgtatagttttagggtatagtttttaattccattgcatttcctaaatatttttagtataatagtagactagtctagtgcaccaaagtggtgtactgtttttaattcacttggttactaattggtgtacccatttggtgtactattctagtatactattatattctatcttggctagtgtactagtctagtgtactagtctagtgtactagtggtgtactattctagtgttctcacttggtgtactattatagtgtacccatttggtgtactgggtttctctcaaacgtctctcttctcgaactcgttcaccctcgatttgttgtacaccgactgtggctagggttcgtgaaaaaccaagaagagtaaagtaactcaatctcagaataaacacgggctcagaagttatttggataaaaaacgtaatgaaactatcgggctcaaatatttgggctcacttaatacgaattggagttaacgggcctaaaatgagttttaaaacccaatccaatttgtttcgtcgaacccagccggaatgtgtgtttttaaaacacaaggctactattgtatttgacacctcttttggatttttgctacctttttctatctcacatgaatcctattagacaaacccaataaaaagtaccctctcagcatatttccaaaaaaactgtctagttctcaaataattttctaaaaactgcctacttttacaataaacccttgtaaaaactatgatactgcagttaaatcctatggaatgattagacatatgatcatgaaagcgacatatgtgattgagttgtccaccaagaaagaataacagtaactggctcaatatgattttcttttgatttaaatattgttttaaaaagtatatcttcattacgaaaattatgttttggttttggtgtcttaatttttagtttggtttttcatatagagagggacatatctaccaattctaacttgttgatagccgtaaccaagattcaagaatagttacctgccaccacatcttcgcggcgtgtatctcaagcgtcatgatcgttgacgccgtctccaccagatgtttgtcgccgtaagctaaccctaataaagcggcggagtaataagcgtttacggcctcgcttgtgctctcttgattccggccgtcccagaactccgttaaccctccagcccatgagtgtagcttgaaaagatcaaaatttctcaaacgcggataactagaatttgaattattatcatcttttctcccaaacgtcatgaaatccgccaatagactgtacgcttgagctctgtatctctctccccacaaaggatcaaacttagcgagcacggcaatagcgtagagaaagtaaccaatatggtaatgatgattattatatataccgaacccgaaatcagcttgtttccacttcaggatcgaagtgaggaactaagcagcaatgtagaaaatg

SEQ ID NO: 31372 - DNA, 3003 bp, Unknown
  misc_feature (1)..( 3003): 2750-1469P.txt file - cDNA_ID_3041446; gDNA_ID_1972096; Annot_ID_178577
gtcagcacatcaacaatatttagcatcttttcagcagaactaggtcgtgatatcagaagctcttctgtgttcacacctattgattctgctagagaaggatccatggcattctctgcatcaagataagcgcaataacctggcacaaacaagtcttttagataaataaaaagctaatggagtgaagaacaaaagcaagtcagaatcaaactgtaacttcacaaaatcgaatcttacttatcgcactagaaacaagaaaggaaaaagtagaagatatgtgtccccaacttaggatggattctagtaacaagtcccaaggtttctgttcaaacaaatgtattgagaatgggattcaagaacagtacctccaagcttttgagcttccttgatgatatgcagagctagagttgtctttccagatgcttcttttccgtaaacctcaaccattcttccctacacaaaaaccaacaaagttctcttgtaaacacacatttagagacctcattaattgcaatacctttagcttggctagtcctatctgagactctaaattaacaacaacctttggcaatcctccaactccaagagctagatcaaggttgagggaacccgtggatatcacagaaactctcctttttctgtaaaaccgctgcaatgacaacttagagtctttatcaaaatcacctgaaagctgtgacaatgctaaatgtagagcagtgtctttctccgctacttttctatcatctggaacttcatcaagttcacaatctgaagcttcaactgaccaaacgaaacacactcataaagacaggatacagagtatggaaatcaaaagacaaaggaaattagtgattacctaaagacgaaagataacgattttcatagccagagcaagccaaaacgcttcttcttccattcagctacaaagcaagataagagtaaacacaagagacatttgtttagtcaggagcttgggcaaatcatcaatgctactctaaaggagataactttattttggttggagtgttgtcctaatttcttcatctgaaaaataaaatctttctttcttatactcaagctaagaattgttgagaaacattagagacgaagagaacctgagataagtaagagaagaaacggaatctctgaatcggactggcccatgagagtcgacccatgccccgttcttcttcaagcggctcctccttcgctgttcagtttcaattccacagttgtgtcttctccttttctactaacgatctccagtttccgccatggtcattgtccttaagaggtaagacctgaaccagaagtggatacataaaaatcgaaaaccgtattaaaccgatcggttcatggctaatggaatctaatttaacggtttgatatgaggaccggaaaagaggtaacaatttaagggaggtgtaactttagtctttttttttttttttttttttttttttttgtgtgtaactttagtcttatcccgaacattttgctcaaataagattttatttttctatataataataaatctgagaagataaatccctaaattaagattgttcatgcgtggagcataacctaaaggtctaagaatgtggagtgcaaattcaataatgaaattgttggttctcttgcttttggtggacgcttcattaatattgaatcgtatcctaagcatgaaaacatatccaacacataattccgaggttttccaaagcagacgcttcattacgtttgacttacgtacactaactggtgataaccagcgaagcggtgtggatcctgcttgcataccaaaatcaaaatgtgatgatagagtgatggaaataggtaatactccagattatcacagtagtaagttcattgatttgttggcacatctttaaacttgtaagctttttataattactttattttgtaggtatatggaggagaccgcgtactctttacagacctaaaaagttcgaccacgagattcatgacgaagaagaattatgaagttgttggtgctattttcttaaattttttggcgattggttttggtgttaattatcatcattttaatgtattagtttgtttttatttgcggaatatcatatgattaattagatggcccgaaacgtctggtacgtaagagtaagaagatatgaaagctaggtggagtcttgtgctattgacaagttctcgacccttgtaaagttgtgctcctccttcataatgccgtagagactaacacacaaactgctatttgggagataaaaacgaaaagaggaaacaacaaggctaagcggtaatgtccaataggatccattcaacttcattaatgtgagataataatatttttttaattaaaaactgttacattatttagtcgtatcccgaatattgtgttcaatcttacgaggaaaacgtcgttaaccctagtccaaagcgtttacgaaaaataaatgggagcttcttcttcgctttataaaaagtactaaataaagactgaaaagatatagaaatccctaaatattgattgttcctgcgtctccgagcataatgtaggtgtttctaacaatgtggagtgtatatgcatgcaacggcgaaattgcacttctccttgcttttttgatggatgcttcactgggtcgacattacgttttaaatgtatcgaaagcctagctagttacataatcacactctttgcagtaataaacccaaagtttttccgacatatcttcttcacaaacatcacatatgaactttgcaccggtgtgttgtagagaagagtgagtggatgttcgtcatcttcccgctccacagtctcaggggcctttgtggacttaaaaaaataaataagtgaaattccaaagggagataattaaaaatcgatttggtatgagaaaaatctaccggtatggtatgagagaaccaaaatcgagcggtcgttaataattagaacgaaaacagaacaaagagagaacgaaaacagaacaaagattgcgaagagaaatg

SEQ ID NO: 31373 - DNA, 3003 bp, Unknown
  misc_feature (1)..( 3003): 2750-1469P.txt file - cDNA_ID_3041466; gDNA_ID_1972097; Annot_ID_178640
aagacctccaccagcagcaagtaactggttcttaaaagcctccctcttttgagcttcagtcttttgctttgctgttagaagcttgccctctagcttcttcctcaacagtttctccttttccttttcctttctcttacgcttagcctcctcagcttgagcctcaagctcttcctgcctgcggcgctcctcttcctccttcctcaatttttcttcttcttccttcttttttcgctcttcagcttcttgccgacgagcaagagcctcttgcatctctctaacatgtttaggaattttcttctctgctgctttaccctttgcatccttcttcttcggctgtagtggctcagttactgattcttcttgtttttcctccttaacctctacagaagaggttgctgcagcagcagctgctgcttttttctccttctctttctccttcttctttttctttttcttcgcagcagcagtctcttcttctccttccttctcaccagcattctccacaggtgcaactggctcaggctgagctgctttctcttctacaggcgtagatgaagcaggtctttcagcagcaggggtttctccaagtgctgcaagaagtttgtccaaatcttcctcttcctgtactgtccttccactcttgttattcttcttctttttcttactctttccagtttccacaacctccacattcttagtatcagaagttttagtttcgtctgcaactgagtcatcacctactgaggccaaaacactgccgcccttctttttagaagatttcttcttacctgaaaacgttacttcagggctctcttcatcttcaattgtattttcgtcgtctctagagtttgaagcatcagtcccttcttcttcatcgagcaaatcagcggtaaacgagttagtgttcttcttcgaagacttagatgacttctttttcttaccagagaaggtgataggagactcttcttcctcatcttcgtgcacttcctctgtatcatcatcatcactaccaagtgcatcaaaagctgaagcggcaaatgaattaccgccttttttacccttcttagacgcatgcttcttacccgtaaaacttataactggctcatcatctttgtcaccatcagattcattatcctccttctcatcttcatcatcaagcaaggcaaagctaacagaaccaccgcccttcttacctttcgacttcttcttcccaacaaaagctatctcaggaacatcgtctttcacccccgcagccgaaaccttatcagaaaaatcatcatcatcatcctgctgcgtacccttcttattacctttcttacccttcttcttcccagtgataacaacaaccttctcttcctcaactttagactcctcagacaactcagtacctattgagtactcatcgtcatcaatttgagcacctttcttcttagatttagtagcaccaacgagagatgacgcaggaggttgctgctcagcatctccacctcgagcactcggcttcttccgccccattggaaaatttcaggtctggttcagaattggttccgaattcttccgactaatcaataaatcgaggtgaaatttcctacaattcgaacggaaacaaattaggttttctgggatcggcacaacacaatccttttagaaaatgaaaccacaagagagacgaggaagcgatactgtggctaagaggagagaatcgaagaagctttaccttattccggagaggaattaatcgataggctgagctaagtttagagagagagagcgcggcgcggagagagagagagagagagagagagagtagagaaccgagaaatagcgaagctttgagaaaccggcgtgaagcttcctagggttgagctaaacgctgtgtagattttaccgattctaataaaaaaaaattgtgacgtttgttaaatactatttttttctccgttttctttctcgatagtgttattttttcttttaaaataaaagatatgtcatattctttgttataaaatgtaatttctgaatgggattcaacagttgtaattttcacgttttaatatactgaaatctaacttatataattaagacacataaattttattaatatggactaaaataagggaaatcagcatgatttagctgtttaaagtattcatttaaaaaaataatcttctcgcgttatgatttgtttgaaatacttttctaaaacatatccgcatccaatgttttttgtttttggaagtttttaagagagagctttgttaaggcatgagcttctcgattcgtttctctaggaacaaaagaaaacgtaattgcttgaaaagacctaggattgccactcgcgtgcaagggagattgcttgagaccgggtttctctcggagagtcgtggcggtcgttgaaaattttctagtttcgggcaagtcagtgaagtatgatctcactccagctcaggtatcatggaacatgaacctttggcttatctctgatcttgactcatctctctccatcctcaacaatggacacatgcttctttagctgacttttgttagataggcataacattcatgcttgtgtggtttagtagaaacacttttcgactgtctatgattgattcagccattcaggtgagaacggggcagatatattattcctttttcttttgcttttgattttgtgaatttgggcttgttagaagaaaatgattaatgtttgtaaattgggttttgaatattgggcttgggagaggagctttaataattgggctaataatggattggaattagagttgagaaattagattaaaaaaaggattagattagtgatgaagtaagagtttttgctctctctcaaacggctcgctttgattactcacgtaaggtaagcttcttcgattctctcatctcctgtgtcctttgtgccgatcctcaaaaaaaactaatttttttttacctggattgattgattagccggaaagaatttggaaccggctctgtaatttatccatg

SEQ ID NO: 31374 - DNA, 3000 bp, Unknown; identical to SEQ ID NO: 9349
  misc_feature (1)..( 3000): 2750-1469P.txt file - cDNA_ID_3041470; gDNA_ID_1972097; Annot_ID_178639

SEQ ID NO: 31375 - DNA, 3003 bp, Unknown
  misc_feature (1)..( 3003): 2750-1469P.txt file - cDNA_ID_3041475; gDNA_ID_1972097; Annot_ID_178635
taataagcaaacagactacactggatcccaacatagaccaagtatactcattcatgatgaataatagtcaactagaactggttgatgaccactcaactaacacatgttatcatttgacaccaaaacaaactcaccaggttgcataatagtcaactagaactggtttatcagagttcacaagcagatcctcaaatgagtcaaatgtctgcttcttggcttcaatctgaagtatgaacaagaatggtttgtcatttagttcaatctaaatcaagaagtagataaaggcactcactttaaatcaattccaaactctagagaaaatcagctatagaaactaaaataagaaaaatttcaaaataggaaagctatcatcagctctaccatcagaagaaagtttgaagcttgaattcaataattcatagggtaaaattaagtaagctagaattgaacaaaatataagctttggaaaaagatgtttaagcagagaaaggcgattacacgtcgaggagtgcatcgagtcgttgaagataaagatggaaactttaagtctccggttcgaacccgacgaaccggaaactgaaatttgacggccgagatagaacgagaagcgaaagcagaaacacctgacgattctttcgaattcagcgacggaaccgtagaagaagagagagaaattgacgccatgaaagaatcagaaaaaaacaaacgatctcttgattcggcgttggcggttggttaggttgatgatgacaaaaaaagttggacacttgtggaaaaaaaactcgaattgaccaaaaagagagaacgaactctgaaagaaaatgacacaaggtactagaaagacaatgatgatccactacggtcaagtacaccgtatcttttttgttataggcccacaaacatgttctaggcccacatgttataggcccgttcccaaacaccgatcactcttcaatttaactttttgctcacaatcttcaggctcaatcatatgacatgacagatctcattgtaaatgcaatcgcaaagggttatcattatcaactagtactataaagatagctgttacttcccgccaacgcaactgggacagttaaaaccgttgagggtaacaaaagacaaaactcacgactccgtttttgagtttcctgaagatggaagttacgaatatgttcttgtgggcctcttcaaagaaacgatatgaaatagcctaatttaaacaaaactagaaaagtgtggactagagagagactttagcaaaaactaaaaacagatgtatcaaaagaagctcacaactaaaaaagatggagcttgaattaggtctgaagatcactcggactaaagacgatgtttcttcctctacagattttcgggttgccagagattcttttggtcatcgttcactttctcgagaaaccaactctgttttcttcctcattcttcatctcaaaggttctattccctctcatatttattcacctttttttcttacctagcatagagattgagattgaaaaccaaatgcaggatttaagaaggatggtatcgatatcgagataaacaaagaagggaatctgattaagatcagcggaagaaaacaggttgaagagatggttttggtaaagtgggtggaatggaaaaaggaaacagaaataaaggaattcaaaaaagtgtttcggattccagatattgtaattcttgacaagatcaaagcgaggtttaatgaagaagatgggactttaactgttacaatgcctaagaaagttaagggaattaccggtctgaagatcgaggaagaggacgaagaagaggagatgaaagagccgatagtagaagagaaaacagaggagaaaacagaaccagaagaagaaatcaaagaagagacaaaacctgaggaagaaaacgaagaagcagaagagccacagagagaagaggaagaagaggttgttgaggaaggaacaagagatcatgaggggaaaaaagaagaagaaatcgaagataaaccaagaaagaagagaagaaaaaagtttcgtttaccatgttttgcaggatccactctgcttatgtctattattgttttcattattcaactgattcaatccagaaataaatgaaaccacactccttaggtttttaagatagggttcttgttggtttttaaggatagaacccactttcttattatctgttcttcttagccttgttctttaaaacaataaaagtcaacgtgtaatacaatcaaaatacaatcagtatctaaaccaaaaattagtaggagcgtatcagctaataaatggaaagtatttgacccgaaccgtgtataacggctagattatcaccgaacctaaggtttgtgtttgctctggactataacaaaccctaagtgaaaaggaaaaaaggaaacttgaatgtcaaacaaataaatttatatacctgcgtctcgcgtctcctctcaagttaaaaacacaattgctctgcatttttttcaattctcttcttcgatttctgtctgcttcgtttgcctctctgttctcttcttcttcctttttgagatttcattattcatgtgttgttgcatctgcttgttggattcaccctaatctttggtgtgattcgttggtctggcctaagaacgactcatatatacaacggctctctctgttcacttaaaaagcaacgaagaagacgagagagatcacacacacaagcctcacgtcttaatttgtttgcctgcgatgataagatctatcatccaccgtagaaacagagacagagagagagatagacgattcgaaggacatgttgccgggattttaggcttcgagagtcatgatgttggaggttctatccggcgatggaggtgtcgatagattgaggaggtggagcgatcagaggattttaggcttcgggagtcatgatggtggagcaatcatcggagattggcgatggagatggcgatagattgaggaggtggagcgtattttccgttaacggataaagatg

SEQ ID NO: 31376 - DNA, 3000 bp, Unknown; identical to SEQ ID NO: 9351
  misc_feature (1)..( 3000): 2750-1469P.txt file - cDNA_ID_3041489; gDNA_ID_1972097; Annot_ID_178628

SEQ ID NO: 31377 - DNA, 3003 bp, Unknown
  misc_feature (1)..( 3003): 2750-1469P.txt file - cDNA_ID_3041495; gDNA_ID_1972097; Annot_ID_178624
tacagaagctttcacttctttacaataatgcttgctatgtagaatccattccaacacgcataccaccggaatcatgctcaatttcgaaatctaaagtgaaaatgaataagcaaaatcaaaacaacaatctttcaatcgaataaccgaaagagcaaatctccaagacaagttacctgatagaagccaacagagttgagcataagactaaagttcatagcagcgatagagatattagcaacaattgagaaccagagaagctcccaaagaggaacatgcttagaagctgatagtcccgttgcgtttgacaccataccaacaagagcagtgaatgcaaagtgaaatcccgttaacgttgtagctgtggaatatataaacaaagaaatcgtcagattcatgaagtgtgtaagctaatgggagatagatagatcagagtcagagagagagaggcataccaaagccaaaaccgaaaccagaggaagacatgagctgtttattagccatgatgattccaacggagctgattacattcatagcccatgcaccgacatcagacaccgccgatttcttctcgctctccggtttctccatttggatttgagaaaattgaacaccgacactatcagatctgaatctcgtgcaagcgaaaacgagatctgagaaatctcgattcgcttgcagattttgacagaatcaaacactgaaagagatgagatctggagaaaagtcgattcacgccgttcgtggaatcagcgaagaaagccaaaaagcgaaaaacacagacacacactcacgtatctctctctgtctctgctacttatgcttcactggttcttcactcgacgtagctgaatatattatcacaagcaagcttcttctcccaccattgatgctttccttggagttgttataaattcttttttaattctctgagatttcgaaaataatattatatatattaatggaatcattttaagtattaatttcattcattgacgcgtgtcgtttaccttatttgaccttcttctttcttcttttggtccacttgtttgttatttcaatatgagttctgtatagggatagttttgtcttttcgtgccgctggtaacgtcgtgcttttagttttcaaattaaattttaacttgcgagattattttattaaacgtttacttaagtgcttaaattaagccacaaggaactgataacagcgaattgttaacggtaatttataacggagtacgtacttactacttaatttcaaactatatatttaatttagacaggaaaatatcgcgatgtgtaactaatagtaccatttgattaaaatgtagaaatgtgttgttcattttcgaataatgcttgattttattataatcatatcgaaagtgaaaggaaataatcacaatttgccattggtcatagtcacaccgtcacactcaaagccaaacaatttcgaaactaaattattgagtttgtcctttgttcttccagctattctttacttgattacagtctcatttatatatacaaatgaaaaaaaaaaatcattacaacaacaaaatatcgtttttgttgtgtgtttgtatatcaagagttttggaaattgtactgtgtgttttatcgaatagttttagaaataatgatgggtctctgcaattattaatgctttgaagatgacaaaacctgtatatcttagcctgtgcctcaacacaaatagtaattgagaacacatgatctccaacacattgtcacaaaagagcttttgcatgtgctttcaacatcaattattttcttctaacaagcccaatttcacattagtttatgccaaaaccgaaaaaaagagagaatagttttacataatggcacacacattaaggggtttgaatggacatacatagaagaagccttggcttataaatcataacttatctttcgtgtattttcttggaaatatcaagtggagcttttgatgccataggatcgatgatcgcatcactgaaagaagatgaagaaaaacaagtaagcaccgacggaaaggaccgaacacttttgcaccaagaagatacatgttacaagacaaagagaccaacactgagatatcctgacttctccacgtgcatcatagctaggcgctgtgctataccagtataccacttagcactttaataggcctctcccgacacctgaacaagagaacttgcttagttgaaaaaagtacacaaaacaaaacgttataggccgacaagttttaggaattttataactgggctcataacataaacaaaattaaggcccaaatctgattctaacaaaaagaaaagagctctgtctctttcaaactgttgcaaagtggcttctgtagtttgttcctaaactagtcaagcaaggtgggctaacataaactcccaaaatggttggtttattacttctgtttgatgtgataatgccgcaattcaatgtgtattatgtctcttgaaatctttcatttgagtctcaattcacattcttttgattttatctttccttctttactatgttgcatatttcagagcatataattttttttttttgtcggtggtcaaagtttataaaatcaaaccaaataaaagaagtgattgaaatcatacgagaccccactggttatgttctgtataagcgccaatgaatcacaaagtcgaatcggaactgtagatgataggaaggaacaaagaaaggaatataggttaagttcaaagtggttaagctctctaatgtcgtcaatgaatacgtcatcatgaagaaataaataatttccaagtggatggacttggggaggtccacacatacgtcgtcaatgacgaccacgtcccttaaggcgaaataaacacttgccttcctaaattctctgatcaatcaatgtgtataaatatgcgcagatatatccattatcctccacaattcagggaaaatcttcaaagtgtttgcagagaaatctaaattcatcaacagttttttacaaaagaaatg

SEQ ID NO: 31378 - DNA, 3003 bp, Unknown
  misc_feature (1)..( 3003): 2750-1469P.txt file - cDNA_ID_3041521; gDNA_ID_1972104; Annot_ID_178674
ctggtcatgttgtaggtaccaaaagaagacagcgaagctaattcaggagatcacagcttctgcaaatgaagtagattgctcaaaaacgcttatcgtaacttgtcttatatgcaatgaattctttcgttaataactgctctgtgatcttcaaggtcgctcaagagacatactctttgatgagaaccgttcgtgtatatgggacagagaagcaagagtttaaaaggtgcgatctgtttccatgaaaaccattgacagtctcttttttctttatttatcttgtgaaaattttgcaatatcggccctatctgtttcaagactatttttggcagccaagttactttttgacatggattttcttcccttctgtggtggaaaggtacaatcactggcttcagagattggcggatataagtttgagacagagtgctgcatatggtatttggaactggagcttcaacactctataccatgcaactcaggtttctcaaatataacccctgttttgctttatttctctcttttgactgtttgtgggaaggatcaattaattttgtggttcttaaagatggtgatgctcatgctaagaatgtgacaagatccatcattcttttcttctcttatagattattgctgtcctggttggaggattgtctatcttagctggtcaaataacagcagagcagctgacaaagtttctgttgtatagtgagtggttaatctatgctacatggtgggtgggagataatttatcatctttgatgcaatcggttggagcaagtgaaaaggttttccaaatgatggatctcaagccaagtgatcaattcatatcaaaaggcaaggttcaaatttttggctaagagcactctgtcttagaaacatgttgaccatttatgagattgatgagagagtgagttaggttgttatcagtagatattactcttactatcaaaccccttccaggatgaaccacttaagagtatatgactttggacttcctacctggaggcttatagtgattgctacgctctaccatgtaatgtatttttatttatatactgttctgtaggaacgagactgcagagactgacaggacatatcgagtttgtagatgtgtcatttagctacccttcaagagatgaggtatgactgtaccgagtggaatctattttctgataatttttttgcttttgtgtgaatgtccttgaaccacagttttttgcttccaacgttttacaattgtgtgaatgtccttgaaccacagttttttgcttccaacgttttacaattgtgtgaatgtccttgaaccacagttttttgcttccaacgttttacaattgtgtgaatgttgcaaattaatggccaaatatatggttttgcatttgcatcattttacatttttgttgagtatattagaatttatgcacacacatcataaagagttttccagtcatgtttatagtatggggcactggggctcatatatcagtttttcataacaattatatcatatgtcaatctctcaggtagcggtggttcaaaacgtaaacatttccgtgcatcctggtgaagtggtagcaatcgtaagtaaatctcaaagtagttcaacaatgcaactgttttccttagaatttagcggaagtgatatgtgtgcttatttgttttgtttaggttggtctaagtggcagtggcaaaagtacactggttaatcttttgctgcaactctacgaaccaacaagtggtcaggtactgtaggttactcaaactcactgtagaataaccctttaaagtcttccttcttaatagctggctttttgaattccagattctactagatggggttcctttgaaagagttggatgtcaagtggcttaggcaaagaatcggatacgtggggcaggttctcctcgcttttcgtctttgtagaacaaataaactttgatgaatttcactatccctttctaaagctgtcacaatgaaacaggaaccaaagctcttccgcacagacatcagttcgaacatcaagtacggatgtgatcgtaatatatcgcaagaagatataatatcggctgcaaagcaagcctatgcacatgactttatcacagcacttccgaatggttacaacacaattgttgatgatgatctactcagtggagggcagaaacaacggattgccattgctcgtgccatccttagagatcctagaatcctcatcctcgatgaagccacaagtgcactcgatgcagagagcgaacacaatgttaaggtaacctctctattaccaaaaagacaaattacttggatgcaagaattcttaagccttttgtttttccagggcgtacttcgttctatcggaaacgactcagcaacaaagagaagcgtcatagtgatagcacacaggtatctttttcttgcactgatccaatcttttacatgttttgatcattgatttataacattctgttccttcacagactttctacaattcaagctgcggatagaatagtggctatggacagtggacgagtcgtcgaggtaagccactatcttacggttttgataaatacatagaaaccattgatggctttgattttgactgttatatttgtacacaaaacagatgggcagtcacaaagaacttttgagcaaagatggcttatacgcgagattgacgaagagacaaaacgatgccgtcttatgattgatcctacacatgctaaactgttcatgaaatagtcatgattatgtttttgaatggtcatgacgatatgtaatggcaaaattatgtaaagtgtaaccatagagaattcttattatttcacacaaatcgtgtcgttctagtatagttgacataaactgcctgccgtttctatatttcctgttaaagcacgaaaatttatagaaagtggaaaccactgaagacgacctgtagtttatcaattcgagaacaagcaagcaagcgatctcaaacgcaagagtcaaggactcaagaccttgctgctaatg

SEQ ID NO: 31379 - DNA, 3003 bp, Unknown
  misc_feature (1)..( 3003): 2750-1469P.txt file - cDNA_ID_3041525; gDNA_ID_1972104; Annot_ID_178673
gaatttgtggagcctttttctgagcaatttgattgcttctatctgcagttcaaccttcaaatcccaaggaagcgatgaaatggttgaaacaatctgcagagaatggttatgttcgagcacagtatcagttagctctttgtttacaccatggtcgggtcgtgcaaaccaatctgcttgaagctgtatgtgccttcttctgattcttttcttcatgcttctagttgagattctatattgttttcatgaggtgaagctgttatctagattgaaagtagtatctagtcgtttatactaatggctgcactcttggtggaaactgataatcctatgtatagacatgtgcttagttcgtttgtggaaactgatactgctatgtttggatgggttattggttcatttgtggaagctgataatgctatgtttggacatgtgcttagttcatttgtggaaatgtgcggtttctgtttttcatctttctagaatcagtaaagtttgtatcgatatgatgattggattttttttctctttttcgacagactaaatggtacctaaaggcagcagaaggtgggtatgtacgagcgatgtataacatttcgctttgttattcggttggagaaggcttaccacaaaaccgcaagctagcaagaaaatggatgaaacgagcagctgatcacggccacagtaaagctcagtttgaacacggccttgctctattttctgtaagcacctcaactcaactactgcttctgagagtctacttctcttagtagtaatagggataacttatcgacttatgtatatccagaaacaaacatattacgcaatgagttcattcgattttaggttatgagaaggtttggatatgtaagtaatgaatgtaatgggttgatgcaggaaggggagatgctgaagtcagtgctttacttagaacttgccgaacgtggtggcgaagcagctgctactcccgtcaaagaagttgtacaccaacagctttctgcaacttttggtggtcaggccgtacaccatgccatacaccaagccaataactggcgtcctctaccagttactcgatgactcctatcatttatttcagtgaggtctagtgattggctagttacatgtccataacttaaattccaatttgacaatgtatcaatgacaaaaccttatttcagatttctacttttagttcgtactcatgttttaatccaaatggtgcgactgataaatttgtatccacacaataccaccaaaattgtaaatccgcgtttgcagtaggataataaatattacagattgtttcgattttggttttcttttgtgggtttgaaatgttccatggtgtagtgtacaagtaatgatgatttgaaaacacaaactttatatgaataacatgtaaaccaagcttatcccaaacatatgcgatatgataaatatcatacggtatatcatttctcatagcacgacactgagcgtaccatttgaaaaattcaacgatttcttcagatcttgcttgaaaataaagtttgaatctcaaaactccgttcaaaatagaagaatatcaaaaacacgatggatacagtataatatccaaacacattattttttcgtccaaatctatgtgactatgttgactccgttcaaatctatgtgacaatctgtactattgggaaatttgaaatgcatttccgcatatttacgtaaatacattactaagcaaaatcacattctagctgtttcaacgttacatataactaatcaaatgcaacaacaccttctcactttgatgacaatcgaacatccaattaaaaattcaacaagaacaatgcatatgtatggtagaaacaatcacaacgagttaaaaggatcgtaacgaatgaatcatgacagacaattaaaccagcatacgcaattataagtctgaattcggaataccaaacatttatcaaaatccaacaaaaggttcataaaactactaactttaaagagatctcgctctttccaaaatccaaaagacaacaaaagatgataaaactccatagaagattcaaaaacagagttaagcaaataaattcacctaacttaagcagtaagcacaacagcaccaccagcttccttaatcttcttctcagcagtcttcgaaataagcttcgccttcacaacgaacggcttgttctcaggcaaatgacctttacccaaaaccttgaagaaaccatgttgagtcacatcgatcaacggaacattgtccttggttgatttcgccttcacatcttcagggacgagtgaccaaagcttgtcgaggttaacgattgggcagaagaacttgttcctcagcttgtggaaatacctcataccaactttaccgaagtaacctggatggtacttgtcgaagaggatcctgtggtgatgcatacctccagcgttaccacgacctccgggatgcttacggtgcttaccgatacgtccatgtccggcgctgacgtgacctctcttcttcctgttcttcttgaatctggttgtcattttcgccgatctgctacactctcctccctccctttctctctttgcggctagggtttcttaagatatcactgagtttataaagacgataaggatttttacgtttcctattttaccctctagggtttacgacattttgggctatttagttataacgcgagatgggcctttaggcccgattatatcgtagagggggaagagagatcatctaccacaaccacatgattgaaccttcacgcgcctttctgacgcgccggtgttgttgttgttaccatgtggttcatgccttcggtggtggatctccgtgggttccacctcggtttattttggttgacacgattcttccttacgtgacgtctttcttcttcaatttcgaaacgacgcgttttaattcttcttctgcatttcatatgaaccaaggaaaaagcttgaagcgtcgtgactcgtgaagcttcttcatctttagtccaccgaacataaatg

SEQ ID NO: 31380 - DNA, 3003 bp, Unknown
  misc_feature (1)..( 3003): 2750-1469P.txt file - cDNA_ID_3041529; gDNA_ID_1972104; Annot_ID_178669
gaggaacaaatgctgaagtttatgggagcaaacacacacttgtctgttcagcaggcaaaagaactcatcgaggtgcctacaataatttaaactaatgtcctacaggttttctctattttttatgtctatctttctcctgtcagcctatatctatgatttacgcgatctataaaaatgctgtttgattcttccaggacgagaaggctggatttgcatatctcagtctacgagaagctcggccatctttgtatgaaatctgagaaacatttatttgtgatatacaaatgcatacgacattttcctgttcttccataagcagtttggtggtaaagataacatctgatcgtattgacaaatttctttgacaaatttgcagatattcactaatcgaaatgagggagcatataaagaagcgccctcctctggcaacaacggagaaagttcagcaatttgtgagggtaagggatctatgaaatgtcaccgccttatatgctccacgcaaatagaatttaacaactcatgtgactaagacaagtttaagggggaaagatatcatagggcttgacagaaagtgaccgtatgcagacatttcatggactgtttttcaatgcaggcgacagggaaagaagccattgttgctgggttttaccatgaaggctacgaagagcctctcttaatgcttatgagacgaagaggtgtccattctggtttggtggttaaggttgagtctctctcttttaccatcaaatatatattaatgccctacgagctactacacacttgggacgtagacttagaacctgaattctgttggaagctctttccatatgaagttttgaacttttagtagagaaaatttcaggtctgattgtaagggaatttataaggcttcttttggtaatgcagggtgaggagggggccctttcaatgacaacacgggtgcgagctgcaagtgcatcaaaagggtttccagtcaactactgttccgggtttcgttcattgagttcggacacggctctagaagctgacggttagaatagctataataactttccttgtttcaaactagaatctactgcttgaatatatgaaccgagtccagacagggttgacacttaatttcacaggtgcaaattagtgttgtagtaaaccggattgtaggtggtaggagttcataggctaataaactattagctaatcttatatttggtcgatatggagtcatgatgtatcattttaccttggtgatggaagtcttttggtggattagcctaatctagagtgctatgaaatctaattcagattagattggtctttgtgctatctgatattaaacttatttgccttatgccttggtactagtatatgtcttgttgtacatcaatatagtttatgctcctaaaactcatggctaaactaacttctggaatcgtaggtgtatcgcgtcagagtttcaatcttgaggtggatgcgagaaactatgggtttgaaccaaccgagactccacgaactgatcgttcggtaaaacttccagaagccatttgtttcacaatgttgaggactgttagaaaaagaaaaaaaaagagaaaacttaagtcatacttttgtttaatgaacaggtgtcaaagaacatagagctggggctggcagcgcttcgtggtgagaaaggagcggcttatgatagaatcgtcctaaatgctgggattgtggaccatttgttgggaagtgaaggtgcagaggatgtagctgtggcaatggagagagcaaaggaagctattgacagtgggaaggctttaaagaaacttttgaattacatagaaatctcacgcaagataaaatagttcaaccaacctgaagagtctgaaaaatcatacacggaatagagaaaagcatacacctttctgattcttattgatttcgttttgtgtaatatgtttttgaaacttgaaagtgtttttttacagaattggacacacaacacaatgtggatgtctagtgaatcacgtgtacagagtctgagaacaaaacttggttatttctaatgtgtttaatgtttcttaatcattttgcacattcatgttacttaattagtttagtcccgtcaaagattctgatggagacattcgagccactctttctcttgaggataatgggaaacaaacaagcgagtcaatgtccggaaaatgacattgaagccgaaggcaagggacgtgggacgattttataggttgtgttgcagaaaaaacagagtccatatcaattctctcactcgttttttttaatccgttttgtagcaaaaagctagaaatgacttttggttataaaatctttctttttgccgattcaagtggctcagctgcttcgtctttttgtgttctccttatgccacatgatctgatcagacgagtgtccaaattcacgtcagacacacaattgtaatctaccgaagattttattttaatatcatataaaacgctattgcaataagcgcccacacaagtctttcttacttgccctgctctggaacgtgactttggaggtaacgaaactgtgtcgtgagttgatctaaggttggtataatttcttgtagttttgtccgatttcgaaaacccatttcaaaaggcgtcgcctttacttttatatcgtttgagactgttctgtagattttgagttgtggggttcactctctacgtgggttggtgatgatttttttttagctctgttcactgttgttttattggaataagttgatggtacgttctgtagttatagattcgataaaaaaccaatctttatgatcgactcaataagtcaaatcttgttgtgttaagtgaaatctatagtagtgaaagggtctccacttagctgtttggttagtcttgttataagctcgattatgtcctttcttgtgatcagtgtattaatacatctgcttattttggttgtagaggggaagtgaggaatcattttgcttttagctttgaaaagtaaatcctggaaatg

SEQ ID NO: 31381 - DNA, 3000 bp, Unknown; identical to SEQ ID NO: 9361
  misc_feature (1)..( 3000): 2750-1469P.txt file - cDNA_ID_3041537; gDNA_ID_1972104; Annot_ID_178663

SEQ ID NO: 31382 - DNA, 3000 bp, Unknown; identical to SEQ ID NO: 9370
  misc_feature (1)..( 3000): 2750-1469P.txt file - cDNA_ID_3041585; gDNA_ID_1972105; Annot_ID_178716

SEQ ID NO: 31383 - DNA, 3000 bp, Unknown; identical to SEQ ID NO: 9373
  misc_feature (1)..( 3000): 2750-1469P.txt file - cDNA_ID_3041592; gDNA_ID_1972105; Annot_ID_178710

SEQ ID NO: 31384 - DNA, 3003 bp, Unknown
  misc_feature (1)..( 3003): 2750-1469P.txt file - cDNA_ID_3041596; gDNA_ID_1972105; Annot_ID_178707
ttggataacccaaagtctgaaactttggctacccagttctcatctacgaggatgttagttgttttaacgtctctgtgtataatcgtgtactttgctcctgtgtgaaggtaatgtaatcctcttgctgctccaatagctatctctagccttcgtttccaagttaattgtggtttctttgtgttgtatagatgctcacggagtgttccaaatgccatgtaatcgtatacgagacacatttctcctccctcgtcgcagtatcctatcaaggagactaagtgtttgtgtcttagtcttgagaggagttcgatttctgtctcgaattcgttgagtccttgttctgaatttgggtttgatttttttaccgctactttagttgtgccgtctataactcctttgtagactttaccaaaccctccaactccaatgacgttggaatcatcgaagttttgtgttccgtgtttgatttctggtaaagagaatctacggcataaacctgctgcgagattggataggtgacttccattgttgctcttccctgagatggttgatttggttcctgatgtggtagagtttccatatataggaagccaacttgatgtgtgagagtcgcctccttgatatccttgtttcttcttgtaggccgtgaaacacaaggcaccgattaaaaccgctaaaactcctccggccgaaccaatgatgaaagcgtgtctcttttcgttcttgaattcttttttaacctcttcctcagcttgcataggcgatggctcggggtttggacccgcaagatttttcatggtgtccatcttgaaaatctctaacccgttaagagatgaatcataatattccggttgaccaaaagttgatggagtcatctgaagtgtaatctcttcgcctccgttgttggcatcaacatatatcgcgtagtctttgtacatcgggattcctttctctcctgtccaccctattatatctgcaggagtagtatctgcctgcgctgttctgttattgatgtaaatgttgaaaaccttctggttgatcttggaaagctggaattcgcagaaatggagtctcaaaatgtaggtgaagttcttatcgatttggaacatccatgtaagattggatttgaggttgatatctccgtttgggccttgagatcttgcggttttgtatatatcggctggagctatagacaccggcatgttctggtagttgatcctaaaattgttgcttgcttgaagtgtaacaccaagacccgcactaaagatgtaaggtgcatcattataccaagttcttgtcaacccaccggagtcttggcttccagggatgtcctgaccaccaacattaagtctaaacattgactgaagattcgcagtcttggcatccattgtttggtctgtgaaaccaacaagagccgccgtgtcaaacaattccggcatctgaatcacctcgataccgtttataaaggcaaatgcgtctcggtatttatctgaaggggtaaacttgatgctcaaaacatctttgtcagtgggtgcaagagagtattctttaaccagataagcttgagtcaaagcttgacacgtaatcgcggcgctgaaattgctcagtaaggtaacatcgttagcttccacagtgaaatacgagttggaaatgttgagaccggtgtatgttgatgggtagaaatataaccgaagcaaatgtcttttatctcctttaatcgggatttcataagttgctggagctgtaaagattctggctgtcatataaggaactgttgagagaagtgaagggtcttgatatgtagccgttgcgtgaattgagtttccagtctttaaaaactttgtatctggttcccattttttcttatcttggtcagcagaagcttctgatgtcccgcagctcagagctaaatcttgtccgttagatctagttggaaaaaccaatagaaaggagagacatgtgaggaaaaagagaatccgagttttcccgctcatggctgacacatcaacgggtagagactctttgccttaaacaaaaaatgaggagagaaaagctttcttttttgtaagaattaagatcacttttacgcttgtggacaaaattagaagtttatttcttattgtctctgtaacctaaccatagaaagtcaggacttgcatggatgaacaagaagcaaaaaccttgcaagaaaaaaaaaaacaaggtacacactcttttttcttttctattttctcgttttgtctagtttttttttgtttgtaattatgaggttactggtgtttttctcattttccgtcgttctgtctgaaagagaaacaaaattagttagaaaaattcgtggtggagaggattacccgaacaagctatgtttagcatatagttagagaaactgaaaagacttttgttctttgactacaacatgaaaattcatgtaatctaaatatagaactcttagaccatattgtttcaataacattattacaaacttttgaaagtttgacttgatagagatagactacgacatgttttgaaactcttttcttagaatggtcaaggatctaaacaaagaaagtccctaaagatctggatgaatcaatcgtcaaattttaagcaatggaagaaaatagctttttgacttttatccattacatagatcaatggtggaaactagtttgttattctccattaaagcactaagagtctcttcaaagtttatctggtcgggttgggaaaaatccaactagagaagagcataaaagtagacatctgatcaacccgacccataataacctttttttgttggccgcgtaatatgttcgagcgcggccatcacactaagaacattcataaaaaaaaatccacaggattcaaagcccttaagctttgatcatagtctcttaaagaggtagtaaaaccataaactagagccccaatttgcattcacaagccacctaacacattagcttctggtcatttctgctttatatacacatcaagtaaaaaatg

SEQ ID NO: 31385 - DNA, 3000 bp, Unknown; identical to SEQ ID NO: 9367
  misc_feature (1)..( 3000): 2750-1469P.txt file - cDNA_ID_3041600; gDNA_ID_1972105; Annot_ID_178706

SEQ ID NO: 31386 - DNA, 3000 bp, Unknown; identical to SEQ ID NO: 9375
  misc_feature (1)..( 3000): 2750-1469P.txt file - cDNA_ID_3041604; gDNA_ID_1972105; Annot_ID_178705

SEQ ID NO: 31387 - DNA, 3000 bp, Unknown
  misc_feature (1)..( 3000): 2750-1469P.txt file - cDNA_ID_3041614; gDNA_ID_1972105; Annot_ID_178696
tatcaacatctaaaagttatataaatcaggattataatatcaaaaaaattatattattaaagtttggtttaaatttttttattaacttacatgatcaatgggatccaaaatcagtttacctctcacattgttttggtgctgaaaagaaatatatagatgggtttttaaaagaaacttaggcccatttaggttgcaaacaaaataactcaggcccatttagatttacaaaaggctcaaccactaaatttttatacctcacaagcatagtggtctctctccgtcattcgctctttactcggtcaacgaaccgtttgaagacgaacacgtgtcacgttttagtaggacttacgagaagcgcaacgagtgctatataaatgccgttaagcgtcgtaacggttttctaattccccgagagtaaccaacaacccaaagcgatcaaagaacttttcccgctagagagagagagagaagaagaagaagaagaaaagttacgcagagagactgaaagaagagtgatcgatcggagaaagatggcgatggaagtagcaacaccggctccggcaccaatcccatcggagaggaacatcgttctcgcgcctgcaacaacaacaacaaccgccactgttgagactcacaagaagaacaggatccaagtttccaacaccaagaagccattgttcttctacgttaatctcgccaaggtaatgatcggaaacctaaattcatcaccggatctacggtttttcagatcaacgagtcttcctttttctcaattttgactgattctgtttactagagttcgagattcgcttgattttaagattgtagattcagttaacgaaacatcgttttagtatcttgaaacgaacaatcagtattcgcctggattttgtttccgatctgtttttggatacttgtagtattgattcaggatcgatctttatctatttgatactttgtgtccaccaagtgtttgattgtattacttagagagtaattggatcttttcgttgtttgatgcagaggtacattcagcaacacaacgaggtcgagctttctgcacttggaatgggtatatagactctttcttttacctttatcttttttatttgatcggtttctcatcttttgcgtgtatatgtatataatcattaatgtgtgtatagcaatcacaactgtggtaacaatctctgagatcttgaagaacaatggacttgcaacagagaagagtgagtcagatctctcccttcttaccatcaatctttgaacctttcgttctattgaagaaactgtttcatctctggtctgtgttgaattacagaggtgctaacatcgactgtgggaatgaaagatgagacaaaagggaagatggtccagaaggcaaaggcgagtttcttttttactacttccttatacccttttgaagttttatttatctccttttgggtttgttattgttgcagattgagatagtgttgggcaagtcagacaagtttgactctttggtgccacctgtgaccaacggcaagactccggaggaggaagccagtgcagagacggaagcttccgtggaagcacaagaagaagttgccgctgccaccgaggtctaggttggagccggttgagagatttactgcagaaggactgatttctcttttactatgttttgttggcttttgtttcgtttgtgacatatcgaacataatactctagatatgatagtaattgtttgtttagcaacaaatagtattcttcactctctgcttccatttaggatcttgaacaatattgatataaatatttttctctgatttttctcaacttttttagtctttgtccttaaggcaaaaataaagaaaagaagttttcaaattaaaatttgtttcgtggaaagcactcccatttgtgctaaataactgaagaccaaaacaatgttgcaaccttagcaccaaatttttgtagttattatttgacgactctataatatcaaaatcttctataaggtgtccactatctgcaaaatcaatgcaatttctgtgaaataactaagcttacatagtaaagtctaatgagaatagtataatgttagcctaaaaaaaagcaaagttaaaagaaaattaaaacaggtataaattgaactaataataaataaattaataagaaaaaaatgtttgttcaatgacctatcccacttccaaatcaataaaatagatgttaaaaaaaaaagttatgataggccttaaagcagatcacggcccatacgaatgtgactttggattataaatatacgggctagctcaatttgacaaaactagaagctgttaaaattagaaggactaaagtgttaataaaagaaaagttcactagttgtcgatctcaactttaagataattttcacccgcctccattgttaccggaatctctctctttctccgccgaacttcttcgaatcaagtttccgtttatcactctaatattgttaaagtttccactgataccacgtaatttcactgggttatctttaatcctaagtttaagcttttggggctatagttctttctttttcattgtcaattctagggttcctcgctggggtctatatgttcgctgtgttaatttagggttttcactagtccgaaaacgatattttcgtgtttcattaagcttatatttttctttactaactgcctctagtttatagatgctattttctgcagaataagcttaggctaagttgatacctcttatatgaagcagctattaggtgacctagaataatttgttagattttgaattttgagcatattattggcgaagctgttactttatagatgcaaatgttttaattctaggcgttatatttctttctaacacatgctttataacaataacttgttgaaggaagtgaaatcttcaatgaaactttaactgtttgtatatgtataacgggactaatgtgtgttatctggactctgaatttatgtcagcgctctagtcatg

SEQ ID NO: 31388 - DNA, 3000 bp, Unknown; identical to SEQ ID NO: 9378
  misc_feature (1)..( 3000): 2750-1469P.txt file - cDNA_ID_3041624; gDNA_ID_1972105; Annot_ID_178689

SEQ ID NO: 31389 - DNA, 3003 bp, Unknown
  misc_feature (1)..( 3003): 2750-1469P.txt file - cDNA_ID_3041628; gDNA_ID_1972105; Annot_ID_178688
gacaacgtcttagtcgatctcgtaagcggcggtgttaagctctgtgatttcggatcagcggtgtggttaggcggagaaacggcggagggagttgtgggaacaccgtattacgtggcgccggaggtagtgatggggaggaagtacgacgagaaggttgatatatggagcgctggtgtagtgatatacacgatgctagctggagaaccgccgtttaacggtgagacggcggaagatatatttgaatcgatattgagagggaatttgaggtttccgccgaagaagtttgggtctgtatcatcggaagcgaaggatttgttgaggaaaatgatatgtcgtgatgtttctcggcgattttctgcagaggatgctcttcgtaagtcatcttttttttctcgattttttttttttttttgagtttgctcatcaatttgtaatggtgaattgcaggacattcatggatgatgaacgttggaaacctccaaagcaattagtcgaagcttttcagatatgtgattagagagtgtaattagagaagtcgtaatatagatgtgagtgtgtaattgtttgattcgaatagtcaaacgtagttgtgtgtttcagcaatcttcctacgttttgtcactagagaaagtatgttgaaaactttttgtaacgattcgccagattcagaataaaattgattttgagatcattgttgagagttaggtcaaaatctgaattcgattatttgctccccaagaaacaaaaagaaaagattactatggttggtaaatctgggccagtagaagggatctttcggaaattgggcctaactgatgaagtttagatattttgggctagatttgtcgaattttggggcccgtttcaggctaattatgatttgttcgagaaaaaaaaggtttcgaagtcaatgcaaaggcaaatggagttcaattattctccagacctggttttcacattaactaatactcaagtaattcgtctagactctaatgtatactagggtttttaaactaaaagggacatttcgtttttaaaaacagccgtggactgatttactaaataattcttttctatataaaaatatcttatagccaaaataaaatattattagtatatatgtgaaagaatatccaccaatgttaagaaacaaatctttttttaagtcaaaataaaatatggttggtatattgatatatggaagatacatcaatggtgagaaagagaaatgtcaaccttgaacctaaatgttctataaattcatcttttacttacaatccagaaaatcacaacatcttttttgaatagattttatagctgatacaacgagcaagagaaaatggccatcacaaagacttcagtgactcttttacttttaataataatggctgcttcgttgtctaatttcagcgtcttggcttcaggtatgtttgaaataattctatgctgttaatttcttattaggtttcatcacttgaaagcaatgacattgatatgtatgtatgtacttaaatcatgcatatatatatatatatatatatatatagtcatatagatatgatattcatgttgtgagtttgtggacatgcagagatcaaacctacaggaagagttgataatcaatgcaaggagatgtgttcggcaacgtttggggacggtaaatgtgccgcagactgtaggaaggctggtttctcatccggacgatgtcttacttcttctcctttcggaaataaatgttgttgcacctagtgatagctagaaccaatctatatgactatatgagttttctcttgttgtattgccacatattataattgtactgcaatagaataaaataattttattgttatatttttctttaatcatcaaaagtaggagctacaattacaatgcacgagtcgattaacatactcttatgactctttaactactcaattattacgtacgagaagttttctaaaatttcaatactgaagtggtgatattgtttacacaacgcaatgtcaagttttttcataaaaaaataaaataatcataaaaatatatgtttgcttgtgtttaaacaatcctaaacattttgtaaaacttcagaataaaaatgattaatttcaaattatgattgtcagttaggtcgaaatcccaaatcgaccatacccttatcggattggactttagatcttttgttaacaatgacgtgcataaatgaattatgaaaagttgagttaataaggctttttttgttcctgctctaaaaagatggccaatattgccagtaaagaaaagaaaacaaaaagaagcaagcaaataagtgttaacattcatggcttaactatgatgaatattgatgattacttttctatatccaacataatgatacctgttacttacattcataaacaagtttgaaaaaatcgcctagagatgctagattagtttagttattgcaaggagagatgagccattgatgtatgggtgaaagctcgattcgattagtcaacgtagctgagaaagttaagttggaaacattattttgtaacgtttcggaacaaaaaggatcttttgggcctatctagcaaatttgtgggccgttctcaggctaattatggtttgcttataacttagttattcgcatcactcctacgatttgttctaggatctgtggtcaaccttggttttgaaacaaaaagggacattttgtatttcaaaatagccacggattgatttgttaaacaatacattttacaaaagaaaaaatcttttagtcccaaataaaatgttattagatacatgtggaagatccaccaaatccaatgttaaggaaaaaatctttttaaatcaaaataaaatattattaatatagaaagatccatcaacggtcttcttttctacaaccacaataacctaaaatgttgtataaataaagcttctacttacaatctacgaaaacacaacatttttttgaatagattttatagttaatacaacgaggaagacaaaataatg

SEQ ID NO: 31390 - DNA, 3003 bp, Unknown
  misc_feature (1)..( 3003): 2750-1469P.txt file - cDNA_ID_3041647; gDNA_ID_2213663; Annot_ID_181914
tagaaaacgattataagcatagatatgattcatttcaaatgaacatgctccacctataattctagctaggtgcaaaattgttgacatagacgaatcaaaagtcacacgtgtggttgcatgcacgttgactatataatcttccatgcttcttagtttattacaacgttttaattggttgattatatattttaatatttgaaggagacttttggagtttcttaactttgacaatcttagtataactacgtatgagaaactccatttcatacaaaccaaaccaaaaagtcacattttgatcaatttcttgccgagtgttttattcgagatgttttgaaagacttgccgtgtaacatgtatcctttacttacagttgcagtttttgtcataggtttccttctatgcgaactttttcataatcagtatatttaacgttgatgtcacattattcgactattaataaaactaatgaaactaatttaacaaaaaaaattaactacatatgcagtacaataaaaaactgttcataaatcttttaattcgttagcaatataaatagtgcacaaaaacttaaacaaaatcaactttttaaaacaattttttttttgtaaataattaaataataaaaaacagattgagtaattgacaaccatatatttttttctaaatagaagaaacttgtttttgaagtatcttttatacggtgaagggtgaactaaagttcaattattgttttaatctctctcttttttttttatcaaaaactattgttttgattgactgcacgattaccgaaatataaatagctggaaaagtaaataactgccacgtataaaaatgagaagaaatcaaaatcaagggtattttggcttagcgtgtggttagcgtgtgtgtgtgaatgccgatgtggcatgtcattttttttaagtagaaaaacttatctaaattatgtatgtataaataacataattctaggatatttaacttagtaaactgcgttttaaagaaaacgttaactagatcatgtgggtgtttatgattccacgtttgctcttctgagaagaaacaaattaaatgttttaatttggtttgcatcccagcaagaaacatatcaaattaagattagtttaatacttgcttcattagacaaaacacgttattacttataagttatactactaacattaatcaaaattattggtatttgattttgtcaacaaattattgttgatctttagcctttacacatttatttttatatatggatttgattcaaacttttgggttagttcttatctcatttaatccaatcagatctcggtttgtttttatgttttactttttgactcgatttattatttttcatgatttttttttgttctacatcacagcaaagatgagatacatatcttgttaagcatgatatatgtataactatgcagtatactttttgtttatgcatatacattaacaactgtgtaaaggattttatcattttaagttgttcttatccctttagtttatatttgagggaagaagaaaatcactttcatatgtttgatttctatttttgtacatactacctaatttcaccatttatgcatgataattgctatatatgctagaaaaacagggaaaattcaattaacctaacaaaattggaaaagttcataaatcagataaagcagcgagcatcgcattcaaaacaatacgttaggctgtgcgtactgttttattaattttaatttctttacaaaaattgaagataaataactcaaaaacaaaaaacagaagtgaatttacagtctcatgatcttattttacattatatatacgaatatgcattatgctatagttcttctattcaagttttctcgaaatttttcactcagaaaaaggatacaataaactaggactatagtatgatgattgcgtcatcagccgcatctgggcttacgtggatatggttaggacaaaagtaaaactaaccaatcagatgtcatcccagaggacacagctgtctcatttgggtccacttctctaacaaaacttcttcaattattcacacacaatacaatgacacatataaacaatttaaataatttattaaatattgaaacggaaattttgtgttcatacttaggttcttactatgttattgtattttttggaaaagcttgaggactatttctcataagtatataaattttttgtactcaaaatttcggattcaatccctagaaatacatttatcaaacaaatccaatttgagttttatttacaaatacaaatttgcaatttaatatgacatgggtctcagactttacaaaataataaagtctagatactacgaactcgttcgtaattagcaatatatatatatatatatatatatatttttccacttagcaatctttgttttgaatgtataaacaatgaagcctttacataaaaagtctaattagacataaataatgcatttaatattaggagaatatatagactacgtgcacaaaacgaccaaaattgagtaagatattaataagaaatatataaattatatattcaagtttctgttcataaaacatgcttgagtttcgatgacgatatttgctagtttctccataaagttctaataagttttttaaaaaggttcttttatttggttgaagatattaatactaactgattttatttactttttatccactacttgacactattttggatcttttcctccggtctactttacagaaaataatattctatatttttcataaatatttcaatctcaattttctttaaaaaattatacattcaagcactaaacgacagaactctacacaccataaattgccctcaaaacctgctctacgaaaaatttcaatctttggctcacttctttgtttatctcatagctcttcaccaaaaccaatattttctcctttgttgttctttcttttctatcaaaactttctacttaaaatatcattcctttaaacaatg

SEQ ID NO: 31391 - DNA, 3000 bp, Unknown; identical to SEQ ID NO: 9380
  misc_feature (1)..( 3000): 2750-1469P.txt file - cDNA_ID_3041647; gDNA_ID_1972110; Annot_ID_178757

SEQ ID NO: 31392 - DNA, 3000 bp, Unknown; identical to SEQ ID NO: 9383
  misc_feature (1)..( 3000): 2750-1469P.txt file - cDNA_ID_3041654; gDNA_ID_1972110; Annot_ID_178751

SEQ ID NO: 31393 - DNA, 3003 bp, Unknown
  misc_feature (1)..( 3003): 2750-1469P.txt file - cDNA_ID_3041658; gDNA_ID_1972110; Annot_ID_178743
taatggtgttgcatatttcaatcaaaagcatttttggccaaatttatatcttatcaatgatactcgtggctccacaatatcatattaatcaataatctataagctccctaatggaaaacaacaacgccaatagaccaacaaaatcaacaaaaaagctaactacctccatagatcgatcaacacaagcttctattgattttcattttcacacatatacaaatcgaaagcaaaagtaataagatagattcacaaaaagttgaaaagtataaacatttgcatagtcactttaatagaaacatgttcaatcatcgtcaaaaatcacgatctttcgcatagtgataacaaaatgtagcaagaaagtctcagctcaacaacatagaaatcgaatcgagatgtcaaaaggatgtttaccagaaaaaaaatcgattttgtttgtagagagcttcgaaaataacgatgatcggaagatgaagagagtggaacaggaacgatccagaacaacaacaaaaaaaaaaaactttcagatctctcctcaaagttccaaaatgagaaagtgattagcttccttctccaggtgtgacgattcgaaaacgcttttagagctgtgggagtaaacagagggagatagagaaagagacctagagagagaggtagttgcggctagatttagggttaataatgaagaagacgaagaagatgagacgatgaagaagaggttgcaatttttgtaaagagatttttgagttttggcaaaaaaaagtaagtttttttttttgtttcttgggggaaggattgattcacttttttcgatatttttttctacgtaaaaaatattactaataataatattttgagaatttaacactaattaatttttctctttttaaaaaaaatcatttttgcaacgttaacttttttttgttctctgtgctcatcatccctaatcgcagatgctacttattggctatcgctgttccgctttgggttcctcgcgtgcctttttttttgtacagatatttgttcatagaaatattctaaaatgttatatgaagaaaacttaattaagaaaatgctttgttatgtcatacgtgtaagcacatttatcacataaattttcactcgatttgttttgaaacaatgaaaaaaaagaaagaggaacttgtttctttttgttgacaacaaatcgtatgtcacaaaatccattaattcatggagatcggtgaagcacatcgcgctgtatgcataatggctttgtatatttgtattagaagtcaatgatttggaattaatatgtcaagtgattattaaaaaaaaaacgtaagattcaagtacatttcatattgtttggctataaattctaggcaatcaaattatttaaaacatgcttagaataaatatatttaactctaatatcagtcgagtgagatggcatagaaagacttcaaagttatcatgtgtttacttaatatcttatatatatttcttctctagtgagtgtttttaaagtggttaaaaatctggttgcaaaaataaaattgttgcatctaacaccaatttaatggtgcatatactgtatgtggaattaagttgttgggaatgtttttgagttttttccggccttgaggatgatgttgtccttaccgcctcatacaactaatgaatgagagaacatgtgagacaaaggataaacatattgatcagttttgtgcaactccatgtgatgtttgccaaaaataatttaatgctatttatatttgagaatccatcacgagcacaagttaaataacttttgaaaagctatacatagcagaaaccaaactctaaagattttgagtttatttatataaaaatttaaaaaacgttttccaattcaccataaataatttgaattaattattattttaaacatgacttgaatttgtctactatttttgttgtatgtgagaccacaatactagtaaccccacaaatcaacctaagattttatttttctcatacacctacttatgttagaaaatccacagaaattaaaatatatcaccagttcaaggcctacctttctttttttatagaagtttaggtaagaagcaaaattatggatcgatgcctaacataaggttcgtatccccttggaatcatctttgaagccatctaagactcgtttatgaagcatcatcccttttacatatgtgcaatgaaggaataattttagatgcgataccgatagatatggtgtgttgattagcttacggagtctaatcacatacacactcaattttttgtcctagccaagaaaacccatgtttgcgaccgatcattttatatataatttttggcctaaaatttgtaaaagttttcttgagttgaattcaaaattaacggattttcatattttaatgttgtcaatatgaaaaccatatttgtaaatttctcgcgaatgattagcaaagttttaatatatcccaaccaccactccttttgtatgtgtatgttacaattaacaaacatcaccatggttagtacttcctaaacaaatggaattcatgataatttctcttaagcaaaagtcctaaaagtgtagttaagctttactgattcgctatattgattttaagttaagaagaaaaagaggtctcactaataaaagcaatcaacgtcaaattttcagaatcttctcgtgtgacgaaaaatcgtcattaagaagaggagccttatctttttgggttaaaggagcaaaaaaatcgaaatttgtcgcttagaattcctcgtaaatttgacccatttgggggcatttctgttctttgttaaagatcaccgccttacgttaaaggggaaggaagacgaagaaaacaaaaaagaacggaactttctaaaaccccccacacaccaaaagcgctctctctctctgggtttttcgaggttgcgtttgctttcatctgcccaaccttctagggttttccttctcttaaagcttatcccttttttttgccttctctcgatatg

SEQ ID NO: 31394 - DNA, 3000 bp, Unknown
  misc_feature (1)..( 3000): 2750-1469P.txt file - cDNA_ID_3041662; gDNA_ID_1972110; Annot_ID_178741
ttttttgctcctttaacccaaaaagataaggctcctcttcttaatgacgatttttcgtcacacgagaagattctgaaaatttgacgttgattgcttttattagtgagacctctttttcttcttaacttaaaatcaatatagcgaatcagtaaagcttaactacacttttaggacttttgcttaagagaaattatcatgaattccatttgtttaggaagtactaaccatggtgatgtttgttaattgtaacatacacatacaaaaggagtggtggttgggatatattaaaactttgctaatcattcgcgagaaatttacaaatatggttttcatattgacaacattaaaatatgaaaatccgttaattttgaattcaactcaagaaaacttttacaaattttaggccaaaaattatatataaaatgatcggtcgcaaacatgggttttcttggctaggacaaaaaattgagtgtgtatgtgattagactccgtaagctaatcaacacaccatatctatcggtatcgcatctaaaattattccttcattgcacatatgtaaaagggatgatgcttcataaacgagtcttagatggcttcaaagatgattccaaggggatacgaaccttatgttaggcatcgatccataattttgcttcttacctaaacttctataaaaaaagaaaggtaggccttgaactggtgatatattttaatttctgtggattttctaacataagtaggtgtatgagaaaaataaaatcttaggttgatttgtggggttactagtattgtggtctcacatacaacaaaaatagtagacaaattcaagtcatgtttaaaataataattaattcaaattatttatggtgaattggaaaacgttttttaaatttttatataaataaactcaaaatctttagagtttggtttctgctatgtatagcttttcaaaagttatttaacttgtgctcgtgatggattctcaaatataaatagcattaaattatttttggcaaacatcacatggagttgcacaaaactgatcaatatgtttatcctttgtctcacatgttctctcattcattagttgtatgaggcggtaaggacaacatcatcctcaaggccggaaaaaactcaaaaacattcccaacaacttaattccacatacagtatatgcaccattaaattggtgttagatgcaacaattttatttttgcaaccagatttttaaccactttaaaaacactcactagagaagaaatatatataagatattaagtaaacacatgataactttgaagtctttctatgccatctcactcgactgatattagagttaaatatatttattctaagcatgttttaaataatttgattgcctagaatttatagccaaacaatatgaaatgtacttgaatcttacgttttttttttaataatcacttgacatattaattccaaatcattgacttctaatacaaatatacaaagccattatgcatacagcgcgatgtgcttcaccgatctccatgaattaatggattttgtgacatacgatttgttgtcaacaaaaagaaacaagttcctctttcttttttttcattgtttcaaaacaaatcgagtgaaaatttatgtgataaatgtgcttacacgtatgacataacaaagcattttcttaattaagttttcttcatataacattttagaatatttctatgaacaaatatctgtacaaaaaaaaaggcacgcgaggaacccaaagcggaacagcgatagccaataagtagcatctgcgattagggatgatgagcacagagaacaaaaaaaagttaacgttgcaaaaatgattttttttaaaaagagaaaaattaattagtgttaaattctcaaaatattattattagtaatattttttacgtagaaaaaaatatcgaaaaaagtgaatcaatccttcccccaagaaacaaaaaaaaaaacttacttttttttgccaaaactcaaaaatctctttacaaaaattgcaacctcttcttcatcgtctcatcttcttcgtcttcttcattattaaccctaaatctagccgcaactacctctctctctaggtctctttctctatctccctctgtttactcccacagctctaaaagcgttttcgaatcgtcacacctggagaaggaagctaatcactttctcattttggaactttgaggagagatctgaaagttttttttttttgttgttgttctggatcgttcctgttccactctcttcatcttccgatcatcgttattttcgaagctctctacaaacaaaatcgattttttttctggtaaacatccttttgacatctcgattcgatttctatgttgttgagctgagactttcttgctacattttgttatcactatgcgaaagatcgtgatttttgacgatgattgaacatgtttctattaaagtgactatgcaaatgtttatacttttcaactttttgtgaatctatcttattacttttgctttcgatttgtatatgtgtgaaaatgaaaatcaatagaagcttgtgttgatcgatctatggaggtagttagcttttttgttgattttgttggtctattggcgttgttgttttccattagggagcttatagattattgattaatatgatattgtggagccacgagtatcattgataagatataaatttggccaaaaatgcttttgattgaaatatgcaacaccattaagagtgtttttgtgaaaaaggaatgctcgtactgcaagctatggtttcttctattgtatgacattgccattacttgctatctctattgattcattttaagcactttcctgataaagaatctgttttatccggttgattgctcttatttgtctgttactgctcaaaccttacactatactcccaatgtttctatgccacaggttaatctaaagaggtgaccgaaagaagaaaacttttacgttttgcatggagtaagaatg

SEQ ID NO: 31395 - DNA, 3003 bp, Unknown
  misc_feature (1)..( 3003): 2750-1469P.txt file - cDNA_ID_3041697; gDNA_ID_1972112; Annot_ID_178798
tatgtcctttttctttatgcgtactcttatcttaccatgctggactagaactgtatcatcatcatctccaggttcttcaaccacagtacctaacttatctcccagtccagttacaagaactttttcaccagcttgtggtgagtagtcactgtattcttcttctaaggaatcaggatccataggacagcaagcttcaataatctctgcaactgcctcttcggttttcaggattaaggaattgtattgatcagcttgagtgatttctagttgactttcaaattcagccaccagtctctccatctttgacttagcagagtttagatcttcttgcaccttttgcgtttcttttttcagaagagccctctcacgtttatcaagatcatgcgactcatgctcaagcttcaggaaaaatcaagaacagaaacatacattacaagagattaataatatcaataaaacaacattcttaaatacctcgtggtaaaggttcattaagtctctatgaaaagctgcagtcttagttgcctgaagctttagtttatttctttcttccataagggactgaaagagtgagcctttccgctctacatcctgctcgggattcaatttctccgtccacttatgcgcattctctaatattcttttattgaaaccaatggacttagctactctcaatgcatttgatagaccagtacttccccagagtactcgaaatgtaggctgcaaagtttccatggagaactccattgcagcattttggaatcgaggttcattatccttcaagcgacttaagtcaccgtaatgtgttgatacaactgccacattaacacggtttttaatatactgtaggatgctagtagcaagtgcaaccccttctgaaggatcagttccactacatatttcgtctagtaagacaagtgaattttctgaagcaatgtcaagtatctgtcgtatccgtgagatgtggccactaaaggttgaaagactttgctccaaagactgcaataagaagtttataaaagaaaattctcgcaaatgtaaacctcgataagaagataatcaagacgttagtagctctattatcttgcaaggaattcataaggtaatacctgaggatctccaatgtcagccagaataagatcaaaccaaggcaaccttgggcagttcttagcaggcaaatacatcccggacttggacataagagacaataatcccaatgtctttaacaaagcggtctttcctcctgtgtttggacccgagatgacgactactttggcactgctttcaactttaatgtctactggcacagggaaaatgtctccaccatttgggctgcctaatactgaaccaagaagtagcgggtgctgcgcagaatcaatgtctacagctaagcccggtgtttttgtgtgttctgaagttacgttgggatagacaccattaatccaatttgcatgtgatgctcttgcaaaagcaatgtcaagttctaatattctatccaacaaatgcaatatctctctctgcgccatcaccacctcagatgtcaaaatgctcaaaatcgccatttcctcagctttctcggagttcgcatgtctcacttccatattattaagctccactgcctctttcggttctataaagcatgttgccctagagctactaacacttaaaacaacaccacctggaagtaaacttttgtgtgtagctctaatagctacacacatccttgatctcctctgcgttatcaaaggcttgttaatccccccagctagaaaaatcttagttgatattttcttcaaaagagaatccaaattctccatgtttctcctccgttcagatcttataatctctaaatcttcactagctctatcaagaatcatagtcatgttgcagtctatacaaaaactaatcttctgctgtaatgtatccttgaaatcacaaccctgtagtatatctacaagtggagtaaccctacaaaataacagaagcaaaagctagaaccataagcatctcaatagcaataagaacatctaataactataactgattcggtagcgtaccacggttcaatcatcttataaacaattcaagaagactaaaaaatttcaaaatgtctacattagaagcagaacacaaacctgttatcactaatggctgcttttcggagtttctgaaacgttgatgtagcagccgttaacgtgcttcgaacggtacagagttctctaacggtaagcaattgaccggacacagcacgctcaacgatatcagacaagtcttggatttcagaaagacctaatcctcgcgatttcatcatctccatagcagctaatgcagctgaggtctcgttaaggagattcctgctttcttccggcgagtttcccaccggaatttcggcgtttttggtggcggaaaggcccatggttgtggaagcgaacggagagagctgattgcagagggcacgccattcgaggacttctagagtttggttttcgactgactgtgagtcgtctgaggaggcggcgcgtataattaacggagaagcgacgcgtaatgatgacggtgaggcggcgcgtgaggatttgagatgaataggcgtcggtatgagttggagtggggaataagtgttcatgcctgtggtgaatgaattatctattatccttttttaatatgtggacaatcggaagtttcacagttcagttaggttctgtccggaacttcagtttgttcgggttaaaggaaattgttccggattgaaccgttttaacaattttgttcggtcaatattctttgataatttcggtttactgggttaaatatcgattttttgtttgtaattttggtttatttttataataatttctgtacatttaacaaacttcggtttggtttagaccaaaaccgattggttcagccttacagaatcaaagcaaactagttcttcagaagtcaaaaacctcttgttgaagtctctgtctgggttttaggcaaaagaaaaaaactggaatg

SEQ ID NO: 31396 - DNA, 3000 bp, Unknown; identical to SEQ ID NO: 9393
  misc_feature (1)..( 3000): 2750-1469P.txt file - cDNA_ID_3041701; gDNA_ID_1972112; Annot_ID_178795

SEQ ID NO: 31397 - DNA, 2086 bp, Unknown; identical to SEQ ID NO: 9389
  misc_feature (1)..( 2086): 2750-1469P.txt file - cDNA_ID_3041709; gDNA_ID_1972112; Annot_ID_178792

SEQ ID NO: 31398 - DNA, 3003 bp, Unknown
  misc_feature (1)..( 3003): 2750-1469P.txt file - cDNA_ID_3041732; gDNA_ID_1972113; Annot_ID_178828
gagagaaatcgtctttgtgtgttaatccaatgagaaacttttaggataccacttttttatacgaaaaaaaacaagtaaggttgagctaaatgtgaaaatcccaatttctaggaattgcacttaactcttgttattgaattacttggtatcttccattacaaaacagacgggagagagtaaagtgtagattgttgatcaaatgctcgttgcatattatgctcatgattgtagttgccagatatcagtttttctagtagtagaagaaagctgttcatgaaaacaccactgatgctacgatcatcgggacatatatgcctatctccgtacctaagacttcactatatccgtctttggttgcagttggcaatatacattctcgttgcaggaattctgtgcatttacataaactatgactgtgatagacaaaggcaagagttcaggaggacaaacgggaaatgtttggtttggggaagggccccgtcaaaggtgtgatcataataagccccaactagcttagtgaacttagctatattccttttcagacctaaacattttgatgtgtatgaatctctcttggtctctcggtttgttgcagattgtggcgtcgtatactacaacatctggtgaaactaaaactagtcttctcttaacgtctggatggtgagactattctacattatacagttacaaccataaaagtagacgttgttcatcatcaatggctttgaatgtgcaggtggggattggctcgtcatttccattatgttcctgagatcttaagtgctttcttctggaccgtaccggctctcttcgataacgtaaaatactatccatctatttgctatattcgaagctcttcttgcaagttaaacgcacttaacatataaatcatctttgtttaaaccagttcttggcatacttctacgtcatatttctcacccttcttctctttgatcgagccaagagagacgatgaccgatgccgatcaaagtaagcaccaaatctaaatgatttattttacacatcctctttgatcttactctgatttgctgacaatattcgggttttgttttggtaaaaaggtatgggaaatattggaagctgtattgtgagaaagtcaaatacaggatcattccgggaatttattgattgtaacgaagtctgttgttctcattttctacttattacgttaattcgaacgttggaatcatcaaaagaccgtgccaaaacaaaaatgcaaattgatgcgatagacattcttttgctgatttgtatgctataggttttcaaatctctagctacacttatgtatttccctagattatcaaagttagcctgccgttttctaattttattatttgatattttgattatactgcttcttaatgcatcaaataagttgattcatccatctaatattttaactacatcaaatgaagtcttttataagtacaggcactaattgaacttgaaccctataaaatacatgaataatcacaaagaattgatagtgttctttcagtttttcaatcacaaagaactcaccgacattatcaagttgacttcacttttagacttaattggtgttctggaggatccacaaaactactattacacagttttcacaaaattgtgattctttattttttattttctttggtcaaactaacatttcattcaactttaaacgagagttgcctccacgtggagagtatacacaaaaagctacgaggacaaatgctcaaacaaaaagacataagaaggggagctcagaagctcaacccgagtagcagcatccaaagttgctaaaacagaaccatcatttacttctgaggcggtcttcgtaccaagctccttcagcaaaattgtgattctatgtttggatatcatgagatctaactacaaagtttttaataacaaaaacttaccattctctaatttgtagtcaaagctaaacaaatttcatactaaaacaattttactgtgttgttatggatgcatatttttctcactttatagtactattttactattgataagatgaaaaaaaagttgaggtacaatagtagtaaaatagcatcattctttttctgtagaatctctctggtcaatggtctttttagtttaaaaactgaataatgttctctctcacacagtaaaaaacaaagagagagagaaagaagagaagaagacaaaaatgtaggcattaaaaagaagaaaaagacaaagagaaaagtaatgaaaagacaatgaacatttaaagaagacagacaaatcccacacccaagcctcagcctcatctcttttattgttatttgtttttctaacaaaacaacaaaaacaaaagagatggtttttgggttttgttttgtctttgttagggcgtgtttggacgtttccttcttctcagaatcaatattttaccaaaacagctttctttttttctctttaacaatttttttgatgtagaaatatatagtcatgattccaaatccacctcatgccatgacaaaaacccataaaagtggaggttccaatctcgaatacagacatatatgttgtattcgtgtatgtatctattataagataattccaatttgtataatgccaaatgggttcattgaacttcttcttccttcataattaagtgttgctttttcttcttagttcctctaaatcaagaaaattctaggtgaaacttctcttatcttgactttatataaaataataactataaaaataatcaataagactaattcctacaagtcttacaaatttaaaagaaaatgaaaatgcaacattagctaatacacataatagtataagattgatggatgtattcttattcagttttatttataaatgcaacataagctaatacactctcattcagttttatttattaatgttacaccactttaagagcactcaaaatcaaaatacgtattcttatatgatattcattcatgtagtactagtacacataatagtataagatagatg

SEQ ID NO: 31399 - DNA, 3003 bp, Unknown
  misc_feature (1)..( 3003): 2750-1469P.txt file - cDNA_ID_3041736; gDNA_ID_1972113; Annot_ID_178827
tgtctcaatgagggtaagtgaaaaaacagataattgcaaaataattttgcagtagttatttcggtgactcattgttacttatgttaaactctttgggaaggttgatttggagtgctcggatggacggaccacagttgggttatttagtcataaaaaactatcagtgtgagtctccttaacatcccctatatacaacattaatacatatataaagctatgtatgagaaccgatacatgttgtgtttacagatccgttggagtttcgaccgcagcttttgttgcagcaatgcttgaaggaagcacacaaccaggggtttggtttccagaagaggtatttctctctagattccctaagagaccttcatttttaaaaatatttgatttatgatgaaatataatgtttaaattttgttctacagcctcaagggatcgcagtggaagcaagggaagttcttctcaaacgtgcatcacaaggaacattcaatttcatactgaacaagtgagccatttttgttcctcttattgcagatatcgattctttatttcctctattttagtttaataatgtatttgctttggtttcttctgatatataggccaccctggatggttgagaccgagccgaaggaggtggttttagggatatacgtatgagttcgactgaggaagaagaaacatagatgatcatcgatactttactttgtaaaccaatttacttctgatatgtatactcgaacagataaacatgttcatcagaagatatacaacttaaaaaaaaaaaaaaatcaaaaaaccacttggagatgacacaatcgttcgttgaagcaaccatataaatcaatgaagaatataatttacaggtgacatgaagagtaaagatccaacaagctcttttcttgtagtatatgttcaataaagtcccaacatttttagttccatcacatgactctgatcaagctcaggaacattcttgcagtcgcggtcttccactatatattcctgttgtgagtgacacgaaaacagtgatgtataccagaaaagtgattaccgtaaatcaagaacagaaaagctgcaagatatcagacctttgtgagttcttgtttggcgagaacatggtaatgccgctcgttgatcttttggccacatattatggcgatgaagaatccatatagcagtcctaccaagacaatggccaaaactgcaacaaaaaatagaccatcatgttcattatacgctcaagtggttcagcacaaagatgattctgattgactctaatcctggtgactgggctaatgtccatgagcctatagaaaacaaaaatagttgtaccagccaatgtgtagaacccataaggatgttcctcataaccaaacatttctcgtagttcttcaccgtagaacttgtaaactagtaaccccaagaatgctacaatctgttgatacgagaagcctttgttcattagtatataaatgcattcactaagagcatcaaatgtatcatccaatccgaattcatacaagggatctcctgtttcggtgttcaaatgcgataagaaaccaatagtttggtcataaactgctatgtggcaattatagctaaggatttgcattctcatgattgaattctagtatatagtaacattatagaagaaagtctataaacactaaactcaatcatgagaatgcaaatccttagctatatgaccaattttatagctaggaaacaacgaatttggtcataaaatgggagattgggagtcaagaagctagtaacatcatagaagaagaaagtgtattaaacactaaaatcaaaaaaaggaaacaagtcatgtaccatctggacagaaatgaagatgaaggcatgatctctagcaaccagcagctgaaatctcaatctcaaccaccatctatcagcaggcacattggctcggagtttgaaaaaggctctacactctgtacaatgcgaaaatgcaaaaccttcctgaaacatatattgcatagaaacaaaatacacttcataagctaagtaaaccattcattcaaaagaagaagaaactttctggaaacggtgacgataatataccttggtggagcgccaattatcgagacaagatctgtgaacgtgcttttgagtacctttacaattgcacggagcaatcagatcttcccctgcaatcaaagaacaaaccaagtcgtctcattgtatcctcactcaattgagttaaggaattgcttttattatacctccaacatcaaggcaaattcgacattgtggttgatctccagaaacaagaagtgtggtttcgtcatcatcagtctcagctatttctgaaacttgtccttcctccacaacacgatctcctctttccgctgctacgatttcgtttgaggatgttgattcgtcgaataaaatctgttcctttctatcatcatcatcatcactaggcactaattgcatctcttaaacatactaaaatttctggaaatgaaaaaaaactgagaaacgcaaaagaattcaacacagcatcagaaaactagatctaggtttcgccgggagttaccaaaaacattagaaaaaatcgatacttacacgaattcaaccaattctggagaattttcttccaaggcaagccattgcttgcgagttagaagaaattggtaaactatgactgcgaatcagagtgaagagaatttgattttgttagtctcgattcatcactatgtgttgaatacagagatgacgaagatcttttgagggttgagagagaagaagctaagaagattgggatcaatcaaaaacgatggcgaagaaaagtctcaagggtaaaattggaattagaaaaaacatgtggagagcacgtgacacgtgggatttatctgagtttcacagtagacctgtgaagttcatcgtcttcatcgttaacttcgcagactctgttgattagtcaacacagatcagaatctgaggctttggccgagacgagagaagcagaagaagaaaatg

SEQ ID NO: 31400 - DNA, 3000 bp, Unknown
  misc_feature (1)..( 3000): 2750-1469P.txt file - cDNA_ID_3041740; gDNA_ID_1972113; Annot_ID_178824
attgcaacgtgcgttttcatgggctctgacgctatttgtccctcaccatttgtagatattttaatttcccaacaatttaaacatttcttttcctttaaaaacaaacaaaattgatattaaaaaaaaaaaactataatgtaaaattaaaattgccagcttttatgctgctgttcgccacattcatacaccaaaggacattcgaatactatttagtatttaataatctcatatatttacaaactttttaacaactatagaatcttccatttaaattttctaaaaataaaaaatttatagaaatttttttcgtttatagtaatcttgtatattttttttgtctaagtatatatgttccaacggtttataatttatatacttcagatttttaccgtttgcatttattctttatatactgttcataaaacggttaaacttaagatgtttttatgtgaaataaattaatttaagttacataataaaaattgcaataatggctggcagaaaataataatgccaatgtgaaaaaaatgcacataatattgccaagttggctaaaaatgtagggcatggtacaaaaaggagcaaaacaaaggtgaatattacaattgaacccctatacagtagggtttattggactagatttagccacgagtcattatcaataattagatcatggactggttttattattgctaattaaattattccgatggttaaaagaattcttctaattatttaatgtttgggtgatgagagagagattcccaacggcaaaaagagcacgccgttgaaatttaattcaaagcagagtcttaataaatcgaacggtcaaaggtcaaactagttgtattactcttttctactttattttattcttaaaaatgattggaatttaaatttagttacgtttggtgatctcctatttgtaactgaccttgaaataaagtgcgattaaagtaaaagatatagacgaccggtcacgacggtaatattatacaaatagagggtagaaatgcaaaacaatattgtttggtaaccatacaaaaaaaaacatcgttaatatttagagtggaaccaattattgacaaaactttaaattctctcttttatgaattttatttttgtcatatgtttaatcattttgtttctattattggccatgttcaagataattaggttgataaagaagcgtaagttaactacattatgtaggcctgggagatcggttaaatcgggttaaacggttcggtttaatcggttttccggtttgttcggctacacaaaattctgccgaattgaacagaataaaagttcggttcggttcggttcggtactcgggtttttcggttcggttaataagatttattattcaccgaaattgcaccgaatattttttttctcggttttaatcggttaaccaaatcgttgtgggtcaatttatgcattctgggcttaacttttgtgcataatgggcttaagttattcaaatcctaaatatgtttttagattttaaaagcccaaatgtttttttcccctgagatcaactcaagtccaccacccagatctaggttttcggtgttcacttttttaaggtgacggtaatacggatggagtaaagtgaagatggatctgtgaagtgaaggaaaacaacggtgatgtgtgaagaagaacaacaacgtaacagagaagatgtgtaaagaagaacaacaacgtaacagagaagatggatctgtgcgacgcggtgtcgagaagaaatgtagaaatccatgaaataaattgctgccgctaaagtcgatgccggagagaattaatgtcgtggcggcttgatagaaggtatcctacgaaagaaaatggtggagaagaagaaggaacacaaggagaagaaggaagaagaatgaagaagaagaagattgaagaagataaaaactataaaaaaggttagagaagaggacaaagaaaggttcgtgaggaggaaacaaaaaatatgaagtggtagatctagggtttctattttttataaggtatccccttttaaccgaataaaccgatcggttttgatgaaccgaaccgaaaaatccgaaaaccgaaatcaatttaaaattccaccgatcgggttataacagtaaatcggttcggaaccgaaaaccgaaatcctcggtttgtccggttcggtttaaacggttaatgccgaaatcccaggcctaacattatgacaacaaaaaaattaacaaccaaacaaattattttgtgtattttgatcagaaaaaatgaaaaaaaaatctcttctgttttcttattattaattttaaaataaataaattaaccaaaaattagctgaatgggtggtaaaaatatttttctttcataattattttttgagccaattcttttgtcaaaataatataaagaatatgttctaaaatttgagtaatcaaaagataatttcaatatcgaaaacaatttaataaactgaaaattaacgagggagaaaaggaaaaaaaaaacaaaaaaacgaaaccgtcgacatctaaaaaagacgagagggtaatattgtaattacatatatacacacttatatatatagtagtatatatatacactggttcgctttccagccccttctctctccttccgcttttgtctctgccgaaatccataaatctcttcctctctctctttcttatttaatcgtcacttgaccgccggtaagaaactcgagagtttgaatcgttttttaaccctcgccggtgattattgactggaaaacaccaaacgaatcgaagcagttagtttacaggtagagcagtgacagctgagcaaaaaaaaaggcggcggaaaaaaaagtagtagtagttgatgatgatgaagatggtgaaacagattcgtatagggttttctaatcggcggtgttcgctgttcgtgaactctttattggagtaagtaaaaagcgccagagagagagatattgtgtatttgtctttttggttctgttttgggatg

SEQ ID NO: 31401 - DNA, 3003 bp, Unknown
  misc_feature (1)..( 3003): 2750-1469P.txt file - cDNA_ID_3041746; gDNA_ID_1972113; Annot_ID_178819
gctgattcgataagatttccagcggctgaatggtgtttcggaattggaatggcaaatagaatccccgcctgacggtttagcttcatgtttgcatctggcaaaagtggttttatctcaaggtggtaagggatcaaagtgcataaatacgttttaaaagaggaaattttgagagaaagactacacttgcctattactctagcacagtcttcagggctatttacacgggaaggtgcctaaagaagtcaatatatccacatcagaactaaatatctatgcagaagcacctgattgagttcagtgataatgaacaattttgcaccttacagccacttttttctgtgaaaaatgctggaaactcatcgctcttgtatgcagcaacatacacttcttgagtttcctgcattgtcaacaaatagctgttgtgaaaacttaaactcttgattgttgactattaaatatgcctcggcaacagactatataccaaatattcaagagtctttggaatatcaagtattgatttaacgcctgctgatatcactgctattggagtcctcccaagtgcagtaagatcagatgatatgtccatcgctgcatcacaaacacaaattagcagcgcatgcagggtgaatattggcatcaacaccatcatctaaacagagtttctaatcatgtaactaatttttttttgtaagaaaggaataaaacggacatgaaacatacaatggttggcatgtctatggacaccacctatcccgcccgtcacaaaaacttggatgccaacctacaataaccaaaaatcctctgaaatgcaataaatgataccaaaactactaaagaaagatcctcctaggaacaaagccaattaccattgaagcgaaaaacaacgttgcagagactgtagttgcaccgtttcctcttgtagccacctgaaggaaaacatttaggcatatggaggagcaaaaagtccatgcattgattgatagaggtgtggaaatgtaaataacgtggttgtctctatataagaagctagttcagggtaggttgcttagattgatgcaatttgattttgtgaactaatgtaagagactgttcctacatgactgagtgtgtaaacaaatcttaaactggagaataaacaagtttgatgtttttcgattcactgatgaacataatgatggtgcaataagtagaaaaacaaccagaagtgactcacaacatttgctatgtcccttcccgctgtcttttggacactttttccgagagatgcaagacgttctagttcttcctcgctcagacctgtttactatatattagcatctacattctataggacgtagaagaagtctagtgcagttgatccttggcgaaaaaaatttataactctgatctaagatcttgaaaccaagttggttttaggatatgtaaacggccaaagttgactaggagattagtgttaacaggttcgataagtccaaatccaagaatctaaaacattatgatccaccagaaataactgacctatgcaaggtactccattaaggatagcaattgttgcagggattgctccattttctctcacaattgactccacctcttttgctgtttgcagattttgagggtaaggcatccctaaaaatagccagttaaagagaaacaagtgaaatcagaccaagatccaagaatataggcttatttaaaaaaataaaacaatgttcaataaaaaagtctacagaatgcaattcaaacaaatccgaataggacaaggaagaacaaaccatgggagataatggttgactcaagagcgacaacagcacgtccattagacaaggcttcagatacttggggagaaatcttgaccagactcctgagctgcttcaaaactagttgttaagagaaagtaaatcaagattggaaaaagtcttaaaacattggaaagtacagaaaccttgttgtttgcttcaagaggtgaaagatgattctggagattcgagattctagattgagctaaagaagaagccattctccctgaaagatagagttttttgaagtcatcagaaaagccaataaactactcaaaaaaatccagcttccaaattctcgatgacgaatcaaaacacgaccctaatgatcagaaatgacaaaattttcgagtcaaatacataagaagcatgaaaatttctgaatttacggtaacctaaaactaaaaacactacacagatgaattgtcttctggagcatcataaattcatgaatttagaacactgaaacctctaagaggatccgaaaagaacgccctttctgtgttctagtctaatcttactgccaaaacagtggaaaagtaaccaacaaagaactcgtttggtagagaattacccaaatccagttccgctcactaagtttatatgaagtttggcaacagaatctgaaagagatcggaaaactgaagtactgtatacaaggacaccgagaggcgagagggatctttgagaaagaaaaaaaaagattgttatgcatataaaccgggtttgaggaagcggttttttaaaaccagtacggttcatttttagggatcggttcggatgatttcggtattgtaacaaacgttggaagtgcgagatctaattgagcctcctatagtgtttgcgagcacatatccgtacacgaaggaccgatccgatctccgtcgccggcgatcatcgccgccatttgctcttgttcttcctcatttacgcgttctctctttcatactcgtgagcttcttcgattttgcttttagaccatttataattcttattgttcccgactgattgtagaacttttttgacacccaattaaatcggaactagggatctaatggttgcgtcgacttgatctctgtgacgtagaagctcttatatatggggctatgttctcattagtatgaagaaagtgtccctgatctttgttttgcagatttttcatttcgagtgatttttggttttatcatacaaattacaagccatg

SEQ ID NO: 31402 - DNA, 3000 bp, Unknown
  misc_feature (1)..( 3000): 2750-1469P.txt file - cDNA_ID_3041752; gDNA_ID_1972113; Annot_ID_178817
ttccaaatttcttcatttgttcggattcgacgctttatccaagcatatctccgctctgtcttatccaactttgccaattctgccaacagctaacctcttagaaattcaatccaaaaaagacataaactattgccagttatacttagggcattaagtccaatgtaccagctccttcaaaaatttgttcatatgaggtgagctccctgctgcaaaagttatttaccaactcttccctcacagatggttccagagcatcaacaaccaagcaagaatcagataacttctgtagcaaatttgtttcctctgtctctttcccagtacctaaactgagataacaacatcatacaattttggtaaatgttgatttcaggaatcgaataaatagaagggagggaggggagtggtctgtagaggatgcaaaagtgaaaataaatatttgaaaaacatcttaaaacaaactttggtttcctacgtaaaccaagcaacaaataaccttagtcactatgcaggcactattatagcaagaaagatgtcaacaagcattcaactcaatttatgacaccaaaagtgcaaaattcatcacatgacacacttaaactctaccagaaataaaaatccgttccagctgtaatgttcttgagattgaagtaaaggaatcgagaaagagaagaagaatcattgaaggcattacctggaaaaatcagaaaatacatgggacttaaggatttgctttatattattaagcttctctctgagctccgtgattttaggaacatccctgtatgcttcaaagtggttacacaattggtttacagcctgaaatatatattatagaattagaatcctaagaacataatcagaaaatgagtagagtcgttttctaggtagcctagcgttaaatttgattttcaaaatgacaatgagctggtttgggttccaatagtgaacataaagctaaagcaagtgaactgcaaccaatgtaacagaagcaatcacaacatattgttgaattaagaaaaagttacctcgagctgtgcagctgcctccttgtattgtctttttgacgccatcacctgaagctgttcaacagcagagactgccatagcgaggtagcgaaattcattattgtgtttatgatgtacttgggccacaagcatcgtatcactatttatacatggcttcgttacacttgagctattattctgatttcaggtaaccatgattaaaataatgaagtaattaaacagagtaaactattgctaactgacctaacattgtgaggcggtgaagggcagtgattgtcgtggttatgttcttctttgcaaaatctaacttcttaatgtcacggcatatttcttgaaccattgcttcactttgctcagctttggattttatctcttgaatcttatgagagagttcctgtgataaatcaaaaagaagatcaaaatctcttgcgaatgaattaaaagggaactgataggagaaacgaaaaaaggatatgatatattgactgaaggaaaagagaacatatcaacctatgagaaactaacctccacagcacgcgtagcatcagcaagatcttctttagctttagttcccgaattactctggagtatgattgccagcccatgaatatgattcagaagcacagattacacgtacacaatatattctagcgttaatgtagactaaaaaagcccacctgttgacgaacagcagagagtatgctagcatcgacccgccgaatttcaccctgaatcttttgcataagtggctcaacgccagttagcgatgcctctgtaaaggaaaacacacatttgaaaatcatggtaaacgcagtcacatatgcagaaactatcagctaatcagcagctgaactacaggtcctaataacagcagcaacaaaaatcaactctaaaccataatcgaagtacaaagagtatgattgttcaacaagtgtctcattacctgttgggaacatctggttgatatactctaaagcactcgacttatccatggcttgtaatttgtatgataaaaccaaaaatcactcgaaatgaaaaatctgcaaaacaaagatcagggacactttcttcatactaatgagaacatagccccatatataagagcttctacgtcacagagatcaagtcgacgcaaccattagatccctagttccgatttaattgggtgtcaaaaaagttctacaatcagtcgggaacaataagaattataaatggtctaaaagcaaaatcgaagaagctcacgagtatgaaagagagaacgcgtaaatgaggaagaacaagagcaaatggcggcgatgatcgccggcgacggagatcggatcggtccttcgtgtacggatatgtgctcgcaaacactataggaggctcaattagatctcgcacttccaacgtttgttacaataccgaaatcatccgaaccgatccctaaaaatgaaccgtactggttttaaaaaaccgcttcctcaaacccggtttatatgcataacaatctttttttttctttctcaaagatccctctcgcctctcggtgtccttgtatacagtacttcagttttccgatctctttcagattctgttgccaaacttcatataaacttagtgagcggaactggatttgggtaattctctaccaaacgagttctttgttggttacttttccactgttttggcagtaagattagactagaacacagaaagggcgttcttttcggatcctcttagaggtttcagtgttctaaattcatgaatttatgatgctccagaagacaattcatctgtgtagtgtttttagttttaggttaccgtaaattcagaaattttcatgcttcttatgtatttgactcgaaaattttgtcatttctgatcattagggtcgtgttttgattcgtcatcgagaatttggaagctggatttttttgagtagtttattggcttttctgatgacttcaaaaaactctatctttcagggagaatg

SEQ ID NO: 31403 - DNA, 3003 bp, Unknown
  misc_feature (1)..( 3003): 2750-1469P.txt file - cDNA_ID_3041764; gDNA_ID_1972113; Annot_ID_178813
cttctcgaaaaagaattgagtgccaaacgcacaaaacactaccgaccctggttcaaatccgtttaaccagtgattccatcggtcttctagaaatttaccactcttattttgcggttcagggagcattggaccggttaagagaagtttcttttgacattctttttcgatgaaaccgcatagcttaccttcaagttccacgcaggtccttatggaaacgacgtcacagttcttaaggcctttggtgatcagaccgaaaagctcatgggaattcgcaaagagagaacagacgttagcttcatgtccacgtaacgccactttggataaaggataatccggcggaggaaaccctaattcagccctaggtgcaagaaccatagctacacaagctgccgatatgatctggtaattgacactctttattccaaactcttctgccatttctggaacccaatgaacaaaatcgaaaaagattagatctggtttcaaagcacggacctttgcttcgatctgatcgcgtaagagatccatggcaacgaatatgggtttcttagttgagtttgggagatccgaggctgtctcggcgccaaaagggagaccatcgacaggagggagagtaagaggctcaaagacaatgctgtctgggaacagattgagaggttggagctgcttatgagctttcttggggaggaagaaagtgaccctatgacctttctcagctagtttgttggctaaatgaagatatggaatcatatgaccaaaaccaaaccatggatacataaaagcatgaaattttgatcccatttcttcaagagagccaaattgttgaccctttttttttctttactcaagttatagaagaatggttgcttttctttgtgtagttgatattaaaagaatgtgtcttaaatattaagtgggattatttaagctgtgtttaggtgctaattgcttgattgcatgtgccaccatgtgttgaatgtataaagcttgcaagttgcaacaacaaatctttaaaatatagatcagtgttttactgttaacttgcattataaattttactgttaacttgcattataaattttactgaaataatcaaatctcaatgctcaaaatccaattttaacagttggaataggaaatccacgtgtaatgattctattagttaatgataaaagccctatgctttggagtggggcatagtcatggagctaccggtgaagttgaacggagataaaaatataatctttttgtctgtcaagatcttaaattgacaatttgagagagcctgagagtagttttgttgggtacccagttgaaggaagtgagaatcagaaaatgggggtttcgatgttggattcctcatggagtttccgattatcctcgaagatgtctccttcaccaacacaaaaactcgctagctctttgacagaaagagatccaatttctctgaatttgaggtttgatcattccattagggcatattcagctcgagctctaaagtgcaggtctgttaagtctgaggattttgttgagagaagtagcccatttgaggtaacatactaaaatctctgcttcgaatctgagttagaatttcattaaattggttctcatttctagtctttgcaatagaatttcatgaacaagttcatcacagcagaaagagtttgactttgcttagatagccaagtccttagagaattagaaacacaagaacaagcgtaaattctgatatctcctgttaaagtcttggccttttttcttgttcaattgaatgaagaagtaaacttcactttatctttaatcttctttggagatttcggtttttaagtactgatagtttccccttgaaagaccatttcgatagaggttattctcaacttattctgttgaattctcattgtttgaaaggttaagaaagagcttgagatttgcttcgacctcgtacataggctcgggagaggcattgtgtacttaggttccgccagaatcccaccaaaccattcacattatctgcaagcacaagagttgagcagagaagtaagtaagacccttaacactccacaagagcttagtttagatatagatttctcagagttgtgtattttatcaggcagcaactctgttggactgtactacatggtctggtgctggaccagggcttatggatgctgtgactgaaggtgctttggaagctgagaaaccggtcggtggcatcaaaatagaaaaagaagccggtgaatggaccgcatcgaagtttcatccatatctccctcctcagaattaccatacttgcaggtaaacatagccacacaccattggttattacttactgtgcttgcacaagaatgagtgatccctaaaatgcaaaatccatgttaggtttttctcggcgagaaagcatggattagtagatgctgtgattagaaacaatgtatctgagaagacggcgataattgcacttccaggtggcattggcacgctcgatgagatgtttgagattttggcattgattcagctcgaaaggattggatctgcattgccggttccattcattgtgatgaattatgatgctttctattcaaagctgcttgaattcattgagacttgtgaaaacttgggaactgtttctaaaggagaagtttctgcactgtggaaggtatgcaacaacaactttgaagctttgacatacttagctgaattctatgacttgcctgacggttctgcaaagctggaaactgaacttagaaaaaccactcccactcgtggatgatgagtttcgtaatttttaactgtaagagatcatatttttgaccatgagcaaccaatttgaagctactcatgtggcacatgtagcatatagattcgtgtgtttgatacatacaccaatcagatttgttgttatcactttcaatcttatgtttcttctcttagcttctcgtgttatccttctacttcactgaacttatggtaatgggaatgttaaagctagtgaagacaacaatg

SEQ ID NO: 31404 - DNA, 3003 bp, Unknown
  misc_feature (1)..( 3003): 2750-1469P.txt file - cDNA_ID_3041768; gDNA_ID_1972113; Annot_ID_178812
cagtcacttacatgttagaggtattgatctcttctcatcttcttattcgatttctcaagaatcgccacgcgtaactcttgatgaatatgtatacatagggagagattttgcatgaagactgtgaaggacacaaaggagtaataagagaaggaggattacaatggatgactgcaggaaaaggcattgttcattctgaaatgccttcttctaattccaatggcattactcacaacaagggcttgcagctttggatcaatctctcctcaagacaaaaactgtaagcttcttcgataagaaacatttgcggattaaccaattgacaatgagtggagtgatccatgttattttatatactagattaggtttcttcttacttgaaagtccgtgaattctcagagtggagccgagttatcaagagatagagagtaaagacatagcagaaacagagaaagatggtgtgagagttagagtcatagcaggagaatggaatggagttaagtcaaagatctgcacaagaacgccaacaatgtatttagacttcactctctcgccgggttctcgaatctctcaacccattccacttcactggaacgcgtttgtctatgttcttcaaggccatggtcactttggggattccaagttacaacattcagccgctgctgcgcaccacttgctggttctaggcctaggtggtgacatgttagaggcttggaacggttctgattccggtttgcctcttcggtttatccttgtggctggtgagcctataggtgaaccaatggttcagtttggtccttttgttatgaacacacaagaagagattgatgagaccattgacgactttgagaattttagaaatgggtttgaaaaagctagacattggaagtctcaagctgcttctgccttgggactgttctgaaatctttttgcctctagttataattttttgaatacttctttacctgttattgtaatgatctttccaaaattattagagaaaaattggagtgtgagatctctaatcatttcttagtaagactttatatcaaaatgtaagacgatactctttattcataaaattgaagtaaacattattttggaacattcaaagtattcagttcaagaaaatttggtgttgttgacttcaatctccaatgcttctacaaacttatcagcataaccacttaacaatccaggactaactaaagtctctttcaatttcttatgattcctcttcactaagttcccaatctcactatctatatccatcacagatttaacagtatctctcaagtcctctttcgagaaccatccggaatcttctctctgcactttcacagagacttcgagttcttcagtcaacaatcttgtgatgagaacttgatctgccaattgtggaataaacacaatctgacaatcactaaccaaagactcccacattgaaccaaagccacaatggttcacaaagcaacctactgatggatgagacaatatcaaaggttgttccaaccatccttcccaaacgattccatgctttttaacccgttcttcgaatccttttggtaacgcttcttgaaccgttggtgagccttttggcggcataaccgatattaaaaacggtagacccattagctccattcctaaacagaattcttgaaattgatccttctcgaaaaagaattgagtgccaaacgcacaaaacactaccgaccctggttcaaatccgtttaaccagtgattccatcggtcttctagaaatttaccactcttattttgcggttcagggagcattggaccggttaagagaagtttcttttgacattctttttcgatgaaaccgcatagcttaccttcaagttccacgcaggtccttatggaaacgacgtcacagttcttaaggcctttggtgatcagaccgaaaagctcatgggaattcgcaaagagagaacagacgttagcttcatgtccacgtaacgccactttggataaaggataatccggcggaggaaaccctaattcagccctaggtgcaagaaccatagctacacaagctgccgatatgatctggtaattgacactctttattccaaactcttctgccatttctggaacccaatgaacaaaatcgaaaaagattagatctggtttcaaagcacggacctttgcttcgatctgatcgcgtaagagatccatggcaacgaatatgggtttcttagttgagtttgggagatccgaggctgtctcggcgccaaaagggagaccatcgacaggagggagagtaagaggctcaaagacaatgctgtctgggaacagattgagaggttggagctgcttatgagctttcttggggaggaagaaagtgaccctatgacctttctcagctagtttgttggctaaatgaagatatggaatcatatgaccaaaaccaaaccatggatacataaaagcatgaaattttgatcccatttcttcaagagagccaaattgttgaccctttttttttctttactcaagttatagaagaatggttgcttttctttgtgtagttgatattaaaagaatgtgtcttaaatattaagtgggattatttaagctgtgtttaggtgctaattgcttgattgcatgtgccaccatgtgttgaatgtataaagcttgcaagttgcaacaacaaatctttaaaatatagatcagtgttttactgttaacttgcattataaattttactgttaacttgcattataaattttactgaaataatcaaatctcaatgctcaaaatccaattttaacagttggaataggaaatccacgtgtaatgattctattagttaatgataaaagccctatgctttggagtggggcatagtcatggagctaccggtgaagttgaacggagataaaaatataatctttttgtctgtcaagatcttaaattgacaatttgagagagcctgagagtagttttgttgggtacccagttgaaggaagtgagaatcagaaaatg

SEQ ID NO: 31405 - DNA, 3000 bp, Unknown; identical to SEQ ID NO: 9410
  misc_feature (1)..( 3000): 2750-1469P.txt file - cDNA_ID_3041795; gDNA_ID_1972118; Annot_ID_178858

SEQ ID NO: 31406 - DNA, 3000 bp, Unknown; identical to SEQ ID NO: 9409
  misc_feature (1)..( 3000): 2750-1469P.txt file - cDNA_ID_3041798; gDNA_ID_1972118; Annot_ID_178853

SEQ ID NO: 31407 - DNA, 3003 bp, Unknown
  misc_feature (1)..( 3003): 2750-1469P.txt file - cDNA_ID_3041806; gDNA_ID_1972118; Annot_ID_178851
tataatcttttaaatccctattaatttaattggattaatgttagcttatactattagatttagtttatctttttaaatctctattagtttaattacattaatgattttaagactaaactgtcactatgcttattttagaccactaacaaccagaagctgagttgttatagcagattccggtagagcgctacgcgcactagtagcgcgtgaacgtacgcttcacgaaaacccaaaaatgtccgtttcacgttttgcaacccacggagacccaaatccgaatgtctcttggagacaagtggcatctatagactatagttgtgagaaatttagattctgaaaccaaatttagaaaaattacaaaatacatgcacaatgtacagataatcatttggtaaaaatctaagcattaattgcatttattaggatattagctgtaatttacctgtttatatagaaaaatataatacattttctcagtcaacaattttttcctttcctttttttgggaaaattagtcaacaataatcataatatgtgtcatacatctgtgaacacgtgtacgaattaagagtttgattatcaatgtaaaatcttcttatttgtatttatattcacatgttaagtattctcatttactttttctaaataaaactactttaacagttatctatatatatatttagagaataatatttaatatgatattagcaatttttcagtaattaatgaaaagagtcagagttgttagcattccaattgaattgttatctatggaattggttgcatttcactttaagaaatttaattaattaattcatatttgaaaatattttatttaattaatattttattaaatatcatttctaaattataacgccaaaatctatttacccgtgtcgaacggtattaattaggattttttaccgtttttagtataagttatattaagaataattaaaacatattaaaaaagttattggaaaaatatattatacctcttgttgatacaattcctaatttttaatctaattaattatttattttaaaaaatgaattaaaaatacaaaacgttatttttttgcaagtgttaaaacgatacttattatgcaatagatgaaatacaatgattgtgattttcgtatatgaacaatagttaaagaagttatgactagaagaattttgaaatttaatacctactgatttttgtaattacaatgaggtatcgattatttcaaacgaattttttttttaatactatgtattatgagacagtgcaactataaattcggtggtgacaagaaaaataacccctgacatgcccacatttaaattattttcaaaaaattgtaatagttagttagattagttttaaacaaatcaacaagtatgacataaaatcatgtgatttaattaattttagtaatattttctagtgtgctctcatggttgtacgtaagctagtattcgaggttaaaaacaaaaaggtagaagaaaaataatgaagtctttggtagtttaaagacaaaaatcatgagttaaatggagagaaagagagaggttttgtcttgaagccatcagagagacacgagaaagactctgaggtggccccctgaccacacccgcatgtgcccacatttcaccgttttacaatgacacccaaaccgtaaacccaaacctcctttttaaaaatatttaaattgatactattttaaaaaaaaatgttttttatacctccaaaaaaaaaaaaaaaaaaaaactcaaccatgttataatttatttactagttgattttactatgctcctaaaattttactactaataataataaaaagtagaattatatatagaaaacaatttgttgtgaacaaaacaaggaaaaaataatattagatatttctataatttaaaatattaaagtggggtcaatgacaattaaatttctagagaaagatttagaatgcatttgttcaaggtgaatctcacattaaatcccattagttggttattaaataataacttctttttacaaaaaaatggatttctttcctttattagagaaaataaagaaagggactgtagctatatatatattgacctcacagaagactcaatcccaattattaaacaacaaagcaagagagagagagagagagagatagggttttttgaggtgtgtgtatttgtatatttatataaatattttagtgtggcttcttgttcttcatcctctaatattatcatcatcatctatctacttgggttctttctttgtctctgagttttagcttttttattgacctttttcttcttggtttcttctctgcatctcaaagactaaaagggtacaataaaaaaacaacttatactatgtcttctttctaaaacttacaaattaaatccaactctttggatttatatttgttctctttgttctcgtaaatgtcttctagtgaattttttttttcatgtcgtcaatctctatggcttcttcctgttcttctaattccccgctttcgttttcttctgaatcatatttgatttttatcttctctctcattttttaaaattattttttctttatggatctttgtagctttagcaaaaaccgaccagctgagaagatgtcttcatcgtacaacacaattgctttgtcctccactccgaccttcctcctctcaagtgccgctgccggacccggaccaaacaactttaaccgtcaagaggctgcgatgaccatggttcaacaacaacccacttcctccgttgctccaccacccaagaagcgaaggaaccaacccggaaacccaagcaagtacctcttacttaatttttttatgaataataagtgaagaattttccattttagccgaaaataatataagaaccctaatcatttccgataaggaaaaaattttgtttagattatataccttttattcgatcaatttaatcaaagaagattagtatttgatgtgcttgcatacaattctctcttgattaatg

SEQ ID NO: 31408 - DNA, 3003 bp, Unknown
  misc_feature (1)..( 3003): 2750-1469P.txt file - cDNA_ID_3041810; gDNA_ID_1972118; Annot_ID_178849
ttcctgaatcttctccgataacttcgtcttatatacatcgccacagaaatttcggttcctgttcgtgaattagcggtagggtttcatttgtatctccgcaacgaattttcctattgattggttcgtttggatctgagaggtattgatttcgatcgatctcaaaagggtagttgttcgtttgctcaatcgaacgagattgttattgttttctgctgtggaatagtatctggatctgtcagattaataggctagtttttacgattgagctatcggaaatgatttgatcttcatgtgtggttgatcatcgaagagtgtttcattgagactgttaatgaatattgctgtaagagaggaggaggagaatctgcttttaagcttctcgtcgtactcgtttctgggatttctcaggttctcaagtttggatttcaataagaaatctgcgtccaccgtaaaccctagatttagatgggataaggtgttctttcagataaaaggtgagaactttccgaatttaacttagttgaactgagatgggttcgtcacaaggctccacactctcggctgatgtgatgagccttgtggatacattgcctgtgcttgcaaaaacccttatcgctggaggagctgctggggcaattgctaagactgctgttgcacctttggaaaggatcaaaattctattgcaggtgattctccttggtcttgagcttattatgtttcaatggctctgactatatctaagttgtattcagattgcatctgttatgctgaaaattgggatattgatttggtgtttggtaggattttgaccatctattgatttgatactgtgctttcaataccagactagaacaaacgactttaagacccttggtgtgtcccagtcattaaagaaggtgttacaatttgatggtcctctcggattctataagtaagtatctagtggtttgactcttattttgcagcttagctctaccactttactaaattcttgtgatgtgcataactctcgcagaggaaatggggcgagtgttattcggattattccatatgccgcccttcattacatgacgtatgaagtttatcgtgactggattttggaaaaaaatcttcccttaggttctggtccaattgttgatcttgtggctggttcagctgcaggtggaacagcagttttgtgcacatatccccttgatttagctcgtactaagctagcttaccaggttggtgattttgaataccttgctctgatagaattttattgttgcttacttaactgacaaatgagcaatatctttttgtttctcctcttatgtgttgttatttgcattttaggtttctgacacaagacagagtctccgaggtggtgcgaatggattttaccgtcaacctacttattcaggcataaaagaggtgcttgcaatggcttataaagaagggggaccacgcgggctatatcgtggcataggtaaagctcataaaatttgcttgcattaatgttaaaagtgtatatcaaatcaatgtaggaagtctattcatcttagctataataaacggttggcatcaaagtaatatcaatcctataaagaatttcttagtctaatcttggttgatttagtttagttacaaattatcttaaactcttatctctgtgtgtgcacttttcctaatttggatttgaagatgattaacaaaggttggagctttcctgtgtctctgcagggccaacgctgatcgggatccttccttacgcggggcttaagttctacatatatgaggaattgaaaaggcatgttcctgaagagcatcaaaactctgttcgaatgcatctaccatgtggagctttagctggtttatttggccagaccatcacttacccattggacgttgttaggagacaaatgcaggtaaaaaaacaaacaaaccagaaacaagattcaaactatgcaccatttcagaactcagaacatattgggcgtttcgtgtgaccacaggtagagaatctgcaacctatgacgagtgaaggcaacaacaagcgttacaagaacacatttgatgggcttaacacgattgttcgaactcagggttggaaacagttgtttgctggtttaagcatcaactacattaaggtaaatcagatgaagaaacaatgaatccaatatctcagtctcggtttcacttttttcctctatgattcgtttaattgtctttatttgctagattgttccatcggttgcgattggattcacagtctatgagtcgatgaagtcatggatgcgaattccaccgcgcgagagatcaaagccagcatgagggtctttgttccttcactctcttatagaagacacagaagacagaagaaaacatgattgttagacagatttttttttccctacttcttttcattttcaaggccaatttgcccctaaaaatccttgatagtgataatattcttttgagaaattatgctaaaatttataaatctgtgatcaaatccaagcgaaagataaagttgatatctgttgttgtgcagcaaggatttggaaaatttccaattgacaattaagaaaaagtttcttagaataactcgaacttaaattgtagtattggagatttattaagtttgtaacaactttaatgatggacaatttcacatgcgtatgtgtaattgaaatgtcataaacaaccccacttcgtaacacgacctagggttataatcgtctttttgtgaacaaatccgaccgagagagagagagagatatatttttggcagtaagatcaaattttggcattggtaagttgttgttccttcttctcctcccgcaggattcgactcttcagttccttatttaatcatctcatcttctgggcaagtcctcttgttccttgctaaaatttctgggcttttttccctttgtttttcttcttagatcactctgataatttttcgttttttatttctcagaaattcgaggtttttatagggttgtggtcttagcaatg

SEQ ID NO: 31409 - DNA, 3003 bp, Unknown
  misc_feature (1)..( 3003): 2750-1469P.txt file - cDNA_ID_3041849; gDNA_ID_1972119; Annot_ID_178903
gcggcagcaccggagaacagcaatacaagatacgttatatacgtaaagaaaggggtttacaaagaaactattgacataggaaagaaaaagaagaacttaatgcttgttggtgatggcaaagacgcaacgatcataaccggtagtttgaatgtcattgatggatccaccaccttcagatcagccactgttggtaatataacatttttctttcatttgtgtcttttaagttattacattcttgtatccgaagaacttaaaatattgctttgaaaacatgtacagctgccaatggagacgggtttatggcacaagacatatggttccaaaacactgcagggccggcaaagcaccaggctgtggctctacgagtgagtgctgatcaaactgttataaatcgttgtcgcatagatgcgtatcaagacacgctctacactcacacgttgagacaattctaccgcgacagctacatcaccggtaccgtagatttcatcttcggaaactctgctgtggtattccagaactgcgacatcgtggcacgaaatcctggagctgggcaaaagaacatgttaacggctcaaggacgggaggatcagaaccagaacaccgccatttcgatccaaaaatgtaagataacggctagttcggatcttgctcctgtaaaaggatctgtgaaaacgttccttggtcgaccgtggaagttgtactcaagaacagtgatcatgcagtctttcattgacaaccacattgacccggctggttggttcccatgggatggtgagtttgcgctctccacattgtattatggagagtatgcaaataccggtcctggagcggatacgagtaagagagtgaattggaagggatttaaagttattaaagactcaaaagaggccgaacaattcactgtggcgaagcttattcaaggaggattatggttgaaacccactggagttactttccaagagtggctttgattttaatgtctacttgttcttgtactttgtgttgtgttacctctgttttagtttgatgtattttttctggtttgttttgtatgacttacccaataaataacatgctctgtttcgcaagtattaggttaataatgtttaatacaataaatttagtgatgtggcatataatattttgaataactttaatactaattaattgaatttttttaatatataatcatactgccactcatcagttataacaccatcattctacccaaaaaaaaaattataacaccatcaattttttttttttttatgggattattatatgtactagatgacccaaactttgagaatattttcatgaataatataaattttttaagttgattacattatttatcaaaaacagtagttaccaaaaataatagtttcatattaaattttacacgttggtcatataggggatttttgcgtactgcattctgcattgcatgtcaacacagtgtatcagcatgtgatataattttactataagtagagcattcaccagtcgtgaattttcggaatatatattgatgataacgtcggttgttaaatgacacaaaaataatgacgtcggtttgagaaccgtcgttacatcgtccgacgcaaattatattggcttcagttaatcaaatgacggtaagttttacgtcattataatttgcatcggtttaatgagtttagcgacggttttcaattttgacgcaaaagtcaaaagctcatgctttgtatcacttctacaaccgacgcatatccactgtatttattttctatttttttccgttttctattatttctgtatttctcaatacaataaaaattcaaactaaccaaaattcagaaaaaaacagtatattatatataaaatcaattgccgcccaaaaataataatctgttttacaatgaatataactgaacaattatacatatatctagcaaatctatctcttggcatttctaaagtaataatctccattgaagagctacaactttgtgtttgctaaaactttttcacctggaacaaaatgagtgtaatgggagatttaaaaatcaacatatgcatacaaaaatattccagaaagaagagagagataataaggacaacaaattttgagtcacatcatatttgttgtgatgggctccatcccattgataaataccttaatcaaccgattgtcagctgaattcctcatgctaatacctaactatacaatattataattgccatatactagaaaactagcagattacacaacaatatagaaaagacacaaacataagaaagaagcctatgcgacaattactacagatagagtgtatcttttcgggtaaacattgtaacgtagtgaaagttgagagtgaattgcctaacaaccgatagaatgaaccaaaaagaaaaaaaagaacatcttttctaacgcccaaaaaaaaaaacctagagttttttttatttattaggtacatattgtcttttctagtactaaaacaataatggctaagtctcatcctcacacgcaagagattaaggttgagaatatattgtattgttgttagcataaactaaaatggatgaaaccaatttctatcaaatacatattttttttagccatttagagtacattggaaaacaagtatttcaactaaattactctaagacaatttttcttcaatcttttatgagataaaaattttggaccacttttcttttctgttctttgtggataataaaaccaaacttcactgaattatagcttcaattcacattgtactgaatttttagattgatctcaaaataaagttttttttctaaatattatcttttatcgaatacaattaattaaagggtaaattgattaagttgctttgctttgtatataagaccaccatcgctccatcctctttcatcagttaagataatatatattcagtaattaagagagaagaaataaacacaaaaatgttggttaaagttttctcttttttcatccttatgataacaatg

SEQ ID NO: 31410 - DNA, 3000 bp, Unknown; identical to SEQ ID NO: 9424
  misc_feature (1)..( 3000): 2750-1469P.txt file - cDNA_ID_3041861; gDNA_ID_1972119; Annot_ID_178898

SEQ ID NO: 31411 - DNA, 3000 bp, Unknown
  misc_feature (1)..( 3000): 2750-1469P.txt file - cDNA_ID_3041865; gDNA_ID_1972119; Annot_ID_178897
ctctaatggcgtcgtcctctatcgcagcaacaccgacacaatcgtttgaagataatttcaacattatgtggtctgaaaatcacttcacgacttccgatgatggagagatctggaatctttccttagataacgacaccggtacgttcaaatccagtttgcttccggtttaggatcaatgccgttctagtctttcgaaattacactgatacttactctgttcctacttaaatctacatgacattttttaacttagtctcttgattattatatcgaaagtttaaatattctgattggataaaaaataaaacaggatgtggatttcagacaaagcacatgtatagattcggatggtttagtatgaagctaaagctcgtcggaggcgactccgccggcgtcgtcaccgcttactacgtgagccgtcgttcttatttaatgtttcaattttgtaaagaagataaccaatgattttgttttgtattaattattttagattaaatttggttgagcagatgtgttcggagaatggggcaggaccggagagagacgagatagatttcgaatttctagggaaccgaaccggacagccttacattattcagaccaatgtgtataagaacggaaccgggaatcgggagatgcgacattccctctggttcgacccgaccaaggattatcacacctactcaattctttggaataaccaccagcttgtgtaagtcctctcttgatcttggctaatggttagttggctacatatatagagataccacgaactgtaccgggaattttgggtagaaaccggaaccttaggtttatgatcggttcgaagttagaaccaacattccactcacaataacataattcagtttacagattaatttcacaataggttcaatcctgttttcttacgtttagctttgagaaaacttaaatggtgcagattcaaatttcgaccgacacaaaaattccaatctggtttaaagttcaaaccgaccaaagcaagcctatcttaaccaaactttaaagaactcaaactagaccaactcgaaccgaattggtcaatcaaagctaattttatcgattggtacaatgcataacccggtttaatccaatccaaaccaggttcttcgtggatagggtaccaattcgagtatacaagaacagtgataaggtaccaaacaacgacttcttcccgaaccagaagccgatgtacttgttctccagcatttggaacgctgacgattgggctacacgtggtggtctggagaagactgactggaaaaaagctccattcgtctcttcttacaaggacttcgccgtcgaaggctgccgttggaaggatccattccctgcatgcgtctctaccacaacagagaattggtgggatcagtacgacgcgtggcatttgtccaagacacagaagatggattatgcgtgggtgcagcgtaatctcgtcgtatacgattattgcaaagacagtgagaggttccctactcttccttgggagtgttccattagcccttgggcttaaaatcaattttgttttgagtgtattaaagtggaaatggtttatgtaataattttactctcttttttttggcatttcttattttgttatggactatatcctctgtttatttatttaattaattatttatttagtcggctatatttcataactgctttttaagatgtatattaacttgagaattcttcttacacttaaggtctcagaacagaacagtgggtcaaaaatataaacgaacatggatgagcataagagtaaagacatgtgacaaacaaaaggttcagctacagctactaatgaagcccaaataccttattgaaaagaaatagcatttgtgattgtgatattataagagagcatatccagaaacttttgtccgatttaccattcgataacatcaatgacaatcgtccatcgatcgttgtagtagtagcatctctagaagaacccacaacttttgatttctttgaagaaatcaacggaagtgggttacattacatcacaatcgtgaggataggcctaggattagcgatttaccgttttttaatgtacatttcttctataaacactatcttctaataaatagtccaagtttgctaaatatgccaagttggacatgtgttatgtccggattcattccgatattaaaagtcaaccttttacgtgccaagtgatgaacactatttatcgcatttttaatttgaaaaacaattcatttttgattgacaattttgaatttcttgcattttattacgattgcctcacttttgggtataaaaataataatatgacatactggtgggataaaataaatagtacgttttcttacacactataaattaaatatgttcgtaaacttactttgaaccacaatgtcaactaagcttgctaacatcatttttcctctagaacttgtctcccatatatgtttctagcccatttctcgtcttgatagtcaaaggacatttacacatagcacaagtatttctttccaaacttgtatgcaaatattcaaacttttctccctttctcttaattaatttccaaaaattgatatgtaaaagaaagacaaatataacttggtgccatagtctttattttttcagctaataaatacataatgctattaccactttttacaagtacctaaaacaaaaacaaatctagaggatatgggaaagaagctcctttgaataaatatttcaataaaaataatactactagatctacaaaaacataggaaaaataattgcatttgtcatctttagttttttatttcaccaaattgtcttaaattaattaattccgtaataaataccttgtattagaattgcagttgactaaaccctttattgattcatatataagtataaaccaaacaataaatgagcataaaatttctaacgttccaaacaaaaataaaccccaaaactttcaaaaggttacaaacaaccccctaagtaaagaaaatg

SEQ ID NO: 31412 - DNA, 3003 bp, Unknown
  misc_feature (1)..( 3003): 2750-1469P.txt file - cDNA_ID_3041880; gDNA_ID_1972119; Annot_ID_178883
caaggtcgttaagaagtgtattcctcttctttataatctaagaagactataggtatcaatttatagtaatacttgttatatagaaaattatgtgtttaaagcgtatgcaaacttatttgtataaagtttacaaatacctaatgaaaagaaaagttagcctcattatacaggggattacatggttagcttcatttcttctctacataacccgacttttatcaaccactaaccaaccatattaataatgatctcataaaaatctttaaatcaacttagaaagtgctcaccataggtttgtttttcttaacttaccaaggagccgacaaaattgtctcaaactcaaactccacatcttcaagctctacattgagatcttttgcacatgactccatctgacatatctttttccaggctgcatctttctgttctttttctgcttccttttgttcttttagagcagcttcttgcctctgcagctcgataatcttgtgtttcacctcaagaatcttttgttccatgtcatcaaactcttgtttagccttgctaaattcatttgtcatctccttgtcaaaaccttttagttcctccattatatatagttgtctatctttgagtgctaacagcttgtcgatccgtgataatggagttgtaacattgaagccatgtttctcgagctccgaaaatgaatctttaaggctatttagttggcttacaggaacgtcggcttcaagatctttaaatttctccagtaacccaaaataagtcaccatcatacctattgcatacccttcacggaaatcttgcttagtctcaaacaatgggctgaaatgaagactgtgtgatacacttttgaagacctccagtgattcataagtcttccagaccggtgacttctttgcaaaaggcaaaaccattattgtgtgttttgcatggttttcctcagcattagaagcagaattcttcaccacattgggggtccgatccgaggataacactggacagatgaacgcatacacaacacaatgagaaaataaaggcttatctaccagtaatagtacaatgagaccattgcaagcgggtcctacattccagaatgtgcaatgagagttaagacataccagtcttattgatgtatgaattgagctttagacctcctcttttcctctttcgagtataatatttgatcttaggctcctcaggcatctgtgcatagaagtgttaaaccaaaaggagagccatctcaaagataaataacaatcataaacaataccttctctcgagttgactcatttccaaagccattcttcattggcacaggggatacctttccttgggttttgttctttgttgcagttacccccagggttataggtaaaccagattcttttttctggaaaacaaagaccatagaacaatttcagggcgtagaaaacaaacaaggttataaaagaatccactagcagggttatgaccatataccacatcatcagccatctcatttcccggtggttcctttgtctgcacatttctgttgccgtctaaagaagtttctttctggcgttttggctgaaaatggaaataacataacaacacttcaattaatcctcaaagatgtcacactaattaaaccaaaccaacacaatgttgcctgcaactagtgatacaatttacctttgttcttttatgccaaactccatcttcccactccattggaggcctaatatcagagtgattaaattgcgatgcctcctttgttgccccgaaacttaccatgtaccttccctcaaagacaattcccctgaccacaccttgacgccattcaaaaccactaaacgcctctacatgatccagcaattcatactttccaacagataaaggaggctgcataggccttagtcttagggaatcaacaattaaatttttcgattcccggcagctataggacttattccagtacttgacaagaaacctcttgtccttctccaactccttaatgacaattaccggaatccaagcacaatcaaatctcaattccaccattgtcccgcaactaaaaacagacttgaccaattccttcaaagacaaaaaacaaacatacaacaacggataaagttaacaactttttcatgcaaaggcgaaacgatttcaaaaaaaactcatcataccttattatcaggtcggatccatttgaagccggtccaatcaagatgaaccctcaatttctttttctcaaactgaataatgtctggtgggcaatcgaagtaaaccaaaaacttctcatcctccattgtttttaccaccacaccagtccaccacccatctttgagataagcgtcgaccatcaagccttctacaaaaacgacgccgtcgttcacatcctccgacgggacaggacgaatgaacctctgatcgacgaattccgttaaaggagccaaacggtgttcattgagctgcgtcaagtaacgaactttaagcttattgtgtcctgatttcgttggattatcttccagaatcgctctgtaataagacccttttaactcttcttcttcagaaaaaacttctactttgtcgtcttttctaatgaatatcatctgctccatctcaaaaacccttgaatgaaaactaataacggctcatttttgctctgctaaccctaaatctaaaaaaagacttttctgctgaaacccgaaaaccatagatatgattatatgaaggagactttttgcaaccaaaacacagtgctactgtgtctgtgcttagtgtcgatattcacgatacacatcggggaaagtgtgttttctttttttctttcccaatttacttttctttttttttggcgcttgaaattatgagaaaatgatttaagaaattatcaggcccaaactatctaatgggcctaattaaaaacggtgtcgtttcataggatcctcatcacgaagcaggtaagtaaaaatatatcttatcttctccaaaactctctcttcgatttcagcaattgcaatg

SEQ ID NO: 31413 - DNA, 3003 bp, Unknown
  misc_feature (1)..( 3003): 2750-1469P.txt file - cDNA_ID_3041884; gDNA_ID_1972119; Annot_ID_178881
tatactttgatgataagaaaacagaaaaatgagctgggactttgtattgcatggttttgaaataactgattgttgtgtggttataggaagtggtgtttgatatggcgaatttcttttgtggttgctaatgcttacagctcactaaacaatttttaagttgaatttgaattgttgatcagatgtttgctactgagttgtgtgatcttttgaatatctgctataacttgtatactcattcttgatacacgagcttacatgtttcagagtttagaaagctttataatgtgtgaactacactgttgtgcatttagcttcttctaacaaactgttgtaactcaccgttaaaccaaaactagattccttttcctgtctaaatgtttaactccatgaattgtttaatgaaccctgtaaatttgatacagaaaacagtatacttgatagctgaggaacaagagaagtgacaagggtgattgaaaagttgaaggactcagatgggaagcagaagcggagaacaaggaaagcgaatggcggaactgagcaaaaatcttaaagaaggtgagaggattctggagcccacacgtagacctgatggtactctccggaaacccattcggattcgacctggatatactccagaagatgaagttgtcaaatatcagtccaaaggttctctggtatggaatccttattccctcaacactctattctgttcttggactcattgtttctcgtggaaatgaatcgtttaaatttgatttttctcagtagtcagtactggttgtggatagcctgctttcattatttgtaccacccttatgttctttgttcgagtgctcaacagaaattgttaccaaatttttgctcttctatcttggtttgaataagggcaaaaatgtagatagaacatatcttttttctaatttgtatttcatttgtaatagatgaagaaggagatggcctcacaagggcctccaggttatgaacctgatccagctcctaaaccaaagactaaagctgctaagaggaacgaacgtaaaaaagagaagcgattacaggtatgtgtttcaactcaattcatatgctactagcttggtcttcggttaatggaacatgctttctaattatcacctctgcaggctactgcagaaaaagctaacagctctgaggatggatcagctagtaatggatcccaatcggtgaatgtattggcttctgaaatggaggctttggacgtttcgtcaaataatgatgtatgtgggggagcacctaatccaggaaccacaggagaagacgtagagaaaagaatccgcgcacttaagaagaaagtaagatttccatctttctcagttgctttaattaaaataagacattcgagaacctttggctttgaagatataatctccaccgtctagattcctaattgtggctggtaagccgtaacagcgtatgttccaaatggttttcaatcaattttcttcagtttacagcaaaattgtgtttgaggtatagcagaaatctgcagtctagcggttgtgtaattgcttcattctgttaacatttgcagatccgactcacagaagctcaacagcagaagactgcttcccgagacctaaacccagagcagttagagaaattctctaagttggaagaatggaggcaagaactcaaggctctggaggataaggcggcttaacttgctgcagcatcaacatgaattgtctaacttttaggcaggctgcagtttctctcatgaaatttctggaaccaatccaaatttgtatcaatgaaaagaaggctgttgttacttgttaggttttgtcagatctgattaatgaacttggcgcaatgcctgaatcttcatgggaattgatttcacattgtgtttgcgtttggtcctaatctaaagaatatgattccaaactgatgatataattgtaaagccgttgtagcaaacatcacttgatcaatcattcacttccatctgcatacatgtagtaacatcacccgatgaaggtggagtgcatgctgaaacggtgtagagttcgatcctaaagcttttgtgagttcatgaagatgtctacgtatttgtagacccaacgacataggtacatatacatacacatgtagtcatatctatgattctgcttacatatattatgtaactcttttctgtcttatgctctaagagaacatctctaccattaaagtacatgtcaatacagaccttaaaatgttaaccatttgtatgcttcctgtttcagatttatttaataaacatgcttcatctggaaagaggaagcccatggtgttatgcttaattatggataccgtttctcattttgctaattggaagttgcatttactgactttaatcagtcattgtcaactttatattcacctgatatgatatgcaagtgtctctagctcgaatagttaatatatatctaggagtagtggttaaaatgtctcatagagtcaattattataaatctttctgcattatgcttatggagcttgcttttactgagtccttatcaacttaatcttcactggggtggtaactgtttcacggtccaatagttggtcttaaagtgactattgtttctaagtttcagttctctgtaaatttgtgtataaaataggtctttatattacataatttgcttgtcattttgtatataagtacttatttattattgtaggcaaattgtggtggcgtggaccatttcctgcagtgaaagaggcaatgattgaatggacaaggaagaaaggtttcacagtgttggtaaccttattagttcgtgtcatgttctaagtcacatgaatcagttttttcttacaacttttgaaagttcaacctttgagaaaaatccggaacaggttgtgactgatttcgatgtcagcagttaatgttgttagttgaggtaagccccacttggcttttaacaagaaacatcatttatattgtttcatcaaactatgatcagaaataatcagagaatg

SEQ ID NO: 31414 - DNA, 3000 bp, Unknown; identical to SEQ ID NO: 9427
  misc_feature (1)..( 3000): 2750-1469P.txt file - cDNA_ID_3041888; gDNA_ID_1972119; Annot_ID_178877

SEQ ID NO: 31415 - DNA, 3000 bp, Unknown; identical to SEQ ID NO: 9432
  misc_feature (1)..( 3000): 2750-1469P.txt file - cDNA_ID_3041892; gDNA_ID_1972119; Annot_ID_178876

SEQ ID NO: 31416 - DNA, 3003 bp, Unknown
  misc_feature (1)..( 3003): 2750-1469P.txt file - cDNA_ID_3041900; gDNA_ID_1972120; Annot_ID_178932
tgttccaattatatttgtccgttagtgcaaaaaggtcttacctttttcgccatcttacagtcttgtgaataattcaaattctaaaactttttgagattcttacagagacattttgtcactctttgcaacagaacagtgtgagaatgggtgaccaatatgtttcttagtggtgatgttctcttttgctttgttggtggaatcttaggactgtattgactggccatggctgctgataccacagcttcaagttactggttgaattggagggtcctcctctgtgcattaatcctcttagctccaatagtattagcagctgttctcatttggaaatatgaaggcaagagaagaagacaacgcgagagccagcgagaattaccagggacattgttccaagatgaagcttggaccacatgttttaaaagaatccaccctctttggttgcttgcctttagggtattctcgtttgttgcaatgttgactttactcatttccaatgttgtgcgcgatggagctggcatattctacttctatactcagtgagttttaatcattatacttccttctcacatttctgaatccttgaaatgaatgaaaaagatctaaactttttttctgaaacaggtggacatttactcttgtcacactctactttggggtacatctcttggaaattccgttgttgaggttactaccttagttttagatactaaatctgtgatactttttttcttcgtagtatgcttcggtgttatctgtttatggatgctgcatctataataaagaagctagtggaaacatggagagttatacaagtataggtgatacggaacaaggcacttatagaccaccaatcgctcttgatggggagggaaatacgtcaaaagcttccaatagaccttcagaagcacccgcccgaaaaacagcggggttttgggtttatatctttcagatccttttccaagtaagtgtcttattttcccctaagttatcttgttgagagtgaagactgtacaatgccatctcaaagcttcaaaaggacttacaaagttttctgttgggatagacttgtgcaggtgctgttgtgctaacagatattgtattttgggcgataatctacccgtttactaaaggttacaagctgagttttgtaagttctggctctaataccgtttgagttccattctttagaaagatttggatttctttgatatgatcacttttttttctggcagtctctatactaaaagtcgacaatgaatatatttattccttacatgtgttattttgactgcagctcgatgtttgtatgcattctctcaacgctgtttttctccttggtgacacaagcctcaattccttggtaagttttcaaaactgaagtctgcggatacacaatctcctgccttttttattagaatctaatggcaatcttctttcttccttatccagcgattcccactgttccggattgcttactttgtactttggagctgtattttcgtggcttaccaatggataatccatgccgtcaagaacttatggtacacacttgttctgttttcttatcttcatagaggcataagtttccatcattttgaccccagatattaactcattgtactgatcaagtactatgactttctgattgcgccaaatggcccactcaaaatcttcttaacaaacagagccgcagtgtctttacgagttttaagggatcttgttatacatgttttgcaggtggccataccaatttcttgatctttcgtcaccatacgcacccttatggtatgattataactcttcacacttactatgatatcaaagtttccaataaaaatcaaatttaacaataaaaaagagacaattgttgtgatcttttactaatgtttctgcaggtacttgggagtggctgtgatgcatataccatgctttgcggtcttcgctttggtcataaagctgaagaattacttgctgcagcagcgtcacaactcgtgatagttttggtctccccgaattcaagtttcatcttctatttatgagattctttgttcacgagagaataccacacatggaggaaacaatggttcatggtcatggtcaaagtcaaagtcaaagtcattcagaaagtttgagaaagtcaaaccctcttgttgagtaagagactatccagaagaaagaagagtaatctccaacactacaacacattaatttaggtcttgtttagtttgtttatgattaaacaagtctcctcaataatgaagtgtcataaataagttatacaatcccttgttgtaaagatgcaaccaaataagtaatgagaaattaataaatatttttcttttaaaaacaaaatttggttatatgtgacacaaatggaatggttgaagttgaaacgttcattttcaagttaggtggcatactctaaaattgaatgaacaattgaacatccaccagcttttttcagagatgcgtagctgcaaagtcttgctaatgtttgttaaataaatcctagtatgtagaaaaataatccaaattctaatgcaattatttgctaaatcctacaaaagtatatactataaagatttgagaaagaaataaacattaaattatgtgcatatgtaaaatgattgttggttataatactaaataataaagtttataacaatattttacaaatttggaagttgcaactataaatggtaaattcggtccttaagattagaagacaaagaagagtcgtgttggtgagctaactacccaacctgtgaagctacccccattctctctcaacggtaaagatccgccattttcaccgatctctgtttcttctcgtttggatctttggaaattttagagtttgttcgttctctctcgtatctcattttggaattgaatcgttagtggatttgatcgggaaatgagtgttttcgcgttcgattagtgtttatcagtctctggatctgtgattttgattttgttttctccagttttcgttttgaaatg

SEQ ID NO: 31417 - DNA, 3000 bp, Unknown; identical to SEQ ID NO: 9434
  misc_feature (1)..( 3000): 2750-1469P.txt file - cDNA_ID_3041908; gDNA_ID_1972120; Annot_ID_178926

SEQ ID NO: 31418 - DNA, 3000 bp, Unknown; identical to SEQ ID NO: 5564
  misc_feature (1)..( 3000): 2750-1469P.txt file - cDNA_ID_3041922; gDNA_ID_1972120; Annot_ID_178920

SEQ ID NO: 31419 - DNA, 3000 bp, Unknown; identical to SEQ ID NO: 5564
  misc_feature (1)..( 3000): 2750-1469P.txt file - cDNA_ID_3041922; gDNA_ID_1620803; Annot_ID_168741

SEQ ID NO: 31420 - DNA, 3003 bp, Unknown
  misc_feature (1)..( 3003): 2750-1469P.txt file - cDNA_ID_3041932; gDNA_ID_1972120; Annot_ID_178936
gtgaaaccaaatcttttgaatctttttaacaaaaaaaaaaagaaaaaaaaaatctttgaatattataaactatgaaaatgatatcaaagtcatgaatagtttatggatgcatgtcttcgaaacaaaattacaaaatacatgaagtcgattcttataggattaatgttgatttgtttgacccgttgatattcattagaaatttaacgattttattctaattaatattatatatatgacatattaagaggtatagcacatatgtatatttttatataaaaaaaagtaattttgtttttaagatgatatatagacatatgttatttttttaacgtataatacaccttggtacaattttagaactaaaaaatttaaaattttaagttatatatatatatatattgttactttggttttgttttcaaaattgtataattatatttcgattgttaattatatgatttcatccgtagtatatataattccatattaatatcaactcaaacgcgtcctaccgtataaccccgtcatgtgaaattaaacatcattttgttatttttctaaaatttaaatatttatggtattgaaattaaaatatatatatatatatatatatattgatccaaactttataattgtattttaattgttatatataggatttcacccgtaatatatattgtctcatattaatatatatatatatattttaataaagtataactttttaaaagttttaaattttttgatatttaacttttaagaaactttaaatatttataatattttgaaatttttaaagattcagttctttaaaatagagattcagagtaaaccggataacatttttatttttggatgcctgataaatcaaacttccagttcattgttattcaaaattattttggttctttttataataagactctaaagcattgcccaatttcttaagtaatgtgggatctttcacacttacttttttctttatacatagagtaatatatgtctgtttacaaaaatttgaattacatcatatgcagaaaaaatctaatattttataaactatatatattttatataaaatcaaataaattagatataagaacaacaaaaagtgaaagaaaaagcatatatttatatttaatgtagatagagaaattttagaaaattcgtaattaattgattgtagttcaataatgataagatttaattaaggatttagacacatatttgttttagatagattttgtagaggctaaatatgtaatatagaaaagagttaatttaagtatttaatgcaaactaacaaattataaatttttagtaatagaatatttggttgaaatataactggtaaggacctaaatgttattagtaaatagttaagggatttttgaccaaaaagtctatcaaaaatgtatatgtagatataaaaatcatagaaaactctttaatgtataataacactatgacaatgccgcccattaacaaactcacggaaaaaaaaaaaactacttttctctattttctctcagtattgcttgcttcaagcatatttgtacttagtgtaaatacacgcccattaacaaacgtgaaccataatcttatccggtgaaatacatacgccaccaaatataataatatatcatgtggtcaaatcctgcaaaaaaactcatcaaagatattttgtgtattgtaaaatgattctatagtagtactaattaataggtaatatatactgttaactaatgtggacaattgtaaaacgacgacatagtcattgaaaacgaaatggagtatatctaatctggctgagagaagagttgatatgaaaagagagagcccgtgaacggatatacaaaatgagttttaaatgagaatagggaacccgaggaaacgcgtgacctaagctacgtaaattataaaaataacttatttttatattcatagggtgtgtttttatttacacaaatatatatagtatttgtatcaacttctatgtattaaatataaagagataaaaataccctttagatgcaagtaataaatggagtaacgagatggaaagagtcgttgagattcacacttcagttggcggtcctatttttgactttctaattatcaccggtcaacatattttgtagagattccatcgccgatgctcaagttttttgcaccctgtgaaaacatatatagaggtttttggtcggtgtttgccggcaacgacaaatatgtgatttcttagtttcttcaacaataaactcgtgtttgcctcttatctagctagaatgacctttgtttagtagttttctgaattgcagtttccctaaaccattatcttagtgcacatacataaattatggtgcaatatcattttggtaacgttactatttgttagatatttatttaacagaaaatgtcataatccttaaacacaaattcttatttaaatatgtaaacgttttctaaaacttatggcttcttctgatttattggatctaatatattggagcagccttttgtttaccattggaatactcaagctaagaataatattgttagcttgaaattttctacattctaatgtattctagtttcaactttcaactaacacatcatctttccacatagtaggcgcgtataccttcccaattttgtccctttaaaccggaaactaaccgaatttccctatccacattctaactaaaccgagacaaaccgtttcatttcgagcaagtcttgaacaaattagtttcagagtgctgctattcgtttttggtattcggacaaattaaacttgaaccgatggttagctacttagccaattaaaccgaaactatccaacatcttcataacgtgtctcatttgacagataggggcatttacgtcatttcggagtctccgccacatgtcagatttgttttataaacgaaaaaaattcggtatatttaatttgaagatatccgccggaaaattcgtaaatttgacccttcgtcttcggaaatg

SEQ ID NO: 31421 - DNA, 3000 bp, Unknown; identical to SEQ ID NO: 15454
  misc_feature (1)..( 3000): 2750-1469P.txt file - cDNA_ID_3041951; gDNA_ID_2926134; Annot_ID_197106

SEQ ID NO: 31422 - DNA, 3003 bp, Unknown
  misc_feature (1)..( 3003): 2750-1469P.txt file - cDNA_ID_3041951; gDNA_ID_1972121; Annot_ID_178974
ggatttgtcaactctttggcttttgcaaaatcgggtaaatttctgattgccggtgttggacaggtatgtgatcatctcttatgttctcttccctcttctttttttctatctttgtcctcttgtctgtgtgattgctaatctcaaaactgatcgtgttttgtgaaatcgacatggcaggaaactcgatttggaagatggggatgcttaaaatctgcgcaaaatggtgtcgcaatacatcccttaagactggcataagtatttcattgggataaatgaagcgttgttatggatagttttgagttgctaaaaagccaaagatctaatcgcaagtcatatagggattacatttccttgtagctcttgaagtttttgctcccttttttgtttgttccttgtaccattttttcttaatacgagagataagaacttatcattttgaggctctgaagaatcaaagaggataacagttcccaattttttcattctctcagtaaagctttttgtttcgttttcccaaatgttgaagataagtatatgaaaaggcaaattattaaaccaagatccatagtgaacacagacttgatcgtaatttatccggcgaaaagaagattgcttttccaaacaaaaaagacaagagcctactacttgaatgaattctcttaagtcaagcttagaatccctagagacaatttcttgatgtctcttggtctcgttgctgctccattctgactaatagcttcaactggataagaaaaaccagcagagaattgataagaaagttccaaatatccaaaacatacatagaataccacaaaatgaagacttgaaacaagaaaaatgcaaacagcattgaaagaataactaaacaagaacatatcctgcaaaaaaaacgaaaatgatacataataatccaaagactcgagcctatatgcagagaagttccagaggaaggtcatgcttccaaaagtttccattttaacattgcaaacactaactcatgtacaagtgagtgattctcattcacttatttgctaatatgcatataactcgatctcaaactaaccaataagtatcatactacctgaaatctagctaaccatcagttttgagatattttctacaacaaagtaaacccaagaacacagctttgacatcagagatcaatactaccaaccatcaatcctaaaccctgaatcattccattgttcgaaaaacaaactgttaaatctcatatccaaatcagaaacaagagaaaacgataagcataagacaaaaatctctaacctttattgactcatctcaacttctctttatttcagacactttctacaacaaagtaaacccaagactcagtaaactactaaccatcattcttaaatcctgaatcattccattgttcgaaacacaagcattcaaagctcatctccaaagcaaaagcaagagataagacaaaatctctaaccttttaaacgaaatcatctcaacttctctttacttgaactcttcttagctgcatccataaccttctcaagatacccttcaataggcggtgtaagagtagccatacctcgattcgccggaaacggtgtcaaatcaggctctaacgccgccttcttcagattctccggcaatgcctcaatagcagatttcttcaaattcaaaagcgcagtttcagctgcacgacgctctctatgctctctcatcaacactttactatactccttcgcaagtctctctccatcttcttccgtaagcttatacttaggcaattcctcagcttcaaaaatccctaacgaaatgtaatccaaacctggcgtcccaattcgcatcggctcatcggtgactcccattgaagcagctcctcctttcttctggatctccatatctcgttgcttctctttactaatcaaacctagcttctcacgttgcgcctcacgctcgatctcttggggggtcaagtagcgaacaggacaaggagcgtttaagcattgctcgtagagtttctgcttctcatcggaaattctaccttttcctttaactgcttcctctccttcaacaggtgctccgccgccgccaccacctttcttgatggagagtttgttacgcttcaatggctgacctgtcttcagctttgcttttcctttaggagttccacttgcggagcatctttggataagatggtaactcagtgattcgatgatcgcttttggtttcgtaactcgaatcatgcttctgattcacctgagtttctgattgctttcgtctgaaaatgttgcttgagtacagagattagggttttcgactctcgactgtggaagaagaacactgaactaacgacgtcgttttacatcaagttaaataaatcacgatgtcacaaaactgtaaattcagcttaaaccgagggttttcttgtcttttagaaaactccaatttggtttcttggttcggttttccatttctttgtataccgaatgagaaccgacgttaattttgaattgatttggttcaattcgatttaatttttggttattgtttcggcttaccaccacataaccgaagcttctttctgaaaacaaattcgattttacttttccagaactgagaagaaatttgctgaattcagtctcatgcaacttgttaaatttctcactattaacaacgaatttggctttggaaactgtaacctccaagtaccaaatacaagtaaaatacaaagaacgtggtgaaaagtaaagaagatccaacacagacaaaaagcaatttgtccactaagatctctcgagagccaaaaaaaagttgagaaatttgcagtcagtatgggctgctctgttgttgtctcttctgggccttgaaaggatcttcttcttcccctcaccttcttactataaacccagaatcatcctctgtttcttttgttcctcaaatcatttttttcctctcgattgtgagatcaattattaatattcatctggagaattatcgtctcttttctccattgctatg

SEQ ID NO: 31423 - DNA, 3003 bp, Unknown
  misc_feature (1)..( 3003): 2750-1469P.txt file - cDNA_ID_3042002; gDNA_ID_1972122; Annot_ID_179048
agtagcagccaagttgtaagaaacaaaatctgcagtggtaataaatgttgccagacgaggataccggaagggcagccgcaagtaattggagtcaacatagagatccctgaaaacaaaaacacaacagaaggaggatgcaaagttgcatttttgacgagcaacaaatattcgagtttgaatgttacagagccagaagagtttcatagtgatggatacgcggtggttgagcttggatggtactttgatacttcggattctcgtgttttaagccccataggttgtatgaatgtgtcagatgcatcacaagatggcgggtatggttccgagacgatttgcgtttgctcgtacggctacttctctggattcagctataggagttgctattgtaactccatgggttacgcagggaatccattccttccaggtggatgtgtaggtaagagatgcgtgtttttctttctgtatccattaatgaattcaatcaagtcttctatcactgattatgaatcaaattcgtgtagacatagatgaatgtaaactagaaataggacgcaaaaggtgcaaagaccaaagttgtgtgaataagcccggttggtttacgtgtgagccaaagaaaccagggcagatcaagccagtgttccaaggtaaaagtcaatttgattttatcttgaatgttgtgttgaagatattattgttttgttctgtaatgtacatattgtttcttttggtggtgcaggtgttcttataggttcggcactgttgcttttcgcctttggaattttcgggttgtacaagttcatcaagaagcagaggaggagcagtcgaatgagagtgttcttcaggcgtaatggagggatgctgttaaaacaacagttagctagaaaagaaggcaatgtagagatgtcaaagatatttagctcgaacgagttggagaaagctactgataactttaacacgaatagggttcttgggcaaggaggtcaaggtactgtttacaaaggtatgctcgttgatggtagaatcgtcgcagtgaaaaggtcgaaagccatggatgaagacaaggtagaagagtttatcaatgaagttgttgttctagcgcagatcaaccatagaaacattgttaaactcttgggatgttgccttgagacggaagttccagtcctggtttatgagtttgttccgaacggtgacttatgcaagcgtcttcgagatgaatgtgatgattacatcatgacatgggaagtgcgccttcacattgcaatagagattgcaggagcactttcgtacctacactcggctgcatcttttcctatataccacagagatatcaagactaccaacatactactggatgagaaatatcaggttaaggtgtctgatttcggaacttcaagatcggtgaccatagatcaaactcacttgacaactcaagttgcaggtacttttgggtacgtggatccagagtactttcaatcaagtaagtttacggataaaagtgatgtgtacagttttggagttgtcctcgtggagctcattaccggaaaaaacccgtcctcccgtgtccagtctgaagaaaacaggggatttgcagctcattttgttgcagccgtgaaagagaacagatttcttgacatagttgatgaacggatcaaagatgaatgcaacctggaccaagtgatggcagtggcaaaactcgctaaaagatgtttaaaccgaaaagggaagaagaggccaaacatgagagaagtttcagttgagctggagaggattcgttcatcatcttataagtcagagattcataatgatgatgatgatgatgatgatgatgatgatgaggatgatcaagccatggaactcaacattgaagagacttgggatgttggtatgactgctccagcctctatgtttaataacggatcccctgcgtctgatgttgagcctctggttcctctacgaacatggtagtataccctcatctgatgaaaaaatgttatgtttcgattatgaatttctagcttttcaccatgtaacaataataagtaacgtttctagtctgtacatgtgattatatgtgtttcataagtctgtacccacagtcatctctatgtattcgacgttcaaaagaaagaatgttttagtcataaacagtatcaggtttaagctttcaccgataacactctccaaggatttcagtttcccttaggaggtaccttggacatgtgttctaattgacacattgcctttctctttggagattcaacgccagcaaacttggacggctttaaactccgatatcctctgcttgaaaaccttctttcctacgctaccacttcagtgggcaagatttgttcaatgtttaacagaataaaaagtcaaaaccaagaatgtcaacatcatctatccattatccatgtgatcggctgattgccactaccttggattacattttatttgactggtcatagattcgttgtttaggtcaacttctgttttgtatcctgaatcctgaacgaacatgccaacatggtgacgatggtcaaatgagtataatgtggtggtctactttcatatggtcatcagaaaaaaggttaaatttttataatccaacgtgaactcattaaacttaaattagaatccttcaggcattgacattgaccaaacttaatttgttttataattccttatgccaacatggtgacgaactgacgatggtcaaatgagtataatgtcattggtctactttcacatggtcatgagcaaaatattggatttgtatattcaacgttcaatcattaacttaaattataatccctcaggcattgacattgaccatagtcttagtagtgtttactaatttttaggtgctttgtaacttgcttcacgcttctttctaaacctctattgacttttaccttaacatcagatcgggcaggtccttaacatgtagaaaagctgattgagattgatcagatcaaggaccaaagtaaaaatacaagaattatg

SEQ ID NO: 31424 - DNA, 3003 bp, Unknown
  misc_feature (1)..( 3003): 2750-1469P.txt file - cDNA_ID_3042012; gDNA_ID_1972122; Annot_ID_179041
tcttgcacaacaaagccctgtttaacaagtatatacatagtttcagacatgtttagaacaatgaaagcacaagaatcttggtaatagccgtgtttttacctgttgggcaaagtagaccaagaggaagcaggggcagcttcagaatccgaaaactcccacactttcaacgaacttgaatgctctgaatcaacactagtccaagttttcattccgaaactactcttatcaacctcactgttcttctgcatacacgcttgcagtgatgactgcttcagagctgttcgaccaccagttgagaaagatttgaaatttgtaacttccgttggaaacccagagttacccttcatcgattgagacttcaaagctcgatctagtttccgagtttccacagaggtagagactttctccggcgacacattctccttatcctctcccttttgagtggataaagaccctgtaattgtgtccacatttcccttattttcctccaacaaatcattcacttttctcgaaccagccatgttttttttccctttctggatggattgctttcaagtatcaagtttagaactttctgggagctaagtttatatctttatagattttgaagacatgaatctagaaacaggtgtttgacaatggtactgagttgaaagtaacgtttttataaagtcccacagtgtttccatttgaatttgaatagccattggggattgtgcgagcacagaaccaaagacacagatggacttttcttttcttgtcttaaacacaaaggttttttagatgtctgcgtttggtttttgccctttttctactttctacggacccaacggtcaatacacgatagtgggattttgattaatattttgtcgttttcctttgtcgggaaactgaaaggttgatgattggattgaggtttagcgggaactgtgtttcaaacactcaaacacttaaagtatcaacaacctgccgttttttatatttatcaacgtcatgccgttttatcttcgtgagtcatccaaaaccgataagccagagcctcaaaccatcgagtggctgttaaaccatactgttcaaattagtccaaccaaaaccatgagaggccacaacatcgtcgaagcccattattatcaccatggctaaagccagtagtactctgtttgctgtttcctgctccgcttcagctcgtttctctttcctccgacgctctgaatctcttaaaccctcagtttcaagagcgagattcgccgttccaatggctatggccgccgcgtcagctgccaccgctaaaaaactagcgcctgctgtgattgtgggtggcggaagagtcggaagggcgttacaggaaatgggtaatggcgaggatttgttggtgaagagaggagaagcagttccggttgattttgaaggacccattttggtttgtacaagaaatgatgatctcgatgctgttcttgaagctactcctcagtctagatggaaaggtagaaactttcataggccctaagaatcattagtgagccaaattgttagatgttttagggcgtttgatcatcgcagagcacaattcaaatgatcagattatcaaattttgattgtttcttcagtttatgacttggtatagtaaaaacgttgtgtgtaattaatcagatttggtcttcttccaaaatggaatgatggagccgtggtttgagagcaaaggtttgggtgatacagaccaagtgttggcctattttgctgtgtcaaagctcggcgagcctcccgtggatggaaagactgacactaacccagaaggtcttactgctgcttatggaaaatgggcttcagagatagctgcaagattgcaatctggtggcctctcttgcaaggttacaagaagcaaatctttgttttatgataacgcagaagctgcatggatatactaaatgtgttcttttgtcggtgtttctgtggttaggtacttgacaaagaagcttttcagaagcaaatgttggagaaactcatttggatttgtgcatttatgcttgttggagctcgtcatccaggtgcaagtgttggcacggtggagaaagaatacagagatgaagtaccgaaattccattcctcgtttcgttttagcattcaaaatcgttgtttagtgctaattacttatacattcaggtgtcgagactcatccaagaacttgcagcagctgctgccgcggaaaaaggactaacctttgaagagaacatggtggaaagactatgtgcttattcacgagctgtttctcatttcccaactgctgttaaagaagtacatatatcacttttatcatccttgatctctctctttcaatgcatgtgcatgtgcatcagtatctgtttcacaactagttttctgattattgcagtttaaatggaggaatggttggttttattcactctcagagaaggcgattgcggaagggcaaccggatccgtgtcccctccataccgaatggctgaaagagcttaaagtgatatagagccagtctttctaaattgtgagtatctggattaagtatcattcttacatattttaagtagatgatctgaaactagtgtcaactgtgtacacgcctgagaagtgaaaaaaagatgtaattttttaataaagaaagagaatcagttcacgctttgtaaaatgtccagacttttatatgtgtaaacttgtgcattttcaagaatcaaaacttttctgcttctagactcccatcaattagggaagactagaatcttcaataataaacaaattatgacagatacctatgtagactctttggaatcatcaatagttgacaaagtaagaggcaggatcgtccacgcttgtttgaattttcagcctttgcaggcaaggtggtccaagtaggcaactgtggtttcttcggttagttactatataacacataattctatattagctttagctttagcttcacataacataactcagttttctacaaagaaaaaaaaacagagcataatg

SEQ ID NO: 31425 - DNA, 696 bp, Unknown; identical to SEQ ID NO: 316
  misc_feature (1)..( 696): 2750-1469P.txt file - cDNA_ID_3042012; gDNA_ID_1563726; Annot_ID_148193
  misc_feature (125)..(125): n is a, c, g, or t
  misc_feature (292)..(292): n is a, c, g, or t
  misc_feature (380)..(380): n is a, c, g, or t
  misc_feature (693)..(693): n is a, c, g, or t

SEQ ID NO: 31426 - DNA, 3003 bp, Unknown
  misc_feature (1)..( 3003): 2750-1469P.txt file - cDNA_ID_3042016; gDNA_ID_1972122; Annot_ID_179040
ctcttgaagtcgtcacctttagtggcagaggaggtaatcggaccatcgacgccacctgagattgctccgcctcgtcggagcttcccggaagatatccagacgtatttcgggtgtcaaaactccggcaagttaacggcggaggaagatgatgttatcttcggtgatttagattctttccttacgcctgatttctacagcgagttaaatgattgctaaagtgttgttcttctgataagttttgttttttagttgttcagaatctcggttgtgaaaatcaacattgacacatcgattattctttcttgtgacaatcttatataataaagtttgaatctttttaacagttgtccactttcagtttcctctgatggtgaatttgatttgagaggtactgaggtagtttgtgaaactcagatagaggaattgtttatgtagaaaagtaaggtatacagatgatgatcattggagggatgttcagagattgaactcgtccgtttattaatgatcaaacagtacaacaaagcttggaatcaatagaagccaagcaaatgcagaatgcttggtagcctgagaatggatacctgcaaacagataaagcaaaagacttttagatgataaagcctttaatcctaagcttataagtatgtttatgtttggctcattctggtttgagcaagtagtacctgaagtcgattacatatcttgctttgtcaactctccccatttgaagaattgtctgccttggagtctcctgcttataccaaattacacaatgtttaggattcttgagattggtttttgatcaaagctttaaagttgtggaaatgcaccgtgagtgttagctgaaagttcttcaccgagctctgtattctcagtcctgttcttcctctgtctctgaagtctaactcatgctgcttggagatctaaagaaaggggaagacacaatgaatttcatgctttacaaaatcaacaatgatgcccggtgagacttactttgttgtaatgtggtatccttgagcatagcttctgaattttttccttattctcaagccaatcaagcggtagtttactagcttgttgaacctataaggagatacatacatacgtgtattaacagttttatgttttcggaatgcaagattgatggagagaagtttaagattaggcatttacctgcttattgttgtttttctgcattggctgctgctttggtagcaaagttctcattcttctgtagctccctgtccaagttgttatggtgggtgtgaatctgcagaagccaacagatgcataagcaaacccaaaactaaggcagaggcaaattcatcaaaaaacacggcattcaaaatcctcaacgcttacattacaaccgaaagaagcggcttcaccattttacctacagaaccaactcgaactccctgcaatggaatcaaaagaccagaaacattcatactcgatttccaacctataagcagaaccaacaccgttacattgagcttgaatttctgaccttgtcccatatgtagtacttggaacccaagagattagccgtcatggaaccgacataactttcatccgaactgcacagcaatcccttaacattctgtgccaccctaaatatagatttcccattacgtcggctatggtaagcaactgctaacttccggtctttacgcccccgaccttcctgagatatcagaaacattgatatcactacatctcaattctcactcagcatcatggtaaatcgaatatctatatacttacatgtgtataaagtgaatatacagatccgtggctcaagccttcaggtgattgttctttcacaatcagacaagtgcatcttcccacatccaaaggtagtgtcttgcacaacaaagccctgtttaacaagtatatacatagtttcagacatgtttagaacaatgaaagcacaagaatcttggtaatagccgtgtttttacctgttgggcaaagtagaccaagaggaagcaggggcagcttcagaatccgaaaactcccacactttcaacgaacttgaatgctctgaatcaacactagtccaagttttcattccgaaactactcttatcaacctcactgttcttctgcatacacgcttgcagtgatgactgcttcagagctgttcgaccaccagttgagaaagatttgaaatttgtaacttccgttggaaacccagagttacccttcatcgattgagacttcaaagctcgatctagtttccgagtttccacagaggtagagactttctccggcgacacattctccttatcctctcccttttgagtggataaagaccctgtaattgtgtccacatttcccttattttcctccaacaaatcattcacttttctcgaaccagccatgttttttttccctttctggatggattgctttcaagtatcaagtttagaactttctgggagctaagtttatatctttatagattttgaagacatgaatctagaaacaggtgtttgacaatggtactgagttgaaagtaacgtttttataaagtcccacagtgtttccatttgaatttgaatagccattggggattgtgcgagcacagaaccaaagacacagatggacttttcttttcttgtcttaaacacaaaggttttttagatgtctgcgtttggtttttgccctttttctactttctacggacccaacggtcaatacacgatagtgggattttgattaatattttgtcgttttcctttgtcgggaaactgaaaggttgatgattggattgaggtttagcgggaactgtgtttcaaacactcaaacacttaaagtatcaacaacctgccgttttttatatttatcaacgtcatgccgttttatcttcgtgagtcatccaaaaccgataagccagagcctcaaaccatcgagtggctgttaaaccatactgttcaaattagtccaaccaaaaccatgagaggccacaacatcgtcgaagcccattattatcaccatg

SEQ ID NO: 31427 - DNA, 3003 bp, Unknown
  misc_feature (1)..( 3003): 2750-1469P.txt file - cDNA_ID_3042024; gDNA_ID_1972122; Annot_ID_179030
aaattaaaatgtagcatgtaatcgattcacacaaatacgtctggtctaagagttcatcgcaacattctactatgcatgaaccgataaccaaaatacatctatacaacaccaaaatacaaaactaagaacacgtcacggtaacaaaacctcgttgtgtcaattaatctctggaagcagaacaaacaacattggtactcaaatacgttaattagcttatttcagaatggctcttatttatcactctctctctcgttcttcttcttcgccttcgttgttgttgttgtctctgcatctacgcaacagtcttggtatctgaagcagcctatgagatgatcattcgtgagtccagctgcttgcatgaaggagtaaataactgttggactaacgctgcgaaagcctctgcgtacaagatctttgcttataaactcagctttcgatgtcttcacagggacttggcgctgatacctgaattggctctgtgtaggcttgttgttcacaaagttccacatgtacttcttcaatgatccacattcagctataatctggatgaagttaagaattaacaggcagacagattataatatttagacaagttctaagttttcagtaattatgatcagtaagtgtgagcttatgttctgttaccttgcgcacatggcgtgagttatcgaggattgatcgtatcttgacctctgatagtaaggaaatggcagcagtacctggcgctgttaactttttgtcattcaattcagctacagcgactggatcgaagtccataaaaacttccctgtttcaaataagaagcaaattaggcaatcagagatcagagctactggcttagcatcagaagtttatattgcgaattcaaaattcatattactaaagaacttggtttggttacctgagtatatgtcttctggagagaatgtcggtccatgagagttcggctagagcaccagagaggcataataactcaaaaagcttcctacacaagttaaccaagcggtaagagactcttataactacaaagtgtatctcagatagaaggaaaatagttgaggatgccacatacttgtcgtcatgtacaggaactccccattcttcgtcatggaaagcaacatagcacgggtctttacaacgtagaaaaacgcaacattattagtcaatttacagcagagaaagatatgaagcatgagagaacaacaaagaataatggaaagtgcctcttggcatggaaacatttatgctcattagtatagagaatccagaaaacgctgtttggcttacactaaaagcataaacgaagtggatctatcagctaatcaaaacatccttcatctaaatttcatggacactgagaagttaaaatatttataagagaacttcaggacaagctacttcataagttatgcaacatagcaaatgatctacacaatgctcactgaataaaatacatagcaattgaaacattttgttggccattgaattacttaatattcacatacagaagaacataattagatcaaacaaaaaacactagctccttgtctcaattcagtcccatttgattcaactagataagaactttatcatctcacacaatcaggctaaactcaatctcacattcacattttcactcatttcatttatttgaatgcatctaaagtcaaaagctctctcactatgcaatgtgtgataggtgaaagtttgatgcttaccagctttaggtgtgatccaagcacaccttttacgaccatcagcgaagcaatcaccagaaaccttctcttcttctttcccaacactcagcttccttgtagaagagacagacccacttcgcctcacaaccttcttacagctcgaagaagacgccacgctcaaaggcgatgactcacacgaagacgaagcatcagaggaatacgaagcagtcattgaagcactattctttctcaaaatcgaagagcaaagagacgagcattgcttcagagtcgtccttggtgaagccggagtagttggtttcttcgctttctcatcttttgagtcgatgatggtcttctccatcatcggcttctccagtttcatccccggtggtttcctctgcagcttgttcccggtaggaccaagaactgatcggaactctcgctcatcggaatttacggaccggaatctaggaggaaccgacattgacccgattctcacaaaaaactgctttttgatttcacagatctatcactggatcacacaacaacaacaaaattgctatttccaacagtctcgaaacttatttcaagagattatatatcggaaggcctagactttacagctacattagcaccaaaaatgaaacttttttgtcaccgctaaatatctcatttttaggaatcttctagtaaaactaaaccaagttgcttgctgtgttcacgagaaaagcaaggttagaaacaatgagcaacaaaataaaatctttgaacaatgaagaaaaaaaaagcttttgacttcagaaaaacccagaaaaaaaaaagaaagaaagaagctttttctgatcgacgacgaaacgaatcaaatcgagagagagagacgaggagaaaaggtcattcaccagtcacgacttaacacgtcatcgtttggttcttctgctttttctgttcttttgttcctcgacccgacaatgaaacgggtccttattgctcgacccgacaagttaaatggtttaattgcttactgtaatcagttggttaatgcttctgagttctgagattaggaatgtttctttgctcgtgcgtatcaaccaatgtaaagacaaaagttttaattaatcgaacagagaataatttctggaattgccataaccaaaataaataaattaaatgctaagttttcttctatggtcggaaaattgccacaaaagggacccacttatcctaagttcctacagagatctgttttctttcacaacatttaaaaatccaaacttttctttctttggctcaaaaaaaccttccaatg

SEQ ID NO: 31428 - DNA, 3003 bp, Unknown
  misc_feature (1)..( 3003): 2750-1469P.txt file - cDNA_ID_3042047; gDNA_ID_1972123; Annot_ID_179079
gcacgagggacatgacttactggaggaatcacaccgtaactctgtccttcccagtaaggaaggttaccatcatgatcgatgacgatatgacaagtttctccaggggctttcgggccaactactcgctccacagagacaatcttagcggtgtaagactccttgggtttgtacaagttcaaaggaggatccttagggtcttccaactctataggagagacagtaaccttggaactacttgtttgttgaaccgacatacatattgtcgtgctcgggtaccgtttcccatctcttatgcttgttgtcttctggttcaatgctaaagaagatgaccatgacttgctgttgaagcttatgctattgttctgctgcagaatggaaatagagtacaacacaaagcaagcgatggtttaagatcaaactcaagcaaacaaaacaatagacatcatgtagaagacaatcagaatccatgactctgagtatgaacacagctcaagctcgaatctttatacttatatgagagattagatgcatcaccttgaagacggatcttctaagagaacgttggttttcaattgaaactgagacagcaccagcctgtatagaagaaatttaaactccatcagattaaaactcctttctgataacaaatgaaactcaaatacaggatcactaagaaaagatcgttaatcgaattaaagacaagcctaaacccagattaaagatcaataaaacctcaaatcaataaagtttttaaaaattccctcgttttctccgaaaacagacaaatggaacattaagacccaaatcaaacccctaaacaaaacagaggattcgaaactctccagctataatcactataatcaagaagatataaaatccaatcgttgactaaaaaaataaggaaatgtgtggaggatctgacctgagaaacagcagagtgagacattgttatcgatctgagaaaggattattagtctcgtcggaacctgattagagcaatcaataatgagaggaagatgatgatgaactctagggtttttaaatacagtaagcaacacgatcctttgaatctcctcaaaggccaagcttccttcttctcctcttttggactcctccaactgacgctctcagacttcttaattaattaattagatttttcttgtaagctttaaaaattaattcattattagcaataaccgaaccgaattgacaaaatgttcccaaaccgaaccagttcaaatcattttcctgaaccgaacacaccaaacataatcaataaccaaccaaaagattattagtatctgttttcttacaataatacatgataacatctttattgttcttgatacaattgagaaaattatagagaaaacccaaaaaaaaaggaacgattctacttggtattattatgaatgtgatcacaattaacagaggaattttgcgttttcgggtaaccgagaaaataaatgagagcagaagcgaccatcaaagccacgccggagagtccacacaccaagctgcccacaaccagcacgtgattcatcacgcgatcatcatcctgatcttttgatagcgtcttcattggagacttcaccgcactcggcaatatcgagctagacggtgatgatatcgacgttagatcatttgaagaaggtggtccaaagaatgacgtcatttctgatgactcgcctggttcgtagtagtactcgagaccgtgatcggacggtcgtaattctcttgcattgataatcgttgattctaggacgatgatgaacatgatcagcattgaaatcaacggtggatactcactggttttgtgtgcggccattttcttgttgaagttttctcttaggcttaaagagagttacaacaactttacaagaccttcccgtgaaggaaggctttatacgagaatccaaacaagacgaaacgactccgttttaagctacttcgaatgttgccactacattcgactaaacatgtagtatttctttattccacgttggctaggaacagtgtctctcgactcttgtgctttgtctgaatttggtataaataattctcgtgagtttccttgtcggagattggccctaaattcacggggatctaacacaaattaagaaatataaaacctcccatttttatttttccagtttgaatttaccatatacttctcgggagtatttttgtcatcgatttataatatagctataataagatttgttttaaatagcgtgaaaaaggaaaaataacaagtaaactacagtagcagttatagatttatagttgagtggtatccaaggttctatttcttgaaagcaaagaagaatccttgaaagttgtttttttttcatcaattaaaaacataaatttccagaaacagaaaaacaatgatatttgcatcaagataaattaaacaaaattcatgactttttgactccaccaacgatgatgatccccgaagaagaagttgagtcgccgcttcagcatctaccatgtgagtcgtttacgtctcccccaaacgaattcgctgtgaactgcttcgcacgtatctcaaaaatgcattacccttcactttccctcgtttccaaaaccttgcgttctctcataaatcatttcaggcaaattctcaatgctagctgatcttcatctcaaaagtgttagtagaggaatttgagtactgtatcttttgttttcacttcgatcttggaaacaattttttatctccaatgtttcaagtttcaactcaaccttggtcagttactaatctgatagtaaagcccatttttaattgggcctggcctatatagtcaccaaacgcaaaaacgatgatactctctctttacagataacgtaagataaggagaggtcgtcgatgcgatgacatgtactgccacgtcatcaatggaaagaacacaaaatcgaatctctctgtctccctcttcttcttccagtaaacttggatgacactgtgaatttcataatttgcccttctccggaatg

SEQ ID NO: 31429 - DNA, 3000 bp, Unknown; identical to SEQ ID NO: 9480
  misc_feature (1)..( 3000): 2750-1469P.txt file - cDNA_ID_3042051; gDNA_ID_1972123; Annot_ID_179075

SEQ ID NO: 31430 - DNA, 3000 bp, Unknown; identical to SEQ ID NO: 9476
  misc_feature (1)..( 3000): 2750-1469P.txt file - cDNA_ID_3042055; gDNA_ID_1972123; Annot_ID_179073

SEQ ID NO: 31431 - DNA, 3000 bp, Unknown
  misc_feature (1)..( 3000): 2750-1469P.txt file - cDNA_ID_3042091; gDNA_ID_1972132; Annot_ID_179105
ttcttatgtgggtgtgattcgccacaggctccgcaaaaatactatccgaacattaagggatcttgtattaacttagagttggaaaaagaaagaaagtagaattaacagaaacatttggattgaaagattgttgttaattacttcgttgtcatcagaaggtggatcaagctccaataagccgacgctgtctctaacactttgagcaccagcagaccattgtttacatatacaatcaacattcctaagtacataaaatataagaaacagagagatcaagaaaaggggttgcttgtagaagaagaaattcaaatcttaagaaaagaaaaaaaaacatttaccatcttaagtgagaaagcagaagtgtggcttcagctttggagagggaagtaaaatctgaaacactttgaacgtcaatttccataagcgctcgaatatcttcctctgtcagaacagttgcataattccgctggacagatttttttccggtctgaccatcttctaaagctgcgttgacatacgactcatccgcctccgcatccacctccgatccgattacagaattattatccatacaaaaatacaatgtgagaagagaggacgttttctccttttatagaattcaattgaagaagaccaagtcgttgacaagggtgtacaattctcttacttttgtgacaagcaatctttaagtttctcagcttttaccttccatcttccgatgtcttttcaataagttcaaacacttgttctacttccccttaaacaagagtttaccaaagacaattgggaatcgtttttaaacaataaaatggttgacaggcgatctatctatggtaaaattaaatgtccaactgtttactttatttaaatgattgttttgttccttatcacatttgctaattaatactatatagactctatgcttaaagccttcaatctagtaaatacagtttaatgttattatagtcatgacactgatcatatcaattagttctactgtactagagatcacaagtgaaattatcaccgcttcacattgataaaagactaacctggatttcagtctaaaaatatcatctaagaaaaccatatagaattaaataaaatattgaaaaagtcatacttattttttaatcatgcatgcaattgggaatattatatggtctccgttagcttccttgtaagaaagagtctcacagagagaatatgaatagagatgcaagaaaaggaaaaatcaaggaaactacatctcatctcaagtaaaccaaaatgtaatttttatgacaatataataatagataagttaacgtcaactccagcatctcaactctcaagctgagtccgtgtaaaattgaaccgatcgtccactatgactcacggaatctacaactagagatcattaaaacaaatgggtaaaacacattagattatcggactcgtctcaccatgttgattcttcgaaataacaacacaagtactccattctttcacataaacataataatgttagtatttatttagttgtatactgtgttgtgtctttatgaattgttttatctttgtttggtgtatcaaaagtgacgtgtgtaagtaaacctttaaggggctaaatgaagaaaaaaaagcctaaagcgttagatcatgtggatcctaccagtgcgatctccgtgatggctcgcgcctcccagcctcacaccacgtacgagtgcaaattgtgcaaaatcaattatacgctttttataagaaaacataaaaggggtctctttttgttaattaataattatatatggtgacttgtaaactgaataatggtgatactactagtaagcaccgataagaaatacgaacatctttaataatgtggtcatttccaaataaaatgattcgaatatgccacccttgcatttgttgatctcatcatcactattgattttctgatcttctcgatctacgttgattttgtacatatgaataataccatgaataaatacctaaaagttgattatgtgtctgatttcaagcatacgaaatattagtgttgttagtttatccagaataaacaaataaatatatatgccttgcatggcaatctttggtaaaaaacccaacatatataacaaagaaaataagcaatattattcttctaagaacatttcatttataaatatgcatggaaaagggaaataatgtataaaaatgtggtcatatgtatttccaatgggtcatggacctcatggtgaccatatataatgtagatgaataattgtgaggtgaagaagaataatgatggtgactttgtaatcttctcctcccacttaaattattgagcgacaacgtggctttttgttggcccatattcattcgtatctcccatctctccactccttatccaccacgtgtccccagctgcaagaccaactgtgtatatctttgtcacatccaagtcgttacaatgacagtgtttcacattcataaaggttaattatcatctacagtttatgacagttctatgattatatctgttataacatcatatcatcatatacatgcagtcccctgtgactatagatgactataacataattttctctgaacaattgtactgttcatttaattgtttctgattttttccctaacatgttaacttctactattaaataaaactttaaaataaaatttgagtttaaaattaagttttgttaaaagattagtatttggtgcctttgatggatcacattaccaattttagtcatctacttaatttcaagatacatatttactttttgacaattataccctaattgtcggggctcactaattttaaaacgacattagtcacgcgagaagatgccaacccatcacatcatcatcatcatacatcgcggcttttataagtaaacaaatcgactcttatgtatttctcccgacacaacacaaagttcatataataagaaaaacagagagaaacacacagagagctagaggagagtgagtgtcatg

SEQ ID NO: 31432 - DNA, 3000 bp, Unknown; identical to SEQ ID NO: 9489
  misc_feature (1)..( 3000): 2750-1469P.txt file - cDNA_ID_3042093; gDNA_ID_1972132; Annot_ID_179103

SEQ ID NO: 31433 - DNA, 3003 bp, Unknown
  misc_feature (1)..( 3003): 2750-1469P.txt file - cDNA_ID_3042105; gDNA_ID_1972132; Annot_ID_179098
gctaacctaaagagctctttgactccggctaggcttgatcctcataaccctcgtcctgatgtcaaggtcgaatccgggttcttaggtttatacacatccggtgagagcgagagcaaattcgggctagaaagctgccgtgagcagcttctctccgagatctcgaggcttatgaacaagcacaaaggcgaggaaataagcataacacttgcgggacatagtatggggagttctctagctcagcttctagcttacgacatagcggaactcggtatgaaccagagaagggacgaaaaacctgttccggtgaccgtgttttcgtttgctggtcctagagttggtaacttggggttcaaaaaacggtgtgaggagctaggagttaaagtcttgaggatcacgaatgtaaacgatccgatcaccaaacttccaggtttcttatttaatgagaatttcagatctttaggtggtgtttacgagcttccttggagctgttcttgctacactcacgtgggagtcgaactcaccctcgatttcttcgatgttcaaaacatttcttgtgtccatgacctcgagacttacatcactctagtaaaccgtccgagatgctcgaaattggcggttaatgaagacaattttggcggcgagtttttgaacagaacaagtgaactgatgttcagtaagggacgacgtcaagcgttgcattttacaaacgcagcgaccaatgcggcatatctactttgttctatatccaaccatatgttgtattataatatattttaggtctagattgatccaagctaaaattttggattcttttttaagataggacaaaataattattgccctatcttttacgtagcataagaaatgtacatatatagatgtatatgcaaaacctaatacaaaaaagtatattttccacatccaagataaattattgcgtctcatctatcacaatgtgaacaaaaataattattttcttctcttagttactatgagttcacaatataatacttttctttaggttaaagctctcaactgttgatgaagtacaagaactcaaaattgtgaatgaaaaaaagggacatcatccaatatcaggcgtgtacatattagcattgttgtgtatctttttatattatagtccattagtcctaatcgatagatgtatttttttttgttttattagttataaaaacagacatctattattaatttgttatggttaattggttattgtatattattatagtagaagtgacgtgaggtaccaacgtattagattataaatataaataatggccaaagacaaagccatttgtcaaaacttcaacgtcattataacctgtaagattaaaaatgaacaataagaaatcatatttagcaaaaaaaaaaaaaaaaaacaataagaatcatttgtcaaatcttcaacatcgttacagtgtataatttatattttgattttttgttctaaatgatcaaagttcatatataaagttatttatatgctcaaatttaatcatcgaatatatatacaatttgtctatgttatttgtcaaagacaacgtcagcaatagttccatatactctctttttctttcggagtctttatattactcacggagatattaaattatatttattttttcactgagatatttttttttttttggtttaatgttaataaactcactgagatattaattaatacatgcaatctttatctatatttcccatttttatttgtaaatgtgtcccttctcgtgttatgcgagggtctttttttaactttttaatttctcatttggaagctttcatctataaatatatgcactagcttattctatatataacataaaaccgaaaaaaggttttgttcacgatgtggattctctgttcacgagaggttttgttgaaaaagaaagaaagaaaataattcaacttgaatttggaagtttggttacagatcacatcattcgacaataaaaataaagacatatataacaattagaacagtaactaatttgaatttcagcttcgatttcttacgaatcacatggggtcaataagggtggggctagaaaaacacgtacgtttggagaccaatgtgtgtatcattcctgcatgcgcatcagatgtgtttcactcttcagaaaaacgtttattttattttgcatgtcacagtcgtagctaattatccgtacgcatcttaattacgactccattttacacaccaatttatggatatataattcagacaagatgagttctcgtttaattttacttctttccatttgtggaagttcatatactattgtgaaaatttgaaaataactggtgaaagaggaaacgtccatatttgtgggctctatttataataataacaacaatattaattgtttaggtaaaaattaacagaactattttgaattacaatcggaaaaaggtttgcgtcaaaaaagtattgatgaaccatgcatttgatataagcatttatgtttgttcaatttactattaagcaattaagtcgaattttatcgaatcattttaatttttacctttaacatttctgtgatcttgaaatctttaaattaacaatgtgagttatatacactagagaaaaataattgcattccactgaaaacctcaacatcttgggaaatttaaacttaatcaaagacatcgcaaatgttgcttatctttttatcaagcccagcccacatattcgcggccccaaagcccaaaggttaagctgactcgttacaaaataaataagtattaataaaggtttttgattggcttatttcggtttaaatttaataccatatctttcggaagatcacgtgagacacatgtgacatccaacgaatagccaatcgctgaaaagtgaagactttttgttaccccataaacaaaagcatcatctctctctcatcttttatttttcttttagaaaccaaacttttcagatttctctctctccatttggcgatagaagaagtcatg

SEQ ID NO: 31434 - DNA, 3003 bp, Unknown
  misc_feature (1)..( 3003): 2750-1469P.txt file - cDNA_ID_3042107; gDNA_ID_1972132; Annot_ID_179095
ataaatattaattttgatgaaaaggaatttgtaaagaagcggttctcgtaatttttcttcggaagttgtcaaagaaccggcagatcctcgctgctcttgcattcgctcactacggtaacactctatcatctccatctctgttttgaattcgagattcgaactcaaagatttcgttttggaggattgcaatcttttcaatcaaaaaaaaaaagtaaaaagattgtaaaattgatcgttgattgggtgcggatgatctttggtcttcttgagcttaacttgggttgacatcagtttactgttttaagagatgaaaacccacaaggcatataacttttctagggtttagggtaattatattttaggatcaatcttctcgaaaaggaagaaaaattgaagcttgctatgtctctttaccttgagatatgagaatcacaggtcaaattatgttcttgatagattcagttgttgagttcatgtgtggtgttggaagaagtcaaaactctagttctagatataagcttgaaatttggacatgattttgtagatgtaagcttgaaaatggtttaggagagatgttactagatgcttccttatgccttctctgagactttaacattttgttgacacttttgttcttttttatctacatcttttgaatcatttgtttaaagcttttgcttaactcaaaagtaatttgtctcagcttttgcttaatggtgcctttttcctctggcaaacagatctcagactacagttaccaagatggtgtacgaaataactgagcaaaaaagtaattatttcttcacaattatcgctgtatagctttttcttgtgctgtttctgatgtacaactcttttggcaacggattttcgttagttctaagcattttgtcggtcctgtcgttcacttgtctttctcttgtcttataaacattactgaacagatcaaggtagatactgggtcagatttctttatatacgtgttatatctcttctttaggaattaaatcagtaatagaaatcacaaacttcatttttctttgtcttatggcttccatttcctgaatgtttgcagaagttgggttgggcctcattggttttggtttatcctttacgtttctcggagtcatcttgtactttgacagaggtttgctcgctctaggaaacgtgaggatatccttgttatttctaaacattaaatctacacaagggtccaacatttgagtctcatttggcttttgtgttcagttattctggttgataggtgttggccttttacttggttggcagtcgacttggagagtatttacaaatgttaataacttgagggtacgcattggactaattctaatctctgttaattgtttctcttgatgaacctttcatatggacatatcaatatgttcttgcaggggactatctgtttcgtccttggactctttctaatatttgtacgttggcccattatcggcattatcttggagatatacggtgtcattgtcctattcgggtgagtgcatttgtttctgttgctcatagtttcttatcgagtttttcacacattgtgcttttagatttgacatattaaagcagactgaaaaatgagtaaactagtggttctggcacagcacactaggatcttttgcctacagaatgatgatgtttgactaataacaatccatatctgatgaactcatttcctttcaccagtcacttattaattttattcagcttcttgcttaaagttttagcctgttacagtgtctaaccaacatcacatgtactaactttgcagcggattttggtcaacagtaaaggcatttctttcccagattccttttgtcggatggataatacagtatcctctcatggtaagtaatccacaacaacacttgccttttcctctaatgctcctttcttatgctttttgtacattcagagcttcctgtcagggccttgttcttgaacaacatcccgtgctcctgcctcaatttattcagtcccttgtggtagcttaagttagcctttctcggaaatggatagacccaatggacgtttcctgatatttagtttgcacatgatatagggatgaacataaaatgatttagagcgatggactgaattttgttttggaatgatctgtttatttttgcaggttcttgagcaacttgtaagaggtgctcgttgaaaaagatcaatctcaatctcatggctcttcagccgcttaacgacatcaaagcctttctttcttttttgggacatgacagagactttgctctgttttttgtttttttggtaaacctcacctttgctctgttttacatgtctaattttgctgtatatgccaaaatacattttcccttaaattgatttatcttctcgttaagcaagtattttcaactataactccaatcttgtgccaaatttaatcaaattcagatgataagtttttttttttaaacctccaatcttgtcccaactcaattttcattatgtaacgtgcggataataattaagtagttttgtaacgaatcaacgacatatttaacataaattaaattttaacagaataaaaagtgttcacgttattaaattttgtttttatttgcgtacggacataagttcctaaatgtgtcagccaaagatcaaattgttttcaggatcagacagagatcatcgagtgcggatttttctcggagagatgtctcttcgtgctttcttgctcggcgaggcattgacctaaacccgcttaataatctccgacgaagatccaggacacactcggcgttaagaggggaaagaaccaaaaatcaaacaatcatgtggatttcgaggttgaagagagttaggagaacgattatggttctgggcgttgccaatttcgtcgtgattgtttccggctgcgttcttactctcgtttctgacgcagattgcgacagccccggacaactatttcccctcttcgccgtttgtttcgctgccggcgtcaaactcgccgccatg

SEQ ID NO: 31435 - DNA, 3003 bp, Unknown
  misc_feature (1)..( 3003): 2750-1469P.txt file - cDNA_ID_3042123; gDNA_ID_1972133; Annot_ID_179130
agatttcctaatttctgatcatctaagccgtaagagctgcacaacattaacaagaaaacagatttatattagtatacagtattacccaactgaataagttacaggggttttcatattagccaacataaagagaaacagattgctgaattctataaacatgacttttaacttaaatggtagatatgacattccagtgcgtacatacctgcctatctgcttgttgatccagttcaacaaaagatcagcagtgcgccattcattgactacgcttatctcatttttctcttgtttaggtccccagctgccaccaacgaaccttttaggaggagcccaaaagagcattggataatgattgatagagaacttgtcacaaagctttacattcatctgtgctgccagaaaagtcacaataacaattagaaagaaaaaaaactatacacaacctcataagatacagttttcaagccccacgctctgactcacacgatccacatgaagtaagagaaaaaagagaaaggaaggtcaagatacacgttcatctatataaataaaaaagatggtgcaagtacctttatcgcacaatcaactctggtcatcaaaacgacaccaggatatactgcgtctgctccattgaatagccttgcaactttttcataatgtggctgcagcagagtcacccattggatataaacaacattgacaagagtaagcattgaataataagacattgaatggcgttgttaccttgtagtttctacatgcagggcaccttgagccaaacaaaaattatgggtcaatgtcagtatacaagcctttcgcatttatatataaagttaagttatttccggataaatctcagagaattggataacgtaaagtcaggttcgaatatgaagaacacttgcaaacaaattccgtgtaagatccagtgcttaaaagcctaaagtttgaatttttttcagattttttacgagagagagagagaatgagaaaactgaccagtgagcgaagaactctaaaacggcatatttggcgggggaatcttggaaaactgaatcaaagttggtagcgttcaattcgatagcgttgtctttctgatcggcgacgttactgccgatgtcccggagaatcgagcgcgatcccggtgaaaacgacgccgcagcttcaaggctcagcagacccaacaacaagaacaagtgtatcaaagacattaaatcgaataaagcatacaaattttgaagcttgatccggatgagagggaagatctaagagcaaaaagagcttccctccttccgttgagaaacaaaggtctctggtgtttattacgacgtcgtaacgcctttgaccggcgtcgatactttgttctcctccgacaactttcatactgggctttattataacgttataggcccattactaatctccatttgatgtttgtgtttgtttccttttgacccgcccaaaaagaaagaatttgaatgtagataagataacgctatctctagtcaatactcaatagtcaaataaaagttggccattttgtttggaaatcggaggaacagttaatgttatccaatagaaaaacttatggagtggttttatttgagatgtttttgtttttctttgtttatagataaatttcggattggatataaaacaccatccgttggtagtattaattttacaaaaaaaattaatcatatatttattttctttgtattctctcatctatgaagataacatgagaaagttataagaaaatatatatatgagataacatgagaaagtctaaaaatggattaattagaacagagagtcaacaagttcatgtctcctcctcactctaaccacaagtcaacaccatttgtcttagtcatgaggagacacacatacacacctcacattaagaaaatttaacacatagcttccttatactattgccacttctcttgcactattcggtatcaattgtttttaagtgcccttcttggtactggggaaaaaattgacaccaaaaagtatcgatcatgtgcacatcctcaacctctaataataatgtcacttaaataagaatgcagtaacacagtccacgtgcatgaattcatttttctgatatagtttgcattcgtctgacatatttggtttcctgatttagatgaatattaaaattcagaaccattttagtatagtgttctcatttctcaactcctgcctcgatctctatagacgttcatgtatgcttttttttgttttcgtttatcaactctcaaaaggatgagatattaacaaccattcttaatttttggcaagtataacaaactgagagagaatgtttaaaagtccaattttaagattccaatatgcttaaaaaattcttacgcagcatctactatccgccgttagttttagacccttttattatgcgggaatttcccaattgtaccttttttgtttttaaaatcaccaataagggggtgatttcaattttcaactaattatttgggtgtaatgttgaatacgaaaaaaagttgagcaataagtaataaaacatgaaatacaagggtcaaattatgcaaaagaaaacaaaaataagaggtgcttcaatctttttattaaagagtccccttttattgactgtcctctctctctctctcttctttctctttgtcatgaaccagtaatcttgtttctcttcatcttccattgacgtttccttctatcctcgttgccttcatttttcactcgcacgctaatcttcgcctactttgttagattttcggttttgggtttttgtcttttggtcgatttcccctgttcccagaatctccgattaagctgcttccttaatctcttgtctgaatataaactttttccggcgtgtaatttagataggtggttaaaattacgagtagtgagaggagtgttgttgctgttttgtttattcggtaaaacgaaatcggaagttctttgttgtcgtttgattccttttgagaaagagagatg

SEQ ID NO: 31436 - DNA, 3000 bp, Unknown; identical to SEQ ID NO: 9498
  misc_feature (1)..( 3000): 2750-1469P.txt file - cDNA_ID_3042125; gDNA_ID_1972133; Annot_ID_179128

SEQ ID NO: 31437 - DNA, 3003 bp, Unknown
  misc_feature (1)..( 3003): 2750-1469P.txt file - cDNA_ID_3042145; gDNA_ID_1972137; Annot_ID_179154
aaggtgtgggctggagaattcaattattataaggtttaatttcttaggtctttggaaattgcaagtcccaaggccaactaataatgacctcgatctttgcgttaaccggaccgtccatctactcttcctttattttattttaatcatttttccactagttaatacgtttacacttgttcatgacccgtattaaagaaaagaatttgtgttaggagaaaactaaacaattagcgtcaataatcatttacctagttaataaaatacaccgagttgttaatttttattaactaaaatcaagtaactttgacatcgatcggtaatttatttcatatttcaattagtgataacaattataatcctaatgatattcttaggaaaactaacaatgaagttattagcattaactgggacaattcttgatcttacgtgtgctttgatctttgacttcaccacaagctagcatattagcagtagtatataatgcacggaatgaaatcgtcatcacttcattggtatcatacgaaggagtgttggaatatgcaaaaaaaagaaaaaaagaattggtaggctcaaattattaggtctcttattgtatttgtatcagtcgaagatttgtttttcttacaacgtaaatcgtagtggtttgtatttgtaagaagatataacttgtatttctcaaatttaagtatagtgcttgtaaattcctcatatattattgaacatttttctaaatgcaaaaccaaaatataaaataaaacaattgaaccttttttacattgtacaatcaacaacatgtactatgtcatacgtatgatgtgatgtcaaattatattcttcaacatggagttgtgaaagttccatcagataataatttgaccaaattaagtgattcatgtaaccattttgaacagatttcaaggttgtttaaatgattggagattggtcacatatcttacacattacaatttattatggtagagtttttagagattgaataatgtgtggatcaaaccataggaacttgtcgcataaattcgttgcatacttgttttgtccggtatactagacatttcatcaatttgctttagcgcatcttcgataaaacttagtatatgtattacggttataatattagcagagcaataaacttctgagtaacacttgatcgtcaaggtggagtttgttggctttgtgaattgtgatgaagtagaaaaagatttgaaccatagaaagataaacttatatgtggagaattccactgcgttatataatgtctataatagaaccatagaaggattaaactttttgaaaagcctaaaagtaagaaataattgtaatctttttcttgctaacaaaataattgtagtttaagacctctatcgaccacgaagatctcgtagattatttgactaaccaagatgtacgaataatttttatttgaataaagtttcccaactctcaagttgcccttaagctgacagaatgtaacaacttgaatatctaattaaaccactattccaagatacagtaaaagatctatctatgagttcaataatattattttctaatcttaatattattgtaattgctatgaatattttaataagtcttagcagtactgtttacaactagacttgagctgcaaaaaaatattcttgaacgaaagcaaccggtcaaaagacacaaaaataacttttttaaaaaaatataaaaaatctccaacaaaccgtgcatgaaaacaaaagtatttatttaagaattacctatgattcggtacaaaatccaaaacattgaacatgaaaccaataattgttatgattattctcaagcattatactaccatatagtaacacagggcaatggaaaagagtaaccctcttttttagtatatgaagaaaaaaaacatttgaatatatgggaacttgaacttattcaacattgaaactagctgataaaatcataaaagtatgcacatgagacatgatgactgactaaaaataagtgttgaccaacaaaaaaagagagtaaaaaagactgaaaaaagttcataaaaatagtctttatacagtatacagtttttcacaaataaatgccaaatagaattgaatgaatgattactaatgagatttaccagacaaacctaattcattaattatgaaaacaagaaaaagaaatcatgaaaatctgtttttcgaggattttaataacaaaaggataaaataaaataaaaaagagagaataagataaccccaaaatgaaagttgtcactgtcagctcggattgtttagaattggaataattacgtgtttaattaaaccatacacagatttaactaatcaaatcacttttaaccaatttttaaacctttagctcacaaaaaaaaaatgtctctgcaaattataatccttgaatactttggctatggcggtgtttatgtttaatgatcaaaaagctctgttttttatgcaagcgtgggtataaaatccagttccttttccgattttttgttcttccttcttcttcacttcctttttttcttctccatttctcaaaaaggccactcctttgcttatctttctctctctctgcagctgaagaacagagaaaaagggttttttattgtctgacccaaaggacccagtttcaattcagcttttgttgttagaaattgaggtaaaagattcaaaatttgttcagaaaagtggcacagattctgaaaaattaatatctttcttctcactcttttagctcgattctaagcttaaatctggtttagggtttttggagtttgtactgataaagcatgatcctttttgtcttccgttgactgattctgttccttttctcaatatattgatttgggcttctcttgttcttcatcgaatcattggtcttcaaggtgaatgtgtttgtgtagtggcaagtcttgttggtttgtagtggttttgatcttggagattttctgattagtgagtggtgttcatcaagtattagaagaagatg

SEQ ID NO: 31438 - DNA, 3000 bp, Unknown; identical to SEQ ID NO: 15028
  misc_feature (1)..( 3000): 2750-1469P.txt file - cDNA_ID_3042149; gDNA_ID_2684254; Annot_ID_193059

SEQ ID NO: 31439 - DNA, 3003 bp, Unknown
  misc_feature (1)..( 3003): 2750-1469P.txt file - cDNA_ID_3042149; gDNA_ID_1972137; Annot_ID_179151
ctttggataaaattgagtcagtttatgggaatgtgataaatgatttgactattgttttagaaattttacaatagtcgttgattgagccgaatctaaatatcgttagtagataaagacttgtcagattatatatgaacactttcttttggaaatatttggtttatagacccgtaacaagttcagacagggatcaagaacatttcgaaagagacaaagatgatgcatacatcgatatggacctgtttatttattagaacatgaaaatatatagtttttatttttttgtaaccaaaaagttttggaccataggtccgaaattcaaaacagagcaaagtcccctgaacacccccaatgacaaaattcgaacctgagatctaaagaacactctctttaggttatatttttggtaaaatatatttgattatattgttatagattcatttgagatgtttgtataccttggtcctcttctttaaataaacaacaaaaaaccaacaagcttacgagacgattagaaggtccagatctgatcggcctctacgctaagaaacctattaagcccgatctcaccaatcatcttcctcgacttggagttttcctctcgaagtttcatgttctcttctataaccttctcgtaacattccctggcttggcttagctcatcgactagagatttgttcttattgatgagttgaacaagcatggaccacagttcttccatgtgacgctgtttccgcatacgcgatctccgagctgactcgcggttcgataccttccttctccgcttcctctcattatcttctgcagtccggctagagtcgtctgacgtggcaggcaagtttgaaagtggtactcgatcaacaaagatttggaataaagactgtggattagggttttgacttggaaggttatagacagaaccagccatgaaaaaaacagttatgcgttctttaagaaaatttttgttgacaagtatgatggtatagatcaatgaaatgcactctaattttggtttttatagatgaataaatcgaaagtagtgttaccttacactaataactaatccaagtggctgaagcatacgtaaattttaataaaatagaaggagaagaaaaagagaagttctaatcgtgagattgatgagtcatgaagcacttgaaaggtgaaagtaagtagatggcatgaaggggaccattgcggagaaaatcaaagactatattataaattattcaaagaaagcgtgagaggtagcgactcgtcgacgcaccatgtttcttttcgagcaaccatatctaatttttttaagagcgtactttattttttttatatacgtaattattcgataatccaatggtttatgaaatttgtgggtaatgatgtagcataaagtgactttagtccttgtacataatttatagtgttaaagagttgacaatgaagaaattttaccaaaaactactatagttcctgaagcctaattgcgagagttgtggtcggatagctaaaatgtgcttttagaaattttgcattaggtaacatgtttttaccaagtcaaataaagtctagtgaatgaaaataatatcttatagctgggatgaaatatattggcaattttttttttggataaatactctaaatatattggtatttaccttcaccatttagagtgaatgtcacttggggttggggtatcagattggttaaatttgctttattaggcggtaatttttagtagcagttataaataatattttatctaaagtaaggattagaatattgatgttttctgctagtaaagaagtttcctagatccacttaaagccaatcatcttagtggcgtgatggtatcaaacatatatagatgaatgtttgaaaaactcgagagtgcgagacgcatcaaattgcaaacgagtctgttcatattataatgacatgttgaattatcttaataagacaattttagccatctagatgttaatcggctaactattttgctatagaataaggattcatccaataacatcaaaatatagccctgttattcataatttatgtaagaagagaaaatacttttctatgacaattaagcgaattaatccattagctgctccaaggggtaactaatgaaagtcaattaaagcttcaagtgacgtatcacatactcacaatgaaacacttattttgctgatgttatggaccattatggttttattgattagaaagcaaatattataatgtgaaactctagtggtagagatttcttgcttgtcttttactagtttccagctactcttgttttgtccgttttggctattccacgatctacaactttcgggttcatatcaatgtccaagaggatattactagcaattcctcctatgatgtgaaatcgtctagtgccaaaaatatatcagttttaaaagcattggtttaacttaccaagcataaagtaatgaagacattacttttttttggcacaaactcatagaaaagtattatctatgattcttcaaaataaaacccaagtagttttatgagaatttatattttgaagctttgtcatacaacaacttgttgtgataaacaaccaactagattttaatccgcggtacaccgcatgacaatttattttaaaaattagtttatataaaaatttgtaaattatatttatttataaaatttatattttatagtttatatttattattaagtgaaaatataccataaatttatgagataaatattaataaattaaagatttaacccatatgttaatatttattttgaaattatataaatacaaaaataaccgaacggttattgctttagaccgatttcgtaaacaattccacaaacgaaaaacaaattcgtaataaaggcgttgtgggttttggttaacacccggtttgtaacggtctttgcgccttatccaaaaaaacctcctaaaaccttctcaccagccattgattcacaatctcaaaattcatcacagcgaagaagatg

SEQ ID NO: 31440 - DNA, 3000 bp, Unknown
  misc_feature (1)..( 3000): 2750-1469P.txt file - cDNA_ID_3042163; gDNA_ID_1972137; Annot_ID_179141
actataatgttcatatcgtccgattgtttcttgaatgaacaattattttgtattgatttttttatataatcgtagacacgtataatactatctttgaggtatgaaccgataaatttgttgctaccaataaaaactgaaaacacactgtatttcataaatttaagataccatccgaatatgttctcttactacttactagactactagtccaactcaaattaatttgattaagaagaattaattatatacttgaatccatatctatttaaacactacaatatgtatttctatatcacctctcatcatcccaacacatttaatttatcaattaatatgaaacttcaataaccatccaaatcacatgataagtttgaatgctgaatcagtaataataaataaaaataaaaacatcagcgaacaagaaaattaagcatattttgctaaaccctctcatgttaactatgggaattaatttctttaacaaaaaaagaaagaaaattaagcatattgatagaaaatatcctgagaaaatcgttaaaatgtggatataaatgttgagaaaaaaagacaaataattatttgaaagtataagaaaaggtccatgcaacgtaggaaaaaacatcggggtaaggtgtcgcaacagacgatgtcgtttggtcaacaatttggagatgaaatttaaagtaggagaaaacttgtgatacgttttaagaacgaaaaagtcagctccatcattgtcatttgtcactgttaagtatggacccaaacctcatctcatcctaattttagtaatattccgattccatctcactcgttggttttagattcttatcttccatcgttgagatcgtacagttttggtaagaagacaaagacttcatgtattattgacattttttcgtatttccatcttcggctaatcagacttgactaactaaattatataattctggtggaataatgaaactcgtggcctagttttggaccaccagaactaacttaattaaatgattataccaccagaaccaacttaatttaactaatagattcaattttgtggctcctacatactatataattggatacaaaagtgaaaagaagaaaacttaaatattaactagcgtgcgactaattaaatattatacacatcaaacttttgtaaattgcagcagccactcgttagcgagtttccatgacctcactaagtaatgtttacacataagtatattattgtttccgtttacaatatatataaatgatctcacttataatattgtcaacaatgaatttatgtaaaaatattagacgataagctaattttttttttcatgttgctgaatcaaataatctaatttgcatttgttagatttactcaaaactaaataaacttgaaagtttatcaaatcaatactttatgtaaaagtgactatctgaaaaaaaaaaaaaaaaaaaaaaaagtgactatctggaaatgaagcgactttgtccaacttgatgttctgttcataaagccgagcaaaacaacaaataaataaaactaactgaaaataaaattatcattgattagtttagctaattcgtgacttaatgtagtgattagtactatgataatatcatgtgaggcaaatgagaatatatttgactgtatcttttgatcacgtatccacgtcgatacagacaagctgtatatgttgcgcgtacattatggtcaatgttcttacgattcttttcacatttcttttccagtgctaatacaaatatttttatcagtatacacgttatggattcattgtataacttgtcatcggtgggaataatatttctcatctgttatttatccgttatgtcattcgtcgatgtacgacccgcttcaaaataaaagaatttcgtaattagtaaagcaaatacaaattgtcaattcaccaaatagtgatcaaatatatgtttgtcaaaaaaaattcttatatcttaagaagatcagatagctgcattaaatctttgaatatccgcttgattattcgaaacgagtatcataacatcaacaaaactagtagaaagtatacaagtaatgaaagtaattatatatatggactatatataacatttgtctaacatttgatagtatttgttttttctatgtcaaacagtgatttgttatatcgattcataacgaaccatcaagttttggccttaaatgttggcaagaaatatttataaatgcgtcggtcaattgcgtgacaaactttactacagtcattattgtagaatgatagtatatagtattactttgatagggagtagcatgttagttaagagtttaaaagcaccaatttcatataatatacaattatgaaagggaaaatataattaactatctcgcaaacaggattatgaagtcaattagcttacgtacatcgaggtcaacgaagtaaacaaatttgccaaatcgttgtcatataatagttgtacggaaatggtcaaaacacttcatcaagaaagttgatttctattatttcaatggcttaatggtataccatataatatcatatatttaaaaatgtgagattttgtgatacacatcaattgacgtaaatacattttaggaagactgaaagaaaaacaaatttaaatttaaacttaagattagccgagtcttacttagcttcaaatcgataattgatggggacttttctaaaccagagtttatgatcgggtggcgaagaattagatttatggatcttatcactaaaacaacatgagaagcccatttaataagcacttcatcattaatgggcctaaaaataagcccgtttattaaaccttacatatccgaatctgattttaatcgacgtgtcctttgtggtgtaaatctactaattaatttgaatgaacagaaaaaaaaaaaaaaaaaaactagtggtgcgaaatcaacgactgtttaaggaattttgattttttgtcttccaacaaaattcttccggtgaaaaaaattccgccatg

SEQ ID NO: 31441 - DNA, 3003 bp, Unknown
  misc_feature (1)..( 3003): 2750-1469P.txt file - cDNA_ID_3042178; gDNA_ID_1972138; Annot_ID_179198
cttgcgaaaaaatcgattcgcgaagactgcaaaaacttataccatcctgcattccagcaatggaagtcatgattcaggtgtaatcattacaccagatggttactggcatagttactttgtcttaattagtcatcttaacactcctgtcattattcttcttttgctatctcagctagaaggttctggtaactggcccatggatgatttagcagttgagaaaacaaaatctgccttcctcctgaaaattgcagagaggtgggtgaagctattgtttgtaacacttcaaactattaagtcacagtgtttttatctgagtactgacaaatgaaaatactgacagccttcagaacgtcaagggaataccatgcacagctactgaggataatgtcgatgttttcattggtggttacgcatttcgcttgagaatattgcatgaaagaggcctgagtttggtgaagagagaaagtgagttttcttcttgtacacactatcctctatttcttaataaaaagcttatgtgatgctgacttcctcgatttctactgagttgcagttggagtggacccggtgaagcatgtttcctctaccgataaaatgctttttattcgtagtcaacatgcaagtatgattaatggtttgcaaggtcgatttcctgtatacgcaccagttgccaggtaaaagtcaataaaatttatgtgttttacttttgtttgctttgaagtttcataacccagaccttgtctgctacttgaaggcttgcaaaaagatgggtttctgcgcatctcttttctggttgcctggcagaagaggccattgaacttttggttgcttatctcttcctcacacctctcccactcggtgttccttcctcccggattaatggattcttaaggtacatttccgcgcttccatacttatgaattttatggaaaacaaccaggcaatgctgttggcaacaatcaaaacatcacatctttccgctggaccgtgtaacaggttcttgcgattactagcagactatgaatggatgttctacccgttgattgttgacataaacaatgactttggtagaaatgacgagaaagagatcaatgtgagtcccaactttaataatgggtctagtgttgggttagatttgttagaacggccgtatgtcattgtaaaacatttctggtatttttaggataacttcatgtcaagtagaaaaggctacgaagaggacaaacaaaacataagttcagctatgttcttggctgctccttacgacaaggcatcagaggcatggacatcaacttcaccaaatttattggttagtaattagaatacgcttttgaaaagcatatcttccgctactctgttctttttcttcttaactctctttatttcctttgttaaaggaacaaaaaaggttggtggcttatgctcgaagcagtgcaaacgtgttgagcaagatggtattgcaagaacataatgattctgttcaatgggaggtgagtgtgatgtattgaaaacaaaatgtattgaaccggtattatgagaacattacatcgactaattttatgagtatatatgttgcagtgccttttcaggacacccttgaacaactatgacgcagttattcttctccatagagacaaattaccttatccacgtcgtcttctgtttccatctgaacttaaccaaggttccaaacatagctctctctgtctctatttattatgtctatatcgttagttccaccatttaacttctttcccatttattgaacagggaagcatgtagcacggggaaaagcgagtagattgttcaacccatttatgtcgcctggagatttgaagagaagccatgaagagcttaagaataagctaatggtggacttcgagccgaccaagtgcttgttgagtgggttgcaggcaagtgttgtctcaaaaacataaacaatcatatttattcaatttcttattaaaagaaaggaacctatcacgcgattcttatctttatgcggttgtttgcaggaagagtttgggacgttgaagccatggtatgatcatataggaggcgacgcaattggtttaacatggaacaaacacaattcaaaggtaaacaaaaatcttcttagtgtcttacttaaaagaaacactaaaggaaaaatcgtaataacaaatgtaatgtttgattgcagaaacgagaacgagatgaagaagaagaagaagaagaagaaagtaatccaatggagatgttaaaggcggtaggcgaaatgggtaaagggttagtgagggatatctatttgctcaagcctccacgctttgtctaaatatcaacttgtcttagtttctttaaaatgtgtttgtcaattttgtttactcatcatcatactcaaactgtctaaagcgactaaacacattaccagttttgcttcattcattgagtttaatgtgtaccaaagcttaatgactattcgttgtcctactattttgttttttaaaacaaacaaagctcaagacctttcggggaaggttatgtgacaagcaaagacatatatacaaaacggagtagtatttgtggagattggagaagaacaatgaaaatgaatttacttgtgctttgtaaccgttgtgtaataacggctattacaagaaaagtttatagataagataagttacatgatctcaaatgtttcgatgggttttgtttgatttgcaaatagcttcctgagcatatcacgacagtattcatgtctacattttctttgtggcctaattattaaatttaagttaccgtcgaaacttgaacttgaaactttatttttgccaacacggcaatgagttctcttggaacatctcacatcatcatcatcatcatcatcatcatcatcatcgatatctgtaataaaataaaacaaaataatgaaaaagattctctcacattatcttatttctccacttgattcccagaagacaaaaaaaaaaaaaatcagaaaaaaagaagaagagagaaaccatg

SEQ ID NO: 31442 - DNA, 3003 bp, Unknown
  misc_feature (1)..( 3003): 2750-1469P.txt file - cDNA_ID_3042186; gDNA_ID_1972138; Annot_ID_179188
tatatctggtatcgatgaagtctatatcagagagggagcttttagaagaatgtctaatcttcggttcctcacagtatacaaaagtaaagatgatgggaatgatataatggatataccaaagaggatggagtttccacgtcgacttaggatactaaaatgggaagcatacccaaacaagtgttttcctcccaaattccatccggaatatcttgtggaacttgttatgaagaatagcaagctcgagtacctctggcaaggaacccaggttggtgttgtactttttaatatatgaattttgtatcctactttctcatcaagttatatgatgccctttctctctgttaatctgtgtctttcttgcatattcagccgctaaagaatctcaaggagatgaatttaaaagggtcctccaatttgaaggcactcccaaatctttcaaatgctacaaagatggagatattgaaactgagtgattgcaagagtttggtggagattccatcctctttttcgcatcttcaaagattagagaagttgcggctgagggggtgcataagtctggaagtcattccagctgacatgaacttggaatttctttacgacttagatatgagaggatgctcaagattgagaaatattccagttatgtcaacgagactctactttctaaatatatcggaaacagctgttgaagatgtgtctgcatcaattacgtcttggcatcatgttacgcatctctcgataaacagcagcgcaaagttaaggggtttaacacatctcccaaggcctgtcgaatttctagacctaagctactctggtatcgaaaggattccaaattgcatcaaagatcgttatttgcttaaaagcctaactatatctggatgcagaagactcacatcattgccagagctccctgcttcgctcaagttcctagtcgcagacgattgtgaatcactggagaccgtattttgccctttcaagacatcaaaatgttggcccttcaacattttcgaattcaccaactgtttcaaattggaccaagaagcaagaagagcaattatccaacggccattttttcacgggacaacgctcttacctggaagagaagtgccagcagagttcgatcaccgaggaagaggaaataccttgaccattcctctcgaaaggaaaaggtcttaccgtggcgttgggttttgcgtcgtgatttcccctaaccaccaaatcacagaaaaatttcattccggactacttatcaaatctcgaacaaaacatttactgataattcactatcactttgaaagattagaccaccaatctccagcgttgagcagagagttgtttttcgaattacgcagcgtaaacgataacttcagattattgaatgtggtgccagattgattgaagaagagagcattgaagataactatgagtctggatcagaccaagcctccgaagaagatagcatcgaagagaactatggatctggatcagaccaccaagcttccgaagaagatagcatcgaagggagctatgaatctggatcagaacaagcgtccgaagaagacagcatccaagaagagaactatgaagagagcatccaagaaagctatgaagctggatcagaccaagtgtctgaagaagagagctatgaatctggatcagaacaagcctctgaagacgaaaatgagtttgaacacagcgaagaagcctctgaagactacaaatggagtaatactaatctgtgactcccaaagtcgaaggagagagcaagtgccatacccagacaaacgcacgagcaatctccttcgcaatcatggtgaattcttcctctgaaacattgaattattttcttgctattaactcgaacagaaatgaataatgatatgatgattttctcgtgcttgcagattatctcagagaagaatcgccgcgagatctccaaataccacctcttcaaaggtacaactctttttattttgtttgcgaatcgtcttaactttgatctgtatacgtgtaatcagatacagtacgtagatattctgaatctcttgtacttagcccatcgttttaactttagctgtttctgaattcgatgccttacttactttgaacatagttagcaagaacaatgtgattcactaggattacttagaaatgttacttttatttcgagaaagttttgtatgctaaaagaggacttgaatttgccacaacatcccttgatcgagtgttccgaatcctgcaggtgattaagcttatgtagagctttttgtcaaaggagtatgtcaaagagacttttacttgggtacattactactggttccttaacaatgaaggcattaacttcctcaagactcacctcaatctcccacctgagattgttcctgcggtcctgccaccttaaaaagcagccttctttttttttccacgactgagaccttaattaaaagcagccgaataagcgaccaattttctgtaaaaagcacttactagattttactttgttaggctttcccttttgtgtatttttgtatgtctctttaaaaagataaggcattcacggtaaaacaaaacaaaaaaatcaacgaaaaataattacggaaacacaaatatttaatgaaaataaaaaaccagtttaaacacttttatgggtcgatttttatttttaaaaataaaatcctttaaaaaaaaaactaaaaaaggagaaaaaaatcgctttgattttaaaaacaagtgatcgaattcaggagagggatcagatgataaaagaaggagagtgctcaatagtcgtaacaggctgagcgaaacactcttctcgcattaagcgagtttaataaccactcctcatttcccctttaacttgcctgaaggatcatatttattcattgccccacctttaatcttttttatagccaactaatcatatccctcccgtctcttctaaccgatgtgggacaaatatctcttcttcagtttttcaaaaccctaattagcctaccgaaaatg

SEQ ID NO: 31443 - DNA, 3003 bp, Unknown
  misc_feature (1)..( 3003): 2750-1469P.txt file - cDNA_ID_3042212; gDNA_ID_1972139; Annot_ID_179226
aaaggatgggaatggggattcggtgtttctaccattgctatcttcgtctctattctcatctttctctctggatcaagattttataggaacaagattccatgtggaagtcctctcaccacaatcttgaaggtttgttttgacctctttagctcttattggagattgacgtgtgccctaagttatgtatatgatttctttattcaggttcttcttgcggcttcggttaagtgctgctcgagtggaagttcaagcaatgcggttgcgagtatgtccgtgagtccctcaaatcattgcgtatcaaaggggaaaaaagaagttgaatcacaaggagaattggaaaagccacgtcaagaagaagctttgcctcctcgggcacaactaactaacagtttgaaagtattaaatggagctgcggatgaaaaacctgtccatagattgttagaatgcacagtccaacaagtggaagatgtgaagattgtcttgaaaatgcttccgatatttgcttgcactatcatgcttaactgttgcttagctcagctctctacattctccgtccaacaagctgcttccatgaacacaaagataggaagcctaaagatacctccagcttccttaccgatcttccccgtcgttttcataatgatcctcgcacctatctacgaccatctcattatcccattcgctagaaaagctaccaagaccgaaacaggagtcactcatctacaaagaatcggagtaggtttagttctttcgatattagcaatggcggttgcagctctagttgagattaaacgaaagggagtggctaaagactccggcttgcttgactcgaaagaaaccttacccgtgactttcctatggatcgcacttcagtatcttttcctagggtcagccgatctattcacactagctggactactagagtatttcttcacggaagcaccttcctcaatgagatctctcgcaacatcgctctcgtgggcttctttggctatggggtattacctaagctcagtgatcgtgtccatagtaaacagcatcacaggaagctcagggaacacaccttggctcagaggaaaaagcataaaccgttacaaactagactacttctattggctaatgtgtgttcttagtgcagctaacttcttgcactacctcttttgggcaatgcgttacaagtatagatcaactggttcaagaagctaaaattggatgggcaacttttgagttttttttttgtttttaattagagcagaaaatgtttttacttgagcggctgttatataagagatgataaatgggggtaagtagtaatgttgtgatcaggtatatattggggtttgaagtttttatcgttggacaagtaatgtacagcgaatgatattaacttgctttaagtctttcttttgttcttgtggtgtacgaaattgagtcaaggttttgatctttgatatattcacaaaagttgatactggaaattctgtgaatacttatttgaattctcagcaagatactaaagaactggaatttgagagaaatgatggataaggaggcccaaggattttttgtcatttgtgtgagaaaacgatggtcacgaggcccaaatatttttgacatggcttggaagataataaggaaacaaagcccatttattgaggttttggtcagtcatgtagtgtggtaagtaaagttataatcaaaacatttcttttgtttttttctttgaagacaaattgattccttacgtctaaacatactacaattgattaatttggattccttaaatctctctagacaaacatcagatatcatgatagtagaggttaagatacttaaaatactatatatttacaaaaaacacttaaaatactatatagaaacgataataaaaaaaaaactctttttttttctgaaacaaaattttctttactaagaaaattttgtttcagaaaaagagtaattatttttttttaaaatcttttttttgttttgttttttgtcgacaaaaaacgatgaaaaagtaatcactcagtttttttttctgaaacaatttttcaaagctagaataaatttctcacaagggatttaaggtgattgtttttgaaaaaaaaatccaaaattatgataaaatattaatgctgaaataaatataaactagaattatttttgtccaaatttttcgtaaataaattttgtaaacagcgattatgactctggcaatttcttaaaaaagaattggataagtactgataaatttgtattctctcaactaaaatctctttttaatagaaataaaagctaaatcccaggaatcccattttagtaccagtcgtggtataaatattaacacttactgattgccgagagacgaaagaggaaaatcccaacaataaagagcaaacgatcttacagctcataatatttcgttaattatcaaattgctaataggtaatttcgcggaatcttcctttgtaatttcctccaactttctctgctttgcttataattgcgtctttgcttcctcctttacctttacgcggcacatagattattctctccaagtgtgttaatttctcttcttcgtaatctaattttgttttgttactgttgatttgtgtctttctgtttcgtggactctttttgactcccatcaattttaggattcttcttcgtgtgtggattttgatttcttcttcttctctggtgggttttggaactgttaggcttttgggtattttgttgaattccttagggttttgtagtaagattttgataattattgaatcgtttagaacaagagtcaactttttaaagtcattttatagaatctgagtctactagtcgttgaataaatattcttaaagaaatgatttttataatcttcttctcgtcgactttatttattatttagaatcttgtatttgtttttataacccataatctagaatttgatgatttttcaggtataaagttttgtaatttacttttcaggagaaaaaaatg

SEQ ID NO: 31444 - DNA, 3000 bp, Unknown
  misc_feature (1)..( 3000): 2750-1469P.txt file - cDNA_ID_3042219; gDNA_ID_1972139; Annot_ID_179221
ctcaaaagtcttctacaaaaacctttgcagtcacatgtttcttgccagctcttttgataaatatcagcatgaaaagaccaacgaaaaaaaagtaataataattcgaagcaaaatgtcatactgatattaatatgatgtgatcagtgtatttaatgtaatttgaaattaatcataagagtacaaagtgggaatgcaaatacgatggtccaccgatccttgtcatggtcttgtacacacttgaaacagaatacaagtcaacgaaggtgtctcttattgatttctcttacttcttaggcttatagctcttgccttctgaaagttacagaatattccctttcatagaatcttcaactttctattttcatgttattggtttaaaggtctaatagaatctttaatgttgtaatgtgtcttagacttaaatgaattcattacttgaagacatgtattccacgctgaaaacacaattcttttgaatatagttttatgatataatcatgaaaacctatatttagatttgcttaggactctaaatatatcacaatggatacgatcttgaaatcccacttatttcatctaactccccaaaaaaagaaaaaaaagatgaatttgttatgcacaactggattataaaaaatcgacttttatatcaaaaacctgaattcaatctaacagtatatactacaaaaaaatgatcaaatgtttatatatgtaggtgcaaatattttcctataacatacttgagatagtaacttaagaaatgattaataattatgtttctttcagcagggtcaaaaatgtattcccacatttaacatgctttagtaagtaattatggtatactttataagaggatattatataaatatctcttagtataaccatatgaagtcggtagatatgatcctctcaaatacaaaatagaaaaagtgagctttctaagagttggagttatctatcaaactccatatacatttttcgttattcgatcatgaccattaaaatgcatatgtttgatagtgacccgcaccacacagctcagcatattgagacagattagtaaaagcagtccaaaccttaggcacccagtccacggttcatatcatctgaccattgagaatggtgaagagagataagatgatcgaacggtgtacaataatatgaccataaaatcgaacggtgatacggtataggatcccacgtaaaggtccaaacaaaaaaaaattaataaagaagaaaagacaaagagggtttgcgtagaaatttgatggctcgcgcatgcgacagtgttaggcacttgcatttgcctaaaaggcgataaaagcctacctcatcttatcgtatttctctttctgtttctgtcttcactcaccgatttttatgtttgtgttcaatttgaattttacaagtttggttggacttaatctttcctttaacataaacattcaatgataattttattattaatgttcatttcttgtgaagattttcattgtttctatatataatatatattttacattgagaaaaaaaaatgatgcgaattgttttgaagttgaagtggttgattaatatttttttctacaataaatcaatgaaaatttagaattgaaaaatatctagacatggaatttctcaactcaacatctagataaacatatgtaccacacattcgagcaatcgtataaaattatatacgaataaatagaattagtttctttctcggaaattctgttaatatttttaggaggattaagtgggttcgaaatttaatcacttcctgcacaaattcatctcaatgtattaattggtgatatgtcatttttttattttattttttggtatgagcttccaaagttttaaggccagctctatatgtgtactattgtttctaactttattatattaaattttggtgatatgtgtttctttgtttgattgcaacccaaaatagtttaaggttcatcttagagtgcgatgactttttgtgcaaaaatattagatcatgttggtatgtacgttttgagttttatttatttgtttaccaattgaacgactctcaacaagcaattgtatgccaagatgacatattggacgtttcaagtgtgtgaattgtataaagcagtaaataaaatctactcttattaactagtttgaaagagagttttaacttcgaagaatctatcgccatgagtcaaaatcgtataaatgtgacaaatgtttatctctatcaataatagtaaaaattttaaaaggttctatataaattttaagattttgtcaggatcattaaagtgtagaactaagtcaactgattgattaatagaaaaaatcgatacaatctcacttcctttaagaaaataaaaataaaatatgctttagagaaaataaaatctcgcttatttatgagatatcatatcatttttaggtaaaaaagattagatgtccttttgagacacatcataccatatatatgaccgacaacacacataaaaccgcgtgaacaaaaaatatcatccatcaaccccttacgatgcaaatgtactgtaaaagatggttcattaatttaacatcgtattttaacgttacaattgtatggaacatggaaggttcacaatacgtggaacaaaacaataatgttacgtacggtgtaagaaaaacaaaaaaaacatagcactaaaatagttttcttttaattttcctcttcaaacttctcacgtggaggctactagtggcgaacgtcattcaaatttacccacacccaccatatattatctactcactcccttatatatacacacttccacaaataattcactacacccaaaaaagcttctaacaaagagaaagtgtctgtatgttgtgcccactctctacatttatcaatcacttcatgtgtgttaccttgattgcaaaaaagtgagaatatattctcacaacattaaatccaccccgaaatcgaagtgagtatatcacgagtgtagtaatatcttagagatg

SEQ ID NO: 31445 - DNA, 3000 bp, Unknown; identical to SEQ ID NO: 9512
  misc_feature (1)..( 3000): 2750-1469P.txt file - cDNA_ID_3042222; gDNA_ID_1972139; Annot_ID_179220

SEQ ID NO: 31446 - DNA, 3003 bp, Unknown
  misc_feature (1)..( 3003): 2750-1469P.txt file - cDNA_ID_3042228; gDNA_ID_1972139; Annot_ID_179209
ttttttttaaatctaatattaaattatattcaaagaaaaataaacttttatacatgtaaatgcaaaagacttttcttaaaaattaaaagagatattatcgatggtgttatcttgtcaaagcaaaccacgtttggatcccgcctttgtatttctcacaactccctctccttgttgtccttaactggtttctaatgtttttgtctatcaaattgtactttttcgattgcttatgttcatataaacacacttctctccacgtcgcaaggtttgagcctgaacgtctgcgatatgttgttcatcttgtcgaacatagagccgctttggaagctcgcagtcactgctttgaaacccctctccgcgttgtttaagtaactagagttgtatgactcagctgcttttgaattgtggagccgatattgaggctcagaatgaagttggacatacttctctaagaattgctcttcaaaaatgaaaatctcgatctttcaagtaaatttgtttatcttttaaactttgttgtgagtctttgtaaatgaaaaataacatgtttatgtcctcttgattgcagcttcttcttgaaagaggtgtcaatctgaatgcttttaatttttatttgcataaagcttttaagaaaccatctttataaatatagcccaaaggtatgttattatcaaaatggtgttggtgaacatgttgatgttgttacctcctcggatgtgtctctcgacatggatttaatcaaattttttttttaaattgtttttttaataaacttatggtacataaattaacagttgtatagtcttatcaaaatcacaaaaaaaaaaacgatgtagtaaaaatattaatagtaaaatctatcaagaattaataaaatattttgaaaacatacaaaattccaagagaaattatagcgggttgcaaaaatggatcaccacaaacaataatagcaaacgagaacaaaactcaaaacaatttaggtctctgaaacagtatatatactcatggccatctttccatcaaatcatccagaaaaaaaaaacgaaaaaaaacaaaaaaaaataataaaacaaaaaaaactttttatttttaaataaaaataaaataaaaaatgggatacacaaatgtgtccattttattaggcctgttgatggtctttgttacaccgatggtgttcgcagatgatgtgacaccaatcccagagggcaaaccccaagtggcgcagtggttcaatgccaacgttggtccattggctcaacgtaaaggcttagatcctgctcttgtagctgctgaggctgctccacgtatcatcaacgtactattcacacttattgtcttaaactcatcctttgtaccaatagattttgatacaatttttttgaaaaacatgtaaaaattattgcaggtgaatccaaagggtggtgaattcaaaacactaacggacgcaataaagagcgttcctgcagggaacacaaagcgggtgatcataaagatggctcctggtgaatacaaagagaaggtcactatcgacaggaacaaacccttcattacattgatgggacaacccaatgccatgcctgttatcacctatgacggtaccgccgccaagtatggaaccgttgatagcgcctctctcattatcttatccgactatttcatggccgttaacatcgtcgttaaggtaagtgatcctactatatatcatacatctatgtgactagtcgactatttcatggccgagtgatttatttttttgcatatgtagaacactgcgccggcaccagatggtaaaactaagggagcacaagctttatccatgagaatctccggaaattttgctgctttctacaactgcaaattctacggtttccaagacacaatctgtgacgatacaggaaaccatttcttcaaggattgttacgttgaaggaacattcgatttcatcttcggaagtggaacctctatgtacttggtacgtaacatctcatacttatttcttaatacataaagtgcgagatctctaatgcatgtttgagttcaaaagggaacacaattgcacgtggttggagacggtattagagtgatagcagcgcatgcaggaaagagcgcagaagagaagagtggatactctttcgtgcactgcaaggtgactggaaccggtggaggaatttatttgggaagagcatggatgagccaccctaaggttgtttatgcctacaccgagatgaccagcgttgtcaaccccaccggatggcaagaaaacaagactcccgcacatgacaagtaagtcccacttttcacattacataaaaaatcgtatgaatatcacccaatcggtccatgtcctttatgctgattatatcaaaaatgacagaaccgtgttctacggagagtacaagtgttcaggaccaggatcacacaaagccaagagagtaccattcacacaagacattgacgacaaagaagctaaccgtttcctatccctcggctacatccaaggatccaagtggcttctcccaccacccgctttgtaaactcttcaatatcaagtctaaaatcatattttgcacatatatcacttttaacaaaaaaattatttttacatatatcacttttagcaaactttttctttacctagtcgtcactacttacgaccctatgtatgcttttatgcaaagaaccgagaggtcgataatctgagaaacatataagcaatcgagacttagccgaaataaattgattttctctctcaaataaaagtataaatggtaccctatatttatgtagcttttctaaaatagccgaggttttatttaattatcaaaaaagtcttttaagtctaaaagtaaaactcggtcacgaccaaagtaaaaactacgaaacagtaccttttgtttatgtatacttacaaaagtatcccaaatgtatttaattatcaaaaaggtccgttttaattacaatcactgaataatcatctggtgttactctctctgctcacaaatg

SEQ ID NO: 31447 - DNA, 3003 bp, Unknown
  misc_feature (1)..( 3003): 2750-1469P.txt file - cDNA_ID_3042231; gDNA_ID_1972139; Annot_ID_179208
ttgaaccgcgggtctaatatggtagcgatggctagaaccaggtagtttttatcccagaaatcgtcaaatttctttctcatgtttacaactagagagctaatgaaatcatccgggttcttgctccactcaattaaccggaggtgtatgtcgcatacctctgggaagtacatattggcgggtaaacaactgctctttgtgaatgcatttatcacttcaacaaagactttcaagaactcaacaattgttcctaatctctcccattccaaatcagatggacataacacggaatcaggatcatgttcattcatgagcgaaaacgcgctcttttgctctaaagcattctccagcatggtgcatgttgagtcccatctcattgggtcatcgatgcataggttcctttcacttacagctcccgtttcaactatccactggttgaatctatcttgaatagattctgagcttttaacatatctaatactctctcgaataatgtttattgtgtcacaacaagcttccagggaatcttgaaccatctcgttaatgacattaactccacagctcacatcaaacaattggccgtaacagtaaaggaacttattctgcgataaccggtctctgattttactagctacgttctcactaaacggaggagcatgactcgacgccatagaaaacaacttccggtcaatatcccactccatcaaacacgtcattataacttcagcaagcatctcaccactatgagatggatcaaccataaagaagttcaaaactctctttttcaattcccatccttcatcaatataatgcgctgccaaacacaagaattcatcagaatcacccgaaccactccacacatcaacactaatactaatcttcccaggtaacttatccaacgcttcgaaaatcttatgcttctctttcgcataaatctccatacaatcagattcaactctttcaaaagcaacaagctcaaacaaaggctgtaaatttccaataaacattctgaatccaacatcttcaaccatactcaacggataaccatgtaagataatcatcctggctaaatcgaatcgacaccgcctctgatccaaacccatactcacaacattaacatcttcatgttcttctttctcatgttcatatctaacattcactacactaagcacttcttcatcctttatccgctcattagctaactctttcttcttccccttaacgaaatactgagcaacaccgttgttgttaccattagttctcctcctacatctaatcaaatggttcctcaaatgcgaagtcccgctcgcgcttgagccgctaagtcgcttcttacaatgcctgcagattgcaatgtatgtctcaccttttctaactctatcgaaatcattccacactactgatttcaatctaccagattttacaatcactgcatctgacaaatccatctcattgtttatcatcagtttcttctgtctcctacacatgtaaacaaatagcagaattttcaccagataattcgaattcaaacaacgaaaccaagttacacaaaacctaaaatctcatagtttccatttgcataaagcttttaagaaaccatcgaattgtcaagaaaaaaggttagaatctgagctctaaagcacatgtacctcttcattcaagtcgcagcggtaagcttctcactggtggtttaacggcggcgaagtctctcagtgtcggtggtcgcggcggtagggttttaagaagaggaagaaaaaaaagctgaaagcttttctgttagcgagagatatttttttgaaacggcgaacaaaaagtaaatttacgaaatgagaccttggattcatgtaactttagaaatatagcccaaagttagtttatcatcaaaattgtccttttttttaaatctaatattaaattatattcaaagaaaaataaacttttatacatgtaaatgcaaaagacttttcttaaaaattaaaagagatattatcgatggtgttatcttgtcaaagcaaaccacgtttggatcccgcctttgtatttctcacaactccctctccttgttgtccttaactggtttctaatgtttttgtctatcaaattgtactttttcgattgcttatgttcatataaacacacttctctccacgtcgcaaggtttgagcctgaacgtctgcgatatgttgttcatcttgtcgaacatagagccgctttggaagctcgcagtcactgctttgaaacccctctccgcgttgtttaagtaactagagttgtatgactcagctgcttttgaattgtggagccgatattgaggctcagaatgaagttggacatacttctctaagaattgctcttcaaaaatgaaaatctcgatctttcaagtaaatttgtttatcttttaaactttgttgtgagtctttgtaaatgaaaaataacatgtttatgtcctcttgattgcagcttcttcttgaaagaggtgtcaatctgaatgcttttaatttttatttgcataaagcttttaagaaaccatctttataaatatagcccaaaggtatgttattatcaaaatggtgttggtgaacatgttgatgttgttacctcctcggatgtgtctctcgacatggatttaatcaaattttttttttaaattgtttttttaataaacttatggtacataaattaacagttgtatagtcttatcaaaatcacaaaaaaaaaaacgatgtagtaaaaatattaatagtaaaatctatcaagaattaataaaatattttgaaaacatacaaaattccaagagaaattatagcgggttgcaaaaatggatcaccacaaacaataatagcaaacgagaacaaaactcaaaacaatttaggtctctgaaacagtatatatactcatggccatctttccatcaaatcatccagaaaaaaaaaacgaaaaaaaacaaaaaaaaataataaaacaaaaaaaactttttatttttaaataaaaataaaataaaaaatg

SEQ ID NO: 31448 - DNA, 3003 bp, Unknown
  misc_feature (1)..( 3003): 2750-1469P.txt file - cDNA_ID_3042246; gDNA_ID_1972140; Annot_ID_179273
gattttgatgaatgacatagagaaacgtatagatgataaaccttttcatgaccgatgggttcatcttgaagactccatctcagacgctatggatgttgataaagccaagaaagtgaagttcgctactaggctccggtataaggcggttctcgatggaggctaccacgtttttgatgagtccatgtataacagcagtgatctcagaccttcgtcgagaaagctctggaaaccagcaattggtgtcttggagctcgggatacttaacgcaaatgtgttccattcgatgaaaactcgggaagggaaaggtacttcggacacgtacgttgttgccaaatacggtcacaaatgggttcggtcacgaactgtgatcaacagcatgaatccaaagtacaatgagcaatacacatgggaggtttttgatcctgcaacggttttaaccatctgcgtctttgacaacgctcatttcgcagcaggagatggcggaaacaagagagatcagccgattgggaaagtccgcattagactctcgactcttcagacgggccgtgtgtacacgcatgcttaccctttacttgttctacaacctactggtcttaagaaaagaggagagcttcacttagcggtgagattcacctgcacatcggtctccagtatgctgatgaaatacacaaaacctctcctgcctaaaatgcattacatactacccttatccacaaaccaacaggaagctcttaagatgcaggctatcaacataattattgttcgtttaggccggtccgagccaccgctgagacgggaagtggttgactatttgacagattggaaaagtcagctgttcagcatgaggagaagcaaagccaacttcaataggttcacgacagtgttctccggtgcgctgtctgtttggaaatggatggaacaagtgtgcacatggaagactcccgtgacgacggctctggtgcacgtgctctacactatgcttgtgacgttcccggagatgattttgccgactgtgtttctgtatatggctgtgattgggatgtggaattacaggtttaagcctagatttcctcctcatatggacgccaaactatcttatgcagacaatgtaaattctgatgagcttgacgaagagtttgataccttcccgaccgtaagggctccggacattgtgaaaatgaggtaacaaaaatcaagaatgatcaaagaaaatcgaaaacgaagaaagacttggtcattggttgatagttttcctccctcatatttttcaggtacgaccggctgagatctgtggccgggaaggtacagtcggtggctggagacatagccgcacaaggagagcgagtgcaagcgttgctgagctggcgtgatccacgcgccaccgcaatattcgtgacgttctgtttcattattgccatggctctctacattaccccttttaaacttgtcgctctgttatccggttactacttcatgcgacatccaaagctccgacaccgcattccctccgctcccgtcaactttttccggcgacttccagccatgaccgactctatgctgtgaatcttcttctggatagagtaatcaacaaacatgccatgtatataactctcttctttgaatctgtatctatctatcgatatgcatctatatgtgttgacaatcatgcgttcgtgaactcgttctccgaattaacaatggtgatcgcaaacaaactctgatgatcaaatcaaataaattgcttccacactcgcaatgttgaaacagagaatctaaaagctcaaaacagagtcggttagatcctaacaaactctttaaaccttctccaattcgcaaccaaagctaaaccatcgcttccacaaaactaattggtcgataaccagcctaaacccggtttgatttaagctgaaccagatccgtgtgatcaatatataaaaagcccatgggccttgaacaaaacaacgtcacatcggtgattaacactgtttttagtgcttaattagttccctccctgattacaaaagtccgttagtgattacggcatgaagagacaacgggaaagaggaagaagcatatctctctctctgtcttgttctatgaacgagaccacttgctttaacaggcggtgctaattattttccagaaaataaaaaaccccaaaaatctgtacgacaaacaatttattaatcaactctttttttttctttctataaggttaatggccagattctttcttctctcacacccattaaaatatttcatcaacttgtcggtaaaattaattcttggcttattctatctttctttctctgtcttcttctttcaatttttcaataacaataatacagatgtgtatacattagatacacgtatactagtactaaacttcactgtgtgatctgatctagagtttttatactatcagaataaataatagtcgacaatttgggatttgtttatggtttacttcacatgaatcacatacgttcatgtcgattcctttgagatactgtctcgatttcgtttttttctcttgtttaatttaaaattattgtaaagcacgtggatttgcttgtcttggttttgttttctccttcgacctctttgatgaaatcgaggaacctacaatttcttcgtcgatccaaatggtagcttagtggtggtgataataggtttctcctcttgattggctccagctttaggtttttttttttatctttgtttctgcttcgattcccaaaatttaccctttcgattttgagtctaactagtcgagttgactcagtagagtcgaaaggtacgaccttttttctctacttcactgattttgaaactattgaagatttgatttggtaagatcattcattggctgtataattttattgcagcttctgggtttacgaagagacatctcctaattgaaacaaaacctttcctttccattgggctgagaaaaaagcaagagtctttgaatattttttggagcgtggttttatttagatg

SEQ ID NO: 31449 - DNA, 3000 bp, Unknown; identical to SEQ ID NO: 9530
  misc_feature (1)..( 3000): 2750-1469P.txt file - cDNA_ID_3042254; gDNA_ID_1972140; Annot_ID_179255

SEQ ID NO: 31450 - DNA, 3000 bp, Unknown
  misc_feature (1)..( 3000): 2750-1469P.txt file - cDNA_ID_3042258; gDNA_ID_1972140; Annot_ID_179254
gggcttaggagaccttggagtacagggaattgggattcctattggaaagctcgacatgtatgtcgctgctgcaggaatcaatccacagagagtatgttgatctccacatgatcttgtgtgtgtttttttgtttgctgtacctaactaaggtttcacctccttattcaaaattatacgcttgttcctctgcaggttttgccaattatgttggatgtaggcacaaataatgaaaagctcctacagaatgatctctgtaagctgtgaacttaattggtccatgtggtgtacatgtgtttccctaatatctcattcgtctgtctttccctttgtacagatttaggagtcagacaacctaggttggaaggagaggagtaccttgagattattgatgaatttatggaagctgcatttacacgttggccaaaggccgtcgtacaggtatatatctcttactatcttctttagatttacctttcggttggaaggatgactaaatgattcattccatcattttagttcgaagatttccaagcgaaatgggctttcggaacattggaaagatatcggaagaaattttgcatgttcaatgatgatgtccaggtatgctcacaattttgcaatccagctgccttcctttttagctacttcttgtatgtatctttttcaaaaataataataataaggtttgtgtatgagttatcagggaactgctggtgttgcactggctggactattgggaactgtaagagctcaaggtcggccgatatccgactttgtgaaccaaaagattgttgtggtgggagctggaaggtacttggatattcacttgaaatccttttcttctgtatttatatatttacattaactttcttctcatcttctcattgtatatttcttttattactttcagtgctgggcttggtgtaactaagatggcagtacaggcagttgccagaatggcaggtatcagcgagagtgaagcaacaaaaaacttttacctgatagataaagatgtaagtttttgttttttcactacttgacttcagctgaatcggtttgtcttgcttgataataacaattaagcttgcgtagttccacggggcagttgactttgaaactgtcatattattgtaatgtttagtgcttgcttttggatgttggtttaatcaatccagtaagagcttacctagaaaaagtcagaaaacgtttttaaagttatccaaaagcctttctgttcttgcattggtcaacatattgttttctcatctgtttgcctcataagatcgtgctccttcgaatatttaatgaaaacgacttgatttgtacttcagggtcttgtcaccacggagaggacaaaacttgacccaggagctgtactttttgccaaaaatccagctgagatacgcgagggagcaagtatcgttgaagtggtaagcctaagccttattattgcgttcttacttgccttggccaatattaaactttgacttaatgtgctttctctactacatcctaaagcaacacaggataaccatatttttttactgtccccaaaagttagacataatcatatgataatatttctgtctaaatataatatgtcttcaggtgaagaaagtgaggccacatgttcttcttggtttatctggagttggtggtatctttaatgaagaagtatgtgactttcttagacaacaaatagtttcaagaagtatgaattttaactgttttacttatatcgttaactggtttcaatcatcaaaggttctcaaggcgatgcgagaatctgactcatgcaagcctgccatttttgccatgtcgaatcccactttgaatggtttgtgtgtttttagcttagcaaagtaatgttgttccatctttgaaaaatctgccctgaacatcttttcgtgtgacagccgagtgcactgctgctgatgctttcaaacacgccggaggaaacattgtctttgcaagtggaagtccatttgagaacgttgaacttggtatgttatggtgggattcattgatggtctttgtatctaatttgctataatctaagaataatcacattttcttgtcccactcgcagagaatggtaaagtaggacatgtgaatcaggctaacaacatgtatttattcccggggttcgttttctttcttgaaaactgttgaactgtattgcatttcaatccatagatatagttcactgtgttgcatttcaatccatagatatagttatcagaattaatttggtcattatcgtttccaggatcgggctagggactcttctctctggtgcacgtatcgtaactgatggaatgctacaagcagcttctgaatggtaataatgattgcgttttgttctcttcaaattttaaaaatgagcttatgacaatgctgacgattaacatattcaaacatacacagccttgcgtcctacatgaccgatgaagaagtccaaaaaggcatcctttacccttcaatcaacaagtaattcctctaaatccctctcattcttatccgttgattatattttagtatattaaaactgttatctgaagcaattggtttctgaaaaaattgcagcatccgacacataacagctgaagtcggggcagctgttctacgagctgcggtgactgatgacattgcagaaggacatggtgatgttggtcccaaagatctcagccacatgtctaaggtatgaatcaagtaactgagagatatatttgtatcagaacatgtataaggtaatttagaaaatggaatctaattgcttcatttaatgccaccaacaggaggatacagtgaattacattacacgcaacatgtggttccctgtttacagccctctcgttcacgagaaatagacaacaactctatataactcttctcaggtttcatagaaagccaaaagacaaaaaatcttcgcttcatcttttatttgtgatcaacattctttttttcttcaaaatgtgatatgttttaagaaaaacaatg

SEQ ID NO: 31451 - DNA, 3000 bp, Unknown; identical to SEQ ID NO: 9529
  misc_feature (1)..( 3000): 2750-1469P.txt file - cDNA_ID_3042262; gDNA_ID_1972140; Annot_ID_179253

SEQ ID NO: 31452 - DNA, 3003 bp, Unknown
  misc_feature (1)..( 3003): 2750-1469P.txt file - cDNA_ID_3042280; gDNA_ID_1972143; Annot_ID_179311
gacagcatgtggcacgcccgacaattctttttaagagtgcacccataacatatatgttcttatgctatcaaacaacccacaaggaacctgaagatgataactacttgatagagatgatatgacttcaatcaatctcgatcgggttcggttaagggcactaatagataacctgctatatgggagtgtgaagaccattaattggtttttcacatatatatgactgaagaaatcagccgtaaccaaatattagtgtttttgcatcagttggggccttgggggtcaattatggagtggaataatacatgaaaacttgaatggtcgcatgcagagcagaggtagcctttaaattaaagcacacatcaaaatgtagtgcaatgttgcgaacttttattcaactaaacaatttaacactcgatctttgtgcgccaatacctctgcacaacaaacaatttaatctcatcaatatgatccgattttgaagaaccaccttcttcttcagtgacttctctggctaccttccattaactgtcgctgtcataacgacgtggaagttaacttaattgacttttaaaagattaatgatgctgtatattggtcttaaaatggcacaaaaggttccgtctaggctttgtgtttcactttaagtctataacttaaaaaaaaaaaactactaatttagcaccaaataatatcataaccattttattataaatgactataattaacgtagaattggaattggtcagttggtctcgagataataatttagctccaacgaatcggacatatctatgcttttatgtttttttttgggtataagaatttgttattaattcttataccaaaattatagatatgatattgttttattttaaaacaaaataaataatatatatatgaatggtttgatctgatattggttacggttaggatacaaattttaatcctgataccatagaggttttattagttcaattttctttccgtttgtttatgctcaacttcagattcgttgtcttgcaatattaagatatggttcaattattgagatatcatttcagttacgttcgcatccgatttgtttaaggtaattgtaatgttttaatgatcacttttatttgaattctgaaaattgaagttttaaagatattttttaaataatcgatttcaacaaaatagaaagaattgtaatacatattttttttatcataatatgaattttatatttaatagaaagtttcgattatgcatttaatttcatacaattgacttttcgactgttcattttttttaattttattttacaacgacttttagacacttcttagcacgaaagaactaaacgcaacatgtgctttgtaattaaacgtcgaatgaatatgaattatatttgacctaggattacgaatgatgtcgatctggagtaataatttagaaccgaacgacgacttcgaaatattacaattgacttatagaatagatctcgacgtagattggtcttaaaataataattaagcaccaaagaactggagatggctttatgtgctctgtgttttaaagcggattaataaggacttttaattcgattggggaaaatagaagaaagcagaagtgataaatggaggaccctttgttgactcagagtgagcacatcgtcgatgacgttacaatccatggcgattcttcttcaaatgaagagcacatcgtcgacgttacaaccaatggcaatccttcatcagctgatgagaaaagaccgcatgagggtgtccaatggagtgatatatttacatttaccactgtttgtattttggtcgagtttgttgtggctttagtccagattgttgccgccattgttgttctgactctggcaaaagatgaacaacctccacaaaaaatgtttcctacactgatcctcagttataccggttgctgtattgccacactccctattctaggtttgcgtttctggcattcttaccgaagtgttagcacagagacaaggtataaactataatttgtatgttaattatttgttttaaaggcattagaaaccgaaaccgatatagtggttttattgatttgcagaatctacgaggtggtggacattttgaaaaagatgcttgaatatttcttcgtgggttgggttgtggtgcttttatggcatcttatcaacaactcatcatctatagataatactacgcaacagttctggtgcgcatcagaagaaaattataactatatattcgtgtcccgaaaacagactaaattaacgaagtctctctaataataccaccctgcattttccttttgcaggttatgtatgactttccttgctatcagctgcattctacatgttcttcgtaatctcccctgtgcgggagtttgttttctgtatcctatgatactatatctttcccaatcgatagacttcgttggtgacattactgatgagataaatttgactacgtctataatcctattatgctttggaatctttgcctgcattatctgtggttgttgttccagatgcttatgcagataaaaagaagaatgatcatgtcgctttcttctttcttttgtttaaaatgttgtaatactctatttatttatcaaataaagccaagtgtcacgattgaatcctatatatcttcctgaaattgttggtataaaagaacaatttagcgccagcgaattggaaaggtctatgttttgtgtttcaaattcaataaacaaaagcgactttatataattggttttggtgtagttggtcttaaaataataatttcaccaaataatttgaaacagtcaatgctttgtgtttcattgtagaatatactataatttagcaccaagtagttcaatagttatttcattgtaggaataccataattgacttaggaatggtcttggcgtctaatttgaaaggtctatatatgctttgtgttgcaacgcagattttgattgaatccaagagaagtagaagaaaatcataagtgattaatg

SEQ ID NO: 31453 - DNA, 3000 bp, Unknown; identical to SEQ ID NO: 9547
  misc_feature (1)..( 3000): 2750-1469P.txt file - cDNA_ID_3042299; gDNA_ID_1972144; Annot_ID_179347

SEQ ID NO: 31454 - DNA, 108 bp, Unknown; identical to SEQ ID NO: 351
  misc_feature (1)..( 108): 2750-1469P.txt file - cDNA_ID_3042299; gDNA_ID_1564216; Annot_ID_149056

SEQ ID NO: 31455 - DNA, 3000 bp, Unknown; identical to SEQ ID NO: 9545
  misc_feature (1)..( 3000): 2750-1469P.txt file - cDNA_ID_3042311; gDNA_ID_1972144; Annot_ID_179334

SEQ ID NO: 31456 - DNA, 3003 bp, Unknown
  misc_feature (1)..( 3003): 2750-1469P.txt file - cDNA_ID_3042319; gDNA_ID_1972144; Annot_ID_179324
ttttttttgccgttagtgtacgctaaatcatagacctcttcgtggttataaagaaagaaacttaatttgtctcgaatttgagtttggatgcgacgttttacgtactagttttataaaagtaaatgttatagaccttgaatttcaaagtggaatgtattttacacacacaattgatacaccaacaattgtggaagcaaggatatagagtatcgatctttaatggagaagaatatatccttaaagtaatcattactttttaattacggcggaaagagaatagttaaatttacggcgaaaagaatgttcattaatcaattgatgacgttcgtttataatttcaaataagatcgaaaataacaggtgaacaaagaaaaaatagacattaaaaatagtaagatcgaaaatacaacccttaaaaatctcacgaaatcaatgagagaaacaattttgagatacggtcaacgtttggtctcctttaggaaagtacacgcataagatcgaacgtgtcgattcttattgctcgttcccaaaatcgacatgctctcggaccgctacattccaaatagtctgacgtaagcaatgacaaaactcacctacattacagtctgccacgtgtccctctccatctacttcaaatgaatcctccactatacagatttaaccatttttctatttttgtttgagattcctttccaccaacacaaagcccctgtctatccgccatgtgtccacgacctttcttatatatatagtcatctttcttctttgctcgagagaagtttcaactttcaaacatatctttacagttctttcttgctaaacaacaataaaggggaaaataggttaattatgatgaaatctggggctgatttgcaatttccaccaggatttagatttcatcctacggatgaggagctagtcctcatgtatctctgtcgtaaatgcgcgtcgcagccgatccctgctccgattatcaccgaactcgatttgtaccgatatgatccttgggaccttcccggtacgtttctttcttttcccctttaaatcacactatacactaacagtaacaggattctataaaatcggtctaagaattaataaaccggtttacaatttacagacatggctttgtacggtgaaaaggagtggtattttttctcaccaagagatcgaaagtatccaaacggttcaagacccaaccgtgcagctggtactggatattggaaagctaccggagctgataaaccaataggtcgtcctaaaccggttggtattaagaaggctctagtgttttactcgggaaaacctccaaatggagagaaaaccaattggattatgcacgaataccggctcgctgacgttgaccggtcggttcgtaagaaaaacagtctaagagtgagtgaatttatcagttcaaaccgaactttgaatatgattttgaatcggtttagttaaccggacgtgtttttgatattcttgaacagttggacgattgggtattgtgtcgtatatataacaagaaaggtgtcatcgagaagcgacgaagcgatatcgaggacgggttaaagcctgtgactgacacgtgtccaccggaatctgtggcgagattgatctccggctcggagcaagcggtgtcaccggaattcacgtgtagcaacggtcggttgagtaatgcccttgattttccgtttaattacgtagatgccatcgccgataacgagattgtgtcacggctattgggcgggaatcagatgtggtcgacgacgcttgatccacttgtggttaggcagggaactttctgagttgtcacgtgcgattagagttagtggaaagtggaaactatcactgtctgttttcgcacgtgtcgggtagccgtcttgaaacccgctagctgatccagaagtgacctcattgggcttttcaacaacaattgggccttagcctttcttctcccttagtaagacaagctactgtattgtgttgttattttcaggaagcaatataaattcattttaatcacttatatattctttacatttttttttcactcaaaactacaatctagcttcttctttttttttttttttttttgttatggttgtactacaatctagctttgttatatatatatataagttaaaaatagtaactaaattacaaactaaaataaaataaagaaattggaagatatcactagtgtttggggtattagggagggaggggagctcgagatccgattttactgactgcatggtatcgaaaaagtgtcggtaatggtagggtctgacagataacagtcttatcgttgcaacttgcattcaaacaaatctcattgttcgctttaatttctaattaatttgtttttgtcttttgtatatttatttgattttgacacgagtttgtctttcctaataagaccgaggcatgattagtttaaccggtttgaattgtttaggttaaatcggagtccaagtcaaatacatcgctatctaacgaaaacgacgactgaaatttcgtaaagttccttactataaaactgatctaactatcttctacaagaacaatataataaatttgatgcattatgaattcacaagttttaaatctttatgattttgtagctcatgaaattgaatgatgtttcttttattatcacatgtcattaaataaaaatagttatgagtagatgacataaatactatttcaaataaatttatcctccatctaattgttatgagatgattatttcctataacatggtatctactatatggccgtctaaattaagtatcaacgtttaaactgcgcaatgctcaagttttcataagatgtgatttgttagaggttaattaagaaacttgcgagtgtatatgtggtctctaatctatattttaatctataaaaagggaagtgaaaatcaagattaaaagcttggatgtcatagtataaaagaatagtaaagtaaggggaccagacatatttgttgcgaactggaaaaaaatg

SEQ ID NO: 31457 - DNA, 3003 bp, Unknown
  misc_feature (1)..( 3003): 2750-1469P.txt file - cDNA_ID_3042323; gDNA_ID_1972144; Annot_ID_179323
atggattctattggagccaagtatgctcgctttcttcattacttaagacgttatatctcatttttcgtctgtaatgccatttaatttacttagtcagtgactgtaatcgtgaaacttgctaggtcagctagaaaatgatcgtggattgatattttggttttagttggaatctaattttggtcttttgtcatccaatgcagtgtatgcatgtcatatgagtgaacttattttacatgtgttgagctgatttaaatatgattcttaatatagttgagattttaccgaacatgatagttgcaatggtgagcatgccttgacgcttgttctctctaaatgcagggagttagctaaagattttgttgtctcgggaactgcttcagaatctctatatggtgcctgtgaagccatgttcaaaccagatatggtatgtgccttctgaaaacttgtttttgtaccgattcactggatactcaaatgtgtgtttatcacctgaaaatttggtaggatcattcatatgtaagtattctattgtagaatcttgatctggtaggaatatttgtgtgcatagtgctggtgatatatgacgtaactccaataattttctctgtatattttaatttggcttaggattaagatgtttcaatattgcgattacttccctgccatagtactgcttcgataaagtttgaatttcaaggtcatcattctaagaagtgcattgtaaacagactcgtgatgaaatgaaaagcatataactagacttaacaaatttgagtttcaggaagctgaggaactattcgagacaatttcacaagcacttctctcttcagttgaccgcgattgtcttagtgggtggggaggacatgtctacgttgtgtaagttttgttctcctcatcttcttcttcttcttcttcttctttttttctgtcacatctggcttcttacagaatatacctcatgtgcacttatcttctaaggatatgtattatataagatagtaacattctttcatggtcatgttgtccagaacaccaaaggaggtgaaggagagaatcctgaagggaaggatggattgatctgatatcacatatctgcttttgtccaagttcggtatactccttaacccggttatgtagaagctctcgtcccatagtaactatgttccttctctgaaactggatattgtggttcgttctctcggatgttttatttgctattgatagagttcaatgaaaatgaagaaatagcagttgttatcttgttccagtactcgatcattctatgtaccttgttgtttctgttttaatttcgtaccaagtgttccagatttctggtttgtcgcagtctttagttttcaaggttggtactgatcagtgacacgttttgttgtttgtcttcttagtgttcatgttcgattcactatgggtgactttagaaagacgttaacatgtcaacgaaatattttggtcaactatcaataaacatggtttggctaacgaaatcatacaataactatgaaatcaatgtaatttggaaggtgatcactagtaactgcaaatagaaacgaatcaaactattatgatgatgatcctgatgctgccatctgacattgtgaatgattttgcatgtcctgttctgtttgtggcgttagatcgagccagagaggcaaaatccatacgcataagcgttttgatgatttcatataaaacgtggcatgtgcaatagatgtggtcgttacacgaatataaacccaatcctgccgacctaactaatctcggtgggtattcatatactacctgtgtgggcaaagcatataaaggttctacttgggcaatcattatcgatgctcgtaaattcatgcgtctaatcattttgattatgaaccatccacatcatgtcacgtgtctaaactcttcggtcacttttgagctttttatcaaattcaacccgccacaataaaaagcggcagaactaacattccggctccacgtggcatagatcgaagcgtttatctattaggtggcacaggcggctcgagatgacgttcttgtggactccattagagaaaatgacagaattaagtgggcattagcataagttgataactatgaggtgctttttaaaaagaaaactaacagctgcgattctgtttttttttgccgttagtgtacgctaaatcatagacctcttcgtggttataaagaaagaaacttaatttgtctcgaatttgagtttggatgcgacgttttacgtactagttttataaaagtaaatgttatagaccttgaatttcaaagtggaatgtattttacacacacaattgatacaccaacaattgtggaagcaaggatatagagtatcgatctttaatggagaagaatatatccttaaagtaatcattactttttaattacggcggaaagagaatagttaaatttacggcgaaaagaatgttcattaatcaattgatgacgttcgtttataatttcaaataagatcgaaaataacaggtgaacaaagaaaaaatagacattaaaaatagtaagatcgaaaatacaacccttaaaaatctcacgaaatcaatgagagaaacaattttgagatacggtcaacgtttggtctcctttaggaaagtacacgcataagatcgaacgtgtcgattcttattgctcgttcccaaaatcgacatgctctcggaccgctacattccaaatagtctgacgtaagcaatgacaaaactcacctacattacagtctgccacgtgtccctctccatctacttcaaatgaatcctccactatacagatttaaccatttttctatttttgtttgagattcctttccaccaacacaaagcccctgtctatccgccatgtgtccacgacctttcttatatatatagtcatctttcttctttgctcgagagaagtttcaactttcaaacatatctttacagttctttcttgctaaacaacaataaaggggaaaataggttaattatg

SEQ ID NO: 31458 - DNA, 3003 bp, Unknown
  misc_feature (1)..( 3003): 2750-1469P.txt file - cDNA_ID_3042343; gDNA_ID_1972144; Annot_ID_179329
aaccttagagaaactgtatgcgtgggaaaagaaactgtacaaggaagtcaaggtattaatatttttaatatttgatgcagctttgtgtttctgaatcactaatgggaatctatatcacatatagattcttgcgtgatgttaaattgtgatttgcgtgtgatggcaggacgaagaaaagcttcgtgctatctatgaagagaagtgcaggagactaaaaaaaatggatagtcatggagcagaatctatcaagatcgatgctactcgggcagccattaggaagcttctgaccaaaatcgatgtttgtataagatcagttgattcgatttccagcagaatccataaacttagagatgaagagttgcagccacagttgatacagttaattcacgggtaaatcatctctctatattttgacatctttttacagattaagctgaaaaaactgatattttgtgttttgaaggttgataagaatgtggaggtcaatgctgaggtgccaccagaaacagtttcaggcgatcagggagagcaaggttcgatctctaaaggcgaacacaaccttacaaaatgactctggctctacagcaattcttgatcttgagatagagcttagagaatggtgcatcagcttcaacaactgggtcaacacccagaaatcatacgtccagttcctaagcggatggctcacgaaatgccttcactatgaacccgaggcaaccgatgacggaatcgctcctttctctcctagccagatcggtgcaccgcccatctttatcatttgcaaagattggcaagaagcaatgtgtagaatatctggagagaatgtgaccaatgcaatgcaaggttttgcttcaagcctacacgagctatgggagaagcaagaagaagagcaaagggtaaaagcgcaatctgagcagcgagatgcagagtcagagagaagtgtggtttcgaaaggtcggtcagagagcgggatatcagctttggatgatttgaaagtggatttagattcaatgaggaagaggctagtcgaggagagaggtaagggtaaagaaaccattaagcttgtgaacaacgcgtcttcgagcagcttaaaagctggtttagttcccattttcggggcactgagaaaattcacatcagaagttgtgaaagctcatgaaattgttaggcttcaacatcctcagacctcttcttgagtagagagtgtggacttaccacatttttgcaccgttttgaagttttgttacttgcaaattagacataggtctatatagaaggaaattgttgtatagatgagttcatattcaattattggttggttagtttcccttgtaaaccgtttttaaatggtgaagaagaagatatctagtttgccttgtaagccgttacttgctgaattaaaaagaatgtaatatgactgttcctggttgagattaaaaggaaaataggataaagctatgtggaatagattagagagtatggttaggcatgatctatgtctataagactataatagagtatctataatggctagaacttaaactaagaacgattatgatgaattgtcaactattggatcagttttggaagaagaaaagaaaaattacatatacagtaaaacctttataaattaataatgtttggactgcaaaattttattaatttatagaggtattaatttatcgataaattaataaatattaatttatagagagattttcttaatttagtaactttttaaaaaactttatgagattttttcattatagaaaatatatttctagaaccagttacaagtataacataataataatgactagaaaacaataccaaaaattttgatacactaaaatatgaaaactatagtcaaacaaagaacaaatatgaatttaagcaaaaaattattataaatatattttacagaatttttttacatataatatatatatatatttgatatatttatacaattattaatttataatataaatgggaccatatatttacatagaattttcaaaaaaattattatcttattaatttatcgatttgtgtaactttttacactggtcccaacttgggaccggaagaatttattaatttacagaggttattaatttatagagtattaatttatgaggttctactgtaaactactgtgacatttttcataacttaacttggaaaaaaatatgaaatttagatatgaaaaatcacaaattcacaacaaggtaaatagtttcaaactatgcacaatgttgcaggcgatagtttcaaactcttgacaagttgacatgcataaactacaaaactatcaaagatttctcatgttttggattcgtatttagtagttttatgcattttgttcattatcacacaacttaataaatcatcagtgtaggtacaattacaaagacaatagtctagaacttaaaaatcatttttacaagtgcagaaatgggctatgttgccatatggcttcacaatgtcaaaacgggagagatactatggttaggcatgatctatggtttagggttatcaatactggctaattatgtatcaaagtcaaaccaccatggctttcatttttttttggtcagttattttttttaaaatgcacattacattattatgttgactcagcaggatataataatgagaaaatctaatgctatttaaaatagagaaaaattaagaaataactttctcctaattgtgattttcttttcaatggttgattatggaagtaaatattgaaatatcaataaccgctgtgggtcaaagagtcaatgacaattattacttgcccaaaagttaatgaaaaaccaatgacgaggtttatccaatgaaaactctccacgtgtatgtatgaccagtaatcatccagcgatttcgtaatttccagtgtaagaaatgcgctcataaatatcatcttctctattgagaagaagaagaagaattcacaagaagaatattcacagagaagagagagcgataataatg

SEQ ID NO: 31459 - DNA, 3003 bp, Unknown
  misc_feature (1)..( 3003): 2750-1469P.txt file - cDNA_ID_3042374; gDNA_ID_1972148; Annot_ID_179386
tggcttcttcttcctcaaattttattttcctagttttctcgctttttcttcggcaacaaacaacagcttttatttaatgttttttactaacaagtctacacgacctaagtacagatgagattattacttttttttatcaccgtttatattataatgacaaaacagctacatatcaataaagaattgacatctgaaaaattgcatattatctgaaattatataatagaaatattattttataaactctgttgatatgttagaagtttttgcgatattaatatacgtatagagctttttattgtttaaagtttttatccagaaagaaagtttaaattctgctagttggttcaaaaatgcacattcacaaaaatatagcatgcgatattagaatactgaatacactatcaatctatgattgatcagattatcagaatatgcttctgagcttctctgtttgctagagaatatgctttttaggctttaagtgaaaaacaacttgttctttaagccggcgtggacgtaaaattccaagagaatatccaaaatatgttctacaattgaagtatttaacaacatgagtttacatatatatagactctacactagggcttaactactgactagttacaattatagccttagcctatacttctcttttgcaagtctttggctttgttttggtgagtttcgactgtttactgctttgcaggtttatgaagcctctgggaggcagcagtgttcatctcaggttctgaacacacaccagagtgagcaagtgacggttcgcttgtaattgagtaggaaatcagtcgatattcttttgagtcactcgggttagaagtaggtttttgtgaaggataactcttggtattttggtatattcttcctgtaatatgttattatctatttcaagtttttctagtttatgatgcttttgtatgttaacattgtgtattttgtgttttgggaccaggaaatgatctgtttcgaaacagagcatttaacagacaaaagaaacacaactgtgaacagtttaaatacttgacttgttgatataatcctgattaggtgacttggcatattggttcaacttctacctccaactatatataatagccagcttcgaaaatccagtgagttttggaaagcaaaaacagctcataatttcgccctcgagaaaaggcaccagctttggatttcgaaggttaagagcttgtctagaaaatcactgccccgggttatttgtgattttaggtgttatttgtgattgaaagacagcatcatccagcaatgggaaccccatttgggagaagcaagtagaggatacacaacatattcagccactaaagagaaaaatctaacatggtggcatttttgaaagcaaacatcataagtttattcagaagcataaatgaaacaaagggcaactaaagagaaacagaaagaaaatattaactggcatggagaaaccatcgagcatccataagagacatgtcgtcaggaacaggaaagcgtttgagggtcttggttacaagattgaagacacagatgtcaaggtcacgaggtgacaattggcagggacggtagtgacgggtgaaatagatggagtctggttcgataccaagggtatcattagcaggcatagtgaaacccaagtcaagaagcagggcctcaccaccaagagaatcaacctcaagaacagtgtggcaggcgtaatctgggagttctacattaggatcatacttgtagacgcggaagcagtccctctgccatggattactctcaaccaacaaaacctctccagaggttgtaacagcaatgctagaatcccacgagtgataacgagaaagcattgagaatggtttattaccctcggtgatgtccttgaagaaaccttgcggtccagacagatctaggactttaacaaaacgacgacttgtcgagatataaagagagtaacgccccagtaccatataagataagccatccaaaaagtgggcgtctcggaaaaacagaggaatgtcagtgtaatgagtgtcccctttcttgcaaaagcttatataagagtggccagggaggtcgaagaaccacaccacaacgtaatctgttccactctcgtctacccacaaaaggcccctcacagtatcacaagtcagatcagtggcaacacgggcactatattccgggccattatattccctttcaaatactctatctcccacacgcctgaccttactagtatctgacgcaatcgactctagagacggaagaggggatcgttttctcgctaaagacatctatgataactaaattggatccagaatctaacaacaataaccagtaacccgagtttgccaggattcgagaccctggaaagtctcgcagttccctatggatcttctttccttcttttgggttgtacagcacacaaccaccgtctttcggtaaaagcatcagccatggagatccgcctttctggggtaacgtttccgacgagctacagggtcgtttgactgaagaagaagatacattcattatcaggcgcaagggttctcgcgtttgtggcctgagattgagggaggcgtgtcaccttctgtctgtagaagatactaaaactgggaagaaagattgtttcttttgatattgatccgttctcttcttaacgattacatgaggcatagctccttatttatactaaagttaagcccttgtaaaaccctagttaacattacacatgtcatcatctagttaccataaatctattctttgttcattgtacctcttttgcttgtgacaatcttcctcttttgcttgtgtaataggctaagggtattaaatttaatgtttatttttgtataagagaataattaaagcgttttttaatcaaaaaaattaaacacctaaagccgcatcaccagcgttgaccaacgttccggtcaatcgaattcggtattagggtttaaacccaaccgtcccccatttctccaccgcgcttagctaatg

SEQ ID NO: 31460 - DNA, 3003 bp, Unknown
  misc_feature (1)..( 3003): 2750-1469P.txt file - cDNA_ID_3042374; gDNA_ID_1971795; Annot_ID_175642
agatatctttggactaaacaaattttaaacgatttcttagtttatcaatatgttaaaacataatattgttgaaaatgaaaaatgagatagtagtgaatatgttttaaaatacaagaaagtaagataaatttgtaagaaaatatgctgatgtaaaaaaaattgtgccctaggttaaaataggttctagatctgcccctggttaggtagttatatagacaataatggtgtataaataaatcatgtcatgtcttttaggtgttcttgaatctatgtgtatgtcatttcctcataagcacccttagattccagatatatcttttggcctgattagtaataactcatttgtggagaaataaaaaaagtattagcaagtccatcttttgtccattttatttttgaagaaagatattttgagcattgcaaagaagttccacttttgtcttgccacaacaaaattcttctcattctttgtttcaaaagccatattcatatgagacatttgaaccgattctaaataaggctgtattatcgagttttatgaaaacatgaaaaaaaaaaaagaggactgagaaactttaggaccggtgtcattatgtgacagacaagagagaaaactcgtttaataaaaaaaaagtctcgacaaatcctatttataaaccttcaaaccccaaattaagtcatgtatattaacacaatcattctatttatattaaaagaccgcgggtatcatcttttcctgtaaaatgatttcgactttagttcccacaccgcaaaacaatatggttcatagttccaactacgcaatcttcttaccttccaagattcaattttctgaaaacaagatcattgctctaatcaaaccctgaaatagagtttaaactataaagcaattaatgtttctaaactagtagtagtgaactaatgagctatgaaatttgtggatatggttgtaatcaatcccctgaaatagagagtagaaagcatcaaagtgttctaaactagtagtgaactatgcatttctttttagcaaaagacaggggttcatagttccaactacaaaatcttatcttccaagtaaacaagatcatggctctaatcaaagccctgaaattaagtagtagtgagctaatgcaattacttcctggcaaaaccagatttgagtcaaatgatcttctcattctctctcaatgagaagcaaactagttatcttgtcattctctctgaataaacgttttgtttatctgaagttgatgtaaatgactttggaagcttggttttaaaagaaacaaaaatgaaaataaataacatcagagctctccaccactccctacgtttcgatgtaaacaataatatgttatacttaataatacagagaaacctaacactgagaaattagtcaacatgataatatttttattcagaagcataaatgaaaccgaaaaagcaagaatttaattggcatggagaaaccatcgagcatccataagagacatgtcgtcaagagcaggaaagcgtttgagggtctttgttacaagattgaacacacagatgtcaaggtcacgaggtctgcattggcagggacggtagtgacgggtgaaatagatggagtctggttcgataccaagggtttcgttagcaggtatagtgaaacccaagtcaagaagcagggcctcaccaccaagagaatcaacctcaagaacagtgtggcaggcgtaatctgggagttctacattaggatcatacttgtagacgcggaagcagtccctctgccatggattactctcaaccaacaaaacctctccagaggttgtaacagcaatgctagaatcccacgagtgataacgagaaagcattgagaatggtttattaccctcggtgatgtccttgaagaaaccttgcggtccagacagatctaggactttaacaaaacgacgacttgtcgagatataaagagagtaacgccccagtaccatataagataagccatccaaaaagtgggcgtctcggaaaaacagaggaatgtcagtgtaatgagtgtcccctttcttgcaaaagcttatataagagtggccagggaggtcgaagaaccacaccacaacgtaatctgttccactctcgtctacccacaaaaggcccctcacagtatcacaagtcagatcagtggcaacacgggcactatattccgggccattatattccctttcaaatactctatctcccacacgcctgaccttactagtatctgacgcaatcgactctagagacggaagaggggatcgttttctcgctaaagacatctatgataactaaattggatccagaatctaacaacaataaccagtaacccgagtttgccaggattcgagaccctggaaagtctcgcagttccctatggatcttctttccttcttttgggttgtacagcacacaaccaccgtctttcggtaaaagcatcagccatggagatccgcctttctggggtaacgtttccgacgagctacagggtcgtttgactgaagaagaagatacattcattatcaggcgcaagggttctcgcgtttgtggcctgagattgagggaggcgtgtcaccttctgtctgtagaagatactaaaactgggaagaaagattgtttcttttgatattgatccgttctcttcttaacgattacatgaggcatagctccttatttatactaaagttaagcccttgtaaaaccctagttaacattacacatgtcatcatctagttaccataaatctattctttgttcattgtacctcttttgcttgtgacaatcttcctcttttgcttgtgtaataggctaagggtattaaatttaatgtttatttttgtataagagaataattaaagcgttttttaatcaaaaaaattaaacacctaaagccgcatcaccagcgttgaccaacgttccggtcaatcgaattcggtattagggtttaaacccaaccgtcccccatttctccaccgcgcttagctaatg

SEQ ID NO: 31461 - DNA, 3003 bp, Unknown
  misc_feature (1)..( 3003): 2750-1469P.txt file - cDNA_ID_3042381; gDNA_ID_1972148; Annot_ID_179378
actactgttgttgaacgacaaaacacagaagaaagttttgtgtctgatgatgatgatgaggaggattctgatataaatgtacttgagaggtatcaagatttattggctgtcttaaacgaagaggagggtttggagaaaaaatgcaaggttgtagaaaaaatcaggctattgctgaaggatgatgaagaggccaggatcttcatgggagccaacgggtttgttgaagccttgttgcgattcttaggatcagctgtagatgataacaatgctgcagctcaggatagtggagctatggctctgttcaatttagccgtcaacaacaacaggttagtacctcttgttgatgttggtaatacaataatagattgtgactttctcattactttttgtgttctcaaggaacaaagagttgatgttaacttctggggtgattcggctgctggagaaaatgatttcttctgctgagtcccatggttcagcaaccgcgctttatctgaacctttcctgtctcgatgaagcaaagtccgtgataggttcaagccaagcagtacctttccttgtccaacttcttcagaaggaaatcgaaacccaatgcaagctcgatgctcttcacgccctctacaacctttccacatattcccccaatatccctgctctcctttcatctaacatcatcaagagcctccaaggccttctcgcatcaacaggtgaaaatttgtggatagagaagtcactagccgtattgctaaatctagcttcaagccaggagggcaaagatgaagcggtatcatcacagggcatgatcagcagtctagcaacagtgctagacatgggtgacacaacagagcaggagcaagctgtttcatgccttttgattctatgcaatggaagagagtcttgtatccaaatggtgctacaagaaggtgtgataccatcattagtgtcaatctctgtaaacggaacacctcgaggcagagagaagtctcagaagcttctaatgctgtttagggaagaaagacagcaacgggaccagccatcttcaaacagagatgagccaccccaaaaggaacctgcccgaaaatctctctcagcaccgctgtctgtccatggatcaactcctgcttcagcttcagttcaagactatgaaccaagagtcctgtcgaaatcaatgtcgagaagaaagtcgatggcaagaccattcagcttcttctggaagaaaagctactcggttcgcgagtgagaaagaagaaaatatcacatgtacatacaagtacaaccttttatatgtaaagctttgtttttctttcttacaagttacaaaagtcatttcatagagaagaagatatgttgtacaggtctcattgtgattagtacactcgatttttgttgttcttttggttagccaaaaaaagatgtatatcaatcaaggtaaatacaagtaaaacaaaaccccagttttaacatcgtattcacttattgtcattcttctggtttattatgtttctatgataagtatccaaagttttaaaacaaatcttaaacttaggttacttagaatatgacatttacaaagtaatgaatacaagaagtacttgaaagagaccaaaacatgtaagctattgtgtcacccctcgggttcaaatctcgaaagaaatcaggtcgaataggattcagaacgcgagaaggtgagcgaatccgcgcttctactacttcgtttgatgggattctgaatccatccggtctcaaagagttccaagatcggatctctgcggctactgctgcttcgaccagtgcttccaccgccatcttctccactacttcctctctgtaatgcctccttgtacgacactttcttctccgtccccaaattcctcttctcttcctcctcttctgaaactgaccctgatctgctaaagctcctatcaactgtgatctctttctcattcgtccctttgttcttatctctccaacgtcccaacacgttcaccaacaaaccaagcctagaaataacatgaaccaacaaccaatctagccacgccactcggctcatcaaactcggaagtttcttgagcactccatcaagtttctctggcagagtctctacaatgatcaacaaatcaaagatcttaacaaacacattgcttgaagaagggaagtaagtctcgattgcgtcttgtaacgcgagtatatgatcgtcagctacagagagaaccgcgagaaaatgacgatgaaacggacttgtcatcgaaacaaagaagataacgaattcaaagagtttcctcaatagccaagaggatagattcttcttcttcttcatcagagtctggcttcttgtgtaaagaacacgagtcatggagagtattacaccaccacaagtctcaagaggacgacgtcgcggcctccttctcgccggttgctcctgtcaaaatccaaaatcacaaaaaataaccaaacatgtccagattatttgaggttatcaaagggtaagaacaaagagaattgcataccatttatgaggaatgtagcagattccaaatgttttattttctcgtctgtaaattttcccggaaaatgatcgagaaacttttgagaaaattagttcggtttcaggattttatacgttagtcaagggtaagcgagcggttagtcttgatttcagctgagcattttttagaacgagcggttacgctattctttttttaagtccactcgagaagattcgaaactgggttgccaaaagtgggttttttgaaaatatttttaaaaccaaacgttgggaatcttttttaaaataaaataaaaaaggaaaccgaatctatgacgcatgcatgaggtaagccattagatagattgtactgtgcgagtctgcgaatcaccgatggtcaacgtctcttctccttcaacttcaaatttagtctcttaccagtacgacttctcggtaacggaatcgttgctctgtttgccggagacgtgggtaagattggattgggaggtggagaaatg

SEQ ID NO: 31462 - DNA, 3000 bp, Unknown
  misc_feature (1)..( 3000): 2750-1469P.txt file - cDNA_ID_3042385; gDNA_ID_1972148; Annot_ID_179375
tacacgtttaagaccatcaatgagagcaatttttgctttctcaaactttaaaagaaccgcatcccccgttatggcctgttcacattggaaaatgtagaacattaaagaagcaaaacacacgaaacgagaaagcataaaacttgtccaaagagagaaaaaactgaccaagtaaagtttactacactcagaacagtgctgaagaatattttttgccttctcaagtgcaatatgtaaagagcataaggcttgaatccctgatttgctacgcggtcttgctccttccaatgacgggaagattgaaagtaccttgcatagaactccagatagttccttgcacatatctccatgtaactgtagcaaaagcacaagacaatcaaatcatcaaacaccaagaacataaaaacacgaaaccctctaacaacattgaaatcaaatgataataaaaaatatgtcctttaagataacccaattactatttctaatagaaaatttgtttgcaataatcagagatgcaaatttaatcagattccaacaattacaatccgaattcgaacatttcaatttaaaaaccgaaccttggcatcgctagccgcgaatagattctcttcaagctcggtcacatccatgatcaaacctcaccaaaacaactctaaaactacaaaaatctcccagaaacaaaggaatcaatacatgaattcagagaaattattaaaacaaacaatgaatcatgctacaatcacagaaattacctttgctatgagaaaaagatcttaacccagaaaagagaaagaaaaaaaaaacagaattttttattcaaacagcaaatcctggaaaaattgcaataacggaactgaaacacatccacaaaaaccgggaaattctacgattaatagaaaaaattgcgaattacattaaaaataaaagagagcactaaaaataaagctgcggagaacacgtgtggaaccagtaacaaccaaaaatggacaaacaaagacaaaacaaagaacagaacagaagagataagatagaggtcaaacatttacataccggggatattgagagaccggccaaggaggaaggttcataaaagataaaccaatagagaagaatcagacaagtgatgatgaattagggttttgttcttggtaaggcgatccatgattttggggttaaatgtgagagagagagagagagaataaaaagatattcgagtggaggaggaagtacttaagaatctgtgtgttctgttttaaaaattattaagttaagaacggcattactgtgatgttaattagtattctaatttaaaactaatgaacggttctttctataaatatttatttaatgtactagttttaggaagttttccagagacaatattgtaactggggttgacgtgagttttcatataatttgtaactttttgacttttgtttaaaagattaatttggttagttaggagtatttaagcttttttggaagagtttagagtttatggttaacctttttttttaagagattagtgcgttatagttgcaaatagtgcgtttttttccatcagaaaagttagtggaaacatgaacaaattgtcagttaaattatgttatcccacttgaatatttttgcattttgcttttaatttctaacggtccaccaaatcaccaaatggagtattttaattattcttgaattaaaaactcactcaaagatttgcttcttcccatccacccaggcggattgaagtttttagcgtctttttaattatcattttgtatttataatttattagatttttaaatttataatttgaaaattattatcatttatttattttatatcagacttaaatataaaaatattgtttttgagttgttatatttgttacctaaattcttgccaaaaaaaaagaaaaagagagaaaatcttctagcttcgaaaacatctaatactgtaatagtaaaatcattaaaacttttaaattggtttatcaaaactatgtcgtatattcttctccttctccacggaacccacacatagtagagaaacaatatgagcagtttatcacactcttgagttaccaattttctctcatttctcattattccttcactttctttcgaggtacttcatacatagtcgtctttctcaagttgttgtggattgtagagaagacctaataagctagagaatggattcgaggaagtctttatcttccatcgatagcttcaacgattgttacgtttgcttgtaacccaagattcgaaggtcaacaattccacggatgatataccttacttgagtctttatttctaaccagttatatgttacaagctaagtctgattcttgtattcttttctaccattgaaaccaataaaatggtctccttaccaagtaaaacagggttattattatgtactctaacaacattttccgttcaatcaatacaagaagcttttggatttcttatttcttttttttttttgggtttttttctttcaacaaaatgattataaattatttatttttctttaccaataagatttggggttttatgaaccatgatgaaatacttttttgtctttttatgaagaaatgatataactctgtttctcctctcttggtagcaattggctttttatttctcaggtaagtagtctcccccttttaaatccttattgggtgttgtattctcccaacaggcgtgagatgttcgttaaaaacaaaaacaattgctcaagagcatggcgtctggttctgttatgtatgtgtcttgttttaggtaataagagtcaacttcaattttgtggtcactttcttgctaattagttgtgataacagctgttgcttagaaacttcaacggccaagacttcaattttgtctcccagcgtagtagacttggaacttctgatatgactttgatcacaaacaagatatatctttaaaaaaccactttagaaagaaatctatttgccaaatcatccatctttctgaaactatg

SEQ ID NO: 31463 - DNA, 3003 bp, Unknown
  misc_feature (1)..( 3003): 2750-1469P.txt file - cDNA_ID_3042389; gDNA_ID_1972148; Annot_ID_179370
ttcaggtcgccgcttttagattcagaatttcataaataagtaggctatagattaaataagagattaacaagccttctttttcattatggtgggtggtttaagtcaaacttcacgaaatgtttgctttgtcttacttttcattaataattggatgactttatcctttttctaagttttaacactaaagaatgtgtatatttggattgaagttccagatttcttaaagtcattcggaatcaaagatgtactttggaaaactttgttttttttttttaataccaacgaagcctgtaatgatttaccattttggtcttttagagagtttcggaaaaactagaaggatacttttttttcctgagatgttcatgatgcttaacatttaaataaaatcaaaatcttttgaaagtgttactttctatgatttgattaatgtcaccaatttttttttgtaaattaagaatcaataacaccctcttagtattattatcatggctttggatttcattccagttttagtttttttgggtatgtttagcttccttttttccaaactaaatttctaaaaaatatgttttttcggatttttttttgattatttgtttaaccgtcggttatgtttttcagtatagcttacgataacaatatcccacatcggaaattaggaaaagatcatgatagtatataagatatatgtcatcatttactcattgccaagtggttttgtttgaatgagataatatatctcattcattcattgtcaattagttttaagttaaaaaacttatattttaatatagtatcaaaatgcttgatccatacattttccagctcggttcgtattcgatatgatccgaatttggtctattgatccttgcttaatatatcgagagcagtggctaaaaaatcatcatctctacaaagcgtattatcatcgtcatcttgccacactgttagcaatatatattcatcctctcattttcacatccatttgataaagataatttgaattatttatatgccccctacatagcgaggattacaaagaaggaataaaactgaaagtgaaaaatgggatgcgactttaatagagtttcatggtcaccactacccataccagttggtccacgtcagacgtatacaaaggcatacgatacgattgcttgtgctttcagattgagacaccaaagatcaccgattcaccatcatctgatctgatgatatgcttttttcccatcttctgagtctttctttttttcttctaaatttcacaatatacatatattaatttcaataccattaccatcaataattttatagctacaactaaataacctacaatatacagaaaatataaaaaccatttctaattttaaaatgggttttgtgtaaaaaagactttaattattgcaactttatttacatcttaaaaaaatatagattaatcatacaaaatcaacaataatatataatataattttttttgctaccgtcaaatttataaaatttgaacaaataatatgtcaaattgaagtcctcacgattaagaatacaaatttagttttagaattttaaaattttaatgtatgtaattgtgaaattgtaggattaatctaccaaaaataattatatatataaaaaatatgatcaaaaatggtaaactttaacaaaaaaaataaaaaatgacaaatctggacaaaaattagtttatgcagtatataatattatttttgtagcaaaaacatgtctttgttttcttggttgtctcgatcaaaaacatgtcttgagagcatatatgaatactaatatagtattaaactataggatgatggggtcattgacgtggtgactagttgacattattatcaccgtaagatctgattgtgctatataatccctaatctgacgctccatttatttattcctccattaccattattagatctctctgtctctttctttctgtcaaaaatattatcttctttgcaccaacttcaacgcattacgaagcagaagacagaacccaaaaaccgacaaagttcccctattctctcggtataacctcatctttatcttctttctccgccattttctcttttctttgtataaatgtctttacccattttggattagattttccccctccaagtaaatgaatcatctgcttcttcaggtctccattgattctcctactctgttttcctcctatatttgtatttgatgttttgtttttttctttggaaccaaacaagtcataaagtttcgatctttgagatcttgcccaattcttggaactagtgtttggttttcttgataatatttctgtgagagaattcttcaattttcagattttcttgataatgttttgctcttttaggaaataatttatagccattcagatttattctcttgtttctttgtggtatatggtgcttgtaattttgcaaaatttggagcaccctatctttttgtttgatgttgatcttattggttcttgacttctttcaaagagttgacttatctgtaaaaaaatattttgcagaaaattcattacttctaaagatggatgttgtaggtggctgatgactcttcttccctagcatgacctttattggtaacatcttctttactcaaaaaagaaacattccttttggaagaatcttgttgttgttgttgttgactaatcttttttatcatgttcttggcagatacagagatgtgtatgagaagaaacaacatcaatttaacaacagtcatagattctaacgaagccattggtatggaacatgaattagattctgctagacatcaatattcttcagtgctcactgcaattccattcttctccgctacattgtttattcctctctctttgaaaatcactatacgtgacgggtttcacgaaagtctttaataacatttccatacacaaaacacaaatagtttagagatttgttcttagggagatttagctatctctctgttcaaaagattggtctaaagatg

SEQ ID NO: 31464 - DNA, 3000 bp, Unknown; identical to SEQ ID NO: 7860
  misc_feature (1)..( 3000): 2750-1469P.txt file - cDNA_ID_3042389; gDNA_ID_1621169; Annot_ID_173918

SEQ ID NO: 31465 - DNA, 3003 bp, Unknown
  misc_feature (1)..( 3003): 2750-1469P.txt file - cDNA_ID_3042424; gDNA_ID_1972154; Annot_ID_179421
ggagttgtgggcacttttctaagccacttcttggtggtgcggatgctagtcaagagattgcagccaaaagagaagagaaagaaaaattcgcacttgagcatattgcaaaatgccagcactcttgtaaatagttttgtctgttatctctggtttgttctatacctatactagtcgcctgaattgacttcctacattttaccttgaccagctattagcaagctcaacaataatcctattgccaactgggatacaaggtttgaaacgggaacaaagacagccctccttcacccattctctcctattgtagttgctgcagacgagaatgaacggatcaggtatgcgagtttcatcagagcatcgttaaaattgaatgttagaacaacttcttgcattcaggttaaccctctgttaggaaaagtacagggtagttcccaatctattggattaggtctcggtttagtttagtcatttagaaaaagcttccctttgaaacttatcttaaactttgatgttctctcttgggacctctttttatcgagaagccttaactgcactaagtatttcactttatttctcttagagtgtggaactatgaggaagcaactcttctcaatggctttgacaatcatgattttcctgacaaaggaatttcaaagctctgcctcatcaatgaacttgacgactctctgctacttgttgcatcatgtaatgttcacaactcttgccaccaagtctttcagatgtttgcaagttgattgaatatgggtgttgagtaatggtatctatgtcttacacatgcttttgggatttgggtaggcgatgggtcggtccggatatggaaaaactatgcaactaagggtaaacaaaagcttgttactgggttttcttcaatccagggtcacaagcccggtgcccgtgacttgaacgctgtcgtggactggcaacaacagtccggttacctggtttgtgatttcttcaatcatgctatgcacgatatttcttcttagttttccaagttacgaagcctgatttattgttatttacgggttactggtatttaacagtatgcttctggggagacgtcaacagtcacactttgggacctggagaaagaacagcttgtcagatctgttccctctgaatcagaatgtggagttacagcacttgtaagtctgcatgaacaaccttctgtttaaaacatagaaatgctctaggatgtcatcatttgctacaatctgatgaatcgaagagatagtatgcataagctatcgtcttatagttctttttgttgttttggaagttcatggttatcatgcttttccttgatcaaaacatttttgaattacaaaacatgtgaattttgcttactttatgttatctttgtagtctgcttctcaagtgcacggaggccaactcgctgctggttttgctgatggatctttgagactctatgatgttcggtcacctgaaccgtaagttggtttaaactttaatgttcattctttaacagaactcctcaaaataatctaaaatgagagcaccaaaaaatatttttgaatacatcacttaatatcatttcttctattgaaggcttgtctgcgcgactcggcctcatcagaaagttgaaagggtggttggcctcagttttcaacctggacttgaccccgcaaaggttgcaaaccaaaattgatctatgaactgtcagctttcatacctttttttatagcatatattggttcgggtttgaagaatttcgtcttggtttggtttttaattctcaagagtttctcaactctttgtcgttttcctggggccaatatctattctgttcttatcttcaggtggtgagtgcatcacaggcgggtgacatacagtttcttgaccttagaacaacaagggacacatacctgacgattgatgcacacaggggttcactcacggccttagctgttcacagacacgctccaataatcgcgagtggatctgcaaaacagctcattaaagtattcagtcttcaaggggaacaactagggataatccgctactacccatccttcatggctcaaaagattggatcagtgagttgcctcacatttcatccgtaccaggttctgctagcagctggagctgctgactcatttgtctccatatacacccacgacaactcgcaagcaagatgagtcacaaccgtaagtgaatatgttgcatttagcattgctcttgtgataaaaagaaaagcataaatcagtgcaggtcgggtcggttttgggtcggggtaaagtgggtgtggtttatagtattcgttagcctccgtccaagataaaacaagatctaagttaacactaaagaaggaggcttcaccaaataagttatatctctacctatgcaacaacgcacgtaaatggtgtctgtaaatagtttccctgttttgcttttcattttctcatctcttgggtgtgtgatttcctttttattaatcttttaagtcattctgtttcctaatttgtttcatgtgtaaaaaaaatggtaaaagtaatggtggaagaaaatttgcattttcgtgacgatgctttgaaatgttgtctgttgtttgttcaagttgggatccgttggaaataggcttgcaatttttcatgctacgcatctctatgattggtcaaataccagtttatgtcagaatccaagtaattatcgaaaaatctgatcactcactaggatttctttggttatcaataaagagatgactaacaatcattaacaatcataatgaatgacgatctttatcattttggttaataacaaaatctacgaacaaaaatccgttaggacattttttactgacacgtgcaaagcaaagctctcccgcgtgcaacaaatgaaagctttttgtttcgatgactgttttactgacttgtgagttctgactgacgatgaaaaaaataaaaagttcctcaaggaggtgtaaagattattgtacggagaattaagcttcctttggagatg

SEQ ID NO: 31466 - DNA, 3000 bp, Unknown
  misc_feature (1)..( 3000): 2750-1469P.txt file - cDNA_ID_3042432; gDNA_ID_1972154; Annot_ID_179413
cctgaatgctcaattgtcatcgatagatgaacataagcaatctacaaagagaaaagtgagggacgacttgagagctgagtaagatccacaaacctcactactgcagttgcttgttatgaatgctcgttacatttgttttctcattgttccctctttttatctacaggaaaaagctatcaatgtatgcttctgtcacgaacgttataccggacattgatgatccatcaaagatctcaggctgtatcctgttctttcatcatcactctattctatcaacgttttcttaatcatatatattgttcactttttatccttaggtgttttgaatccttgattttgaaaatcatattagatatggtagatcgtgaaaagaggctaattgagaagtttcaattcgagacaaataagatgacggcatacgagacatgtaacagtatctggagcatcataaacaaacaataaacatacttggcaccacttcatttgtatgatatatgtgtgagcagtcttggttttagcttagcaaccaaaaacctctttatctaccatcagttccgttgatgtaaacactttctactttacttaactttggatttttgttatatgattttgaattttcttctcctgtaacatcatcatcaatctaagatttttccccctgcaagtttccgtgttcatgttgcagctgctcctgccgttttcctgatcgttttttgctgtgcagattgatgcacaagttcagatttaggttgtacaaattctaaaggaacagaagtgcagttttttagtttctatgctttcattatattcttaaacgcctttcataaggatttaatgattttgaatccaaatcttggtggcctagcaaactttgggattattacctagcttctcttctgaactgtggaacctgcttagtgtctccactgaaccattgaacttgttagggtttgccatttttctgtcttatattggggtagattttacaggccagagaactcgatccaatttagcgagagtgtacacagtacacactatgaagttataattttgttgtccctgtctcttgaaaacagtcacagtctcacagagatacaaatcctcatagccagagtctttggattattgatgaatattgtcaccgcctgcctcacgaagatggtcagttccccttttcaaatttcatgcaagtttggtaactgtttttccggaagtatttagagaaatgatcaacagatggtatttatgaagtctttacaggaatttcatgtcggatcttcactggtacatgaggcttagtagtttgtagtttatgaaccttctataatagatcagtcacaaagaaagagaatctttacgaaaagatcatgaacttttcatagcttctgtgcttaggaattgtcaatcttgtagaaacaaagtaacatgtcattacattttaggtaagaatcgaagtacatgtcatcagatagtatctgtgacttgtctctataatattggctttaatagtgatctcgtacgtgtatctcagtttcagatatgatcttcacatcttcgaatctctgaggaagcaaagaccacatacgattctagcaccttaatggactcttaacaaaacgggtaccttctgcaacttctggtttcactaatggcttattggctttagatagatttgggttcttagttcttctttagggaccacattggaaaattagatatctattgattaagagggaaggaacagtgagaaacaaaaatcattgtggaaactgtgaaacaagattatgaaacctgatactccatgaacttctctgtgtgctctctttcgtcgttgcttgattctttgacatatctgcaattataaaggcaattaggattagtgagaagatatataactttctgtttcttagaatgattatgaaattttaacgataaatacttggctaaacccttaagagttatgtcttctctgtcgaaatacgcatacatggcatggtacacgtacgagacattgtctcaaccactgcacaaccaacctgttacaaaatagaaggtgaattaggtaggtggcaatatttggaggtaacattaacaaaataccaatggtgtgacttagtgccatcgaattagtgaaacatgagtattttttagttacaaaatacaaaaatcttactaacttcaactatctttttctttgctaactatgataacttgtatgtagaagtgttgttttttattttgtcttgatagctaataagttggatgatgcttacttgatttgctcgttaacagctgcctcacaagcttgtgcgtatctttggtgagcgacggagacaagagcggtgattggtagggctagataagctctctttacctcctcgaacggctcgaatatgactccgctcatcgagccagctgtttctgctgccaccaccagtgatctccttgccagtttcctctgttgtgggaatctcagtgaaccagcaggagaagtggtgccatgatgggtttagtggtaaatgaagaaattcccttgaagctatgtctttgatcagcatgcgatgtggatgatgaactgatgaagaagaaagggttttgtaatataggagggaatcgagtgtagtggccgttggattagacccacgtgttggggtctagatagaaccacatttacgggcgtgtggtagcctcatggccatccaatgggatggcgtcaacgaggagattccgtccacgtcagataaaagcttatcctattttcactgtcagtaataaactttgtctgattctcttctattggccctatatacactttaatacaaagttaaattgtttgttctacaatccacatcgttctttcaaattggtacgtgtcaaaaatctattggctcttatagtgttaatacaaagtaacgaaattaaatgaatcggtgatagaaccaaaaaaaaaacacctccgatctcggcgagagaaagagaaacgatctgtgagagagaatg

SEQ ID NO: 31467 - DNA, 3000 bp, Unknown; identical to SEQ ID NO: 9565
  misc_feature (1)..( 3000): 2750-1469P.txt file - cDNA_ID_3042438; gDNA_ID_1972154; Annot_ID_179408

SEQ ID NO: 31468 - DNA, 3003 bp, Unknown
  misc_feature (1)..( 3003): 2750-1469P.txt file - cDNA_ID_3042442; gDNA_ID_1972154; Annot_ID_179407
aggactgtcatactcttgacggtcgatctcttcatcacagatggaactccagaactcaattgcttggagggaaacgctctcttcatctccctttacagcattcgatgtgagctcaaagagtgtttgtatgtagtgctccagcacctcatagtatgtggatgcaatggacacaaggcactcgaaagcagcttgcctgatctctgcctccttggaacatgctgtctcgcataccatcttcatgatgtaattcctctccatttcattctcaaaatttgtctgagagaaatccaaggcattaacagtgcctttgttgctgcgagacgaacttcagcagtattttcagactggttcatgccctgcacaactgctgtgaggacagaattcacttcatcttgcacaagatcatggtgtgatatctcttcacagacatagcctagagtttccaaggttgattgcttcaagtgtgcgggactgccttgctgagtcatattgttaagcagcgatccaacaagttcaggccactgcttctgaggaatttcaatggaggctaccttagcaataacctgagctgaagtatgccttgcctctagggcagatgaaccaagagttcttagtaagcgatccttgatctgggatttaagagcaacatcaattgcaaaccattgtttcaccagatgatcttttgtggcagaatctttggcgtccagagaattctttagcagaataccggctagtcgacgggattcagcaggtttatcattgttggcaagctcaaaagacaaggatactaagaacagcggcaagttctgttcttggaattgcctgagattaccctctgcttcagtccggactcttgcatcggctgactgggcagccaacagaaactgtgtgatctccatcgccattctggtctctgcgcaacaaggacattcaccataatcagcaaaaaaaaagaggggttaatagaacaaaatcagcacaattctaaaaaaaaagggaaagctactgaacaaagtaatggtacaagtataaaaggcaataatactatacaaacggtcaacaagttcaatcagatggtacaaacaagagcatttgaacattatgagcaaatatatccatactccgagaaaattatatgagaatctctgcttggtgtaattgacaacaaaaatcattgaaaacaaacccaatatgaaatccgaaccaaagatgacccagcgttttctatgaaattcggaaaaagctttttctcctagtcgtgaagaacacgagttcaatttctaagaaggaagagagacaaataagtggcagaatcacagcgagcgagtaaaaaactaaagttaaaaaccctgcagtactagtgacccaaaacctaatccgaaagcatagatctataaacagatatacaaatccagagatcaatacacagttcaagcaagagatttacctggaaattaaggtttgcgtaaacgctagggtttttcgcttcaatttaaacaccacgtccctctcactgcagattctatccacaaaaagcttctcgaagaagagcaaaaaccaaaccctagagtttgcagagacagagagagagtctgtacttgaaactgtcgaaggagagagagatatgagaaaagaaatttcaatttcgaatacagagaagaagcgggtgtggaactgtggaagggcaaggctcaaaagctaaaaacactttattcctaaatcaccccatagactttgtatttgtatctgaaataacctttgtttaccataattattcgacacactttgggactttttgttatttgtttgttatacatcaaatgagtaaataactcttttatccaaatttataaccatcgtctatttgcaagcttattcattttggcacaaccttaggtgaatgaactgtatcataaccagtcatgggtccaagtaaatgaacatttaagtttgaaacctcaaatacattatacataactaaatacatccacactactttagaaaaacttaaatttgaattatgaaacaaacaaactactaaagtaaacttaaatttgtttttgtaatcttggttaattaatctggattttagtattttttttgccaaaactggattctaattttgaagtcgaggtaacaaataaaaattattggcaaatataagggggttacgtagaataaagaattgttaatggggtgattttagaaataaaatagttttaagcttctgctttgcccttccccacccgctccttccttatattcgaaattcacattcacctctctcagtctcctcattatctctgcctcctttccacacagtcgactctttttctctctgcaagtctagggtttttctgatccaccagaggtttttcccctgcttcgagcgccgtcttggagaagctttttctcgataggctttgcagtgacagggacacagggtttggattgaagcgaaaaaccctagcgtttacgcgtcttctcaagcgaaaaaatccttaatttccacgtaagtctattgcttgtagtgtgtattgagttcgggatttgcatatctgttactggatctatgttttctgattaggttattgggtcactactactgctagggtttttaattttgctgggattttaatttggttctttactcgctcgctgtgttcttcacgattagggtttaagcttttttcgaagttcaaagacattgttgagtcaactttggttcggattttatactggaatttgtttgtagtgatttttttgttaattactcagagcagagattctcctatggttttctctgagtatagatattaatttgtttgctctctggattgaacctttgtacggtttgaatagtattattgccttctatactcataccattactttgttcagtagcttttacttttgcttagaattgtgctggatgtgattctatttgactactgttttgtcgctgatactggtgtatgtctttattgtgcagagagaagaatg

SEQ ID NO: 31469 - DNA, 3000 bp, Unknown; identical to SEQ ID NO: 9563
  misc_feature (1)..( 3000): 2750-1469P.txt file - cDNA_ID_3042446; gDNA_ID_1972154; Annot_ID_179406

SEQ ID NO: 31470 - DNA, 3000 bp, Unknown; identical to SEQ ID NO: 9559
  misc_feature (1)..( 3000): 2750-1469P.txt file - cDNA_ID_3042454; gDNA_ID_1972154; Annot_ID_179403

SEQ ID NO: 31471 - DNA, 3 bp, Unknown
  misc_feature (1)..( 3): 2750-1469P.txt file - cDNA_ID_3042454; gDNA_ID_1971936; Annot_ID_177247
gat

SEQ ID NO: 31472 - DNA, 3000 bp, Unknown
  misc_feature (1)..( 3000): 2750-1469P.txt file - cDNA_ID_3042461; gDNA_ID_1972154; Annot_ID_179398
tagatatgtgcaacggaagtgatcgtcttggacaaagagaagctgaaggtatattctattgatggtctttaccattatttttagggttttaaattttgttctcaattttgtttctgcctttggcttacaagttactagagattctgtagaattcgagaatggttgaccaaatatcaagtcacttcatcttaatcttgtgtgctaattagaacatggaatttgtattatttgatgatatctcacaaaagttctctggtcttttgaaaaatcagagatttgcaccaacaatgtgagggtcttttcatataattcattaagatcagccactgatagtttccatccaacgaacagaatcggaggtggtggctatggcgttgtctttaaggtaataaaaatgataacttctcttacaatctgcttaaatcatgttgaggttcttctggtgaatgtagtaaagggttttgaatcttgcagggagttttgagagatggcacacaagtagctgtgaaatcactatcagcagaatctaaacaagggacacgcgagttcttgaccgagattaacttgatatcaaacattcatcatcctaaccttgttaaactcatcggttgctgcatcgaagggaacaatcggattcttgtctatgagtaccttgagaacaacagtcttgctagtgttttgcttggtaacttttgccacaattgcattcttgtctaccaaatcccatttgtgtcctgtttttctgatcttgtttgagtgatatcaggttcaaggagtagatatgtaccgcttgattggtccaaaagagctgcgatttgcgttgggacagcttcgggtttagctttccttcacgaggaagtcgaacctcatgttgttcaccgtgacatcaaggcgagtaatatcttactagactcaaacttttctcccaaaattggtgatttcgggttggctaagctttttccagacaatgtcactcatgtcagtacccgagtcgctggaacagtgtaagaatccctctataaacatatcagtttccatctttcctctacatgtattttcagctgatgaaactgcgactacaggggatacttggctccagaatatgcacttcttggtcaactgacaaaaaaagcagacgtttacagcttcgggatacttgtgcttgaggtcattagtggtaatagtagcaccagagccgcctttggagacgagtacatggttcttgttgaatgggtaaagctaaaagcctcgtacctcaacaaaaatatatatagctctatgtttgtgttaatgtttcttacaagtgaaaaaataatacattttcaaaatgtaaaatgcgaaaacaaacaatattcaatgctttaaactctgtcttgggcaggtgtggaagctgagagaagaaaggaggctactagagtgtgtagatccagaactaaccaagttccccgcagatgaagtgacccgtttcatcaaggtggctcttttctgcactcaagccgcggcgcaaaagagaccaaacatgaagcaagtgatggagatgcttcgcaggaaagagcttaacctcaacgaggatgccttaacggaacctggcgtctacagaggtgtcaacaggggacgcaaccaccgtggaatcggtcttagggtcggccaaggaggcagctcacaggagagctcgtcaacgcaacgtgacaaagggaaaagctcagccgttcctcaagggtcgacgtccaactctaatatttccttccagagcatcacagagttggctcctagatgatttttttctgttaatagagcacaattttattcttgagtatattaattagtttatgatgtgttaatatcttatacatagggtatatatgaataaaccaaagatgctatctgataaaatgttatgtagttgtctgacatttccctttgtgtcagaagccagcagtttaaaattatgattggcatgattttgcaacattcttgtattcaatgatttggcttgatttgcaacattcttgaaatgaatgattgataccttattaacttactaaaccatcggcaataatgagatgagtataatattattgggaacagatttttatgcaactaactatgcgagctttcaattgtcaaagtcaagatgcttccataacttgacaagttgtttggatgaaagatgtatatggacttatttccaattcaattatgttgtacgtgaaaaaacaaaaaacaatatgaaggatggattagacaataaaaaaatctgatgaaactaaatataacaaactgaactacgaggaaagtgcctgacacatctttagtacctcgctttgagccttttaaggtgccttcttagttatagcaagaaaatagttaaattcaacgaaataaatgttttatttgtcagtcaactatatgaaagtaagcgtgtttataattaggaagaatttttttaactactaaaattccaccataggcggcctaataattaataacaattatgaaagctagaagattaagaccatatcaaaagacagattaatagttgctttgtccttgcaagaaatatttatttaaaaattacgagaagattctaaagatcatcaacatgtaataaaaagattcaaaataatggataatgtagctgtgctcactaaattgatatatccaaaaagaaccaaaatatatcaatccgaaaataatgaacagggtcctaatggatataatcatagagatgatcacagaaaagtcgtctatatgtagcaaaaataaaagtgaaatgtggataaatcatgatcatttatttaagcgtatggtcccattttaattacataacaaataataatctacgtccaagtcagcctgctttggctgcttaagaacttttcaaaacacgacagcttcttcaccaagcaagcaagaaactcaacacaaattataagagaaaaacaaaaaaatacagacttcactatttttttcttctcctaacttattttccaaaaaatg

SEQ ID NO: 31473 - DNA, 3003 bp, Unknown
  misc_feature (1)..( 3003): 2750-1469P.txt file - cDNA_ID_3042461; gDNA_ID_1971936; Annot_ID_177252
ttctagatatgtgcaacggaagtgatcgtcttggacaaagagaagctgaaggtatattctattgatggtctttaccattatttttagggttttaaattttgttctcaattttgtttctgcctttggcttacaagttactagagattctgtagaattcgagaatggttgaccaaatatcaagtcacttcatcttaatcttgtgtgctaattagaacatggaatttgtattatttgatgatatctcacaaaagttctctggtcttttgaaaaatcagagatttgcaccaacaatgtgagggtcttttcatataattcattaagatcagccactgatagtttccatccaacgaacagaatcggaggtggtggctatggcgttgtctttaaggtaataaaaatgataacttctcttacaatctgcttaaatcatgttgaggttcttctggtgaatgtagtaaagggttttgaatcttgcagggagttttgagagatggcacacaagtagctgtgaaatcactatcagcagaatctaaacaagggacacgcgagttcttgaccgagattaacttgatatcaaacattcatcatcctaaccttgttaaactcatcggttgctgcatcgaagggaacaatcggattcttgtctatgagtaccttgagaacaacagtcttgctagtgttttgcttggtaacttttgccacaattgcattcttgtctaccaaatcccatttgtgtcctgtttttctgatcttgtttgagtgatatcaggttcaaggagtagatatgtaccgcttgattggtccaaaagagctgcgatttgcgttgggacagcttcgggtttagctttccttcacgaggaagtcgaacctcatgttgttcaccgtgacatcaaggcgagtaatatcttactagactcaaacttttctcccaaaattggtgatttcgggttggctaagctttttccagacaatgtcactcatgtcagtacccgagtcgctggaacagtgtaagaatccctctataaacatatcagtttccatctttcctctacatgtattttcagctgatgaaactgcgactacaggggatacttggctccagaatatgcacttcttggtcaactgacaaaaaaagcagacgtttacagcttcgggatacttgtgcttgaggtcattagtggtaatagtagcaccagagccgcctttggagacgagtacatggttcttgttgaatgggtaaagctaaaagcctcgtacctcaacaaaaatatatatagctctatgtttgtgttaatgtttcttacaagtgaaaaaataatacattttcaaaatgtaaaatgcgaaaacaaacaatattcaatgctttaaactctgtcttgggcaggtgtggaagctgagagaagaaaggaggctactagagtgtgtagatccagaactaaccaagttccccgcagatgaagtgacccgtttcatcaaggtggctcttttctgcactcaagccgcggcgcaaaagagaccaaacatgaagcaagtgatggagatgcttcgcaggaaagagcttaacctcaacgaggatgccttaacggaacctggcgtctacagaggtgtcaacaggggacgcaaccaccgtggaatcggtcttagggtcggccaaggaggcagctcacaggagagctcgtcaacgcaacgtgacaaagggaaaagctcagccgttcctcaagggtcgacgtccaactctaatatttccttccagagcatcacagagttggctcctagatgatttttttctgttaatagagcacaattttattcttgagtatattaattagtttatgatgtgttaatatcttatacatagggtatatatgaataaaccaaagatgctatctgataaaatgttatgtagttgtctgacatttccctttgtgtcagaagccagcagtttaaaattatgattggcatgattttgcaacattcttgtattcaatgatttggcttgatttgcaacattcttgaaatgaatgattgataccttattaacttactaaaccatcggcaataatgagatgagtataatattattgggaacagatttttatgcaactaactatgcgagctttcaattgtcaaagtcaagatgcttccataacttgacaagttgtttggatgaaagatgtatatggacttatttccaattcaattatgttgtacgtgaaaaaacaaaaaacaatatgaaggatggattagacaataaaaaaatctgatgaaactaaatataacaaactgaactacgaggaaagtgcctgacacatctttagtacctcgctttgagccttttaaggtgccttcttagttatagcaagaaaatagttaaattcaacgaaataaatgttttatttgtcagtcaactatatgaaagtaagcgtgtttataattaggaagaatttttttaactactaaaattccaccataggcggcctaataattaataacaattatgaaagctagaagattaagaccatatcaaaagacagattaatagttgctttgtccttgcaagaaatatttatttaaaaattacgagaagattctaaagatcatcaacatgtaataaaaagattcaaaataatggataatgtagctgtgctcactaaattgatatatccaaaaagaaccaaaatatatcaatccgaaaataatgaacagggtcctaatggatataatcatagagatgatcacagaaaagtcgtctatatgtagcaaaaataaaagtgaaatgtggataaatcatgatcatttatttaagcgtatggtcccattttaattacataacaaataataatctacgtccaagtcagcctgctttggctgcttaagaacttttcaaaacacgacagcttcttcaccaagcaagcaagaaactcaacacaaattataagagaaaaacaaaaaaatacagacttcactatttttttcttctcctaacttattttccaaaaaatg

SEQ ID NO: 31474 - DNA, 3000 bp, Unknown
  misc_feature (1)..( 3000): 2750-1469P.txt file - cDNA_ID_3042465; gDNA_ID_1972154; Annot_ID_179397
gagatgcttcgcaggaaagagcttaacctcaacgaggatgccttaacggaacctggcgtctacagaggtgtcaacaggggacgcaaccaccgtggaatcggtcttagggtcggccaaggaggcagctcacaggagagctcgtcaacgcaacgtgacaaagggaaaagctcagccgttcctcaagggtcgacgtccaactctaatatttccttccagagcatcacagagttggctcctagatgatttttttctgttaatagagcacaattttattcttgagtatattaattagtttatgatgtgttaatatcttatacatagggtatatatgaataaaccaaagatgctatctgataaaatgttatgtagttgtctgacatttccctttgtgtcagaagccagcagtttaaaattatgattggcatgattttgcaacattcttgtattcaatgatttggcttgatttgcaacattcttgaaatgaatgattgataccttattaacttactaaaccatcggcaataatgagatgagtataatattattgggaacagatttttatgcaactaactatgcgagctttcaattgtcaaagtcaagatgcttccataacttgacaagttgtttggatgaaagatgtatatggacttatttccaattcaattatgttgtacgtgaaaaaacaaaaaacaatatgaaggatggattagacaataaaaaaatctgatgaaactaaatataacaaactgaactacgaggaaagtgcctgacacatctttagtacctcgctttgagccttttaaggtgccttcttagttatagcaagaaaatagttaaattcaacgaaataaatgttttatttgtcagtcaactatatgaaagtaagcgtgtttataattaggaagaatttttttaactactaaaattccaccataggcggcctaataattaataacaattatgaaagctagaagattaagaccatatcaaaagacagattaatagttgctttgtccttgcaagaaatatttatttaaaaattacgagaagattctaaagatcatcaacatgtaataaaaagattcaaaataatggataatgtagctgtgctcactaaattgatatatccaaaaagaaccaaaatatatcaatccgaaaataatgaacagggtcctaatggatataatcatagagatgatcacagaaaagtcgtctatatgtagcaaaaataaaagtgaaatgtggataaatcatgatcatttatttaagcgtatggtcccattttaattacataacaaataataatctacgtccaagtcagcctgctttggctgcttaagaacttttcaaaacacgacagcttcttcaccaagcaagcaagaaactcaacacaaattataagagaaaaacaaaaaaatacagacttcactatttttttcttctcctaacttattttccaaaaaatggatcatgacatcacgacgaaagtcagggcgatgtttgatcaccgtaggttaaaccgctctggatcatcactcttcacagcgtttgcttccacggttatagctctggtcgttttcaccatcgttctcgtctctaatttatcggtgagagaagatttctcagcgaaggtggtgacaatagagatcaagacaattgttccttacttacctctaagctcagagaaggaggtaagtgatcaagtcaacaataactattcgatcaagcaacaaatcacagtcaaagaagagattaacaaactgcaagttcttgaagtttttggaggcaaagacgtgtcggagaagtttcaacagagagcaacagagtttttgagagatgattgtgaggtcaagttcatgatgacatggatctcacctgcggaattgttcggtaagagagagatattatctgtagaaagcgtattcaaatctcatgctagaggttgtttgatgattttatcatccacaatggattctcttcaagggtttagaatcctgaaaccgtttcttgatcgaggttacagagttatggcggtcacgccggatttgccttttcttctcaaggacacagccggagaatcttggcttgaagagattcagaccggtaaaagagatccaggaaagatctctctagctcagaatctatcaaacctcatgagacttgcttatttgttcaaattcggaggtgtttatctagacacagacatgattgttttaaagagctttaaaactctaaggaacgtgatcggtgcgcagactctggagccggtttcgagaaactggacaagattgaacaatgcggtattgatcttcgacaagaatcatccattcttgctcaaatccattgaagaatttgcgttgacttttaatggaaacgtttggggacataacggaccgtatcttgtttcacgagtggctcgagccgtggaaggaaccgatggctataacttcaccatcttgacacctcctgcgttttatccagtgaattgggttgagattgagaagctattcaaggttccaagaacagagaaagattcaaagagagttcaagtcaaggttcttgaaatgcagaagagaagctatggattgcatttgtggaataagtttagcagaaaattcgaaattgaacaaggaagtgccatggataaattggtttcaaatcaatgtataatttgtgacagtgttgtatctgtatcatgacttttcttttttcattttgtaattccattgtagaatagcttgtaaattgtaattaacaatgaaaccctcagtttttttcatttctttcaatttaaaccctgattaaaatcaatctctctataaagctcctatcaggatggttctggctttttatgtttgggctgataattatcctatagagattagcacaggcccatataagttgacaagtcatcagttacaattacgtttcttcttcacacagcccaattagcaaaaactcggttcaagctgaaatcgaaactcgaaccggactgtgatg

SEQ ID NO: 31475 - DNA, 3000 bp, Unknown
  misc_feature (1)..( 3000): 2750-1469P.txt file - cDNA_ID_3042486; gDNA_ID_2684231; Annot_ID_192275
tttatttttctatcaaaatgaattgcttaaaggtgaaaacttgtgaaagatatttccaggtttctaacattatatacataacatagtctccattaatcatcatgaatactaccccaataaaaagtaaatcaagaacaaaaaaaaacataattcaatcaacagcacctgatacaaaaatatcaaactatcagtgtgcttaaacaatgaaacgacataatagtattaaactatcagtgtgcttaaacaatgaaactacataatagtatcaagagaataatacttgccgagtcatacccattatcatctactgatatatatatttttgtcttatgttaagatcagtctactagaaatgagacttcattattttttataaatgtcaaaataacatagaacatcagaacatataaactaaagcttaaagtttacacttttttttttttttataactttattagatgcattgataaattatcatttcatttactccacagctctcaattgaacataacccatatccttggccatctttctcagaacattctttcgaatcttcccagtgggagtcttaggaacatccgagaagactactgtctttggaatcatcttcatgttcttattcccaagctttctcttgcagaactcaatgatctcttcctctctcgcttcagctccttctttgagcttcacgaaagcacacatcgattctcctaaagtttcgtccggtcgacccacgacccctgcgtcataaaccgccgggtgactatagagaatcccttcgatctcctttgatcccacgatttctcctccgcatgttataacatcttgtgacctatctttaaattgtatgtagcttcgcatgtggaaacatcataagcataaataaattcaaagtaatacattcaaagtaatgcatgattcatttacttacccatcaggatctataacacccatgtcgcgactccagtaccatccacctcgaaaagccgcttcagtggcttccttgtccttgaagtaaccgctcatgactgtatttccccggagagcaattaccctgatagtctttccgtcgtgtggaaccgatttcatggtggttgggtccaatacatcgacagcttccttggcgaaatggttgagaccatctcttgccttgagccttaaactctcctcttcaggtagagtctcccactcgggcatccacaaacaagctgttcctagtccatacacctccgagcatccataagccatcatcactttgaatcctagcttcttgagtttcaacatgacctgtccaaataaattaatatctttactatgattctatgttaaatattaatgtactgtgacggagctaacgtataaagcaagggattgattatatataacctcaaaatatggaagttcaaccaaataagcctgattgaacaaacatgtaattcaaaactctgtgatagttagttttacctcaggaggagaggatcctccgctcataacctgtacggtccatggaaacgacttcttgaccgagtctcttgcattagcaatcatgttgagaaccggaggcgagccaccaaagttagttaccttgtgcttcacgatactatcaaatataacttcgtcgttgacttccctgagacagacgatgactcctccaaaagccgtaactgtccaaatatagcaccacccgctacaatgatacataggaactgtacatagataaaccggcattggtttcatctcattcataacaccaacagcagttgcgttcagataggcaccgcgatgactatagacgacacatttgggagtcgatgtggttccagatgtgaagttgagggcgattggatcacattcgtcaactggtcgtattggtttgaaattagggtttccagtggagagaaaatcctcgtattgttcatattttgattgctctgttggattttctgtgattgtgatgatgagaggtttttcttcaatgtttgagaggagactgagagattcttcagcgacagagaggaactcagagtcaacgaagaatacttttggcttcgttttctccagcgccatcgcaagcatctgagaatcgaatgtcgtgttcaacacgcaaagtactgctccagccatcggagctccaaaataaagctcgcataacgcaggaacatttggcgctaaagcagccacctgataaaagaaatagtttaaacaaaagaaaaaagtatgaccaatatataaaagtcgtttaaccacttacaacgtcatggcgagagagaccaaggtcagagagagcagatgcaaggcggacgcaacggtcacgtgtttggtgccacgtgtactgaatatcaccatacacgacagaggttctggagccgaagacgacagcagctctctcgagaaagctgatcggagaaagcgggacgtaattcgctgagcacctcattgttccttccatttcttttctattgttattctctattgagctactaaaatcatataaaaattgtggagtatttataggcaaactattttgtgtaacgctccaaacaattaatatggaatctttgattaatatggactacaagaagccaaattggcaattaaatcagaatctgtgaagaagatttgtacattgcaacatctgtttagagaatctgagttgtcacaacttttttttttgaatctaatcaccactcggctagttgtcacaagtgtagaggagctttaatttacaaacagttcttatctttttatttttttgggtcaactaaacaaatcttatcttatcttatactaataaaacttaagagtaaaaacaaagtaacaaaaaaggcacacaacattcaactaatgggcccaataaactaatgggccgatccaaaatctaaataagaagtccataagagtgtggagctttaacgagagaagctaaattgttcaaagctttttggctgctaaaaaggaaaagggaaggttcaattagggtttagtgaatcgacgaagatg

SEQ ID NO: 31476 - DNA, 3003 bp, Unknown
  misc_feature (1)..( 3003): 2750-1469P.txt file - cDNA_ID_3042486; gDNA_ID_1972155; Annot_ID_179469
atatttatttttctatcaaaatgaattgcttaaaggtgaaaacttgtgaaagatatttccaggtttctaacattatatacataacatagtctccattaatcatcatgaatactaccccaataaaaagtaaatcaagaacaaaaaaaaacataattcaatcaacagcacctgatacaaaaatatcaaactatcagtgtgcttaaacaatgaaacgacataatagtattaaactatcagtgtgcttaaacaatgaaactacataatagtatcaagagaataatacttgccgagtcatacccattatcatctactgatatatatatttttgtcttatgttaagatcagtctactagaaatgagacttcattattttttataaatgtcaaaataacatagaacatcagaacatataaactaaagcttaaagtttacacttttttttttttttataactttattagatgcattgataaattatcatttcatttactccacagctctcaattgaacataacccatatccttggccatctttctcagaacattctttcgaatcttcccagtgggagtcttaggaacatccgagaagactactgtctttggaatcatcttcatgttcttattcccaagctttctcttgcagaactcaatgatctcttcctctctcgcttcagctccttctttgagcttcacgaaagcacacatcgattctcctaaagtttcgtccggtcgacccacgacccctgcgtcataaaccgccgggtgactatagagaatcccttcgatctcctttgatcccacgatttctcctccgcatgttataacatcttgtgacctatctttaaattgtatgtagcttcgcatgtggaaacatcataagcataaataaattcaaagtaatacattcaaagtaatgcatgattcatttacttacccatcaggatctataacacccatgtcgcgactccagtaccatccacctcgaaaagccgcttcagtggcttccttgtccttgaagtaaccgctcatgactgtatttccccggagagcaattaccctgatagtctttccgtcgtgtggaaccgatttcatggtggttgggtccaatacatcgacagcttccttggcgaaatggttgagaccatctcttgccttgagccttaaactctcctcttcaggtagagtctcccactcgggcatccacaaacaagctgttcctagtccatacacctccgagcatccataagccatcatcactttgaatcctagcttcttgagtttcaacatgacctgtccaaataaattaatatctttactatgattctatgttaaatattaatgtactgtgacggagctaacgtataaagcaagggattgattatatataacctcaaaatatggaagttcaaccaaataagcctgattgaacaaacatgtaattcaaaactctgtgatagttagttttacctcaggaggagaggatcctccgctcataacctgtacggtccatggaaacgacttcttgaccgagtctcttgcattagcaatcatgttgagaaccggaggcgagccaccaaagttagttaccttgtgcttcacgatactatcaaatataacttcgtcgttgacttccctgagacagacgatgactcctccaaaagccgtaactgtccaaatatagcaccacccgctacaatgatacataggaactgtacatagataaaccggcattggtttcatctcattcataacaccaacagcagttgcgttcagataggcaccgcgatgactatagacgacacatttgggagtcgatgtggttccagatgtgaagttgagggcgattggatcacattcgtcaactggtcgtattggtttgaaattagggtttccagtggagagaaaatcctcgtattgttcatattttgattgctctgttggattttctgtgattgtgatgatgagaggtttttcttcaatgtttgagaggagactgagagattcttcagcgacagagaggaactcagagtcaacgaagaatacttttggcttcgttttctccagcgccatcgcaagcatctgagaatcgaatgtcgtgttcaacacgcaaagtactgctccagccatcggagctccaaaataaagctcgcataacgcaggaacatttggcgctaaagcagccacctgataaaagaaatagtttaaacaaaagaaaaaagtatgaccaatatataaaagtcgtttaaccacttacaacgtcatggcgagagagaccaaggtcagagagagcagatgcaaggcggacgcaacggtcacgtgtttggtgccacgtgtactgaatatcaccatacacgacagaggttctggagccgaagacgacagcagctctctcgagaaagctgatcggagaaagcgggacgtaattcgctgagcacctcattgttccttccatttcttttctattgttattctctattgagctactaaaatcatataaaaattgtggagtatttataggcaaactattttgtgtaacgctccaaacaattaatatggaatctttgattaatatggactacaagaagccaaattggcaattaaatcagaatctgtgaagaagatttgtacattgcaacatctgtttagagaatctgagttgtcacaacttttttttttgaatctaatcaccactcggctagttgtcacaagtgtagaggagctttaatttacaaacagttcttatctttttatttttttgggtcaactaaacaaatcttatcttatcttatactaataaaacttaagagtaaaaacaaagtaacaaaaaaggcacacaacattcaactaatgggcccaataaactaatgggccgatccaaaatctaaataagaagtccataagagtgtggagctttaacgagagaagctaaattgttcaaagctttttggctgctaaaaaggaaaagggaaggttcaattagggtttagtgaatcgacgaagatg

SEQ ID NO: 31477 - DNA, 3000 bp, Unknown; identical to SEQ ID NO: 31475
  misc_feature (1)..( 3000): 2750-1469P.txt file - cDNA_ID_3042486; gDNA_ID_2684231; Annot_ID_137621

SEQ ID NO: 31478 - DNA, 3003 bp, Unknown
  misc_feature (1)..( 3003): 2750-1469P.txt file - cDNA_ID_3042490; gDNA_ID_1972155; Annot_ID_179465
catgagaaaataatggattaacaaaataataataataatataacagaaacaaattactcgatgttaaaatgctagttttactagactacttatattatcatgttaaaatcactttttcaaacatgaaatgtcaaaatgttctaaaatgttatgaataatatcaactcaataaacgtaaattgatactcaacaaaagtttataccaatgtatatatatatttataatacttaatgccatactgcgcattaaccatttacttgataaaaaatacacgaaaaagcttacggattcacatcatcaccacgccacacattagcatcatcatgccacgcattagccatttcgtaaaattattaccataaattaaaaaaatacaagaaaaaacagaatacctttttccatacaaacaatatactatgtgaatttacaagctgtcagattaatcaagatcttctttatcaggaaacgtgggtccggataaggtaaggggtcaatttcagtctcggactagtcggctacaaaatcttgcgagttgctaaacaatagaaatttcaaagataatcataacttcaatctcaacctaacagtctcatactattaactatagaacccgaatcgagaaagaggcaataactcatagtattaacaaatatagtcaacaattaattgctatcacacccatatcttagagacatccgttaatacctttagaagcgtcatttttgaccgcaattttgttataaagtaacgaggaaataaaaaagaatatcatattggatgggattgtgacaacatcaaataccaaacccatcatcaaacaaaaaatcccttcacatgagtaacgtacggatcaagaaacggttacaccaaccctaaacctctccaactaaacggaggtccccgctcctgatcactttcttatccttaattatatattcccgaattttatgcacttaaaaatttaatgtaatactccaacatttaattaattgaaagttagtgaaaagaatttataaggtaaggaagttcaaaagagtcgataaattaccttaatgccattgggcgaattcataggtgtgaggactcgaaccatcggctcagtctcattgattggcttaggctcaaagatacgaacccaagcaagtcttggtgcgtccttaagtaaccgaagtttgaaagaatttttgtcgagaggactattaagaaacaaatcagcattaggataaaccctcaagatcttctccataatcgacggtccggttaactcaaaccgcctcgctcctcctaccaaacacaccgcaatcttcgacttaaccaactcctccctcttcctccgccgtcgattttccatctcctccgcttggataacgtcgttagggttcgaatctgacaattcgacggtgaaatcggtgacggttagggtatgagtgtagattaggttacgaagaggggctagagttggaaaaggatcaagtgagagagatgagaaagagattaagacgaggagggtgagagatgggattatgagaaggaggagaagacgacgatcgacgtcggagattctcctggaaacgtacataacggcggcgtaagtgatcgtaaccctaatctgtgagaataaccaccaccgtggattgttcacacacgtttcatttgccgagagagagatttttgtatttatagagttttgattttcttcaaaacttttgaagtgattcggagaggcgctggtttgttggagtggaaggtgaaatcaacattacgcgtgggtttggttttcgttttctcttttcttctagagagagatatgaaatatctatgtagctctgtataaaaccgatgcataattaattaaaatatacgtatttgattacgttttcaaaaaggaaatgatcaatgttacttttgtttttttcacgtttctttgtttgcttagtaaataatttatgaatgtttgaaatactttggtgaatagttttagtgctcgatcgttacagtaatcaattcgaataaactcttcactaaatatgctcgttacagtcttcacgtttattgtaactgttagacccccactcattgtgtattaggggatgttgacaagtatattgaagagattgatatcttgaaaggcgtacgtggactagtaaagaaatggatagtttgggttgcaagaaaagttttactttttgtattcaacaaaaggaaaagaaaagtattttttgttatccaagatatgactttatgtagtatattcatttgagagcattgtattaattagaatgttcacatatatcaatatataattatatatagaatttgctcttcaattgtaaagaagaaatgaggttccaaatttgttattagtgctctaaacatatatttttattaccttagaaattaatatataatatttctttctttgctttcccatgactttttactgtttttggtaacaagataatactttccctagtatataagatttttaaagcttttttgttgttgttcccaattagtttttctctagtttctagtcataatttatattaattccatagtttatgattatttaaattatgcagtattttttattggttaaatttttattaatgataaaacatgtgattttagccaaaacatctaataaaatgggacatatggagtactacaatagtgatagatcttttatttacctgtttattatatatgaatctattcaattttcatttatttacatgtttatttaaattatttatttaatttgcatctaaaatttgcaaaactattgttgggccatgagtgtcaactgtcaaatgtcaaccatagaagcaaaaataaaacagtttatgattcagtttgtaaaagtgggcttatttaaatgaatattggcccattagtatcatcttcacgaaacccagcaaaatcagagagcggcaaatcgttgaagagagatcttcttcttcctgaatccgtaacgttagctcaggcgtaagagcataatg

SEQ ID NO: 31479 - DNA, 3000 bp, Unknown; identical to SEQ ID NO: 9572
  misc_feature (1)..( 3000): 2750-1469P.txt file - cDNA_ID_3042504; gDNA_ID_1972155; Annot_ID_179452

SEQ ID NO: 31480 - DNA, 3003 bp, Unknown
  misc_feature (1)..( 3003): 2750-1469P.txt file - cDNA_ID_3042510; gDNA_ID_1972155; Annot_ID_179445
atcttttatatgacgacgacgttggaggataacaaatcaattcattagtgtcaccttacaacacaaaaatatactaatttgattaaaaagttacaaaaatggtgggattaaccaacaataacaaaaacaatgtcaaaatcttcaaactaagcttccatcattttgcttagagactatgacttgctctttcatcaattttcttatgaacaagaacttggtctgtgttttgtccacagctgccaaagtttaggtctggatagtttctatagttcaaggaatgtaaccaaagagccatatttccgtattttcgctctgtagcgccgatatgagaatagatatgcttcaatttgaatgcttcagcttcttctttgtatgcttccatggacacttcttcatgactgtcttcaaagtttctgttataagacgtgaagaagcattcgtccagataaagtccaacttctggcgccattggtacagttatattcacatccctggttacataatttccgaactgagtatcaaaacaaacaaaactatagacattgcaaagcttcaaaaccaaagaaaaaggagaagcttacttgctgaaagcactttggataagtgattcagaagcacaattccgcatgattgcaacagcaagacccatcatcttccgaatctgatgaagcataaagcttttgcctaagacttcacacttgataaagtcaatcccatcaagattaatcacagtattagcagtgaaggagatgatttgacgattcgcagtcggatcatctgcttttgttcttgtagtgaagttatggaaattatatgatccaacataacaacttagtattctactgaacctttccttttccttttcaccataacaaaacttgctctttaccttagtctctgatgaatttgtattcaatttacaactgtcttcttgtatcctacctacttcaacatctactgagcataagccagctaaattagaactcaaagcttcaatcttgatgtcacttcttaatgcactagagttgttcgacgaaatgtctgactgaaaatccaatgatttagtcccaaagttggtacctttccatttacccacaagacctggaggaatcttacgacctctctctgagcactcaaagcacttaacatattcctctcccggacccaaactagccattactgtttctctatcacgatgcgagattggatcaagagcaaacactggaagcagatacacataccttcttcgatcgcaaaacttcttggagctaaacgacggcgttacatgcttgtaaccgaagattctaatctgattagggagatttgaattgagacgattcacgaatccaagtggatcaacgataaagcgacctgaaactacttgtccaacagcactaactcctttatctgtccgtgcagatcgtgcgaaatcgtatagttttggcttgcctctaatggactccggtacagctccggcatgaaacaaagcttcttcgagctcgccttcaatggttttcgcgccgggattcttttgcattccttggtatcctacaccacaaaacgcgaagattatagcaactttttgaggctccgtgacacctccgtcgcaggacaagtctatttcctcatcggtggtagttgtcaacatattgagctacttctgatctgattctcaatcaggaacctcgaaccgggggaaatctctcggttttcaaactcctgagcctccattatagtaacaagagttcatcgaactctctattttccagctttcctctgcaacaacgttaatggctaccgcacaaaagtcgaaacccttgaagacgactgaggtatgcttctctacgacggcgtttttgatatcagaccgctctttaactgggcctataattttgttttatatatgggcttattagtctcaagcccaaatgtttctcttataattcaagtcaaatttgaaaaagtcaactatatccattgagcacacatctttggaaatacagtctgttctagtgggcaaaagaaagagagaaaattatagccgttctaattgtatcaaagtatgaaactttcaaatctccttgaggtataggcgttgttgtcttgctgatggtacacgcgtcgtatgaaaaagcgtacacaaatcttatttcaattgaagttatcgactttattctaacagtcaacgcgtgtctagatttttcttcaggtggacgaagaagaaaaaaaaaaactactttggcaaattatgaatcttcgtttctcgattgagttttaaaaccctaaaaattcaaaagagagaaaaaaagacatagcttttaatctctgagattctctgctcaagttgtttacagctttctactttttgaagaaggtattgtattctataattggctcatctcttgatgaataccgtagaatcgaatcgacactttgtgtttgtgggtatagtccaatttgctcttttaattcttcttcttcattgtaacatttataaaaggtttgttttttgtgtggccgaaagttgtttgacatttgattctgattcgtttgggatcagaaactgtttaatcacttcacgttctctcttcggctctatatatatatatgtaggattgtttctttaagggacttgtgtgatttagcttcttcgtttccttggtatttgatcttcttttatgtgtgtgatcttgttaaacagaattttggttagcctataatcaatctcaaattggaaacagaattttgtttttgtttcatttatctgtcatgaaacaaatgttgctcttcactgatttttttatcttagtggaaatgtttggaatttaggatcttttgatttattagtttgctgcttcagaacacatactggtttgtgtctcaatacgcttattacttattgttttggatctctctgaaatggtatcattctgtatgcaggtaatcgttctgttttttcgttgattactgtttgaggttttcattgaatcttgtctcgacatg

SEQ ID NO: 31481 - DNA, 3000 bp, Unknown; identical to SEQ ID NO: 9567
  misc_feature (1)..( 3000): 2750-1469P.txt file - cDNA_ID_3042522; gDNA_ID_1972155; Annot_ID_179440

SEQ ID NO: 31482 - DNA, 3003 bp, Unknown
  misc_feature (1)..( 3003): 2750-1469P.txt file - cDNA_ID_3042532; gDNA_ID_1972158; Annot_ID_179502
gatacttagagagaaactagagcaagatccaacacatgtccctgttattacatccccggatttagaatccgagaagcagtctcaacgatcagcttcatcttctgcttctgcttacaagattgctgcttcagctgcgtcttacattcactcttgcaaagagtatgatctttcagaaccaatttataaatcagctgctgctgctcaggctgcagcgtctaccatgaccgcggtggttgctgcgggtgaggaggagaagctagaagcggcaagggagttacagtcgctacaatcatctccttgtgagtggtttgtttgtgatgatccaaacacatacactaggtgctttgtgattcaggtaatatgtgttcaaagttactactttcaagcaaatcctctgtttcctcacatcatgatccttgaatctgctagctaattagtgttatgtcgttgcagggatctgattctttagcttcttggaaagcaaaccttttcttcgagccaactaagtttgaggtaaagatcttgatcttggctagggatgtacatttggtttttgattcggttatttaactcggtttatccaatcgcttaggttacattacaattattttggtttgtgtttatcctagagaccttaagatattgatatgaatgtcgcaggacacagatgtattagtccacagaggaatctacgaggcagcaaaaggaatatacgaacagttcttaccagaaataacagagcatttgtctagacatggagatagagctaagtttcagttcacgggtcattctcttggaggcagtctctcattaatagtgaatttgatgcttatctctagaggactcgttagctctgaagctatgaaatccgttgtcacgttcggttcaccgtttgtgttttgtggtggtgagaagattctagcggagcttggtcttgacgagagtcatgttcactgtgtgatgatgcatagagatatcgtcccacgagccttttcgtgtaattatcctgaccatgttgctctcgttctcaagcgtttgaatggctccttccgtacacatccttgtctcaacaaaaatgtaagtcttactataatttcctttttggcttaacgttttgaacatcttaaattaaaaatacggatgttgaagttttttggttgtgtttttgcgttttgacagaaactgttgtattcaccgatggggaaagtatatattctacagccgagtgagagcgtctcgccgacgcacccatggcttccaccgggaaacgctctgtacattttagaaaatagcaacgaaggttactctcctacggcgttacgagcatttttaaaccgccctcacccgctcgaaacgctgagtcaacgcgcagcttatggctcggaaggttcagtcttgagggaccacgactccaagaactacgttaaggccgtgaacggagttctcaggcagcacacgaagctcatagttaggaaagccaggatacaaaggaggagtgtttggcccgtgctgacatcagcaggacgtggattaaacgagagcctgacgacggccgaggagatcatgacacgtgtctaatgaaggaaaatgtacggttgtatataagtggaatcacttctgattatgcgtttatttacatttcttgtgggtgagccgaaacaagcgaataaaatattgtaaagaataaattattctaaacttctaaaatattgtaagcaaattatggttggtggagattggaaaatttggttttctccaactccatggatcactcactcccattcgatgcacaccgttttacaaaaatgggcatatattagcaagaaataattaggcccaataataggcttatgcaatttgaaatcttcttttcgatagtaaggcccactaattaaaccaggcgtatttattaaaaaagaaagaaaagaaccatcctttaattttgttttttttaaaaaaagggttttctttttagttttatcaatgtctcatatatattcattaatccataaatacaacattcgtataggagatttggtttgaagaggcgattctcatatatatacgtacacatcaaaattaaatcaacgaatgacttcaatgtcgtttatggaatggtttcattttgggccatgagaaattagtaaggcacgtggaaaatttgcgtactcaaaatagaaaacacgtacattttatcattttaattggttttattattgataaaaacagaatatatcattattgcgttgtttgtgtgtgtgactttacaattattttgtaaggcatagttttaattaaatgtcaataagctatttaaattatgatacaatgacgaaaacgcccatggagaagctgagattcaccgggattgcctatcctcgtcaccaaacactcccactttttcctcttcctcccagaaagaaagaacgaaagaaaaagaataatatcatcaacaacagaagaagaagatattaaaaaaaaaaaaaaaaacctaatcaaaatatatagatgttcatttttggtcatgtcttcttcatcatcttcttccgcacgatttcagtccgccagtggtaaccttgatcaatctcgcatttgcctctcgattcgtcgatactgctagattttctctcgatttatcctctagggttcttattgatttccgccacccactctctgtttttagaatctaactcccgtctccttcgtttcctcctcctagggtttccttcttcttcaattcgatttccccttctccgatttcgatttgattctttacaaatttgtctgtttggggttattggattagccagatagatccaaggttctttaggctcgtagctatttgatttgttttccccatttccggtgactttgaagctacgattcatcagggaggttgcttattagcaaccgttgaagaaaacgtaacggttggtttaaggtctttgtttggattagaggggtaagctttcgtcggtgactgtcacggcagagatttgcatg

SEQ ID NO: 31483 - DNA, 3000 bp, Unknown; identical to SEQ ID NO: 9585
  misc_feature (1)..( 3000): 2750-1469P.txt file - cDNA_ID_3042543; gDNA_ID_1972158; Annot_ID_179497

SEQ ID NO: 31484 - DNA, 3003 bp, Unknown
  misc_feature (1)..( 3003): 2750-1469P.txt file - cDNA_ID_3042578; gDNA_ID_1972159; Annot_ID_179557
aaacactaggtaaatgatttttcttcttttgaaaagcattccagtgtattgtttttaggacaaaattgcaaacttttttcttttttttttcgaaaaacgcaaatttgttaaaagtattgattggtaactgtattgtagttttaataaaaaaacaagaaaacgccttttgtatgtttcttaatcacagtgtatgaatggtgacatagaccgcccccaaaaccgtaccgtaactgtaacagtataaaaaatctctatatatacatatatatctatgtatttttgttattatttgaaccgtcccatactttttccgtatcacaaaatacagtcatcattcgaaccgcaaaactatatatagtatttcggtttttgaattcaaaatgaaggagaagaggaataggcagattaatataatttcgttatttctttttaatttcctatcttcaatttttcctcacccactgaatttgactatgccattaaaaatgtgtatactaatcatcataccgtcaataaatagagtttgtgggaaacacacgacagacacgtcatcagctctcgacggcgcgtttccatgcctttattatccttcacgttgaccccacatgcccctgttttttttttttggtgttctacggtatatttttgtgaaaatgttacttttcatctactcgataaaattcttaaacagatagtacaactttttacccgattaatctgtagaaaatacaatgttatttacactcaacaaacatttccattaatagaactttacccgatttaaaccactcttccactcgattaatattattattttattaattaaagatacgatgacgtgtccatgagagatgagctttagtggcacgcaacgtaagagaagaagacaaaagtaaaaaagagaaaggcacatgtcgaactcacgtgtccacttaaacgcaccaccttcttctgtgctctccacgcgcctccacacgccctcctcaacttcggaccttcttcctccaaaaaaaacaatttcactcttcattttctcagattctcttattatttcttctactcgtttcgaatcctaatcgtctacagtttccgacgagattctcaccggagaaagaaaggtagttcttttctctgaatctgttgtgttgagaacttagccgtaatttttgagaattattcttcactatttgatttgacaagaatatgggtaataaagacagaatctaaaacacttgcttcagtttttgaggaatcaaaaatcacacgaaagttttttttttttttctgctcctatgtttcttggtgcgtttgtgtttatttgacattaggagtgattgattgattataaagatgaatgatttgttagattcattaagatcactgttctttttgattaatcatcttatgtctaaattttaggtgacttgacagagaatcttgttctgtaataaaagcaaagatggtatcgaaaactccttctacatcgtctgatgaagcaaatgctactgcagatgaaaggtgattcttaaggagacaattcttggaaatagattatggaaccttttatttttatttatggggattgattatgtttggtgtataaaacagatgtagaaaaggtaaagtaccgaaaaggatcaacaaggccgttcgtgagaggcttaagcgtgagcatttgaatgagcttttcattgaattagccgatactcttggtaaatttctcatctttccgtagatttgaatgaacaattgctcgagtgtgttgtgatattttgaatgtgattgtgatatctaactgtgaacatgtttctttgttgcagaactgaatcaacagaacagtgggaaagcttctatactatgcgaagctactcgattcttgaaggacgtgtttggtcaaattgagtctcttagaaaggagcatgcttctctcctatctgaatctagctatgtaagtcaatttctatatgcacattgattgtgtttatgtattctgtgacgtgaatcaacaactaagacgaatgttgcttcaagaagttacttcatctttgtatttttctaaatggtcttgttgatggaaactggtgttgtgtgtaggtaaccacagagaagaatgagctcaaggaagaaacatcagtgcttgagactgagatttcgaaactacaaaacgagattgaagctagagcgaatcagtcgaaacctgacttgaacacctctcctgcacccgagtaccatcatcatcattatcaacaacaacatcctgaacgtgtatctcagttcccaggacttcccattttccaaggccccggctttcaacaatctgctacaactcttcatcctcctgcaacagttcttgtccttccaatacaacctgatccccagacacaagatatctcagaaatgactcaagcgcagcagcctttgatgtttaatagctcaaatgtgagtaagccatgtccaaggtatgctagcgcggctgactcgtggtcttctcggctacttggagagcggctgaaagccagtgaatgaggtcttgaacggctccacatggagtagcaacgcaagttataagacatggcaacttatgaaggactctggttttgtattttttaatacatcgttctgatgtccttgtgggtttggccttggctatttcttgtttttgatggttgttcataggatcaggaagttatggccttgatgggtcgtttgagataaataagtaaattagctctaaccattgtcattttcttttgtcttaagattctaaaaacacagaaacagaacaaaaaaaatcaaatttctttttaagaaaaaagctttctaatggaaactaaaatgtgaaattgggtttaaaagacaaaaccggttaataggttttggtttggattggataaagaatatgatggtattttggtaaaataggcacttgagaaaaagagaagtgagaggagccatcttatctttgctatcgagtgggtaagaagaatcagaaaacagaaaatg

SEQ ID NO: 31485 - DNA, 3000 bp, Unknown; identical to SEQ ID NO: 9594
  misc_feature (1)..( 3000): 2750-1469P.txt file - cDNA_ID_3042580; gDNA_ID_1972159; Annot_ID_179555

SEQ ID NO: 31486 - DNA, 3003 bp, Unknown
  misc_feature (1)..( 3003): 2750-1469P.txt file - cDNA_ID_3042584; gDNA_ID_1972159; Annot_ID_179553
aataaatagaattgtagaaataaaacagtacatatatatatagagaattatatatgaaaatattattttgatttgtattttggtatagtgacttataaatttatttaggcaaaataaagtagataaaatttcagtttaaagtacatgtcaaatgtaccaataagatagcagaattttttttttggaattaaatgtttgtcataaggtattaaaataataaattcaaataaatttaaagaaactaaatcactattaaggaggacaaatgtcacccaaagagagtgccaaatgtcgcaatggtaggaaaagttagaaaaaaaccttgtcttattatataagatgtccacaatacctaattatttccaaaatcgtaactaaggattcaaattgagcctagacacacaaaacgaaccatcaagtacatggtaattttttttattagtaaatgataaataaattatgtttaaccgtaattatagtactagggtggagaattatatgagatccaaaatccaacctaaaatataactttttctttttttaacacatgaaatctaacttactatgctcttgataactggtcatgaacatataatttttctagattcatgtataagtttccaagagtagttttctaaaatatttgttatcatctttacattttaatcttttgatctgtaaaattatacctagtacatttgatatacaatacaattttgcaatcagctcctttctttcttttgatgagatcagtcagctcctttctagtagctctttaattgctaggacactacgtaatacatcggtgtagatgcatggaggcgtgtatggccaggatgcaaccacctaaactctgtccggatatggaaagcgacgatctcggacaagacattggcaccgaatatcatcaaaagcaaagcaagaccacactttgctttcttttgttgggtatgtttgtgggagcccactccaaaaagcaatattttatcgtatagctcgtacatggtccccatttgaattatcacgtgtcgctatgtgatcacttggacgattctatacttacgctctcttccatcgtgtccgttgaaacgtgtcgacgggaaaaagaaaaaaagattaattacaacaacaagatctcgatctttcaatattaagttttggaatttttgcaaatgcatgggctatatgttgttactattacttttcatatagtgatttatgtattaaatgccatttttttgctgtgaaatcgctaattattggtcattttattcatactatataggaccatggtgacataatccgatccaagagcttgaggtctgtaagtcaattttcatttggatttgttcacattgtgtttaatgatatctttaagatgttggtatcattaagaaattaaattatagtttattcctttgatttatatatattaaaaacatcaattcaaagaattaaattgtagttttttaccggtatattattgtagctaattcgggatagtaaactcatttatcataattatgttagttaaagctaaatatcaatttccatgtatacggtttgttatgtactctaaaatttacaaaaaaaatatagcttctataaattagttttgtttttcatatgagatcagtgagttactcaaagtcttaaacccatcgagataaaactagtctaaccaatacaaactttatgatgacaattttgagagtttaattgaattgtcatcatcctaaataaatgttgatcatctcatagatcatgtatttataatataatctgacgataacccacaacaaattgttcagtaagttcttcgaatccagtcaacaaaattatttgattataagacatgaaaattaaattatgatcaatatcatttaatacttttccttccactgatttgacacaaaatatatactttttcttccactgatagttttctaatttctatccactgagagacttaaatttgtgactttggaagaaaaaaaaatctacttatgggttttatacgagttgaactattgaaataatgattgatgttgggttatatacttgtcattttctttttttaatatacttatcatcttatttaagagaattctaataggtaaaaaaataatagtttcgagaattgtgttgggatgttgaaaatgaggattgtcggacacaggcagtgcgaggtgggggtaagaaatgttccactaatcaaatcatattgggaccatggactatggaccatgtaccatggcttatacaatacaaacttatttatttcgttgcccacttcataaaagctatgtcaacattataattttcgaaaaaaaagagaggatgatacttgtagaaaatgagtttaagttgctaacgtaattaagtttttttttggtaaagtatcttattatttatttataaacgtaaaaataaactacactcggacactctgcgtaaccataaagctaaataagtttttgaatcaaataacttaaagtaaaatgtcaaaaccttgcacttcaagaaattatcttttgtcgtctacaactcacatgtatgtataatatcgaatcgattcgaaccatagcacatcaacgatattactataaacttctaagttagaagctctagttgtgtatatcaaatattaaaaatgtgtgaaaatatgaatcatctgattgtaggaatgttaattgggctataatgattaatgaggtctaaaatgatataaatgtttatgtcaagtgatattaggtcaactaatttaggcgttccaaattagtaagaggaacccggtaaacgtaaaattgaaagaagaaacccgggtttaacatgtatttgggtttaagttcaaatatagcgagacatttaggcccgtttcacaatattgggccgagcccatgaataaatacaaaatagtatttttgattggagaggatcggccctttcttgtcgtcgtttcgaagagactaaaggcgacggagagaatcggagaagaagatg

SEQ ID NO: 31487 - DNA, 3000 bp, Unknown
  misc_feature (1)..( 3000): 2750-1469P.txt file - cDNA_ID_3042591; gDNA_ID_1972159; Annot_ID_179549
gtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaatcgtgtgactcatttggttatacaaattcatgtcacttaattagtattgatatggttaggtttcagattttatgtttccataaacttcaatcagtaggtagaacaaacttttctcctcattcattatatagattaagattactttaaactgtttaatgtactaaataatgaagttctataataaagatataggttcttttactggtgagatatttcattaaacaaacaaaaaatgagttgttactaaaagaaaattaaagagcaaaatctagttttgtatccgattataggaggcaaaatctagtgattcatagaattatgtaaaactaataaaataaagctgctaattaacaggagaggcaaaaaaagaagaaaaaagtagtgaatttaatgcagaagaaaatgtgagtgtttgtttgacttatgcctgtgttgagcacaacgagcatgatccaagtagagatgctttaccttagagacatcacacatattttaatgtcacactgtctcacacccaactcgttgactttttttttgcttgagtctctaataaatttcgggcttagtaaattaattggctgaaaatggaatttatggaatttatttgactgttctgatctatttttcaatggtttaaaaagtttgttttgatagttgacgaacgttttgtgagattgaacagaataaaccaaacaaatatttcaattaaaaatagtgaaaatattttaaacataatatgatttgaaacaagttaaattattttttgttatacatttgatttaaaaccgaatccgaaccaaaccaatatttttcatgaaaccaattttattggaccctatttttccaaaacctgaaaaaactgtaaccctaaaaacctaaattaaccacaaaaaccatgtacatgcctctactactagttttgttaagctgctgataaacatatgttacttactttaagcaatgatcaaatgtctactagtattattatttttgtttgttttccactgattttttttcctcttatggaactgaaactgaatcgcactacaagtctacaagaaagtatagtaaagaagaagaaacacgaatatgtgatcaaaagggaaaatgagacaaggcctaatggctaaaaaacagagcaatagaagctcaagactttagcaatccaagatcaaaacaagttaataggtttttatggaattcgtttaccttaggatgtgcacacttttgatattttctacgtccaatatctctttcgtttttcacctgaaggaagatacacagagagatttgagaagtatattacataatagtttcaatcaaaactaaagttaaatcacagtgatttcctttattttgatttcacctctataaattaaattgatgatttaaatccaagccgataatgaaatgatgaattattatttataaagctcaaaacacaacttttcgtattttgtcgacaaagagttaaacttcctcaaagaattagctttctggattgggctatttaagttgggtcacagcttataaactgaattgttggttaaacttttagtctgtcaagccttgtaagtggaagttttcactgttgtactttttacaacataaattttaaataaaatgttacacttttgagaaaaaaataaaatttttcattattagccttatatagtagtccaaatattatttaagaaaattcttacaaataaagagtttttaaaaaaaattaaaatttcaagtcattttccttttctcactaaaaaataataaactaaactctcatcatcttcagtcaacagttcatgtgatatgaaacaatgagaactcttttgcacaacttcaattttgtccctcaagattctccttattacaaaacgtccccttttcccacatcatccttcttcaacgttcgctttcccatcaagaacaaccaaatctcttgtaacaaagcaaagaatttgagaatg

SEQ ID NO: 31488 - DNA, 3003 bp, Unknown
  misc_feature (1)..( 3003): 2750-1469P.txt file - cDNA_ID_3042594; gDNA_ID_1972159; Annot_ID_179548
ggagatcttcgtaatgcgacgaatggcttctcttcgagcaatatggtcgggtctggcagttttggtaccgtatataaggcattgctcctgacggagaaaaaggttgttgcagtgaaagttttaaacatgcagagacgtggagcgatgaagagctttatggcagaatgtgaatccttgaaggacataagacatcgtaatcttgtgaaactattgacagcttgttcgagtattgattttcaaggaaatgaatttagagctctcatctatgagttcatgcctaatggaagtttagatatgtggctgcacccagaggaagtggaagagattcataggccctcaagaactttgacccttcttgaaaggcttaacattgccatagacgtggcttctgttttggattatctccatgttcattgtcatgaacctatagctcattgcgatcttaagccaagcaacgtccttctagacgatgatctaaccgcccatgttagtgactttggtctagctcgtcttctcctcaaattcgacgaggagtccttcttcaaccaactaagctcagccggtgttagaggaaccatcggctatgccgcaccaggtatactatcacacatctgtagcattatatgaagaaaattagtatctatcctttctttttatcattacagtcttcttaacattgtttctatgaaatatggtgcagagtatggagtgggaggacagccatctataaatggtgatgtatatagttttgggattctccttttagaaatgttcactggaaaaagaccaaccaatgagctatttggaggaaactttaccctgaacagctacactaagtcggcattgccggaaagaatattggacattgtagacgaatcaattcttcacattggtctcagagtcggtttccctgttgttgagtgcttgacaatggtttttgaggtgggccttaggtgttgtgaagaatctccgatgaaccggttggcaacgagtatagtcgtcaaggagttgatctcaatcagagagaggttctttaaagccagtagaacgacttggcgttgaagtgtttggttttgtctacaaactttgcaacccaataaaaaggcttataatatcttatttcataaattggggttttgtctaagaatgcttgtagaatattgctaatgaaatgcttgtgttaattaataaaaatgtatgaatgttgtggtaccaattttatatggagacaacgtagctttatagttgcaaatccacattgttcccaattttatttggattctctttgttttggtaatgtaaagttctgaacatggagcaatagatcgatgttcaacgataagtaagtaagccttgtcgtcttggtaattgcgtttactaaaagtcccacaagtgggatatggagaaaatacatctaatgccggtcagatcatgaaatgagatcgacgtcaacatttctagcataaaattgacttttgttggcacagtgatcacgacattacgatacgttttagcttacaaaaaatcgttaaccggattatagggtatgttacccataacaaaacaaaattgtgagcaactattcgtaacactggtggatattacaagaataatcttcgtttactgtacttttaatttttctctttgaaattttactattttgttgcaactagatgttaatttaggtatgcaaaccctatttaattaatgggtatgtgtaagagaaattgatccatttaatttcattaagaaaaaaagttaaatggggttaaataggttagcccaactaaacatatttattaaatgtagttttacaactaaacatatggggtatccaattaaacctatttatttttcttttatattatttattcttattgaaaatggtaatatgtttatacattaaaattaaattaataaattattctatttaacttcactttttggtttaaatatttgtttttaaactgcaaagctccattttccactaaaaccgtaaaccaatgttttcccgtcaaaatcgtaataccacgttttcccgtcaaaaccacaaaaagtgttttccgcaaaaattgaaaatcatgttttcccgccaaaaccgtaaaccgacgtttttctaccaaaaccgtaaaaccacgttttcccgccaaaaccgtaaaactacgtttcctaccaaaatcaccaaaaatgtttttctgcaaaaatcacaaaaagtgttttcaaccaaaactgaaaatcatgttttcccgccaaaatcgtatgccgacgtttttccgccataccgtaaaaccacgttttctccccaaaatcacaaaaaatgttttcctgccaaaattacaaaaagtgttttccgacaaaattgaaaatcgtattttcccgccaaaaccgtaaaccgatgttttctcaccaaaaactgtaaaccaatattttctcgcaaaaaccttaaacccgtattttctagctaaatttttctttgccaaaagaatattcacccataaaaatctgtaaaataattattgattatattatatagatatagatctaaatgggtttaaatagattaatgataatttaaatagaaaagataaatgaaatataaaattaaaaagagttaaatgatttagagtaaataggatagattttaaatgggatgggttaacccctattaacatttgcgactaaactattttggctttgcaataataacaaatgaaacctgtcgtcagttggtggatttcttaaacccaaggtgcgtgaaaataaatatacaagtgacataagttgtaaacagtaatgactagtgtcatcttttaacaaagttgatttgttgacttagacggcaataatacgtgtcgtattctgtgtggttgtgagccaatttattatcaccacaatacgtaatgaaaggatttgcaattgcttcgtccccttttaaatcagtttcctgcaaagttgataagcacaaaaacattcaaaatataaaaataaactttgagaaggatg

SEQ ID NO: 31489 - DNA, 3003 bp, Unknown
  misc_feature (1)..( 3003): 2750-1469P.txt file - cDNA_ID_3042598; gDNA_ID_1972159; Annot_ID_179547
tgaccgacccgcgcattctggcaatggcggctgcagaacgtcatttcttggaagcagactatgatgaatattctgagaataactcaagcggagctgccttttgtcgctctgctgctctcatcgtaagctctcagttgagaagatgttttcttaccatgatttaatactaaatgcctgcactctaacttctgtaatggcagctaatggcacttttactgttacgagatgcgctaaatctcacaacgaacccagacgacgaggacgatccaactgccttcttctctgtatgttcatctttacttactttcactacttctttataccgtcactgactacacttgtttgtttcaatagctattccttcttcgtgctgctggttttctcctcccatgttacatcatggcatgggccatcggtatactacaacgtcgaagacaaagacaggtgtgtacacggaaaaaactctctgtatcaaactctgttatattgtaagatactcaatctaacagatgagacaatgtactgcttttgtttgtaatcaggaagcagcggctctagctgccgcagaagttactttcatgatacacggtggtgggcctcaacgcagaggactgcactttgctgtagcaccgcagccgccgatatccaatgtcccaacaccagtttgatccttaccggcaatgattctccgttaaggctattagataaaaccttgaacttggttataagaactctacctacttatgcttcttcaaatgttattatcttcctcttatgtttgtgttatctgaatctgttaaatgtctacttcggctctcaaatgttttacaaagagctctcacggtatactatgtacagtcttattattatcatatgattatataagtattatatttttatttaccttttataaatttatttggtcaaccaaacataaataaatgtccaatgcaatattggagggtcaattacaagtcttgtcgtttttttcttcacaatgactctttatgaactccataaccgttaaaaccaattgactttgataattggtataacaatgatcagctccttccacaatctgtagctcgtggttcggtattatctttgcaaactcctttgcatcttccactggtactgtctcgtcacccgatccatggaccgtcaagaccctaccattacatcaatccgggcttgtttataatgtatctcaaacaaacgatatgagttggtgaacttattgaatctcacctgcattctttgtcaatcttgaggcaagcttcatgcatatctgtgtttaaccggtccatcaaactctcctcggtaacacggtaaccagaatctcctgtaacaaaccagtacattgatagtaacactaaagttctgataacggtgcatgaaaagcgaagagcgataacaataccatctttaacatcgatgtatccttgttgcttaattctttccaaaaaatcttcaccaagacgttctcctatgcctttcttcagatcataacgtcccgagagattgatcacattggggatatcgtgatacttggaggcatagaggaggaccacatcacctcctatgcaatgtcaaagtataagttgagtttcttgcaatgtaagattcaccccttttgaaaatccgttgctcgaagcagaaagatcggtactacttacctttactgtgaccgagaattatagtaacaacacggttcaagttagagaagtattggataacagaatgtagatcatcagcttcgtaattgtagttaccataatagaaactgccttcactctctctgaaagaatgaaagcaccacaaccccagagtcaaaacaaagaccaacttattcaagataatgcaagaaagaaaaacatacccattcccggagaaatcaaaacggaaagcactaatcccttctctctctatagcaacagccacatttttcataatttcgaagttctggatacattcataggccaaagacaaaacaaagttaatgcatgcaataactcctaccaacatctgcaaccctactatgtcatgaggactccactttctttgtgtacaaaataaatattcccaaacaacgaagaagcagagctactaatgggaaaacattataatcactataaaaaaagtgaactaaaattatgcacaaatctttggtaagatgttggattgagaaatggacattcaagtaagtgagaaaaaagcagaaccgaaactaaccttgtttgatcgaaagccatgacacaagactacaatttctgtagaaccagtttcatgaagcagacccaccaggttctcattgtggctgttcagaatcacaatcttctgttgtgtacttccctgcgatgaatccattctcaacttttttactttgtttgttgcaggaaatttgggtctccttaatggtaaggcgtgcgttgagaaagataatgtgggacaaccacatgatctctcattgatcatattttggaatttatatatatatatatatgatttctatttaattttctttgtcactcattattttttctctcttttttctagtgtttaaaaaaacttagtttttaccaatcaaacctaccatctagtaaatgtaaatgaataattggtcaatttctacatcatctcctgactcctgttacatgtttataaataaaatagttcatttgctagttgctacaaaagtgccaaaatatttcatcctgtagccaccgcttgatgtctgaagaaaagtcataaagattcgtaaaatgtctttgtttttttgttcctttttagataatgggatcccataaaacgtgtctttgttgacgacttgacttaaattttcgaaaagtggcagtttaatatccctattttttatttcaagttgcattatcactacaggcattttaatttgcaattgcttcgcctcttatatgttcattttcctgcaaaacatgagaagcatcaaaagctttttaaccaccatttgtttttttggaaagcatg

SEQ ID NO: 31490 - DNA, 3000 bp, Unknown; identical to SEQ ID NO: 9592
  misc_feature (1)..( 3000): 2750-1469P.txt file - cDNA_ID_3042602; gDNA_ID_1972159; Annot_ID_179546

SEQ ID NO: 31491 - DNA, 3003 bp, Unknown
  misc_feature (1)..( 3003): 2750-1469P.txt file - cDNA_ID_3042605; gDNA_ID_1972159; Annot_ID_179540
aaaaaaacaaaaacaaaaatataagtgtatcttcgaatttatttattaaagtaagaaagattttacatacatacaaattgtttctctttattggttgtattactgtaagatatatttttctgttaaatatttgatttcatgaaatccagaatccatatcaccagatggtggatgaatttcaatctatagtgtaccatgttatcaaaaaagaaaaagaaaaaaacagtatatgttccacaaattaggcattttataattgccatagttgatattcctaacattagtgaacaaatatgattagtcaattgaaaattgaacaaagcaaattaaacgtgaattctaaagcactagacacaaagcttcgtttgagtcgacccatttgttagtgtaatgactaactataaaatagacacgcgtaattaagtgatcatgcccattggctcccacaattccaccactttaaacagcatccataatctacaagtttttcttattgatcatttacatatgcaaatgattcatacttcaaggaagagaacattctactaaagcaatctccactgactttcaacattgactataatcttatcttttcttttaaaacaatatatagtatgtttaatgtacaaacactaaaaaccctacggataaattaggattttgcttatgtatgatggagtatacacacattttttcatattgtaattataattagtatcatatattatatcgaacaataaacgtggaaaagtgaaaccgcgtcgattacttggtgcttcgtatatgttcttttaaagtttagacattttggtgggctgatacaaaatactatagcagtccaaatcagattaaaaaaacattccatgtttaatttagtgatgaaagccccaccacgacaatattttaaaatgcgcaaataggaagaaaagaactataaaggaaaccaccacaaagacaaaactcaaaacaagttggaggaaaaagagagacaaaactcacaacaacatcaaggttttaactaaatttaattttgtcataactattcatatatagtcaaatggctaacaaagctctcattcatctcctcgtcatcttcttcttggctctatcacacatcttcttcttcccttcccatgcttcgagtaaaatcttcatctctcttaaaatcgtattttatgtatttacatcatatgttttaacttatatcatctatattttgtacgtatacaggacttgggagtttgatggagaagccaaaaattgttcgacctcaacaagatacactaatggttagttatttagctatttatctgtgttcttgagaggttaaaattaggttattaaagattttaatttggttttgttttacataatcaatgctattaggatgtgaagaaggaggtcgaagaaaggatggtgatggagttaaacgactatccaggttcgggtgcaaacaatcgccatttgccacgacaacgaggctgcgtcgttgattgctgatcgatatataaaatgacgaaaaacgaattaatatgattatagctagtatcgataaattgatgtataagtaagatacgtctaattatttttcagaatatgaattgagttagtttaacattggagtctatagacgattagactatatacttgtctactctacggagaaaagcatagttttatttatgtagttcagttggtaaatcaatagatgctattgttaataaaccatatatatggatgatatgtacaagcctttaatttcaatttggtgataggacataattggtttactgccaactaatagacattagactgacgtaaagtttttcaaaataaagataagtcactactctccttttcacttatatttaccaaaaattgagttagttaacttcttattcaaatttatattttgctgatatatcttatatactcgtcatgttttacgccacggatcaatataaaataaagatttaaaactaaaaactgatgtggaaaaagagtggtttaataaagtaaaacaacaacataattgaagttttatgcaacaccctaagtgtggactagataggaacatagaggacaggcaaaaaaagaagaggtaattaacatacctaccttggagtacatgccactatgccagttgggtttgatttttaccctcgaaatattagtatgttaccgttcatctccgagtaggtgttgtgattttatagacgagcaaaaaacaaaagtggttcatgagttttgtcgggctctctccaaagagacaagattgggaaagaatactctatcttctcattcttgttacattgattttgttttattttgcataggcgatgcagtaaaactattaaatatatactcaaggtttcaattatcataactggtgtgattgttagagggttaaatttaagatttatataagatgtgattacataactcttgtattaaaagtgtttactgtatttgtatcactcacatgtaatcattcaaaaaaatactaagatgaagatatggtaaaacatttcaacatagaaaaagacacaatcgataacaaaatagaacagtacacttgacctaaaccaatgcggtaaacacacacacacttatatacatattgttaataattttgaagttatgctatacaacttattattttgtatatcaatacatattcaaatagcttaatatttaaagcgctatgatgtcaatttcaaatactgaaattattttcaaaactttgtcacttatattatcacttataaccattctatatatcttcccaccgcgaaatttataaccacacttttacaaactaaatttcatacattttccaaatagtattgtaataaacaaaatagtttaaaaataatgtaatttacaaaacaataaatttttaatataaaacatattgatcagcaaaaatgctggttgatgcataaaaaagactcaactacagaagaaatattcagcacacgatatcacaagaagaactcgatg

SEQ ID NO: 31492 - DNA, 3003 bp, Unknown
  misc_feature (1)..( 3003): 2750-1469P.txt file - cDNA_ID_3042621; gDNA_ID_1972160; Annot_ID_179579
gcttaaattatttttataattctgtattatttcgttttcacgagttttacgagtcttttaataattaattaattgtataatttgttacgataaatatcttacacgtcttaatcgatcccagttcttatgtatcttctaagaaaaagagtagttatacattccgagaaaaatatggatattgggtattttctgaattaaatgccgggaaaatattgtttttttggtggcacaaaaaattgacttataattattctttataactatattgtagtatctgatggttaagaatttttggaattattttaagatttgtttttttcttgtcaaccgatttttatttagagttcagaaaactcatcccttaaaaatgttgtttatatatgtgatattatgcggttcggtataaacttttcgtcaaattaagatttggctttgaaaagacaaaagcaaaaattttaaatctaaaatggtgtgggaaaaaataataataataccttgctaaataagacggaaaatatgtcgtgcagcttactgcttatacttacatcttacattacctattaggctataacctaatgcttgtgttataagtctgtaagatttggtcattcattctctttgtactattgtcttcttatattgctagaaacttagaaactaaagaatttcaccaatttttgtgggcatagtatatagcttattagcttgtaataaggcctaataaggccctcgagcgttacaataacatccaaattagttttggcatggtaccgttaaagtggtgttaaactattaatttaccaaagactcattgtttggactttggaccatacgaaaaatgcagtagagcccatagtgacatagtgtaccggctcttatagctgagaaattatatcccaattaacagcccagtatttaatcatttagaactcaacgtgaaagaggacatgttaaagcccaacacaagtccatagactcatgaaatacaagtccacaaacccaccttatctaaccatgtaattaggttttatagcataatataatgaacatcaatgaatgtaagtaggaatgcaatttgtgcaacctctatttgacaatttctttcatttcttctcaatagtttacaagtctcatacattgtttttgttctgttttcaaagaaatagttttggtttttctattgtatgcaatatgacttcccactgtacatcataaacattgaagtatatataatattttttctattgtgttctgccgtacgtctaacttataatctattttataacattgattttactaaatatataaaggtaaaatctatcttgttgcattcacttcagaaaataaatttttggaagaagggccacaaaacaatactaattttcaaaaattgagattgaaattatgttataagattgatatttaaaataggaataccgttgtaaaaataagtagttgatttatcgaacatctaagcatctgtttaacaccaattttatgtcgttgttgatcaaaactgtcgcgttcaagtgtcttgtgtcgactaattaagcaaatgaactttaggtaccagaagttcaacgaaacaataatgcatttttaaattactaatggactgaagtaattgggaataaagaaatataaagagacggcggcattcagtggaaaatttgcctaattggagtgtaggtaagcacaccacgtaagccatgaacggcgccgtttcaccgcattgctataggaaagtagaagaagacactttgacttattaatatcattttgttgtagatcttctgttcatcatatatttgattttgttactagctaatgtaaaggagaaaagaaatgtttgatttggtcacacacgtgagacagcatcgtaggcaaaaaaacgcctctatctttcttctaaaacatttttcatattaaattatcaaaacccttaaggttgatttaagggtcaggtagtggatttgtttcgttgaagggtcagcttagccttaaccctaaacaaaacaatctcattggtttcataaataaattgtttacaaagtatacgtactgcatgaacgaatgaaccatatctatatttataaaactcatagagaccaatagtttaagagaggcacttatatagctcaacaaataatagcgaactagagagaatatgatctaattagttataaatctcaattttgaaattgaagtgcgttatttcatttgagaatctatgtgttttttttgttgttgttagatgagaagctaggtttttttcttttctttacaccgataatcgataatatatgttaatcacactgatttttgtttgagacatgaagattcgaaaaatttgtcaacgaataaacactggatagatagaattgagatctgccatcaaataatcgagatcgttcatgcatgacgcaaacatttatatagaaatgaagcaagtaaagaatatgaaaaagaatagaaatgagaaatttataaagaaagaaaaaaagaaccaatggttgaggaggcaactattcgcggggacacggagccgttcgcacccatcaccttggaatctctctttcttcctctctcctcatcaccaactagtcaacaaccacacaccatttttaactttcataattaaacctaacataacatttttttttgtataaactatagcataaattaaattcagttaatgataaaataaatatattttgtagcaatcattctattttgtaatttggtagggctctttaaactttgattattatccaatttttattaaaatataataaaatctcaaagccatgacccattccttcactcaagtatcaatgtctattgtctataaatattacataactcttcttcttcaaccaaacattgaaacactttgtcccactctctctctttctctttcttgtaccaaaagctttttgaatctccaagattatagcaaaaccaaagataaaatactaacttaaaagatttctgaaaataatg

SEQ ID NO: 31493 - DNA, 3000 bp, Unknown; identical to SEQ ID NO: 9607
  misc_feature (1)..( 3000): 2750-1469P.txt file - cDNA_ID_3042645; gDNA_ID_1972160; Annot_ID_179588

SEQ ID NO: 31494 - DNA, 3000 bp, Unknown
  misc_feature (1)..( 3000): 2750-1469P.txt file - cDNA_ID_3042648; gDNA_ID_1972160; Annot_ID_179584
tgtgtaatctgagcctcgttacaagttacaacttagtctagattcatattggtactgtaaataattttttaaagtgtcaaaaatctcaaaacacaaacttttaagaaaccggagggagtaataagaattctcatatttataaatccataatttcgacattataaaagaaatccatatggatatgaaaatgtattagtaaacaacaaaagagcacactggagaagaagaagaaacaaaaatcggccgagacatctctattgagtcctcattctgctgctttctgctgccctgacttgagcgaaatagggatgagcctgtcatcaattcataaaaccatcacaatttagcagactatgagaacgaaaacttgtttgagttacgttatatgatacttaccattgcttcttttgcagttaatctgtcttgatgatcataccggagcagcttgtccaaataatcaatcgcctacatttaaaacaaagttacagctcgagagagaaaccatggcaacaaacaaaagcgtttgtgtttcttatagaatacagagaacaaagtaaacaaacctcaggtgagaccaaatgcctattgtcagcgttgatgaatttggaccaaggcttcctgctatgtctgtggaaagaggattggtcattggcactgctttaatctactcttatactatagagagaatatgtgagttctgcttacctcccaacaagtgcctctagttgagtatcaagttctaactgatacttattcagatatgcattcaattcatcagttccgagtacctgagtcaagaatcaaacatacactctaaagatgtgaaaaaacactcaatccctctaaaattcccacatttacccacgcatttgattaccttggcaattttgacgagctgatcctggttgtcatggccatagaagaaaggttccttgcggaatatctacaagaaaagataatttagacacttcatcattacgatactatattttggaaattttttgaaaagaatgatcatatataaatgtagcattggaagcctagcatttcgcaaggtactcaccatcccagcaaacatgcaaccgaggctccacatgtccaaggaatagtcatagtcctgtaaatcaactagaagttcgggacctttgaagtatctgagacaacatttgatcaagcttagatactgataacgactaaatattaaaaatggataggaaaccaacttatcttgaaggcgcctatcatacataccttgaggccacacggacgttgtactcttttccaggatgataaaactcagcgagaccccaatctattaggcgaagtttgcgcagctcatggtcgatcatgacattgtgtggcttgacatctctgtgcattattccttgtgagtggcagaagtccaaagcctgcagcatatcataggaaatttgcaaggttatcactgaactaaatttgttgtggaaccgagaaaattccacaaatcagaagtcgtaatgaaataataaactctacataaaataaattaaaattaccttcaacagctcatagatgtagtagcgaatgtcataatcagtcaatgttggatacagaaccttaaagtctgtgctgtttacatactcaaatatcaagcttggcgtttttgagtgttgatctctgacaacatcaagcagctttacaatatttggccctccacaaagattctgaagtattttaatctcccttctaatctgtaaaaggatcatacaaattcagaaaggcaacccaaaatcaaaactaagtaaagacaaaaccttttgtaaaagcaacaccattcattgctatcaatcataagtcaccaattgaagtaatatagacactcaccttcttcttcttaacaggcttgagaatcttgataatacacttctcattgttattcatgttaatcccctcaaaaacctcactgtatttccctctccccaccttcctcactacctcgtaatcatcttgctccctgacaacgaaacccacataaaaaagctcaaaactttaacaaaagcatcatcacccatcatgatcataatcataataaccaacaaactctcctcaaaaccagattaaaaaccaagaacatcgccagctagacaaaaagctcaatttctacattacaagatccaatttttttaactgattagcttcctagggttttcataattttcgaaaaatacgatcttacccccactgaacattgagagattcgtaatcccaataatccttaggtcggatcacgttaacatcggtataaacacgagctttcgacatgacggtggaaagagagatcttggcgagagaatcggtatcgaggcaacgatcgaacctgataccagtaacgtctgattcaacggttccggtgttgacgcacgttaatggtggtataagagaatgcgccaacggcgcacgtaagatcaagatggcgcacaataacaacaggtaccgtcgaagaaagtaggagaagaagaagattaggtgcatgtaaccattcggtgcactctcccgcggtggattatttcttttagtggcatacactgagttatggaaataaaacaaatatttaatttgacttgttgccaaaaacgacgcgttttggcttgcttaacacaaaaacgcagcgttttggttaaaccctaaaatgatgcgttttgggtggctctaccctaaaactaaaaatcttcaacagcgtttttgttcttcatctgcattgttctccgcctctctctctcaaactcttcaggtaagcttcttcaatttcattaaattagtgtttttgaatcgtttctagacttaaagtttctcccttttcgatgttttcgtgttgattgatgataaaaatttacattttattagtcaggattgaaacatagtctagttgattgctgtgacttagaagttagacatcttatatcttcgtaattgttttacagtttgcaaaacccttaagaaggtgtgaattagtaagtaatg

SEQ ID NO: 31495 - DNA, 3000 bp, Unknown; identical to SEQ ID NO: 9623
  misc_feature (1)..( 3000): 2750-1469P.txt file - cDNA_ID_3042687; gDNA_ID_1972163; Annot_ID_179644

SEQ ID NO: 31496 - DNA, 3003 bp, Unknown
  misc_feature (1)..( 3003): 2750-1469P.txt file - cDNA_ID_3042691; gDNA_ID_1972163; Annot_ID_179643
ctgagacattttatcgttgctgcagtttgagagttggcattcttttgatacaaatccactatatgctcttctccacgaggccatatactgtgaggtatagtctcttcaaatttctcatctttttttctatttcagacaattacttcttcttgttatcgtttatgtttaaatggaaactttttcagggtgcttcatcaggatggtctgctcatagattacgggataaatatgagtacaaattcgacgcaatgaaggcagtcaaagaaagtcagcctgtactcttcacaggagaggtacaggttttgagtatttctaattgtatggctcatagcttggatgattggtccacattgcttaactaaaatagaatttggatttgtatagatgatatttccatggatgtttgatgaaattcatgccttgaagccatttaaagctgccgccgatcttttggccaagaaagaggattggcctccattatatgatgttcctagattgcagaataacaaggtctgtttcagaatcttgatcgttctttcatatggatcaaataattttactctgtttcacatgatttctttttgtaggtgcctgttgctgcagcggtttactacgaagatatgtatgtaaacttcaagctggtgacggaaacagcttctcatatatcgggtatcagactttgggtaacgaatgagtttatgcattcgggtcttcgtgatgctggaagacaaattattgatcatttgttgggaatgatcaatgggaaaaagcctctcttttgattccttgtactagtcagtactttgtgacttgtggttttcttcgttatacactttctttgagaattaaatgagtaaaaaagaaagagaatgaataaaagaaagtctttcaagttttgactttcctttccatttagtgttcatgcagacagttgggcgagagacagtgagataatgtaaattctagatactacttatacaatatacgatgctggtttagcaaaatccgttgtagtctagctggtcaggatactcggctctcacccgagagacccgggttcgagtcccggcaacggagtctttttttgctttctgtttttttatttccggaaactgtaaaatagaatgaacttagaagtcgtgagatactgttactatctgctcattgctcaataaaatgttgaatgatgaaacgaaaatagctagaggtaaacaacaacaaaatatcacacatgtcaatgtcatacggctcaagcatttaaactaaataagactagaaaaacttgacctcccttgggccacactactaagtgaagtcactattcacaaaacgtataacaagaaaacctaataaatgcaaagctattaatattttgccaaacattgtattcaatgccgtagctacatttccccacccacctccccaaaacaccaaaaaaataaatacaccaataataatctctccatcactcttttttgccatcgacgccaatcccacatggccctaacctctttcttcaccatcaaatgtcaaccgccaccctcgtcgtcttccctcctccacctcctgtccctatccctacctatataactagcctcggccttggctactccatagccatagctctaggtttcctcgttcttatctccacaatcattctctcttcttacatctgttgccgcgcctcacgcctccgcttctctgcctccgccgcaaacgcaaacgcaaacgcatcgtttagcgaccgtggcgttatcgtcccaagaatcatattcgtagctgaagacgacgatcttgagtctggaaacgtcgtcgttggaggtcttgatcattcagtcatcaactcttaccctaaattccatttcactaaagatatcaccgccgtagtaaacggtgatgggtttcacgacggagaaggaagagagacgacgtgttcgatctgtttatgtgagtacatggaagaagagatgttaaggatgatgcctgagtgtaaacactacttccatgtttattgtcttgacgcttggcttaagctcaatggttcttgtcccgtttgtcggaattctccacttccgacgccgcaatctacgccgcagtcaactcctttgtcggaagttgtgccgttgtctcaatacgccgccgatcggaggagatccagaagataaaacatttcttttttttgctccgtggcatttattattaaatctttttttcttggtataatatataatttattgatttgctttacatactctttgtcatgtaattaagtttgtatcaaacaaacaaacaaaaagttcactgttgcattcatcttcttatattttagctaatcgagatttggactacaaagtcaagtcaaatatgtagttaatcaaattagattagattaattgtcggagatgaatgtctctaaagatgggaacaaattagttggaatttgagatttaaacaaaaatgttcctaaatatcggtaacgttgactaaaaaaacatatgtttttctaagcaattttaatgtgtttgaaatgtcaaagaatgtaaaaaagagaaagaaagaaagtctctaaccgagataaagactttgccactcactgacgaaatgtcccacgacgtcgttctatcgaccgtttgtttttttttaaacgagtgagccgttgatattattcttatatgaaccgatgactgccagtctgccacgtatacggaatctccttacgcttgtcggttactttatgtaagtaaaaaagaggagttacagagcgcaccaggcccactaggcctttgttggatccttggttgcctccacgttccaggcactaaacgttgacgtccgtttattccttctttaaaaaagactaacgtcgttaacgtatttctgtggttcgggtcacgaatctaaaggctcgttcataagttgcctaataaacctatttctccgttcgttctctccctctctctcgcttcacgttggatcgaaatcggacaaaagtaaacgacaatg

SEQ ID NO: 31497 - DNA, 3003 bp, Unknown
  misc_feature (1)..( 3003): 2750-1469P.txt file - cDNA_ID_3042695; gDNA_ID_1972163; Annot_ID_179641
cttttcttctgtcaaaagccttcccttccaaacctcgtgtaacacaatatccgctgtgattctattaggaggaaaaacagattctttctgaagcatttcgtcgagcaccttgaaggcatcatccacaagtccatttcttagcaagacgtctaccacaacattacgaacctgcgagtttttcatattcgaatcgagtctttcgtatacaagaaccgactgattcaccatacccatacgcccaaaccatcggatcagaagattagtggcaacgacagtaagaggaatgttcttctctttggcgatctcgtagagacggagaagtttatcacgcgggtccggttcactaccggcgaattcaatgaccgactgaagcgccaaggagagagattcttcacggcgtttcagagactgagacttcgcatccaggtactcgaagaacgagattgctagagaatacgatcctagccgccgcgtgatttgcgagaatactaaaggagaagcagaagaagaagatacgacaagcgcacttagcgactcgctcgacgcccaatcatgttgcggggttttttgaagagttttcacaaatttgactactacaaattcctggctctccaatttgatttccggccgtgggtcaacatcatatgaaaaacgacggaggaatcgagaatggttgagcagaatataagagttccggcgccgggaaattgatagcatgatactcatcgtctaaggttttgaaaaagacggccaccgggaaaagtgagacgacgaactctgttcggcgaattcaacgaacaagaagttgggcccattttaaataatgggcttacacatatttagcccaaataaacctttacaatattacacaatgggtacaaaaatttattttttctcataaaactgaacgtgagctttttattatgctgactgattacattatatttataacaaaatgaggacgaatctttatttttctcatataattatcctctttgttttattaatcaagccaccaccctgaactctgaaatagctcctatggattacactagttttacccgctaataactatcctattaaaggatttttatttcttcaacctactcaaaatgaagagctacgagaattgcaacagctttgtcactgagaagatggtgaatctgaatgatccatcttttcagctgatgctgctgcatcagaagcagctttatctaatcccaatttctgtaactcgcttaagaatccgtccaggtcgcttgaggagatcttgtaagggctgtgagaaggacctggaaacaagtgtttggatacttcttccttatactccaagagggctttgttgatcacttctcctacttgagcgtactgtttgcaaaactttggagtaacctgaaatgaaaaaatatagggatgcaacacagcggaaactatcagataatgaatcataaatacaggaagaagcatgatgatatatgaatggtccaggattttaccttagcgtgatgtggatgctgcatcattcccagaagatcatggtagactaaaacctgaatccacaagaaaaatgtgacatacttgatcagaaatgtagataactcactctttttgtgctgatcttactctttaatcatgcaaaaaggccaataactgagaatatggtttattcaatcaaaccatgtataagcacatgaaaccgaaagaagcctattgctctcgttaagacaatgtaaagagtatcaaaacgaacctgaccactgcagaaagggccagctcctatgccaatggttggaatattaagagcagaggttgcagcagcagccacaggaggtggaacacattctaaaacaaccgaaaaacatccagcttcttgcaaagccatagcagtttccacaacctaatccaccaaataagagaaaaataattttatcacacacccctttaaaaaataacctcttaaggattacatacacatgcctgaaccattacattcaaaccttaacagcactagcaatgtttttgccctgtggcctgaaaccaccaagaacactgatagcttgaggagtcaacccaacatgtcccataacggcaatccctgcttccacaatggattttgcagcagtgatccttgaaggtgatcctccttcaagtttaatagcatccattcctccttctttcaacaccctaactgcagtatcaaccgcctgaacatcattcaaactaaaacttaatcaaccaaatcgatgctttgctcgaacaataacaaacttgatatcaaagcgattaactgaaacataggataggatcctttgggttgtgaatttgaaacaaagtatccaactttcgagattattcacctgattggtgctagattcataagtaccaaacggcaaatcgccgacaagaagtggtcttttggctccgcgagcaacggcgcgacagtgaacaagcatctcctctaaggagataggaagagtggtgtcatagccatggacaaccatggcagctgaatctccgacgagacaaacatcgattccagctgtatcgatgtgaacggcagaagggtaatcgtaggcggtgaccatagttatcggctcacctttccgatgcttctgtctcaattgcgtcaaagtcactctctgattcgagttctgcggtttcggtcctccgtaaaccgtgtcctccggtacgttgctcataaaccggacggtggtgatggctctcgaagcacgagagcaacaactcctgacgagcgaagcagccattgttgttgctgatgaaagcgattttggaattagttataaatttaaagacttttggataaatatttttcttttaagaataaaaacgatgttggcgactcacgcgctggtgactccgattccaaagttgactgctttcgtactctctctatctactactccatcaagattgtctggttctgttccgggtttgattgatttctaccgtcgccggagattttgtcgtgtaatcacctccatg

SEQ ID NO: 31498 - DNA, 3003 bp, Unknown
  misc_feature (1)..( 3003): 2750-1469P.txt file - cDNA_ID_3042699; gDNA_ID_1972163; Annot_ID_179634
aaactatgcttttgggactctccgatggatctttatatagtatttcctggaaaggagaggtaatgtacatctgcttcatctgcattgtttgttcttggggtttttgaattctttgtgcaagattcctgatttctcatgttttgtttgtctttgtagtttggtggagctttcagtattggctcccacccttctgctagcaacgatgatagactcttgtcctacactcttggtaatgggctagtctctggagtagcttcaccaacacttgcatctgatgataaattctctacaaaaccggctattgttcagctggaactttgcactcgttccaagttattgtttgtgttaaattcggatgggcagctagtagtatgctctgtgaataagaaaggtttaaagtacactgagagtattagagctgagaagaagttgggtggtgatgctgtttgtgcatcagtggcttcagagcaacaaattcttgctgtgggtacaagaaaagggatggtggagttatatgatctgtcacactcgatctctctcttgcgaacagtttctttgcatgactgggggtaagcaacttgttactatgaaaagggatggtggaattttgtgatgaacctttattttttaatatttgttttgaaaggtttgagtattactattcatctgagtagtttttattgtggtgttgtgtaaagaccataatatcatacttgtcatactacaactggaagtttatacgcctttggtagttttcaagttgtcttactgtgatttatttcatgcccttgatattttggctgcatcgttaataaaactgttttaaaacttgcagttattcagcggattacactgggcctgtaaataacattgcatggacgcctgataattctgcttttgcagttgggtggaagtcgagaggacttgcagtttggtctgtttctggatgtagattaatgtcaactgtccgccaaattggactgacttctacatcttcccctaaaattaatccaaaacaagactgtaaatacgaaccactgatgagtggtacttcagccatccagtgggatgaatatggatatagactatttgctacagaggaggcatcatgtgatagaattcttgcattttcttttgggaaatgttgcttaaatagaggagtttcaggaaaaacttatgttcgtcaggtaatgtatggtgatgatagactactcatggttcaggcggaggacactgacgagcttaagcttttacatctaaaacttccagttgagtatcatcatatccgttatccccttttgctcattcatcgtatcactttgaaataaatttcttatatatattttcttggtccaggtttcttatattagccaaaattggcctgttcaacacgtggcagctagcgaggatgggaaatacttggcggttgctggtttacatggcctgattttgtatgacgttaggtttaagaagtggagggtatttggagatgtcagtcaagaacaacagattcattgcaagggtttgttatggttggggaagattgtcgtaatctgtaacttcattgaagcttctgagacgtaagtcccgatctatattattagtttctaatcatggttcactggctatatttattaatgtttacaaggaagagaaagtgccttttaatagaaatgtgtttgctactcttccagacttttttacattaatgtgataaacgtttctgagcattttgtctttgaatgttgtttaatttcacgtgtatgttcgctaattattgcagatatgagctgcttttctatccaagatatcaccttgatcagagctctttactttgtcgtaaagtgctgcttggcaaaccaatggtgatggatgtttaccaggattatatacttgtatcttatcttccgtttatcatccacgtctaccatgtgaagatatatggtgaattgacaccttcaagcaaagcagatctacaggtagttagttattccggttcatttcttctctgcatcattttcagtaaattatactttttaacttccaaatgtgaacgcttgagttgcttttcatgcaccttaaagtgattaaatgacaaacagctttccacagtaagagagttgtccatcatgactgcaaagagccatccagcagcaatgcgatttgttcctgatcagcacccgagagaaggcgaattggatgaagataatttgtcttctgatttgtcagaaagggaaccctcaaggtaatcatcaatagagtagaatatcctttcagtttatgctgtcattctaattgcctttgtggtctccatagatgtcttatactgagaggaaatggggagctttcacttcttgatttggttgatggacgagagagggaacttacagactcagttgaactattttgggtgacatgtggtcaatcggaagagaagacaaatcttgtcgaggaagtatcttggctagattatggacaccgaggaatgcaggtaattcctctgcttcaaagctgcttgttatgctcacttttcttcttcttcttttttttttttttttttttcttttttctttttctcgttatagggttgccctgcccctaagtgtctgacagtaactctctgtttgatccctgtcttttgtaactttttttgatttgtttaacgctgagattctatattataggtttggtatccttctctaggggatgatccttttatgcaagaggatttcctgcaggtatgcatgctagtagagtccattttcaccgccattggtggcttatctttttgttctgatttttattgtctgtaacattattgtttgacgacattgacattcaaacacatccctcttataaatttctaattttttcattgtttcaaatgcatttttattatgttccattcttcagctggatccagagttggaatttgatcgtgaggtgtatcccttgggacttttaccaaacgtgggcgtcgttgttggagtttctcagagaatg

SEQ ID NO: 31499 - DNA, 3003 bp, Unknown
  misc_feature (1)..( 3003): 2750-1469P.txt file - cDNA_ID_3042705; gDNA_ID_1972163; Annot_ID_179632
actagcttttgtgtgtgtgttttttttacaggctttcacacccaagtgagacaacgaaaaagggttatggggaggtgaatgcgtttgtgtgtgatcatgtttgtacaaatatcattttgaacttaaaattattatgtactttatataaattgtggtcgaatgcaaattaaggttccccgtaacactcttttcctaactcaatgatcataagatgcttttacattgtcattcggagcataaaagagtccatcttaattgtttttcgttattgttgatatctaagcttatgttcttcttctatctctctctcttacctttctctctttccgaatatctctttctcacctttctctctctctcttgcttacctttttctaaatctctctttctcacctatcttcttttctctctctctcaatataacatgacaaatttaaatattgaaaatcaactgaaaatttgttattgtctaatgcatattcactaaagttaaatctaagatagtagttatacgttaattatgaacatgatttagcaattatacaacttccaaatagataaggtggaaaaaagtgaacacatgagtaaattgaagtttaacttgtaaatattttgtacagagaaagaacctctatcaattaacactcgataaattagtaatcactataaattacttattttttcagtctcgagttagatcaatgtaatatttaacatcatttgataaaataataacttgtttgaaaatctaatgtaactaaatagtctagtaatatcgtaaattaataatcattatcataaattaatataaacttatcaaacatcaaaattccgattacaaaaagaataaaagtttagttatgttattaattattaaaaatttagacgaaggtatactagttttgtaatcccattattaatagtctatagaatggtaacgggctaacggcgatggtgataaacggaagagaagagagagagctagggttggagaaagagacaaaagagagggactacggaatgcagaggaaagcttcggcggtgttcatagggtcgtagaaaggagaaaaaaaacagagagaaacgacggaaggcagaggaaagcttcggcggtgctcataagaaacccatggagaagtctagagtcggagatgttgtcggagaaaggagaaaaaaacagagagagaagacggaatgcagaggaaagcttcggcggtgctcagctcataagaaccatggagaaatctagcgtcggagagaaatacaaacacacaacagagagagagagaaagagagagcttacattgtgagatcagagcgagagcttccatccagagagagagagtgagagcttatatagatggttttccgaatatatagtgtgtgagaacgaagaaccatcttttgtttttttgtttttttcttaagtacttttatataaaaacacgagagagagagagagagcacggagaagagggagagagacagagaaagcaatggtaatgatcggaatatggtgcacggcggtgatgatcgggaaatggtgcacggaggagagagagagagctaaaaaaaacttacatagtagtacatgaaatttaattgtttattttttggggtttctatgaaatcgtagaaatattattttattaaatatgaaacttacaataaatattattttctttaacctagagaaatagtagagatacaagtggatattggatataaatacctctttatcaaagacattttatacaacacacatatcaatattaataatacaacggttgattaaagtcaaaaacaaaaaatcccaacccaaatttttttaagttcacatatgtgtagtttgtttagcgtttcagaattcttttcaaaccaagtaatccgactttatttttaactgactcgtttttttaattatgttttggtgtcaaaactaatcaacccatggaaagtatcaacccacatatgtggtttagctttttcataaatatacattttaatcatttcttgtttagttagtgacaagacatgttacttgtttgatgacaaatatttgtatctccaatttctaaatcttttagccaaatgaaattatatatttgaccaaaaaaataaaactaagaaaagtgaaagagtatgggggcatcagaatctctgtcatgtgagtactattttttgaacaagctaagtaacgtcttgtatctatttgatttttttttagtatcatatagcacgagtgtcttaatgaaatcgttattagcttcaataatactaaataaaatgtttactttcacaatatgtaaccgattaaattcgtaaatattttgtacgaagaaaggatctcactcgataaattagtaattactataaattaattatttttttaatctcgagtgagatcaatgtagtatttaacataatttaataaaataataatttggttggaaatataatgtaattatatagtctagtaatattataaattaataatcattatcataaattaatataaacttatcaaacatcggaaattcagattaaaaaagaacaaaagtttagttgtattattaattattaaaaatttagacgaaggtatactagttttgtaattctattattattactctatagaattaaattaatagtctatagaatggtttgagtaaaccgagaaatgagagagagttctccttgaaccaaggataatcaataattgattcccggtttattcgtaaaattagattcgtatcaccgaaaccaattatattcgcaaaattaaaatccgatcaacataaaccggtcgggcaattccaattttgatgctccgtttattgagcgtttattgatctgcgactgcgagatccatcttcttcttcttctccttcttcttcttccaacgaatgttcctatgatctctgtgtatgaacagaatctgtaatcagatccattgtagagagagatagccatttcaattcgaggtagccaaagatgtatatg

SEQ ID NO: 31500 - DNA, 3003 bp, Unknown
  misc_feature (1)..( 3003): 2750-1469P.txt file - cDNA_ID_3042709; gDNA_ID_1972163; Annot_ID_179631
aggcagtagataaatagggttacgttctcggtattaggacattttcataagaacaaacaaaaaatagagcactaattatcattattttaaaagacattagtatatgaaaattttatcaagatcgttaactaatcttgtagtaaagtaagatcaaatggctgagcttcattccgtaaatcacacgtcaaagaggtctcatgcgttgtctctattagcatttatactggttataggaaaacaacaaatgtatttgaaaagtataaaattcttttgtaattacatatgataagctaagtagctaactactgtattaggttcttttctttatttaacaagtttagatatttgttttgtgattctatgttggcatcagtggaggtgtatatatcaaataatgcgagggatcacctaaaatattactatttctataaaccagttcattgcttttgtctttcttttttttttttggtaagctgcttttgtctttcttatatatataggaaactatgctctaatttgcactacggtttggattagtttcttattttgactacagtaatatagttaggattgcttctagttttgaaaaagatgataatatgttttgagatcggtacaatgtttaattgaaatatatatatttgatgatcaaattaaaggcatattaggttgagtaaaaacattacaaaagcaaaagttcaaaaaaaaaaaatgaagaaagcaaagagaaacgagagaagggtgtgtgtgggtcaaggaggctttaaagagatgattaataaagaagaggaatcaaccttatctatacccctcaccctcaatttcgaaaatgatagattatatatatacataattaataattatataaaagtagaaaaaagtctattgtttaactgagtggtggaccggagagaggtataggagacaagtcgtcggtggcaatgatccttccaccaaccggcaatggttcatggctcaactatgatcggagaaatgtcgtttttgcaatgaacatatatgttttgttatctataatcgtattttaaaatcaagtggtcgtatatatatactctaatacttatagtcatgtggaaattttttcataagatgtacaacttacttacgatgatatattcaaacttagtaggaatttatttggttctatagcctatatatagttgactcactcaaaaataaccagagataaataataaaattgatgttttttggtaatatttatgaagtatgggccttatttataatcacacgctgaattctgaaaccttataattagaaaacgcattcaaaaaaaaaaaaaaataacaataagaaaatctatatagcctagtagaacggtcacaaaaacccacaaaagtatcaaaaactcgtaaaccatcaacgtttgagctcattttgttgttatagtcaaaatcattcaaagttattttgacaagacgtattggtaccataataacgcattaatacacctatacatttataaattattttattagttatacacgatggtagtacaagaatacatgtattgtagtagaattttgtaatcaattaatgtcacaaaattcaaaccaaacttcaatgagaaaattcatgatgctcaactagtcaatgtgtatgttatacgacaaaaaaacatgcaatttgtcaattaccatcgatccaaaaaaaaaaaccctctaaaacgataagaggaacgaaataagtatggagaatggtgtgttgatttggaaatgttataatgaggccgagacagccacatggccctattgcttgtatgcatatcatctcatctcctacctctcccacacttctctttgtcatgtcactgtttaatttttgaatactcgcaccatctcgttctctggtcccatgatgcatcgatacgaatatacttgattgactgtttcttgtttgtttcataactatataccctactttaaaccctatttgatccaatattgatcttagatttaagatgatgtttcggtggaatatgaggttcaatcattgcttcatttgtaattaaataaaattttagatgatactgaaaaagtcacgacaatacagatttttttattacactataattgtttttcaaataaaaagattggagttcatgtattcagtctctgttagggtcttaggaaccttttgttgttgatattatacgataaagatataattagcttattctctatctttatgattcctattcctactgatgtctttatgaatctcataatttataggtcacataaaacatggctaatcagtgttttgctaatcataagattttatagatgtgattcgcaattttgtttcctacaaagcaggggtggttttctagatagaaagagataaacgtatacaatcattcgctataataatatatgatcgattaacaacgatgtttatagatatttaatcattttgctagtgagtatacagtcttagatctcgtcgtcttgtctttctcctacacgtcacatggtaccacttcatgtttctttttgcttggtaccactccatgtttttattatcaaattggatatagaaaaattgcaattaatttgtagaaggtacataaatgaggtcccgctccggcaaatgttaaagccgtagttattttcttgaaggcctaatgctatcagctgaagattaaaaaaagcccaaaaacatatgggctttggtattctttataagcccagtcacttggaatactagcttatattttctttctttaaaactcagttaatagttatgttcaaatagagagaaaatctaagatgtggtgggacgaagttgccacgtgccaatgagttgaccaatgaggaaactcagtgcgttatccgtagggataatcagataagcagaatctgattttgtcaccagagtgcttttatagattacacaacacacgttcgtttctttcttcttctaacacactctgagtcttgaaggtcaacaacgtcgagaataatg

SEQ ID NO: 31501 - DNA, 3000 bp, Unknown; identical to SEQ ID NO: 9617
  misc_feature (1)..( 3000): 2750-1469P.txt file - cDNA_ID_3042712; gDNA_ID_1972163; Annot_ID_179629

SEQ ID NO: 31502 - DNA, 3003 bp, Unknown
  misc_feature (1)..( 3003): 2750-1469P.txt file - cDNA_ID_3042716; gDNA_ID_1972163; Annot_ID_179627
gtcttttctatttggcaattagtacactacttacgttttgtggtaggaacaaataatttgtaatcttggcacaaaccagtgctttgtaactttgatgatagaaaaaatttattcactagttcgataacgattatcaatcatcataaataaaaaaagttagtttagacgatcatgaagagagaaaaaacagaattattggtactatctcttaatttcccaactctgtaggtacactcattaatcattatggagaatgtcatagtcatggtacataatgaatgtgcatggtgcttatggtacagatgttcttaacttcttatcctggctggcaaacgccagatcatctcaactggaggatcatgttttgttcgtaacagttagtaactaaccaaattagtgacaatcatgagggattattaaaaacagacattgatctatttttgattagaaaacattactgataaaactacaaaaatagctggaatggagcattcaaaactctgtccaaagtccaaacggttaaattatcactgacccaatccaataattagatttatttagtaagtatgattactacgaagataacattaacaaaattttatgttattgtcaatttgtcatcatcgtctttattttttatttctcaactttctttgcattacatcttccaactatataattaaccactctactttctcaaatcccacactcagagaagaagaagaagaaaaaaaacagagctttacaatttctctctacagagatcgaagatatggaaggcaaggaagaagacgttagagttggagctaacaagttcccggagagacaaccaatcggaacatcagctcagagtgacaaggactacaaggaaccaccaccagctccgtttttcgaacctggtgagctttcttcatggtctttttggagagctgggatcgctgagttcatcgctacttttctctttctctacatcactgtcttgactgttatgggagtgaaaaggtcaccgaacatgtgtgcttccgtcggaatccaaggaatcgcttgggctttcggtggtatgatatttgccttagtctactgtaccgctggtatctccggtaagtcactctacttctccaagtatacgcctttttactgtaattaggtttccgagtgtttgggttgtgaaagaagacgataaagctataatcttgagaaaattgtgtttagatttatagcttcttagcctgaacttgttccatttgtatctgattcaagaaatctcagaaagctacaatcttggtggaatttgcagttttctaatatgaattgtgtcctttagcctaatcttggaatgtattttttttatatgtaactctcaggtggacacatcaacccagcggttacttttggtctgttcttagcccggaagctgtcgcttactagagctctgtactacatagtgatgcagtgcttgggagctatctgtggtgctggagtggttaaagggttccagcctaagcaataccaggctctaggaggaggagctaacactgtggctcatggttacaccaagggaagtggtcttggagctgagatcattggcacattcgttcttgtatacacagtcttctcagcaactgacgccaagagaaatgctcgtgactctcatgtccctgtaagttaccactccttgtaacatatctgctaatagcttcttgaaacaattgaaatgagtgaacttttaagctgcctttagtgtgactctcatgtccccgtaagtaaccagtccatgtaacaattgctagaaacaattgaaatgagtgaacttgaagctgccattagtgtgcactaaagactgattctcaatattggatttgttgcttaccggcttgagttttgtaataattgtgcagattcttgcaccactcccaatcgggtttgcggttttcttggttcacttggcaaccatcccaatcactggcacaggcatcaacccagctagaagccttggagctgcaatcatctacaacaaagaccattcctgggatgaccacgtgagtttccacacactatataccaaatcgcattccaaactcggtttcgagcatttttccctgacaatttcgtttttttttgtcgtcattccagtgggtgttttgggttggccccttcattggagctgcacttgctgctctttaccatgtggttgtcatcagagccatccccttcaagtccagaagctaagtaaaaacaagacatcaagtcctctggtttctggccttgtccttagttgcttctatagttctattgttgatctactacatgtatgtgtgcaatgtgtttatctatgtgccctcttaatgcaatatttgtaaacaaggaagaagttccaaaggagaattatttgcaaattatgatgtttaacatgtttattacagatcaaagatgtttaacatggatattggtaaacgagaacctatataaacccaaattaagatggtctatcaccgcttaaccggttaggtattgtaatggtattttaaacgtgtcagtgtcaccaacctcgcctaaatcctaatggaattgagacacagccaccaaaaaccatcagaaaaatggttccatttgtcaaatacttttcaacaaagcacgaagattccttgaccgatagaaaaaagtaaactgtataagaaaagaagttaaaaatttactagaaacaggtgtaagaagttgactgtaagtttgatcattccacgagtacgaataaaactctgacaagaacacttcacttaccacaaatccacaattacttttctcacatagttccaacaagcaacttgtattattatattcttaacaccaatggtaatggatgatgatgcaatgtatttgtctcgttttctcatccatttatatgattgctttcttctccacctcaccaatcactcctcctctaaacttttcttcactctcttgtctcttcaaacttcggttactccgttttagtcgacaacaatg

SEQ ID NO: 31503 - DNA, 3003 bp, Unknown
  misc_feature (1)..( 3003): 2750-1469P.txt file - cDNA_ID_3042720; gDNA_ID_1972163; Annot_ID_179626
atgtattataccatacccggccatcagtagacggtttgatgcctgaaaccatcatgcttttgagccccatctgttgttttgactttctaatggaatctttaccaagtaatttctgcgatcagaacacagttgataactattacgattgagacttacgagaagagcaaaactgaaacatcaaggaaacaaacaaagaaccaaccttcctcgtagaccagaattcgtcttccgtcaggactttactttccacaaattgcttatgcaatttctgcaactcacttcattatcataatatcagaaacttttacccaaaaagaaagcaacttttataagtgattacacacctattttctcgaagaagcttgaagcgtagctcaaattctgccatactaagttgttcagcaggtgtcaagacaactagtttattaggctcctcttcacatttagcaagggccttagctgttcatagcacaattggttacagcaacaacaccacgaaagaaacacagaaaaaatacttaaaatgaatcaataacaccaaatcatggcacgtggagcttactgatgaaatcacgacaagcatgcatgtcaggataattttcaaactcaaagatatgactccttccctgtaataatcaaagacgaggaaacttcagtgatacacctatcaatattttttagccttgagcaaaaagggccgaggaaaaacaacctgcttgctggtcagattgagccaaggaggtttatttgatccttctttggtatatttctgacctgagaaatttaacatggcacaataatcatttagagaaattattcatgataaatctgaatgaacaatatggataatcaaacacttacttttgatgttgtgagtctgaactttaagcttcaaatctgatttaggatcatttgggacaaagagcagcatcacttcactctgagaacaaaaattggaagatcctttgagaaaaaaaccattgagtaaggaaacaaaaatagaaatcatatagtggcaaagagttaaagtattcttactaattcgagggatccaagagttcctggatccttcacaaagctcttgtatttgactcgcttctccattgatatatgcccaaggttctaaagcatggtaaaattggtggattaagtttgtgagccggaggaggtaaggagtgtcgacggcggaggaaatatttgaatctggcggaggagaacggctagcgtcggcagatcagacaaaaatagctaaataatttgggaattttgttaattttaagttcgagagataatgaggtggttagaaccacgtgtacgagccgtgatagctcatgtcttgagatggttcaacagttcacacccgaagttgatgagtctcaagagccacgtgtacgagccttgtttaaccgggcctgcgatcaatagtagtgttgttagcttaagcccgtatatgtatggcccatttattgtctcgagctaaaagtcgcaacttttttttattgtttttttttagtttattataggcagacgataacatttgtcttattaatttcatgttaggaggacattggtaattttcgcttgtttttttgtgtttggtcaatgaatattttttttttttatggagccgtgacgcaaatgggggtggctaggtggggcaaatgcaatcatgaatagcagccacaataaaattaataaattgatcgagtacatatgtcataagataaatggtcggttttggatatgtaaggcgccggcattaggtggtatgactccacgtatcttatcgtcgatgcattggacggctattaaataatcagtctccaacataaaaattccaaaatcacacttcacacattcttttatcatgtcatgaggcttaatgggtcggtctttttttttagtggctagtgattttagctgatgtttcaacattttggttttaagtgtttctattttgcagcttaaatatacatataaaaataataatttaaagattgaaggtcctcaaatcgtgtaaatgtggatttttagtttgagaaagtatctcacatgagccttttttatcattaattacttaattacagtgtcaaaatgattgataaggagttggaaaatactaggtggtaatcaagatggcccttggatgctacaagagcgtagggccatagggcccattccagaacaatatagcaaccactaagcatgtttttgttttctttaacattgtcttttctatttggcaattagtacactacttacgttttgtggtaggaacaaataatttgtaatcttggcacaaaccagtgctttgtaactttgatgatagaaaaaatttattcactagttcgataacgattatcaatcatcataaataaaaaaagttagtttagacgatcatgaagagagaaaaaacagaattattggtactatctcttaatttcccaactctgtaggtacactcattaatcattatggagaatgtcatagtcatggtacataatgaatgtgcatggtgcttatggtacagatgttcttaacttcttatcctggctggcaaacgccagatcatctcaactggaggatcatgttttgttcgtaacagttagtaactaaccaaattagtgacaatcatgagggattattaaaaacagacattgatctatttttgattagaaaacattactgataaaactacaaaaatagctggaatggagcattcaaaactctgtccaaagtccaaacggttaaattatcactgacccaatccaataattagatttatttagtaagtatgattactacgaagataacattaacaaaattttatgttattgtcaatttgtcatcatcgtctttattttttatttctcaactttctttgcattacatcttccaactatataattaaccactctactttctcaaatcccacactcagagaagaagaagaagaaaaaaaacagagctttacaatttctctctacagagatcgaagatatg

SEQ ID NO: 31504 - DNA, 3003 bp, Unknown
  misc_feature (1)..( 3003): 2750-1469P.txt file - cDNA_ID_3042774; gDNA_ID_1972164; Annot_ID_179703
agaagttttttttttttttttggttagagagaagagggagaaggagagggaatggatctggaccgttggatcttgttcgtggagatctgtgttggtccggcgcgtggtcttcggttacggtttgataaatttcgaaccatgggccttgggctagttttatttttgtgtgctaaatttatgatttggtgtccactaaatgtttagtttattcttactgatccaacccaacaggttacagaattgatgaagtatattcatacagtatatgtatttttctatatttcgttctgagttgcgttgcgattaagctctgggaaaaaaaaagttgtttcaatcccttcacttgtaaataaactcaattatttaactccaaggggacgcaaaggttaggcaaaataataataataataataagagttaggcaaaaagagagcgattgacaaattgaggaaatttgaatatattgtcgtcggtgttaagcaaataatcatccaaagaataaagcgtggataggaatctacaatgatcctacgtagcatctaatgtactgcatgagcattcgtttactcaaccccatccaccgatcatccgctgcggacaagtccacatcttcacttcttcacgaccaatgaggtaatgccacgacgaaagcctttcctaaaattacacgatccatttccttttctaaatggatacgaagagtgtttccattgacattaaaggaaagctaactttacttaaaatatcgtccttgaggtaacaaaaaagtttaagcccctatactgtcttatttaatgttttttttttactcttacactatttagttctatgttaatccaaatttatccaattatttccgatatctaactattatccaaaaaaattagggaatgacacgacacgacgtaagcctttcctaaattatacgatctagtttccttttctaaatggatacgaagagtgattccattgacattaaaggaaaaagttaaagcatacattctcagatttgttttgaatgtagactgcaattattacgttaatgtgatcgtcttattaatgcttttaactccaatttacaatgagattcatgtttatccaattttatcccaatctcattaaactcttaccatacaaaaagtcagaaagattatccaaaaccttccgatatgaaaatggtaattatttgaaatgcacgtgtatatttatcataaaaattaatcataaaacggtgcttacggtgatggtaattggtgacttgtatcaatcaatgccagtaaccgattataatacgagttcaaataccaaaaaaaaaaagagctgtaaacaacaaaaatccatataatatctaatacttttaaaagtataaatctaataatttaaaataataataagttagtaatttattttaaactcctaatatcaaaatagtatagaaatcctatactatcataggaatcctaaaagtataaattattttaaattctactaatttaatagttaccagctgaaaaaaaaaataaaaaaaataaaaaaataatagttaccaaaattactatcatagacaatccatgcatttttgcatgaatcctaatactatataaaatacgataaacacccatatttatcattttacacatctttttgtttgaattatccatatacattatgtatagaaagaaaataaaaacgaatattcacttgacagattaacatatgcttttcttttgattgcagtttgtaatccaccgacagagaaattgcgatgtcataaatctgaacacgaattttcggtgcactcgccaacacctgatctcaactctctccagcatattccccaaattaacagtagctaacggagacttaacgtggactcctcgcaatccgagtcactttaacgtgtatcagacagccaaaccttacgttgaccccaccgccgttaggaattccgtctatgtctctttttccatcatccaataaaatcttgccacattgacactttcgggtccggacatattccaaaattaaagagaatttaatttattgttttccttccagaaaaatattaatattctttctaaactaaaaaatggagtcttcaaatagcacagaagcagagacatagagcgggaacgcgtttagtcacagctttcttctcctttagcttttctctctacacttgcttctctctctctctcctttgggttatccttcttgagatctgtgcttgcgtttcttcttcattcgacgacactttatctcgggagatttcagatttgtcgatttgttcaggtacggatttcgaaatgttctttcaatcggatttgttcttcctcggaaggtttctagggttttgggattgggtgtctttaatctgtttgcataagccatgaacgagtttttttgttcccccgagagatctttgtgacttgtagatctgagttgggttccaaaatattcaatctttgtgatgtatatctacatttttagattatcaaactccattaaagagaaaatctttgctcgtttctcttaaggcccattgctttttatctgaagatgatttcaagagagtgccctgtttttttgtataaataaaattttgatcttttgctcgctttatacacatgtgggaacggttttgtcggtggagacatttatggattcgtgaactgctgcaaaaattatgcgtttcttggacgtttctgtaactttctctttattagattttgtatcttgtgtctctgtgtccaccattgcgttgtgtgtattcaattgatttccccaggtgttgaagattgttatttatatatttaacttattttatgcacagagatctttagtataattcatgaaaatatggttttatcttccatgatctaggggaactaaaacatttgtaaagtttgagcccatattttgtgtttgttgcttttcagagatgcatatattatggttgttgttctgtttatgaattgttatgtgcattgttttgcagcaatg

SEQ ID NO: 31505 - DNA, 3003 bp, Unknown
  misc_feature (1)..( 3003): 2750-1469P.txt file - cDNA_ID_3042788; gDNA_ID_1972164; Annot_ID_179698
caggccagtctaacttcgcacctcgtctgaagtatttctcagagcgccggctgcaagaaccgttttggttttgatataagaaatgacagttcaagttattttctgctggtatctgatgctgcaaataggatgatattattgttcttactcggctctgagcaccatatgaggtggtaaaggtcctaggaccctttccatcatggccaaatgttccaagttttcatgcgtttggaaaagcgcctctccctgcaaggtttaatccagagaaaacgttgatggagacatggtgagatgaatagggtggtgtaccggaagatatgcaaacataaagttactcaccgaacaaagttcaacaagtatgcaaccaatactccacagatcacatggatagttccatccaacccctgcaataaacgttccaaactcttaaataccatgactacacaaaaaaataatcatctacgtagatgtgtcagagtcataaacgtttacctaggataacttctggtgcgcggtaatgtcttgtggatacaatgtagttatggtcttgatgttcaaatgttgtacttccgaaatcaatgagcttgatggcacttgacttgggcagattcttgaagtatgacccatcttttgtgggtcgggatagaaactagattttcatgaccacacataggaaaagggtcaagagttatacaagttccttcatggatggatatcatattagccatgaaaataaatgagtccagcttggagatgattgattgctcaccttataatcaggtattttgatatattcagacgataccaaaagaatgttctccggcttcaaatccgtgtggatcagccgtaaatcatgcatatctgtcagaatggaatgagcaaagtctgagtacactagtcaacaaaagtctccagaaataactgtctgagcaatatggattccatggaaattgcattatcgaaagaacattaagtaataactattaacgcctaagtcttgtatcaaaaagttaagaaaaatgatttgtggcactaatggactactatatagaagaatgggtcaagaatattccacacacatgcaacagactccaaaagttgtctgccaagctcccgaacaagatcaatgggaaatgaacggtagctgtttttgcggagaaaatcatataagcttggtccaagcttctcaaatacctgttgaaaccatttaaacccatgcgcaagttcttttaactcacataacatttgggcgtgaagaaattgcattttcccctcaaacttgtcaaataaaggtaacagcacttacaatacaaatatgattacgatagtcaaaccaattccgtatttgcacacaactgcaaggaattgaaaagcttataccaaatgtaataaaattaaaactagcgaagaaatagtaagaggaaagaaatattcttaccgagaaccaccgacatcatgccttgtaagcctctgcagcacgtcaatttcgatcatggcagcttcacgatacttgtttatggaccgtataactttgattgccacgacttctttgtttttattatcaaagcattccaatacttgtccaaatgtacctgccaaaatacaatccaattgattaagataactggcgaccaaataaacatatttctcctacactttgaaaaacagaataatctaatcataatgattatataaacattttcgcaagagatgactaaccttcacccattttgctgagaatttgatctgcacgcacaatagaagaggcatgtcaatgtaaacctccatgataaagtctgtgaaacgtaacagataagatgtcgaaagactctgtaacataagactcacatcgtggagtcaaagtatccccaacaacaaagacataatggccgtctttatcatctggtctccagggaggagagccctgacgaggaaggccattatagaacatgtttgggtaaacaaaattgggaactaaaccactcgcaaactccggaccatagtacaacggaggttgaaatacctgaaagaaaaaaacacatcagctgaaacttagctcaagcacacaaataaaaatcttaatttcttactagttaacacaattcgcagtatcttatgaaaacaacaaaagaacagtccattgataccaatacaatatgtggacaattcgttaccgtgggtggaggaggaggaggaagaagaggcggagcagcatcccaagtcaatcggggacgtttcctgggacgcttatcaacgatccgatgagggaattcaacattcctctgagtttctaagatcatcgcgatcgagctagctttatcacgatacacactgctttgcataaaggattagaaaaatgcaaatccagagctgaaattcagaaacccagattatgaacagcgagagaattgcgattgaatttcgaatctaattagagggataataagattccgaaattcgaaaccctagttatcttcaatttgggggggatctatctccagaagataactaaaaaaggtgggaaaagtaacagaaaaatatattaaaaaaagtggaagtaatgtagctaataaactaaccgcaaatttctctcacacagagtaatttaaaacgttgaattagtcgctgtcgtaatttgatcgccggaattcagatcggagaaacaataaaaatgctcactgaattggaattgaagaaaaaaatctcaggagaaaatatttaacagcgaaagagactgaaatgagagagagagagagaacctgaggaagagaacagcgaaggagcgacagaggctctggaagttcttaatgggcttttttagtcaggcctttattaaatatatgttgactaaagaaacgacatgatgttattactgttgaggataaaaacgacgtggagttcagttatttaatatcagaacaatggggtgttttctccaaagtcttttaatatggaggagacgggagagtcgttgaacaagaaaaataatctgaagcagccatg

SEQ ID NO: 31506 - DNA, 3000 bp, Unknown; identical to SEQ ID NO: 9637
  misc_feature (1)..( 3000): 2750-1469P.txt file - cDNA_ID_3042799; gDNA_ID_1972164; Annot_ID_179689

SEQ ID NO: 31507 - DNA, 3003 bp, Unknown
  misc_feature (1)..( 3003): 2750-1469P.txt file - cDNA_ID_3042802; gDNA_ID_1972164; Annot_ID_179687
agcattaggctcaatagtcaatactaccagaagatgccatcttctcgaaccaaatcatcaattctgtcccaaagcctcctctccggttcacgtctgtattcaggagacaatggatccgagagataaaccctagctctccattgctgaggtttaggtttggataatgaataaaattagcaaagagttacttattagagccggttaagctggagatgtctagtctgggatcgggtatttcccaaacccgaatttaaccgtttaataaccatcccggttcagattcataataagaatgggtcccattgatagccacgtgtcgctagcgaagacgtaagaagagattgaaaatggctaaggaacattgtccggcggagaatcgaagaagagaagaagaacacaacagtcagatactttttcttcttattttgtccgtaccgaaatcggaaaatggacattactgttcgaatctccggcttaaaatcctccaatctaatccggataacccctagattctcatcttcctctagattccgttgctccaacaacgaacctcctcgaaagggaaacgagtccaacggtgagagtctgatctcgaagcttatgttcgttggtagattataatcggttaaattcggttttatttggtttatagcaggtggtggtggtgataaagcgtcgacggactgggacaaggcgtggaagaatttcaagaagcagagcaagaagtcattgttctcgcaattcaacgtggacaagtacgtgacttggaatcctcccagatcggagtttgatttgtcggaagaagtcgatcctataaaaagaacagagagatccaatctcatgctctggacaagtccaaggttcacacttgttggagccatcgtcattgtctcattcctccttctctacaccattcttgctcctgtcaagtgataataatctcattcatctttcatttagatcagattctgaatctgttgtttctactgtttatatgcattactacttttgccaaataataagatcgcagtttctacagtcaagcaaataaaaacgcagtataatagagccctttttgtttttgtaataaccgagatagatcatgagccgaaatcaagattaatcccctgaagtttatagaaattcgtgtatttttttgccgttgaaaatgtttacagtagttaaaaatgaatgataaacggttttcgtagatggtagaactcaatctctagacttgatcctctacacactcaaacaaaccacttggttacacgttcttggttgagcggatttcaaatgtgaaacattttaactcattttttttggtgaacctgaccaaaagaatattgattgtacaagaaccaaagttaaaacttgttttggtcgttgttgaataagaaaaccgtgctctcagaagtctttatataggcaaacatataaattgtgaattttgttttctttattatcaattacaatttattttaaaatataaataaagatataataaagctatatattcacgaataattctaaaaaagtggtaacaaaaaatgacttgaaaacatttttctagtttcaatttcaagtcattctaagaagttaaaattaaggaatatcacatgcatgaagttacattgaaagtgtcttcttacaaaatagaaaaaaaataaaaaataaaaacatagtaaatgttgtgcattattctttcaataattagggaaaacaataatacagtatcttagatgtttataagaccagtatttattcatccaggcctaacaaaactgcccgccgcgatttctcatgtaagtatgtaaccttagttattaaacaaaattgcatttcttagacgttaaccaacttaattatttgtcttatagtcaacgtgatttttttactttataataatgcttcgatcgtaagttgaatctcaatcaatgtcttgattcccgagagagaagtagagcgttaaaattgccgtacagaacatgatggagacattaatgaattcaataaaatcggcgaagttggaggtttagctgagggaggcctgtgtcatgctgattcgtttagttaccaactcttctttcaaacatctttagtatgttactgctttcatcctctttatttgatctactgattatatatatatatattttttttttactacattcgacattcgttgctaagagaatagaaaacaattttctttttcaaaattatccttagtttgatattggtatgagagatttacatgtaatttcgactcttgaaaatagataaatgtatgttgagtattgttgactataagaaactagatgaatgcatcaaatagaagtgtctttttgctttatgtacttccccacttgaaaacatgacgattctatgaacgatttcattcgtcataacgatagaattagtttgtcctacgaaaacaaatgtaaaactactataattttcttgacgtaatattggtgggtttcatgctgcggctgttggttgggaaacgtccaatataaacatttctaattatgtatatacctgaaaatttgtaaaagctaatctaaattgtgaaacatacataacaaatactttaagaagaaaaagtcatcaagcaaacaagaagacatgacctagaaccatttccgagacattatattaatataaaattgatattcaaatcctccacgatcttacagctttcaactttgagtatttcaacgttttctctgattacacataaactaaaatttgtttttttgtttttttaatagttgatagcatgtgttaattattagtttatatcatacaatgaccttagaatccgcagatcatttcaagaactcagaacaaaagctgatgtattcacttacatcattgaattgtgtcagtttgagtaacccataatataaatatacgcaagtcaaaatgcattgagcttatctctcatttagactttaaatttctgatttcagagaggtcaactctttaagccaagccatg

SEQ ID NO: 31508 - DNA, 3000 bp, Unknown; identical to SEQ ID NO: 9635
  misc_feature (1)..( 3000): 2750-1469P.txt file - cDNA_ID_3042806; gDNA_ID_1972164; Annot_ID_179685

SEQ ID NO: 31509 - DNA, 3000 bp, Unknown; identical to SEQ ID NO: 9650
  misc_feature (1)..( 3000): 2750-1469P.txt file - cDNA_ID_3042822; gDNA_ID_1972164; Annot_ID_179668

SEQ ID NO: 31510 - DNA, 3000 bp, Unknown; identical to SEQ ID NO: 9662
  misc_feature (1)..( 3000): 2750-1469P.txt file - cDNA_ID_3042840; gDNA_ID_1972165; Annot_ID_179742

SEQ ID NO: 31511 - DNA, 2239 bp, Unknown; identical to SEQ ID NO: 9657
  misc_feature (1)..( 2239): 2750-1469P.txt file - cDNA_ID_3042854; gDNA_ID_1972165; Annot_ID_179757

SEQ ID NO: 31512 - DNA, 3003 bp, Unknown
  misc_feature (1)..( 3003): 2750-1469P.txt file - cDNA_ID_3042858; gDNA_ID_1972165; Annot_ID_179755
aaaaaagagatttagaacatcaaattgctacagattcagcaggagatacagcacaaagaagatgatgctattatttgccagaaaactaaacaaaaagtctaagtcaacgcaggaagagacaagatatcaagttatcaacacaatagcaagacccacatgcaccagtataaaagaaagagaacaatttgataattcagcagagatagtgacaaaagaaggatctttatagaaaatcccaggaaacaagccatgcaactactcataccacaatgcaaaacaaaacaaaaaaatctagactagctaaatcctctaaacaaactatacaaacctgaggctcaagtttagggaatttaagagtttcctcaacaacaatgtctctattccacttataatccaaacgagcagtccaaacaacatcagacaccgttgattcaccgccgccgtatacaatctcagaacccacagaagttacggcgatgtcaggagtcaacaacggtctcttcttcctcagactcgagtaagaactgaaagacctcccggtgcaataaacaagcaatgaatcatggcgatagtgagcttcccaaagcgcattgaatctaagaaggtcattgttttcaggatcatcgtgatccacctgcgaatttggtgagaattgtttaattttgtggaatctaagagacgaattggaaatcagaagtgtgagtgagagaggaaatagaaattaccaatgtgcaatcgagatcagcaactagtatgagacgtggtggtccttcaagcctatccatcgatttcaggaacccaggtgtttctctttgcttctctcttgtctctttgctcaactaactttttggttcctttattcttgacttccttgggaagacgaagtttttcttttcttattcgaacaattctgtcgagtatttgaattagttataatctttctttttttaattagttagaaatttccttaagcacgtatttatataacatgtcaacgcaacgaagttccccctcaaaattcagttttatgcgtgcgttattacgacatgatagatcctgacgaccaccacatgatgcattactagcaatggatgactcttccttatcattcattttatattcagagaaaatgtgcaagagaatttgcttggtaagtccattggtgacaaaaaatcgatttagtttgagtggaaatagagaatcataaacaataccaaaattgttagagatgtatgtagtgatacaaaaaacgatattaaaaatatatattgttctggttctattatttgttatcgtttttatgattggtaactattaataataatttttcaattatagtggtaagaagttatcaattaaagtcttgttcttttgggtctaactttggatccgattgttaacctataaaagaatacaaggaatgaaaagtaacatgactaaaaaagaacaaacaggaaaagaaaaaattataaaataagaatacaaaagaatgagtgtagaagaaaaatagaacaaatgttactgtaaatgataaccaaaacatagaacaaatagtaacaaaaattaaaaaataaataaattattttcttaattaaatagccacgttttcacgtttttttttctaattttctataaatttaatttttaattaataaatgtttaatttgtttttctgtttgttcctcatcaaatttgagaaggaacaattttcttctacgattcctcaaaaaataaggaatgattaggaatagtgtggggtctacatgttacaatttggaaaaaaaatactactgaatggtaaaaaaaaagaggaacatgttgttcctgtccattccttttctaaaaagtggtcaccaatcggaccctttattgtgatttactaaccttttcagcggtaaaatattatcgttacactttcacaaataatttgctagtaacgttaagtgttagtgacttatatgagattgttcaagtttattcgacaaatgaaatcctttcgatctttactttaatgtgtcaaatatcatgtccactttcaaataaagactcttagcttgaaggaaaactctacgaaaaactaacgcaatatgtcccatttatatggaagacgcgcgatgttaaaattagatactgaaagttggagtctaatacattagaaactaatgatcattcaagaaaaccatagattatcacagtgacaataggcacaagtcccactccggctattacaagcattgttagaaaaagtttaggtgggacaaaagatcacaccttgcatttagtcgttacacgaccatccatcaaatagaagagatcgaagatcagctggaagaaaagctagttttaaaaaaaattcttacttgatttgaacataatacgatatgattaatgtgtcttaaaaagcatagaaaaacacatcgaaggccataaacgtgagaacgattcaaatgacataatttttacaagaacaaagaccagcaaatccaacttaccaaaaaataaaaccaccaaatcctagaaggcaagaatgtgtggcaaaaaaagaaaaagaatgtataccatttggatgggaggtccaaaattttcttagaaattagtaacttaaacttttaaaactcatacacatatggattatatgttgaaaaaatcataattcagaaaaggatcatatataactactaatatatttttgaggtctttgtttttagttattttattttattttcttaaactcgaggtctttgttttaacaatttttctaatttcattatcttacaaaaaatctcaaattttaataatataaatatttgtcataggtacgggaagagcggtttgttttccagcgaaaaaaaaagaacggtttttctctatttgttgttgttgtttttttttaattattttcgcccctgattttttttaattaatgaatataatttttgcaatttttcgtgggaggctaaaagaaaggcgaggaggaagaagaaggaaccagcattatatatg

SEQ ID NO: 31513 - DNA, 3000 bp, Unknown; identical to SEQ ID NO: 9660
  misc_feature (1)..( 3000): 2750-1469P.txt file - cDNA_ID_3042868; gDNA_ID_1972165; Annot_ID_179752

SEQ ID NO: 31514 - DNA, 3003 bp, Unknown
  misc_feature (1)..( 3003): 2750-1469P.txt file - cDNA_ID_3042876; gDNA_ID_1972165; Annot_ID_179738
tgcttcatttttagtaaatatcttgtggtatcaggtcaataagagtgccaagatatagagagaagacctcgggtcagtccagaaagattcatggtcaagcagaggaagaacaagagttgcattcataatcttggcaacagcgaccatgtcacatatctgcatattggtcaaaaccaacaaagaatagtacatcaaaacacttgactatggagaaaacggagatcaataccctctaatatccttttgaagtaaactcaccccagttctcatctgattcaatcctccatttgcgtgtactacaagatacccattggtttggcgttgcagtcctagacaaagacataaataccagattttgaaaaatcagaactgcaaacgagcttgaagaagaactaggaattttaagatagcaacatactcgtatagttcttagggcgcgtcacacattggcgataattcccgctttcaggtttctgccaaatttccggaatctgtgagaagagacaacaaaagcataaatccaaatgaccaagatcctcgaaaatgaagtcaaacagaagaaaaaactatcttccttacattgcaaaaacagaggaaatgataaaaaaaaaattagttaactatcaaaacatgtaagacctccgattacactgatcacagagaacttcgcgtactttaaatatgttacttaacgaatttaagtcaagttacaatttaactcaacaaaacaggttagacactaacacagattaaaccatatagtcaacggtaatgaactattaatcaaaccaatatcaacttggatccttatggaacttcaagattacatattgcagagctagaggattataaagagtttcaatttcaagtcttcacaaactagaacacaaaatgttatggattctgcataaaattagtaagtcaactaaaatggtaggaaggtattatccacacatcgaagccgcctataattccattgactatatattgctcgtcaaagtctcaatccaatagcaaaaaagtaaacctctcataaaaatcgccaccgagatattgattgttagaaaagctattataattgcacaatgataattcagttttgcaatcattaaagttgttgccagaattcatcttattacctaccccactaggccactacttcttcttcttcgtcccaaaaggagacactaatccaaacattgcaatctgtttacactaacttcgcaatcttaggatcatttctaatgaactgttcaacaaaaccctcaaacaattcagcaggaacaaacacataattaggattgatcccaagtagtatctaactaactaaaaaaaatgctgaatttgatcacaaagattgaatttttaaatccctaaatgtttaaagtaaagaagatgaacaaactcacgggaagcttttcgagaacacgcattggctgagaagaagcttggttctctgcaacttcacgttgagccattgaccaatcatcacgaagcgttctaacaacaacaaactccttcaaacgagcgtgatccaccacgcggacaccacccataaggtagactctaaggaacacagacgcaaccacaagcaacattagaagacccaagatccgacgacccacgtttctccccgatctaaacccttgaccaatcacaaccgtcgatgcaccaccataaaacggaatccagaattttcggaggagaaggtaacgaatcaccggatgactgtaaaatcggtggtagtgatcgtgatggtaatgagatccagtagatgaagcagagctttccgaagatggtgacgagtcttgaccagtcgcatctcctccgtctaaatctgttgatccaacgatgggttggttaattgtattgcagtaatcagatgaattcgagggtcgttcggagataacgtctagagaatcgccaacacggcggcgagtggtgggtgcaattggtacggggttaatcgctccgacgactgacatatcgtcgccggtgaaatagggaattgaagattagacaaaaggaaagagatagagaaagaagagagagggttgatttttaggttttggaggaagtagttgaccatgtatgtatcttctggtatagtcaccgtcaccgtgaaattcgccgaagctgagtttttgttttcagaattttttatattcgccagtgtgtctaattatatatttatgtgactgttctaatcattttttttgtttaggttttacattttttatgtatgatgtgaatggataattttcaagagtttgtcacgtttgtagcacatctttttatatgaatagttttttggatgttagtgtataaatataatttgtcatatcgtttagattaaacaaatataggcaaaagagtgattaacgtgttcttttgaaatagctaagagatactaacctatgatgattaagtttatgatacttaaactttttatcatcgagggcactctgcattgtgacgaagatgtgaagtagacctagaagatgacgcactgactttattgccactgctacaaagctaatcaactttgtaccaaatatacaaaacttcgacctctcacgatgttaaactaatggaattattagaacttaaaaaaatcggattagagattaaaaagaaatgaaattatttagagaggtagttagtaaaagtaaattcgatccagcgtggtgctgtgtcatttatttgactgggaattttcttcagacagtgaaagcaacataatcgatggatgatactatttaacaaaacaggtcgtcacacacgtgtgtataaataagtaaagcgcccactcctttctcatttcgtagcgcgcagagagagagagagagggacgatcttttctataactgaaacactactcgaggccaagttgctttagccgtaatcgtcgtcgtccctcttcccgatattatctcttctctgttcttcgatttcgaaaccctaacctcctctctttaattcgcgttttctggatcgaagatg

SEQ ID NO: 31515 - DNA, 3003 bp, Unknown
  misc_feature (1)..( 3003): 2750-1469P.txt file - cDNA_ID_3042882; gDNA_ID_1972165; Annot_ID_179731
ccgcagcatcaaagagtagccctgaaaatgacttgataaactctataaaattttccgttggcaaaaccaaataccataacttctctaccagccgatgagctaaggttctcattttttgatcacgaaagaagaatcccttagaaactaaaatcaaaaaatgaaaaaaaaaaaagtttcagttgtgatttcaatggacaatagtatcatatatataatctttcaaattgtttatttcttctacttacaagaacttgctacttgctgaaacaagttaagctggcttttatgggaaatggcagaagtcttgcgagccaacaagtgcaaggctttgttactatttggataaagggctagttcttttctatacaaatccactctttccaacatccacagaggtacatctgcaaatacacctgagtgagatgcaagaccaaacttgacaaaagtggaaaacaaaaagacaaaaagacaaaaagctctttgaagggtagattatatatttaccataaatatcagctgatatcatggtatgaaagagattcagatattgctgatcattgagatctttgatgcttgttttggagaaaagatattgaaccatttctccatggccgtacaaagcggcgatgtggattggtgtcattgttttctcgttcgaaatatccggaagatctcggatcatgtttattaacatctcagcagtctcaatgtctcccaacgcggcagcaaaagacaagggtgtgttgccgtctttgtttttcagtgacaagtcagggggatccatttctctgagtagatttctcacaaaatccttgtgctttgctgcaacagctatgtgaagagcaatctcagaattaccagtaatttgctccacgacattacactcttttctcgatattaaagtgctggctgttttccaatctcctgtcagaacagctttatacattaaattccggctatgtggttttgtaactggagaaagaaatatgaaaatagaagagattaacaaaagaacacaaacaaaaagtggaatcaataaataaagagagcttatatgaactgttgcatatataccatcttctgaagtatgatcctcaacattgggcagtgaactaggatcttcatttggagatgacccacttggctctcctacttccactattacgtcttcttggtgaagctgtttgcctttatccaagattcccataattgtagattgagatctcattttggcagcttcacactctaatctccaaattggtcagcttccctggattatcaacatcacatataattatttagtttacagtaaagagatcatatatattagaaaagagtctaaccataccttcaatatcttttgtcgtcgggtaagacaatgaaattaacaggtacacgaaaaatatcgtacaagcaggtcaatggtggtagcacaaccatagatgatgcttataagcaactcgatgaacatggtgaaaagttcgtcgatcaatttctaattagtaattacaaattgaacgatgcattgactatttttttgttttactttgagtacaaaaactatgatatgcataatcacgtaccatctttagcctaacttaataacatgttggaataaagacgcatacaaatttgagatcagtttcctctcgtcattactcaattattatcgtaacaattaaaaaaaaaaaaacagtagtggcgccggccatttgaatggagccaaactgaaatgttctattattggtttttatatgggaaaaatatcatttaaattattattttaccattttcgttggtttaaagtttgaactctggacttggtaaattaaatcctcaattttatgttgattttcaatttaaattctcgttaactaagccaattgaggcacaaatttttttttttccggcatcgtcggtcgatttaaagacgagagattactttgaattggaagaagaagagaaaattcgaagaaaatgagagatttcgaagaaaaagggagaaaaaatcagaagttttgtaaaaaaaattataacgatgtgctttaattggcttagtaaacgaaaattcatgattaaaataaaagttaacataaaattgaggatttaaatcacaaggtccagagtttatgctttaaaccaacgaaaatgattaagtgatgatttaaatgacatttttctcgtttttatatatctcaaaactaaataacccaacaaaacaactcagtccacaagaaacagaagtttttgctagggaaaacactgacttgttaccaacttctagaaaaatacataaacttttgttattcacttccaacttatatgataaaatatacatttttgtgagactttggataaatttcaaattgatagccgcgtttgccatgaaagatgatgtgcccttcttaatttgttctttgacatagttgatgtggtgtcaaaaagaaaacaatatataatcacggtttggagacgatgttcatgtgatagagccaacaaccaaatgacgacccgtagtagattaagtcagcagcggcaatttccgggaagatttatcacactaagaagccaccctagatactctcataagtggattcaatggacttcgtccatgcctttactttacttaatactaccacagtaccactattggttccatctagtattttgtgctactaaactatttggcatgtcgagtttgtaactggagttaaataaaatgcacttgagtgtaattggaattaaatgaaaaagataagcatttttggggttttacaacagtgaaaacaaagatagggaaaaactcagaaacgagggagacaaaagttgacacctttaacgctttttcacattgtccaagtgcttgacccatacctctctgttcttcctctctctcttcccccaccacagtcaccactttactcttctccatcaggggtccgatcccatctccaattttaaaccctagaaatcaatctcaaaagcaagcgtgcttcattaatg

SEQ ID NO: 31516 - DNA, 260 bp, Unknown; identical to SEQ ID NO: 9671
  misc_feature (1)..( 260): 2750-1469P.txt file - cDNA_ID_3042902; gDNA_ID_1972168; Annot_ID_179805

SEQ ID NO: 31517 - DNA, 3000 bp, Unknown; identical to SEQ ID NO: 9605
  misc_feature (1)..( 3000): 2750-1469P.txt file - cDNA_ID_3042902; gDNA_ID_1972160; Annot_ID_179577

SEQ ID NO: 31518 - DNA, 3003 bp, Unknown
  misc_feature (1)..( 3003): 2750-1469P.txt file - cDNA_ID_3042912; gDNA_ID_1972168; Annot_ID_179799
tccaacaagaagttgaggacagtaccattatctgagtcagatatctttccttcttcattccacaaaacaccagaagggagaaggaagctaacgaaggaagagttgcaaaaattcactaaagagagcacggaaaatgcattgaaggaattggtttcttcacctggttttggcgaatgggcggtgaaaaatgctaaaagaatcactgtaaatccgataaaggaatcgtcaagtaaatagggtgatactgttaagcgcagaagaaggttcctctggttctgaaaagcaagcagctaggggaacttctgaaccagtcggagagtgtagtaggttgcttgtgaacaaagcaacaagccttgcttatatatagtcttctggaaaagaactaatgagcaaggcgaaaaagttgagagattaacttctaaatcaacaaaatgtaacctttgacataaattgatattgaccaataagatcatacgtttccatgtgtgtagtcatcaatgatgtgaaactcaatactatagtgtattttatttgaatggacgatgatagttggtataataaaggaggaaataaataaagtcatctttttgttatttaacggctgaaatttcaatagcaatttaatttgaatgattccagttccacaaatatgagttggtcatctatatcacatgtaagttttcttagttatatttaaaaatcattaaaatctaagagtagtccttggagagaacatgtctcttgtctcctaaacctcctttattatccatcatcattgtcactaaccctattattattccattcacagcgaagaaaaagaagcaaagagttcgttataaagaaagaaataaaccctcagataagagcataacagagaagaagaagaagatgtcttatcaagacccacaacatcccgttagtgctcctcctcctcaaggtaattcccaattttttccaagtttttagggtatttttgtttcttgtttcttaagtttcgatgttgttgttttgtcagggtatcctcctaaggaaggatatccaccagcagggtatcctccaccagcaggttatcctccaccacaatatcctcaagcgggatatcctccagcaggttatcctccaccgcagcaaggatacggtcaaggatatccagcacaaggctatcctccaccgcaatatcctcaaggtcatccaccacaatatccttatcaaggtcctccaccaccgcattatggtcaggctccaccgaaaaataagaaagataagaaggattcaggaggcttcatggaaggatggtgcgttgaccaattatctctctctttttatattaacatatagttttgaatacttgaagctgatgatatacctttttttggttcattattcataaattttggtatggagtaatatggatattcaaagtctatatgtttggtacttataaaatgtgtatttgttttgtattacagtttggctatgctctgctgttgcgttctcttggaagcttgcttttgatcggaagatgagctgatatttgccgttgaccgtcttgaggatgctattcaattttgtcaaacatgttaaaaagacgtgtttgatatacattttagatctcttcttctggttatgtgtgtccacgttttgggtttgtttctttaattttctttaattttatgaatgaatccgaatttgacttgaggtcttgtttactttcatgactattgattgattcagggtatgttacccatcttttgtatatgtgtgttttatcttttgtataaaagccattcattctttccaactagaggaacacaaaaaaagaaagcaacccaattttgttctctttctcatcaaaaatgtaagaagaagtgactgtatcaacgtgatcaaaacttagcattaccatcaaacttatataaatttatacttacggtccgatatatttccattttccgtctcaaacatatatgtcacatccaccattcctcggttgatcaactattcaatgtacaaatttttataaaaatactactaaatcgtatataatcttgagtcttcacttcttatatttaatgtaagagagtggtttagtatccaccgattaactcggttcaaaccaaaaatacaccaaaatgatatgactgaattgtgaaatcagtccaagaactaaaagtcgatgagctcggcatcgacctccatgaagataaggaaagattcactcaaatcttaagaaataatacggtaaagaatattagacatattcccatccgaaaaataagaagctcgatgaccaaacaaaaaatccgtaattctattttcgaaaaccctaaatttattatattactaaaaaatctcttgtaattgtcaagtttactctcaaaaatcatttttcttgaatctcttgtttactctaatttctactttgcttttactcgcattgttaatttaatttcataaattaatccctaatagatcaaatgggtgtatttttgcaattataaagtttaagacgaatttgtaaaaatgaagataataaagggctcccagtaaagcacctcaaaatcgatacatacttcatcctccaacatgcgtaggtgaatcgaaagattaaaggtcaaatttttgtgtcttctcttcctctgtctcatgccacaatttttagatttcaaactttgatccatgacactctccatagcttcctctctcattcccttcagctttctcaggcatgtcttcttcttcctcttcttctccttgttaatttccccatttccctgatcgaaagctttaatctttttctcgtgcgtgtcttcgtaatctctggcgtttctattgaattactaatgcaattgaaaaacttggggatttcattataaagtattgatctttgtgatgttttcatctgttcacagagaattgaagtcgagacattagaagtgtttgttgtgtgtgtgtgtgtgtttctatagaatttttgaattttgtgataaaattgtgtgaatg

SEQ ID NO: 31519 - DNA, 3000 bp, Unknown
  misc_feature (1)..( 3000): 2750-1469P.txt file - cDNA_ID_3042942; gDNA_ID_1972168; Annot_ID_179778
aagttggatcatgctgttaacaatctcttgatgctcaggaagaagttgatgctgttttcgtaaacgccattttgaccgctatccaacaacggaatttagaggtaacgccacgaaaaccaaaagtttgtgcagtttttgtttctcttctgttcaagctaatgttgtatcttcgcatgtgatatgactcttcagcgaatatgggcaaaacctgtcttagaccgtgtgggtcttataatcgaaatatttaatgctcatgcgcatacaaaggaagcaaaactacaggtactgtgacaatacagatttgtccttttacatactaggaaaggtttattaatagctgattggttcatccattcacaggctgagttagctgctttgatgtacaataagagcagactggttcgagtgcgtggtactgatggacgccatacttttgggcagtttggagaagctgaagttgtcagtgcccgagggtgagtgattaatctatactactttgtgtattctctttactcttttgatttttgagacaatgatgaaactgttgttaaattgttgtgcaggagagcaggaagcaagggaaccggtggcggttttgtaggtggtgcaggagaaactgagcttcagcttcaacgccgaaggtcttgtctaattgttggttaaccgaaagacttagtgcatggctctcttttctaatattaaatctatgcgttaaacaaaatcttgatgtaccagaatatcagaccggaggattcgcttgttatcccaaattaaagaagcccagcgaacacggctattgcagcgtgctggacgtaagaaaagagtggggttagagggtgagagttcaggaaccattgctgttgttggttacacaaatgctgtaagtgtttgaattttgctccgaagaagtttcagctagaaaccaagtgttttagtctactttctgagtatcaattatctgcttttgttagggaaaatcgactctgataagtgcactaacaaagactgctctctactgcaatgagcggtataattcaatggtttcataactatcttaaaactgttaaatttgaaactgaagtcataacttttgaatggttggtctggcctctgcagattgtttgccacattagatcctacactcaagagtgcccatcttccttctgggtaagttaatttgtacgttgagaatcatgtttataactttctggtacacatgaacttgtactgaatcgcaagagtcaatttcttttcagaaactttgtgcttcttagtgacactgtcggattcatatcagatctgcctatacaggtaatgtatacctactttaattccacttatcctttatcaagtgatatttcacttacttttcttttcttggctcatgcctttttgcagctggtgaaagcttttcaatcgactctggaagaagttgttgaagctgatctacttctggtaagagctaaataaataaataaaataatattccatagttacatttagaagagaaaactgcagaaagacttggcgttgatatgattaaacccctgcagcatgtagttgattcaacagctccaaatatcgaggagcatcgttcaacagtgcttcatgtcctaaatcaaattggagtacctgaagagaagcttcaaaatatgattgaagtctggaataaggtaggattgatatataaaccatctatacaagtagaagaagcaaccaccttttttcacactgggaattttgttgtagattgattatgaagaagacgaagtggaggaagagaaatatctagatgatggcgaaggagtaggagaagaagacgaagacgaagctgatttaaaagctgaagaaactgttgatgcatctgaagcaacagtagatgaagaccaaatccaaaacggagacggtgacgacgctgatgggtggctattgtctgaagatgaaaatgctgacgaccctgagttctggaaagttccggaagttgctaaagtagatgctgcaaataagaaaggaccagatgttagagtttctgcattaaccggagttggtttgaaggagttgctgtatcttattgatgacaaaatgaaagagaagaagctcaagtctccgactatagtcgaaaggagtgagcttcataagcgtaaatggaggccacctcgtaacgatgatgaagaggagagattaatcccgttagatcaacgttgagaatataagaagaaacgaaacaatggttttgtcttctgcttctatgttcctttttttgtaccacggaatcagagaagtgcgtgtcgttttgaaacttgtacgtgtgtaaaaaacggcaagaagtttgttggtattctgattaataaatggacttaaaacgctgtcgttttcgtaacagcgcgtcatagactcgtagccatacgcgctttgtagaggcaggtataaataagtagatagcgatattgaagcagtgatattaacacttcgaagcttcttcttcctttagtaaattcaagtgtgaggtgtgtttattgataaagtgctcattttctcggatctcagatcttagatccaaaccctcattatttcattgatccaaggtagatttcgatttcttccttcttcttcttcctcttctcgatttgggtttccttcgtctaccgttctgcgagctgtttcatggatcaatctgtaattggatttgtttctggtgaaattcattgttaatgtagaacgaaacgcagctaatttgttgtgggatctaatagattttaaggttatgtgtttgtttcgtcgatggttatgttggatctgtgaattggagaattaattagcttagttttgtcgatttctgtgtttggtttgcttgagaatggtgttttattccacgttgatttgttcattttgcttagtgttgttctatgaatgttaattctaaaaaaggatacaaattaatccaatttagtgtttgatgtgtagatctaatagcttgagcttgctgggattttagttatg

SEQ ID NO: 31520 - DNA, 3003 bp, Unknown; identical to SEQ ID NO: 29463
  misc_feature (1)..( 3003): 2750-1469P.txt file - cDNA_ID_3042949; gDNA_ID_1972168; Annot_ID_179774

SEQ ID NO: 31521 - DNA, 3003 bp, Unknown
  misc_feature (1)..( 3003): 2750-1469P.txt file - cDNA_ID_3042953; gDNA_ID_2684126; Annot_ID_191115
caaagctatttttgcaaaaattgttatctagttaaggaaaagttgatagctttggaacagttctgttattgatcgagattcaacacttttgaagggtcgtatttagagggttgtaagatacatcttcttttggtgtttgcgtctatagggtattgttgaataaaggaattctcatgattcgttataaatttgcagaggttgtggaacatttcgtctgctaagttcctcaaaacatacactggccacgtgaacgcacagtattgcatttcctctgcgttctccgtcacaaatggaaagcgaatagtcagtggatccgaggacaactgtgtacacatgtgggagctaaactccaagaaactgctacagaaacttgagggtcatactgagaccgtcatgaacgtagcatgccacccgacagagaacttgatcgcatcaggctcgctcgacaagacagtaaggatttggacacagaagaaagaataaatcatcactctctctcttcagaaatcaaacatgtaggtacatgccaccttcttcatgcagtaatcatctgttgcttactaagcttgttagattgattctagcctcattatgtaaaagtctaatttttgtttggtgtaagggaagtgcaacagactgttctaaacttgtaatagttctctgtgtgactcagaactatttaggtaggtcttaaggcaaagactcctgcaagtgcaaaggcatttgagagaatgaacacaaatcttcataggtttaccctttactcattgtatctattaagctgatgcaatgcttcaccaatactattggttataaagtagtttcaggattgaaaattgttcatctgaaccatattgatgggtggctcatgggtcaaagtacagatatatgactataagtagataatgtatggtagttggttactttggttggccatgatgatgaagcttatggtcccctggtcctgtcccattttttacttttcattttcacttttatcgtaaagtcttcttttttttaaaccctacaagattttgaaatggaccacttgaaaatttgaacccactctctctttttttgttttcaatttcgaaaccaaaattttttaacaaaaagatgactttgtgacctttgttctgtcttttagctacacaccagtgggctgtttgcttttacagcgtgtctttctgtttacatgattcaagagaaagcaacagttcctaaagactcagtcatgtttgtgtctctcccaattgatacaaagaccaaaattcagctttggttcttttgtgtaaaagttctcgagatatgctaataagattaaacataaaaactctcaaaaagagtataaattgaattctttatgattgtagtagcaaacaataattgttaggtttagtgctatcataataatctattagtcaggttaaatatattcgatttggtaccaaatacgaaatcaagcttcaacaaacgaatctgcaatacacacacacccatccaaaagtatatcttcgacattttccccaaaaaagtatacatttcctaacacgtgcttaccaattcttatcattcgaagtaaaccattaaacaagaaatgttttcattattataaatttttcactaatataagtttattatttagtgcaagaaagtgcgttgcagatgaaaacttattctattgatccgggtccataaagaagaaaacaaaaattcacctaatacgagtacgacttattctagtggctacatatttccctaatcatgtgactaaaaatctgctttcaaaattttgacattcagtatttctttagatctatatcattaaaaattcatttttttcttttgcattttgattccatatttaatacaagattaaaaaaaaaaaaactaatatgtttgttcactgagcaaaccattattgttgatcagtgaactgtggtaactggcaaaagaagcaaatgattcgaaatcctactttcttacaaaatcaaattggataattttgtgagataataaaaaatcagtataaataaaataaaatacatgtcgggaaaccattattgttgatcagtgaactgtggtaactggcaaaagatgaaaatgatgcacataggactgtgtttaactgacttacttccactaatcaaaagtacgatcgtatccctacccatctctcgaggatcttaactgttgccgtgcgtcatctcaaggttgttctcgtcattatcagtcgatcagagtacagagaccggctctctgggttttgtcgatcatgccattgccttggggcttgttgttgtggtccgtcctaaggatagaaatgttattacaaagctttttaaggggttctttggttaattaagtgtttcgttttgcttaagagaggttaaagaagcgggtgtctcaataagttttggtaagtttgtgaatccccagtggtggactccatcttttcccgtcgaattataacatcaggaccgttcatttcaacatcatcaattaattcattatggggtttatctttaaaacatctttttgaatttatggttcgctttggtattgcattattacacttgtatacctgtgtaataaagtgttggattttgtcaagattaggtaacatcacgtttcaaaacaacaaggctccaaattaattaacattttcttcatgtaattatcgtttttgaatcccttcctttctaattccatgtttcattaaatccaccacatgcatatgtttctatatatgttaaataaacgacttttcaagtttttaatttgtgttttctattttcagaaaatttatgtgaaatcaaagtttcttaaaaatctccctccaagtaaattccaaaataaaataaaaataatacttttacaatatacaaataaaactcataaaaaacacacacacaatcttcatcttcctcacttactctcaccctttttaaaaccaaaccctaacttacacagaaagagaagaaaaaaaacaaaaaaaaaatg

SEQ ID NO: 31522 - DNA, 3003 bp, Unknown; identical to SEQ ID NO: 31521
  misc_feature (1)..( 3003): 2750-1469P.txt file - cDNA_ID_3042953; gDNA_ID_1972168; Annot_ID_179773

SEQ ID NO: 31523 - DNA, 3003 bp, Unknown
  misc_feature (1)..( 3003): 2750-1469P.txt file - cDNA_ID_3043071; gDNA_ID_1972172; Annot_ID_179871
aaaggaactagaaggttattgaacactttttgagtttagttctatttttttttctttctaaaaatactttagtgattctttttcttttaagcaatgagatttgttcttcttcttctcaccatatcctatgcaaaatctttcttgataattgaacaaatatttatgcaaaaagagagtatgggaagttcgattttcacggtcatgtatccatcagaaattgtgtacttgaattttcttagggttgtgtgtatcagtttgatattattccttttactttttgctttaagttcctttgttttgatttccaaaattctacaaaaatacaacctgaaaaaaggcctaaagccccccccccccactaatctggcttgactatcacaaatcttcttgatatttcttcctacaatgaaccttttctttttcgcttttcacaacttatgactgtttcatttttgcatagccgtcaaagagcatttttaggctccactttgttcaaaagaaagagtgagtttcagaacgccatggaaactaggagggaagagcaatatccgaaaaatcgaagttttgattccatgtaatgaaaccagaacgcacccgcatcaaactcgggtttataacagcaaaagtatctaacaaaaacaacaaaaaaaataccaaaaaggcggtttcaaaagcgttaagaacctcttttcaaaccccattacattcaacaacagcttcagcagctcgtcttggtttgttcttccttctgctcccattctgcctaaacccaatagacgacgatgatttcatagaatcttctgtgcttgattttgaccctaccccattctcttcttcagttatgttgctctctttagactccactggtttcttcctcttcctcccattctctgtcacattttctttacttgttactgaaccatttgtatcatcatccttgtcttcttcctcatctgtcttcttcactagctcttcttcttcttcttcttcatctttcaccggcttctgtggcctccctcttttcctaaaagctggaatcttttcttcctcgccgctccctcgatcttctctagcagtagcattctgcctcttgccttttcctctacctcttctcataactctattcaaaccaaaaaccaaaaacctcaagcaactagacaagaaacctgcaagttgaaaaggttgctttttaattaccagtagtaactcatacctcacaacaacacaatgaaggcgaactaaactcaaacactatagaaatttgttgaagaatgcagactaaaaagtgtgaaaagcaatgtcatttttttcgatatgcacaaaagtagaggatcattcaaactggcagacactccatagaggaggaactattcattgaagaatcaacacaagcgcaatcataaacacgaaagcaagattccatttttttcatgcattagaagcagtgcattgaacaagttatttaacaacatccaaatacaaattctttccaaaaagatctgaacaaaggaaacatatataagcaacacttgagtcacgagacattaaacaatttcatctcttaaaaacctatcctttagagctcaatagaaaccaagaactaagctacaagcaagttcaatcaattatcttccacgaaaactaattgcatgaacagtctaaacaagaaaacaagccctagtttccttacaatctcttcaaaacagagagacagagactcacctgtgaacccattggtcagactgagacaaaaaccccaaaaaacctataaagggtttctctttttactaatttatagttgggttctcaatcgatctaactcacgagtttctacagctaaaacccagatcagaggaaagactaagagtctaaagaaaactgaccaaaccaaacggaggaatcaaatcgaataaaaatccaaaggataagactcaagttaaaagaaagagatctaagagaagaaggaaggaagaaaacgaagagaaagagcaacagctagagtactagtgttggttgaaaaagattaaagttgattgctttcaaaaggcttctcttttctttgttctagcttctgtctctgagtgaaacttaaaagaaaaacgtaagaatgacgctttttcttctcactaccatcactgagactgactaaaatggatcttaagcccgttgaagatggatacggatttcacccacgcgccccctttttggcgcgtgctttcacattctactcgttttcgaactcgttgggttcggttggataagagacgacagctaatagccgcgtttcatccaaacatttcaaaacactttccacgggcttcttcttttcctttaacgtttgggctttggcccattagagttcactttatttgttatctctctattctctctatctatatactaataatattctatatgtcaaaatcatcacattttgtaattcagcttcatcagctatataaattgaagttacatcgcttcaaaattgttttcaaaaacattcaacaaaggattttgtcaccagactcaccactaacaactacaaaaaaaactaaaagagagagacacatatgattcttcccgggcttcttcttttactgggccttttatgcttatgcccattagagttcactttattgaacccgattttatatgaatagtggcattaaaccatttcggtctagtactcggttatgaatgattcattcattgagtaagaaggacaaaaaggtcaaagcagaaaaatcataatttcttcggtcctaaaccctactcaacaatttagaaaccctaagttctgttccggtggtccttgttatttttttttattttggtgttgttcttaaaattcagttccaaacggaaattgatttcttcgtcagttgcgttttttaccaacactcgaaagcagaacccatattttgttattgaatttgggtttttttttgtctgtgttaagaagattaagtaggaggaagaagaagagctagttttgcgagaatg

SEQ ID NO: 31524 - DNA, 3003 bp, Unknown
  misc_feature (1)..( 3003): 2750-1469P.txt file - cDNA_ID_3043077; gDNA_ID_1972172; Annot_ID_179866
tttattttctgtctatgtaaaagccatcatgattcgtttaggtgaatcagaagaaaataactctgggtaaaattccaaaatgtatactatcaaatggatatagatagacgacaagttttaaacgcgttagcgaactcttcttgtggctttggtattttagtttattaggtataaaatggaaatcatccacacttcggagcaattgttacaaaaatgcgattatctttctaccgactaatgttgggtagacataattagtttacaaaatgttctttttccatttgtcaccaaagttttcttcattattttatgaaacaagacttgggcagttggacatatatactatattagtagttaaattgcatatgtttgatctgttgatttgtatattcagttcttaaactaaataacaagtactaactatatttcagtatttgtatataatcatttagtatcgaaacggtctcgtggtcgtggcacctttaattgctgagagggccgtcttttacttttcgttctagctttatgatgtgccaccgagtagttaagagaatgcttctgctccaagtattttgacataatttaatcaaaagtattagctactttacacggacaataatctaattttataattagagtaagatagaaattaaagaagatattggtagtcgttgcaaatgacacgtgttgatcatgctttgctcgcatttgtatagcttcgacttgaaggatttcagtccaccgtacgtttaccacgatcgagtcacccactacggtcataactaatactataatttgataagtgtaataagaagacaaatgataaaaaaaaaagaagaagacaaatttgctaagatgacagtttgtaatccatatcttatcacatctacaagagagatatatacaactctttttcttaagagatgattaatgcgttaaacaagtttaaccagttatcaaaaatatgtaaatcttttctccagaggtttaaagacaacgtcacggtaattgtttcgtcgaaaaatgactattttaaactgtacggttcatggtcactttttgtgtatttacataaagaaaaaatattaaattttatactcagaattaggtatgggcacgaagcggatatccggaaaaattatgatatttgttattcgattcgttttaaacgaatacttgattttgtgattcgctttacttcgaaaatttccagatatccggaatttcgaatatccggaattttttgtgatatttgcggatatccgctttgatacatttaaatattaaaaaaatatgtatactatataactatatcatatattcaaaaaatttatccgtgcgttccttaattggtgtctccgtgtgcttttaaaataagttctaaataccaaacataaccgttgttggtatcaccggtcaacaaaatattatcaaactaattccaaaactaaaacccgatagttttttgatgccattgatcaaaacataacataaaaaaaaatgatcaaacaaacatcttaacataaaaacataaaatgacaacaatacacaaactatttatgatatctatatatagatatactatattttctaatatatataaaaagatacggatcgaagcggatattcgattttttaaaaaacaatatttattatttgattcgatttttacgaatactatatttttctatttgctttgctccaaaatcttacgaatattcggatttttcgaatcaaattaaatcaaataccgaatcgaaacggatcaaatcaaatcaaatcagaatattgagctagctgaatgaatgagataacctaagaatccaaaagttgatagtgttccctttccgaattccaatagtagcttgataacatttatttaacggcgataaattcaaccgttagtttgattaccaatcaaataattgcttgcaatagacggatgaaacgagtggtaagaataggtgattgaaacaaacggttaaaagcttaaacaaaataggtgagtttgcaacctctcttgttcaccattggaatattttagttatttaacgtttcttagatttttaaaactgtaatgtatttgaattatttactaaagagttttgtttttctttgttttttaaatatttttagttatttattaaatattttaatttagttttttttttttactgtttaaccgtttgttactaatcataactattatttaacggttcattttaaattatttatcattttttcttttaatatattttctaaccgtttttttttatcagtcttttttgtaagtgttaaataaaataaccgccttatttaaacgatattaccaattggtttaattttaggttgttcatcttttctaaccgtttttttctacccgcctttttctgtaactgctaaaaaacataaccgtctcatttaaacgatgtttacccattgcaaaccattttccttaaacaagcggacaatatttaaattgcaatgaaagcgagttatgagttcttttggcctaaacttcccaattttatctctctttttcccactaatcttctaacaattttaattaacagtgacaacttacaagtacttaggtaaccaagtatatttccctattgtaaaacctaattatgagttgtgatgatcaccttttctccttttgacgaacgcttaggacctaacttattgcaacaatggcctaactaaaacttaaatgcgatttgcattcaattctcaaatgggcctctttagttaacatgttatctccgttcatctgacgtgtcatagctcagatcaaaggttaatctactcgtaaatccaacgaccaaagaaacgaagcgtacgttactaacatacacgtgcacgcactgtaaccatctctctctctgctcttctccttcaatgaaatgattcgtcacccaaagaaagatctgcaacttcaccaccggaccagtctctctctatctcttctgtctctctacctcgcgcgacgaatcaatcatg

SEQ ID NO: 31525 - DNA, 3000 bp, Unknown; identical to SEQ ID NO: 9694
  misc_feature (1)..( 3000): 2750-1469P.txt file - cDNA_ID_3043081; gDNA_ID_1972172; Annot_ID_179864

SEQ ID NO: 31526 - DNA, 3003 bp, Unknown
  misc_feature (1)..( 3003): 2750-1469P.txt file - cDNA_ID_3043120; gDNA_ID_1972173; Annot_ID_179923
tatattttgaacacggccggattggttgtcttatgattaagtgaatgctttagatctggtgacgattggtatatgagatatatagtagaatgatagaacatcagaaatactataagtcaccatatttttaaaaaataaatgctatagaatttttgttttggtaattgttataactctacaaagttatgtgttatagagttttactagtttcatcgttatcatgtgtatagtataacacaacaaaagaaattttaaatatctgaaaacataaaaatttaataaaatgatgtgagtataagaaaaaaagaaagaaagaaacacgtaaaaaataaaaatcatcatacatataacaattttcaaaagatcaatgttactttaattagtcttttttcttatgtttcatgcaaatgcaatagtattacttttctttaatctaagattatgtgttgcttttaagcaagaactattcaaagagtcaaagacatgcatgtaaactttagagaacgggatctttcatcaatcttatttttttcccttttttttttacaacgaacgataggtagtaagcatgaatctggttcaaagtttggatcagtgtgggcataatcctggttcgctaaaaagaatcaatataatatatgttgagcgtaagagaagaaagctcatagttctgtgtagaaaaaacgtggagattggagagaaattactaagagagcgaagagaagagtaaacctagaagatacaaaagacgctatcaaaagattgttttatgtgtttatgaaacattcacttaggccagtataaatattaaatgtcattttgagaaagaaaaaaaaatggtgtcattttgaggatataaatattttctcaacaagatgttttagactttcaacataacgatcatttaaaactacataatttatctcttcgttaaaaacttaacattaacaaaaagttaaattcgacaagaagagtttattcaataagtatactgtatgtgtttattttattcacatgaaaagtgtcaaacaacacttgggatacatatttcatgcctaaaaatcgtataacaacatttaaggtaatcagtaaatttgatgcctaaactaaaatatgtgaccattttgaccaatgagcattttttggaaataaaactactgcatacgacctggtcaaacacatgaactgccactgcttttaaaactacctttttaaacttttgacgtccatttttatttactaattattatgttaatcaaaccactaacattatgattcgaaatttcgagtgatgattgttagaagtgatgtgaatgatgcggtataaaacaaattgtgatatatattcactcatatatatcaaaatcaaaatagcttatcgttccaaaacatgattgataaaatgtaattactattcaaaacttaaagccagtagttaaaataaaacaaaataaatagtatatgtttcatattaatgccaaaccaatattttgttttgatgaggaaaagtctttttttttttttctttttttttctcatagttaaaagacataaaaaaaattaatattacaaacaagacaaaaaaaaagaataaataaaacaacaatcattactgtcaaatcaattatcagagggaaaagttattaagaaatgtcaaccaatgagtatcattatcatcatgcttttttagacccttctttttaattcatcaagatttagtcttgtttataaatttgaagtaaaattctaaatgaatcaattctacaattttttccctacattattgtaacgataaaatttaagatcaacaattacttcgttaattttttttctgataaaaatatttgatatctttctgattatgatatattagcattgtttttgtattgtatgtatggtaattaattttagttcaaaagaataataaatggtttgattagcatgaatttaataaaaaaataagactgaataaacataggtaataaactttgtttcttttggtaaatgtaaaattagaaaaaatcataatcccaaggtaattactataattacattcaatgtcagaattaaacgtagtgaataaaaaccgtaaaacatgagaaaaacaagaatttattatctttgacaagcaataaatgaaatgctgacaaaaaattggtttcaaagtttcaacgcgtttcttataataagaattcaatttcgtgcagctaatcaggagataattatcataattaaattaatcgttactactttataatactcccaaaataatcgaaaacgaatttattttattgtaatttgtttaataataaagaattactgtttcctcccacttcccatctctcttttccttttgtgttcttcttcttctccgctttgtttccccaatctctctcttctctctctctgaagaaaaataaataaaagatctaactttgacggctctcttaatcttactcactccgtaagttccaaatctctctcctttactctcatatctatatcgtccgaacaaaacccaggagaattgcttcaccccctttttgggtttttaatcattttctcagattctcagtttctgtttccgtcttctagattctgggttcagtttctgttttgctcttattgaattttcttattcattttgtgtttcggagttattcatggtagctgaatttgttaattctgatgttgttttgcgttttcttcttttctagtttggctatgtcgtctttgatctgatgctgggttattctctttccctctgttttggtttcttttagggttttaagtcggaatagactgatgggagcttgatggttattgttagatcagatgtggatttaaagccttcgctgaactaacaagtctatggaagaagcaaagacccttgttttacactgtatgttgtgaggaatttgtctgattttgggtgataaaggtgaagtctttgagtttgtaattttgagataagattggatggtgggaagagaggatgcgatg

SEQ ID NO: 31527 - DNA, 3003 bp, Unknown
  misc_feature (1)..( 3003): 2750-1469P.txt file - cDNA_ID_3043124; gDNA_ID_1972173; Annot_ID_179922
aaactcccaaaaaaaacatatgtttcgctaattactttttattcgaaattttttgcatcctcttctgccaaaatcattatataaaacatcccaaaacccttggaataatgattccataaatgaaaatctatttttgacccgttataatatttttcatgtattgaacagtttatattcgtttgaaaaaaattcaaattatagcatatgcgaaaaaactctaattattttttataacgatgatattatttttcgcaaaaacagaatcatttaaagatgagaggtgaactataataattaataaaaaattaatatgataatttagatatcaaatctaatttgttgattgtaattggttacttttaaaaattaccaatgtatttcgttttttaattaattaaattagtatttgactttttaattcttaaagagatgaattaatttactttttaaagtattacttctaatggcatacctatgtacttacttacaaaaaataaggttacatttaaaatgtacttcccaaataatatagtaggattgaatctttcgactaaaaaaaggttctatcttcttcttcttctccttatgtgacaagaacgaacaatcctccattgacccaaatttcgaaaatgtcaacgaatctttttcgtcttattctcgtattcatcactttatctatcgcttcatctctgtcaactccgtcgccggctgattctcctccttatctatggccgttaccggcggagttttcgttcggaaacgaaacgctctcggtggatcccgccgtgactctaatcgtagctggaaatggtggtggatctccgattgttagagctgcgtttgtacaaacaggagataaacgtgcatgatttaatatgattttagaggaacttatgttctaggaaatagacccaaagataccatcaaattttaaagaccatttcacgagatatctcaaaagtcaaaagactgtctatacgtacgttagggacttatgtctcttcgttttggaaaacaagacattattatcttctctaagcacatcatgcaaacttagtataatcttcttatgatgtagaatcaggactcatgactcatgagtgttacttagtaatgtaagttcacaacgtaagcgagagataatcgtaggatttatatggttctacaatataatgaatagtataacccatctaattttctttttagtttgcttatgtgtatacataacaacttcacataaagaaagcttataagcattcaaacattcgaacattataaatggtattatatttattcaatcattctcatggttacatttatttgataaattatagtgataacaaaaactttttttcttcttcttaaggaccatcttcccatttaaaacagtaaggcaaatgtctcccatcacgatcaatacgacaaatatggccgttatcaccatattttcctacttcccatatacattttttacaaactggaaaacgtccatctggattatcatctctgtatactttaaaaatattaaagtaatgagatccgtcattatgtcaagtaaagtgacaacgaaatttggtatttttccaaaagttgacgtgaaagctgaaatcccatgtaccattccaaggaatatggaccatcccaaagtcatcttcactcgatctgcaatgtacattcaaaatttctctattttttaccacattgcggattacaacatgttttttggctagaggtaagtagtcgtcagggtccgaacttggtacttctacgggagcattagaaaaattcaatgcagacacaaaaagaataagaatagaaaagatcataaataacattggaaaatgagatttattattaaaagtcataactaggtaaattatgtaggtgtggttagatagaacttagagacaccctatttatagagataagaacatgtcaatatatttgagagtgaagttgactaacattcatgtaacgttaaatacatgtacttactctatgttagtattcaactcaacgacataattttttttttttccttttgagttatagatttattagttttaataagaaataaatatgtgtttggtaaaaaatatttttagttatgttttatatattataatctacaatatttggaaaaatagttaatcattttttgactgtcacataaaaagaaaaaatctttttgatgctttgactttgtaaaactattaaaagatctcaaagtcttatttttattaaatttacataagacccatgaaattgtttagtttacacaaaacacaaattaactggtctgggtgaaaagatgataaatatattaaacagacttcgtaaaatgggctttgcagttgggctttatacgttcgttcttcgaccctttatgaatccgatcaacttgtatataaaagaacatcaaatcagcttttgctagtgagaaatatcatatggtaattaatgtatcaatcaatgcacattctgatactaatcagaacacaaaagattttgaattcatcggaactaaacacacacaccttagtaagagttaagaaatatgtttccaccgaactaacagaaacatgataccaactcaagttggttgttcgtgtaataaataaaaattgaatctttcgactaaaacaaagtttatcttcttcttcttcttatgtgacaagaacgaacaatcctccattgacccaaatttcgaaaatgtcaacgaatcttcttcgtcttattctcctattcatcactttatctatcacttcatctctgtcaactccgtcgccggctgattctcctccttatctatggccgttaccggcggagttttcgttcggaaacgaaacgctctcggtggatcccaccgtgactctaatcgtagctggaaatggcggtggatctctgattattagagctgcgtttgataggtatatgggtataatctttaaacacgcttctggtagaggttctctattgtcgaggattagatttctgaaaatg

SEQ ID NO: 31528 - DNA, 3000 bp, Unknown; identical to SEQ ID NO: 9700
  misc_feature (1)..( 3000): 2750-1469P.txt file - cDNA_ID_3043140; gDNA_ID_1972173; Annot_ID_179913

SEQ ID NO: 31529 - DNA, 3003 bp, Unknown
  misc_feature (1)..( 3003): 2750-1469P.txt file - cDNA_ID_3043144; gDNA_ID_1972173; Annot_ID_179911
atcaactaaatatcccaactttggcatgcccatcactgataaagcaactctagacacacagaatcgattaccaccatcttcaaaaccgccatattcatcacaaagctccttaaaacatgaactgatcactgaatgaaacttagtggttttagccaaggctgaaacaagggtcttatgaagaggcaaagaattctccatgaagagtatctccaagtaaaacctaatagcttcccttacagaaactgtctctctctcgcctccttcattctcattggccttggcgagaaactctccgaacgaagcaacaactttcttggcgtgattaacttgcgcgtagattgaattcaacgaaaccaattcttcaatgttggagtaaaacttgggacaagactgagacaaactagattggctcaaagaagcagtgaacgagctggggaacagaacagcactgtaagtataacgatggcgatgctgcagagctcgccacttcgcagacatgtttcagtgagctgaggaaaaacagagaaacaataaaaatttgaactttatttttttcacttgaatgaaaaatagaaaatatggtaaaacagattaaagatcataccgggaaaagcggctaagtgtacgagagagcttattaggaggccggagcaataccagtgagtaacctaagaggcgacgcggcggaggcggaagaaagcacccgccttcaaatctttcaactggagaagatatgggccttacttgtgtttttaatgggcctgatttttagacaaatgagaaaacattttggttgtctaggacgactgcttagttgtgctataatgagttcttgaagccaatatttcagttgatttgagtgtaaatttcagttgcaactggttgcatagctcatcaacacagttcgaacatggtaatgctcttgtctcagattgcttataaaacaattagctaggttcttagactgtcccaaagtgaataataaacaggtgatgatgttaagtggcttttgttcgcagaatcttacgtttttgcagattttattgccgagaccaaatagatcagcccacgagctagttctcgaaagtcaaatagggtaaatctcaaatttataacaaagaacgtgcgtgagagatcatacaatcatgtttgaagaatcaaatctttaattgaaagaaaattcagatatattagagaagactgagggaggactctctgacagtagaaagataattaaactttgatggcatactttctaattggaaagtacatgtctttcttcttctctcgttctgtcttcagcgacgcctatccaatgcagagaaaaagtcatgaagtatggaccaaaacaaagcatgtcactgaattcaaaatacctggtgtttagtgagtctccttctgatggctctagtcttcttgggacggagatcgagtggcaacaacttcttgtttttgtatgcttctctaagagcagacttttgtttctgtgagctcacagtcaacacttgcgcaatcgacttcctcaccactttgctgcaacaacccaaaaacaaaagaccacaattagatccataataacttaatttgaggccttaccaagattgctaaaagtcctaaacaaaaacaatggtcttgcttgttcagagattcaaatagattatataaatatctttcttttcccatttcgcagacatacaagataactaaaaatcccaaaaactgcaacaataaacccaagactaatctaagcctcgattgttttaaacaccaatgttttggcgtctgtgtgcatagggattttgcttaagatgctaaagatatctaaaaacaatgaacataaaagcaaacacaagcaaaaaaaaactgatgactaaagactagaaatcaacaattccataagccaggtaccaataccatgcaaagggcaacacactaatcacatgaatgtatcaaaatgcctaatttgtaaacactggcaccataaacaattcaatataaatgcaattaacaattaaaaaatcaacaatctagtaatctactattctcagtagctttagatcatactcagaaagaggctagtgattccaatatcaagcagctcaaaatattccaacatttgtataataaggctgagagtagagaacaattacatcttagagagcttgttaggagcaccaccagtgaccttagcgacacgtagggaagcaagctctgccttcaattctttcaattgagtagaaagatccgattttgatttatctctcaactcatgaaccttgattctcgctgttcacggatccatttcaacacaacacaataagaaaatggagccaaacataagcaactcaaacaataatggtggaaatgattcaagagtagggacttacccatggcgtcttcgagccctctctgactcagtctctttgcactgctatagtaagacacctgaaaccctaaactgaagaagatgaagagttctaaatgggcctcaatgatataaatgggccttaagtttagtacagacagtgaataatttattctttttagtcatggttaatacgttaatctgactcaccatgtggtatttacaaaattaatcagattgtaatatgtcactttatgtataatgtttttgtaggattgattcaaaattgaccttcgtgtgtcttgcaaatatattttttcttttgccggcaatgtgtcttgcaaattttccatatatatcgaatttggtaatttgaggtcaaatgttatcttcccctaaagaaaagttaggtaattaacaggataaatttattttagtcagctggtcccataagtaaaacgcattaagcggtttttcgttaaaagcttaatctgatttgactctttgatctctccctcttactaatttttttttttggtcagatataaaactctcttatctcgtgatcctcgtcgtctatatattgaaacaaatccagttttctttcttgaaacgtataacaaaaatagaacatcatg

SEQ ID NO: 31530 - DNA, 3000 bp, Unknown; identical to SEQ ID NO: 9709
  misc_feature (1)..( 3000): 2750-1469P.txt file - cDNA_ID_3043148; gDNA_ID_1972173; Annot_ID_179909

SEQ ID NO: 31531 - DNA, 3003 bp, Unknown
  misc_feature (1)..( 3003): 2750-1469P.txt file - cDNA_ID_3043173; gDNA_ID_1972174; Annot_ID_179956
ttagctagatgtatgtagtgaacaccatttttgttctatactagacaacagaaacaaaataattaagaaaaataactggtagttctgtttcccttttattgctctaacgtgacggctacgcgaggaatattcttgtaattttatgcacttacagatggagcaagcgcagtagctggagaagcaccaccagtggttggcctaataaaatgataaaattatagttaactgatggagtgtctttcataattagttcttaaatgaattgagtattgatgatgaaaacttacaatccagctaaaactttgacagcatcatagataacccactgcgctccagtgagtgttcctatcatgaaaatgcgaagaggaaggccacgggttaacataccccataaccctagcctctttactgcctgtagcacatgaaagaatcaaaccaagtcagtagatcatataaaaagctctgtgttgtgtatccacaagtttgatgttgtggtgaagagtatggagcttttttacttacatcagcaacggttgctcctttagagttattgaggaaagacaccaaattatctgcaggatgtgagatgatggcgcagaatattccagcaatgtatccacctgcaaagctaactccgagctgaactggctttgagcactcttcttttggggtaggcatcactttcttgtatatgagctccacagtgttttcaaaagtagcaaatttcatcatcgtatctgcaaagaagtcgaattttcttttagtaactgaaatcatcatctcaatgactctactacattttcttgtgtatagagacttacatggaatctggcgtccccagagaggaacaagtcctttgtgtaacccgcggaagccttcggatttgatgatctttggtaaaccatcagataaaccgcgggcgaaaccaggctgagtctggaccctgactttgacagcttccattggacaaagagccacatcagcgacgatttctgcagaggctgagccagcgaggtaaatcaaggtcttgtatttagctgcgtattctggtccaacaatgtctgagtagtatttcttggcgtactcatagagaccgtatttaaaagctccttgggcactgtaaccaagaagcgttggtgaccagcctctggtgaaacccttaagcccttgctctttgattgttgtcttgaaagctgaagttatgttcttgtacttcagtggatcaatctgaaataacaacagaattaagggtcttttttggaaattcgtggaatattctctctgagtgaacatcaaaatcatgcatgagattgaaaagtcttcgacggcgttgaagagtcgatgccgtgtaaaacaagaaaacgtaaaagttgacaaaaacaaaaattgttattcgctgtttttttttccgctaataatttctatattcaagtttttctcactaaatattttacttatcacacacgtattaaaaatgttaactacaaatagagaagttggcttggaactttcacctgcatgttgcatttgatgacatcaagtggcgtaatcgccgtgtgggtgataccgcagctcagcatcccggcgaccgtacacgccgcgaaatacgccggcgagtacatttccactttttcattcggcgtcgcgatggcgaaactggtaccgttggatgagactgaagaattagtcggagaaatcaacggctgtgatttaaggtgagtactcatggtcgtcgcctgaaaaagacgatgatcggacgagtagagaaagctcgggatcagcgatctgcttgagtcagacatttcgagagaggagatgagaaattcaaattcttctgttggtttttcgacttttctcttcgagagaaaaaaatgtcaggttgagttttgctggaatctaatttgacgtttttataggtgctgagtttttggttatgaaatgtcatttttaccccctcactatttgcatattttaccattgactgacgacggcgatagaaacagtcaaatactgatttgtcacgactctttacttgtcaacagaccgaataaatcactgaaaagaaacatatatttctaataatactaacactgtatatagtaaagatatactgatctttgattgttggttagaataatcaaaattagtaaaccgtttctaccatgcgtaaatggtatttgtatgtaacaagttatctctccatacgtgaacttgtttaccattacccaaatttcgaaccttgagtgagcactttgttaattacctttgagaaaacttagccaagcatggctagaacttcatttgttgccactgccagctccaagaagattagacttggagtaacagtttcctttgtggattcttgtcaagaggtttgaggattttgaatcccataattagttctccaacattgttgggctagttatatatattatagtctttgataccaaaccatgtgcttttgaataattgaatttgtaaaattttcttccaaaataaaactaaacttggtcgaaaaaataacctggacaaaccacgaatcaggggggattttaatttactcatgtgatttgattaatatgtgtatataaattttctcttagaagagaaacaaatctctttataaactgtattaaaatatcacagataatatgattcagaacagatacaacataaacagttgtatatttttgtttttaaatggtacgcagattaagtgaaaatgattaaagattttgttaactataatcttatcattaatcacttacctttgaaagctcgcatgtgtttctcttctccgtgttaaacgctgtcgtttttggcgtcactgttatttcaacacttttctccaatctcaccgaacgtttattttcccttccgttttctcgagaaaatctacctttttccccgagaaatttcattttctctggttcacctgcttgttgctcgcttaaatacagcgatttcatccaaccaacaagtaccttcaccaacacactgatg

SEQ ID NO: 31532 - DNA, 3000 bp, Unknown; identical to SEQ ID NO: 9715
  misc_feature (1)..( 3000): 2750-1469P.txt file - cDNA_ID_3043177; gDNA_ID_1972174; Annot_ID_179955

SEQ ID NO: 31533 - DNA, 3003 bp, Unknown
  misc_feature (1)..( 3003): 2750-1469P.txt file - cDNA_ID_3043193; gDNA_ID_1972174; Annot_ID_179948
ttgataattgctatacataattgatcatgtaatgcatattgtgtttaatctttctaaagtacaaatgtaagtcgatactaacctttctttttcgacttgaagaactgcaagattgatgagaactttgaccaacatttacttcatcgtcttgcatatcaagatccacaacgattattttcttcggtttctctttgttttcttccaatgattttctcatcgaatgttgaacctcggaagaaaccttttggcatgcacttctattattcaatccagccaagtgatgtttcattctatttatttcacttccaacgtattgtttaccacaaaagccacaagttataacttttctccgtcttgaatcaatagcttctctaacatagttccaagccaaatcttgtttgtgatgactggaacggttcgacgatttctcttgctttatattgcttgtatttggtgaaaaagccttctccattgatgagtaaactacaaaaaaagaagaagtaaaaacctctacacaattaacatatgtatactctttaccaataaaaaatgtatataactcttacaaggattaaattaaacgaacaaaacaaaagtattcgaatcactcaaagttatattttcatttgtatatattagctagcgataagaagactaggccaaacgaataaacacataaggattggaagaaactcgacataatctaattatactaaatcaacagtcaattttataaaaactgcaagcttctctttctgccacgtatgcttaagtctaaaattttgctctttcaaaatcgtaaaccaattcacttctttttactattcaataaaattcttgtttgacaaaaaatgaaaataatttttttttaccactttttcagcaactgcttcttccacgttcttaagattcttcagtttctctcccatctttcaaaaaccctctgccagttaatttacgatctcaatggcaaccgtataagccattctcagaaagataaaaacaggttcaaattcttcttcttctctcctttctcataaccttaaatcctccattctttcatctaaatacgtctaacagagaaacgaaagtatgacgtaaataatgaaagttgagacttttgtgatgcctaatgtgatggacgctgttaactcctcacgacacactgagtttggtccacctaatcgctggtatgaatatcactaaacctttggccattttgttgcgttttacttggtcttatcttcttacattttccatgcacaccagctgctcgacaaaatgaccacataagtttacgagaatcgtatagaaacaaaatggatgcaaatgttttggggctttcaattcaaaagaagaagaagataaccaatttgagagatgggtggcatgacatggcatcttcttctacggtttagtgtgtaaaataatttaaatgtgaaagcatcttatatatttcgagttaaaaaaagcgttttgattagaaggtaattcatttctccattattattattgttaagcttttggagaagaaaaaacggttctatatattttttcttttcttcatctattccttctctttttctctatgtctatgagagaagtttatgtatttatgtaagatcatttgatgtttccaataaaagttttctccaattttgacacatatagatattacaatttgagtaaagttgaagaggatttctattgagagttatagagcaatgatacacattgtattttgtgaggttgtgatattcatcatttgtgtatagttgcagatttcaaagaaacaaaatgtattattggtattgttgttttcccgtgcaaggcacggcacgggctgcctactagttaagatatgaatttggaagatgtcaatgagagttattttccatttccaaaaagaaaagaaagaaaagcatatgaaactgacggataacgaatggtgataactatttaaaattatggcatacccataaactcgtgacgaagaagatgacaacatagaattggtgaagacaaagacatgcttaataatattataaaacgaaaagtgagtttggtcgttgtcttacgggttttgaaatcgaagaacacaagttgactgattgactctacgttgaagtgaaaattatattgctatatcacatctcctatactcgctacattttatttttctctccctacttctctcaattgcaaaggatacaaggaaacagtgtgtaactaaattgaaatacaaagagcccatacctctagttattgttacgaatccctatttcactggttaacagtttgaatctgctttgaatctaaagctgtgaatggtaaacaaaaccgcactcaaaaccgcaccgcaacagtgctgtaacagtatcaaaatctctacatatacatatgtatctatgtattttcgttactatttgaatcgcaccgcacttctcgcgtaccgcaaaacgcagttattattcggagctaagagtcactcaaacccaaaaattgtggagaaacaatgtcatgaaaaaaaaaccaaatgcgttaaagaaccctaatcaattgtttttctattcatttttaaataaggaaaagatgacagcacagtaattaataaaatcttccatatctctattttaagctatatataaatattcatttttgatattgtatagtatatagtattaattagatctttactcttcatagtcatcgatcaatacacataacattccctaataagttaaattagtggctacgtttgacgaaaagccctcgtttaaaaaaaaaaaaagagaagaaggaaatcaggaatgatctgattcttcgacgaaaggggaagaggttgttgaattcaaaatctctctctcttctctgtctctctcgcgtgagctagttgcagatttttccagatctcaacattgaaattcaaactcaaagctagagagggagagagatagatagatagagggagaagaagaagacgaacacggagctgaaacaatg

SEQ ID NO: 31534 - DNA, 3003 bp, Unknown; identical to SEQ ID NO: 27953
  misc_feature (1)..( 3003): 2750-1469P.txt file - cDNA_ID_3043224; gDNA_ID_1971867; Annot_ID_176484

SEQ ID NO: 31535 - DNA, 3003 bp, Unknown; identical to SEQ ID NO: 27953
  misc_feature (1)..( 3003): 2750-1469P.txt file - cDNA_ID_3043224; gDNA_ID_2926155; Annot_ID_198337

SEQ ID NO: 31536 - DNA, 3003 bp, Unknown
  misc_feature (1)..( 3003): 2750-1469P.txt file - cDNA_ID_3043234; gDNA_ID_1971868; Annot_ID_58448
atgaacggctgcttccgtgaagtgacgcgtgtttatccattaacggataatttgatcttaaatcacaaatcttacgtggctgatcttattattcaaacgcatgggcttgggccttgaggtaaacaggtttatatgggccaataacaataaatttgattaaaaataaaaggcctcttagctttaggttcaaacttcaatggagaagcagtggctgttgtccctcgcagttgatcttcttctcaatccaaaatccagctgataaataaataatttttctcttgtcgtcatattaaaaaaaagaaagattatctgtatttcaagtttcatgagcgtttgccaccacaacattgtcttttcgggttaatttcttcttcttcttccttttcttactaaattctcttaggtagttgtcgattcgatttctttgtcttcctcttcgcttattttcgttgaatctcttgtttacaccttttcctgaaaacaaaattgtgttttttgtagggttttagtcatacttaatggcttccaattcggagaaaaatcctcttctttcaggtgattattttcttctcagtatacaatctgatctgcgataatgaatcgtttctagtcagatttggttattggttcattgtaatttgtttactgtagatgagaaacccaaatcgacggaggagaataagagttctaagccggaatcagcttctgggagttcaacttcatcagctatgcctggcttgaatttcaatgcttttgatttctctaatatggctagtattctcaacgtaagttacctttgctgttagcacaattgaaaagttatcttctttgagtttttttttaattgataatggttttttttgtaggatcctagcatcagagaaatggctgagcaaatagctaaagatcctgcgtttaaccaattggctgagcagcttcagagatctattcctaacgctggccaggaaggtggtttccctaactttgatcctcaacagtatgtcaatacaatgcaacaggttatgcataaccctgagtttaagacaatggccgagaaacttggtaccgccttagttcaggttaggaattgatgactttttccatctaatcgaggtgtggctttgaatgaagctctgtgtcttatctgattttatttattttttttgcctacaggatccacaaatgtctccttttttggatgctttctcgaatcctgaaacagcagaacactttactgagcgtatggcgcggatgaaagaagatccagagttgaaacctatactagatgagattgatgctggtggtccttctgccatgatgaagtgagtgatacaaacttctttcaatgttttttagagaaactgtagagtttgtttctgtttatgaaggaagaattatttattctgttttaggtactggaatgatccagaagtgctgaaaaagctgggtgaagcaatgggtatgcctgttgctggcttaccagaccagactgtttcagctgaacctgaggtagcagaagaaggtgaagaagaagagtctattgttcaccaaactgccagtcttggtgatgttgaggttagactgcttcctacgttaatatgcttgaccatgtgagatttatcttgcgtgttgcttgaggaattagatgttccaagttttgttttgttgaactcgttattggatttttattcgttgattcattagggtttgaaagctgccttggcatctggtggtaacaaagatgaagaagattctgaaggaaggacagcattgcattttgcttgtggatacggcgaggtatgcaattctcttatcaattcacggcaattaaatattcggatttagatggttctctttttttcagtagctgtgaagttaagaatctttataatcattcaattggtagaaaagtaaccagtctacttacgtctacgagtttcatgacacaattacttatagcaagttcaaatatttggtgaaagagcaatgagatggaactggcgattacttgcatactaaagattttgcttatgaatatggattgaactgagtttaaccctgttgagccctatcaacagttgaaatgtgctcaagttcttatcgatgctggagcaagtgttaatgcggttgacaaaaacaagaacacacctctgcattatgctgctggttacgggaggaaagagtgtgtaagccttctcctggagaatggtgctgcagtgtaagtctcacaacacagtacttataatgaaacaactccattaaacactgtttcaggactttaattatatgtgctttggttgatgtgtgtggttgcagcactctgcaaaacctagacgagaagacgccaattgatgtagcgaagctcaacagccagctggaggtggtgaagctgcttgagaaggatgctttcctttgagctctgctggttaaaggaaagctctaagctcatattgtctttgaggcatttgtcttgtgtgtgtcctgaaccagtttcacaggctttttgtgtacactttttattagttcctctcttcttctaaatttgtctcttatgttgttttaaaagtcaataaagaaagaaatagcaatcaatgatttaatttatgattatattctttatttcgtcgacctctacagaatgattcaatttggaagaatcattctggtttggaggatatgtaagaaaaactacttgatctccaagttattccattcttctgttactgtattgcccaaattcccaagcttgacaatatttacgcaaagctcaaaacccaaaatatttgagaatcaaaacaaaatcaagggtcttgtctttttttttttttttggtgtgaatcaaaggtcttgtctttgcaagtaaattcgttcctaatgaactgtgtgagtcgtttaaagtgtttgataagcaaagcacgaagctttgcacggcttggtggtgaatccactctctctcaaccgccgtctctcgcctccgccgcgttttcttcatccgccgtcatg

SEQ ID NO: 31537 - DNA, 3003 bp, Unknown; identical to SEQ ID NO: 31536
  misc_feature (1)..( 3003): 2750-1469P.txt file - cDNA_ID_3043234; gDNA_ID_2926209; Annot_ID_141894

SEQ ID NO: 31538 - DNA, 1335 bp, Unknown; identical to SEQ ID NO: 4150
  misc_feature (1)..( 1335): 2750-1469P.txt file - cDNA_ID_3043238; gDNA_ID_1620687; Annot_ID_48467

SEQ ID NO: 31539 - DNA, 3003 bp, Unknown
  misc_feature (1)..( 3003): 2750-1469P.txt file - cDNA_ID_3043238; gDNA_ID_1971868; Annot_ID_176530
ggagaagaagaatctgatccaagttataatagagacacacacatacacatctatacttatataagacatgtccaaattgcagattaaaattaattaaatattaataagtagtgttcatttaattccatgtcatatcggcaaaaaaaggttttggatgaatagaagaaaaacttagttttacaacttttccgaagataaataatgagattgcagtatccataaagacaaacatatttgaatctttatttaaaagtaaaaaaaaattgatcactttttatttttttttgggtaattcaagtttgatgttctacaaacaacatctttatttttaggtaacccaaagtttactcgagtggtccaaatttaaatgttcaacccaagattttaaatttttaatgcatgctttgaactttggaagtttataaagttctgatttacaaattgataaatcatataagtatgtgtagttaaactaatagaatcatcaactgaatttttttaattatgccgttacaaaaatttacagaattaggtacttttgtatgcaaaactatatatatcatcattccattttgttatttttgacaaaactaatactttaatataaaaaataaacatttcctcgtgtgattcaaagactatagattgaaatactttatcatatacaaaaattattatgatttctgatttaagacagaatttatgtctcaacgaataagttatcttgtttaagaaaaatctaaagtactaatacaatctgttacgactaaattatttcttagccgcatgggagatcttgggcaacatgcctcaacatagatacgggttttaatttaaataatgttctcctccaaaatacatttagataagagatttggaaatatcgtaatcgaatacaataaagaattaaattgccgtatattattagaaaaccagacatggaaaaagatgggtaggtgtgggcgctctttttaggttctgtttgacgaactcattatcaaaaggtgtaagtgtaaattactttcttacctaaacctacttctattagactcttttattctgcattcttcaaattttttgggcatcttgaaagattcctttaaaacaaaaaaaagggtaaaagattgagatcagaagatggttttgttgacaggtggtgctgaagtttggattcaatgaatttcgaagttcttgcgatattgtcaagttttcctcttggaataccatatttgttttaatagatatactgtagttgttagtttagatatattatttttcataaccgagtttgtttacatttgtatatgttaggatagaatgatgtagccatgtaggtgggatcttgataagtgataactatcaatttacagaatctttgaaatgaatctacgtgtcctcaaaggtagcataatatatttacattatagtattaacagcaggtaccaccgtccacgtgtgcataaagttttggtgtttctagactctcttgtcatactactaactgaaatattgtaatatggttttcacactaaaaaatcgaatcaacccaatatattatcaaatcaaaccaacgacgataaattttacctaaaactttttttttaaaacgattttcagccgaaatatcacaagattatcggtcttgggctagactctagagagggatagatagatggaacttagaaaataataaatggaaaaagatattaaaagaataataactttgaagttcaaagtacaatcggaatggaatatcagtcttttgcgtgaatgcgtgtgatgtgagtcttgacgtcgtatatggaaccaaaaaggtgaaaaagcaaaccgagttattaaaccactaattaaaactataagacattcttagcacatcggattaaatagaagaaaatcaacaataattgagaacggaagcattaattatgacatgtaataaacgggaaaaacaacgacaattatggactttggaagcatcgattgtactggggtttggagcatcaataatccatattttggatacaacaacaattttgtttgttttttactcaaataaagatgctatatttgttatgttcaaaatctctatacatctttcggtctacggccaaataggcaaatacttgcaccaattacaagcaagtaagtttatatcttgacatataatcaatatatgatatagtccatgcgattccagctaaccacatataactaattcatactttagtggagctagccagatataactttattcatatagtagtgtggttatgaatccaatatataattgatagagaaatggtagtttcgaagtaacgaaggttgacaatttcaaaaagcccatacaatcagtttgagagacttaaaagagttgaataatgtacagcaacaacgagtcaaagtcatgcttgtgtgttacgtgttctatatgtgtccatgattataacgcaatagcaatatcatgtcggtgcgctaacttgttttgactttttggggtcattaaactaaaacatcagtttcaatatacatatacatgacgtcataaacgttccattcaatcgctatgccattttaatataatagaattttgcaacttttttttttcctcaaggtagaattttataactatagattaaaattggataattaaagttctttgttcgtttatttgattagtttttctgtagtatagggtcaaacaaggcaatgttaaaagtcaaccatcttctttatttatatttgttcctagttaattacacttaacactgtttgttaattcattgaaattgttttgtcatgtactaactattgattattcagtcaccgtcccatgacatgataatcccaccaaggtaccaacacgtccaaaacaacgaaataggaaattattatttagaatctaatgggctaaaaataaggcccaaataaaaagcaaaggcccaatatatactgtcacaaaaaccctcaaagaacagtgaagctctcatcacgatcgcaacaatg

SEQ ID NO: 31540 - DNA, 1335 bp, Unknown; identical to SEQ ID NO: 4150
  misc_feature (1)..( 1335): 2750-1469P.txt file - cDNA_ID_3043238; gDNA_ID_1620687; Annot_ID_164639

SEQ ID NO: 31541 - DNA, 3003 bp, Unknown
  misc_feature (1)..( 3003): 2750-1469P.txt file - cDNA_ID_3043238; gDNA_ID_2926209; Annot_ID_141898
caaatcaaaccaacgacgataaattttacctaaaactttttttttaaaacgattttcagccgaaatatcacaagattatcggtcttgggctagactctagagagggatagatagatggaacttagaaaataataaatggaaaaagatattaaaagaataataactttgaagttcaaagtacaatcggaatggaatatcagtcttttgcgtgaatgcgtgtgatgtgagtcttgacgtcgtatatggaaccaaaaaggtgaaaaagcaaaccgagttattaaaccactaattaaaactataagacattcttagcacatcggattaaatagaagaaaatcaacaataattgagaacggaagcattaattatgacatgtaataaacgggaaaaacaacgacaattatggactttggaagcatcgattgtactggggtttggagcatcaataatccatattttggatacaacaacaattttgtttgttttttactcaaataaagatgctatatttgttatgttcaaaatctctatacatctttcggtctacggccaaataggcaaatacttgcaccaattacaagcaagtaagtttatatcttgacatataatcaatatatgatatagtccatgcgattccagctaaccacatataactaattcatactttagtggagctagccagatataactttattcatatagtagtgtggttatgaatccaatatataattgatagagaaatggtagtttcgaagtaacgaaggttgacaatttcaaaaagcccatacaatcagtttgagagacttaaaagagttgaataatgtacagcaacaacgagtcaaagtcatgcttgtgtgttacgtgttctatatgtgtccatgattataacgcaatagcaatatcatgtcggtgcgctaacttgttttgactttttggggtcattaaactaaaacatcagtttcaatatacatatacatgacgtcataaacgttccattcaatcgctatgccattttaatataatagaattttgcaacttttttttttcctcaaggtagaattttataactatagattaaaattggataattaaagttctttgttcgtttatttgattagtttttctgtagtatagggtcaaacaaggcaatgttaaaagtcaaccatcttctttatttatatttgttcctagttaattacacttaacactgtttgttaattcattgaaattgttttgtcatgtactaactattgattattcagtcaccgtcccatgacatgataatcccaccaaggtaccaacacgtccaaaacaacgaaataggaaattattatttagaatctaatgggctaaaaataaggcccaaataaaaagcaaaggcccaatatatactgtcacaaaaaccctcaaagaacagtgaagctctcatcacgatcgcaacaatggcggctgctgcgaaggagatcctacggcgaccagtggcggcaacaataaggctaaccgttccggcgggaggagcgaggccagccccaccggtaggtccggcgctaggtcagtacaggcttaacctgatggctttctgcaaagacttcaacgctaggactcaaaagtacaaaccagacactccgatggccgtgacgataacggcgttcaaggacaactctttcgaattcaccgtcaagtctccgacggtgtcgtggtacatcaagaaagcagctggagtcgataaaggaagcacacgcccgggtcatttgtcggtgacgacgctatcggtgagacacgtgtacgagatcgcgaaggtgaagcagacggatccgttttgtcagtatatgccgttggaatcgatttgcaaatccatcattggtactgctaattctatgggtatcaagatcgttcaggatttggagtgattttagggtttctgatgaaagagtggaatcaatttgcttctggtaaacgtctttgctttgagtagtaaagtataaaccatgaatgaatttcacagattgttttgtgttttggtgttacttccattgtgttgtttgtttcaatggataattgagctccaaaagctttccaaaatcaaaatagatattgagtttgtttaactttgatcgtttgaataatttggacagtaaagacattgcattgttgttgttgtggatgtagaaattgttcgtatgagcaaagtattctaaagtttggtcctttaacttgataatatcagattccatggaagaagttttcctctgtaaattcgattttttcagagaattgtgtgttcatagctcagtgatttgaaggaacaatgggggtggtctgaaatggcaagacataagtaggatcttaaggaaacaacaatctcaaattaacaaaactgaaagcttttgaattgagttgcttgaatcttcttctgcaatatgttttcaagtgtcacagctttgtttgtagttgtatgtttggagaaactagaacttttcttgtgtttcattggagattagtttggagtctgtaatcgagccccaagcttatgagttatgactatcaagctcgatgaaatgtccagctcgaactagttgcttttgtgaccggatctttaaaatttgccgtctgtctatggaagtttttgaaattttggtaccatatcgaatgtttttggtcaagcaagacattgacttggcccttgggaaacaataagacagagacacctgaccggagcaaagggcaaaatagagaaatagggaaaaaaagtttaaatcgggaaaatctgaagcaacgagattgattaaaaaaatcacagaaaagagcaaaaagtggagagggtcttacgtttcagggccacacgcaatctgagtgccattcctctctttgtctttctctctctctttctctgttctaagaaagggaagctctttgtctttgtttgggtccttgccaagatccaatttttacgatcaaaatcgacccggtggaattcagacacgtcttttagatagagatatg

SEQ ID NO: 31542 - DNA, 3003 bp, Unknown; identical to SEQ ID NO: 31541
  misc_feature (1)..( 3003): 2750-1469P.txt file - cDNA_ID_3043238; gDNA_ID_2926209; Annot_ID_202481

SEQ ID NO: 31543 - DNA, 3000 bp, Unknown
  misc_feature (1)..( 3000): 2750-1469P.txt file - cDNA_ID_3043242; gDNA_ID_1971868; Annot_ID_176522
tcttgattgattcgttaagaggactttgttatatgttgttacagggttcaatgcagctgtggctggatgcttctttgcagttgaatccgttttgtggccttcttcatcaactgattcatcaacttcacttccaaacacaacttctatggttattcttagtgctgttactgcttctgtggtttccgaaatcggtctcggctctgaacctgcgtttaaggttcctgactatgacttccgctctcctggaggtaatatgcattgccattcttatgctttttacgcaagggaaccagaaaccaaacttatgagagctggtcactgattttcagaacttccactctatcttttattgggcgctctgtgtggcttggtctcgttggcattatctcgatgtacatcatccatgacatctgctgttgacagtcttaacaaggatgctgggataccaaaggctgtatttcctgtaatgggtggattaagtgttggtatcatagctttggtataccctgaagtattatactggggttttcagaatgtggatattttgttggagaaacgtccatttgtgaagggtctttcagctgatcttttgcttcagctggtagcggtcaagatagctgcaaccgcatggtgtcgggcttctggacttgtcggtggatactatgctccttctctctttattggcggggcagcaggaatggcctatggaaagtttattggacttgctttggctcagaaccctgatttcaatctctctatcttggaagtggcatctccacaagcttatggtctggtactgttcttatgtggtcaatgtttcaaaattgtcttaatttcagactttcttgattggttacctatcaatactttgaacagaatattttttcgggttaactgagaatggatgctagtttttttgtagcttcattgccaatgatcctgtttgtctcattgtttaacaggttggaatggctgctacacttgcgggggtttgtcaagttcctcttacagcagtactactgctatttgaacttacacaggattatcgtatagtgttacctctactgggagctgtaggcatgtcttcatggattacatctggacaatcaaagagacaagaaactagagaaacaaaagaaactaggaaaagaaagagccaagaagctgtacagtctctgacgtcatctgatgatgaatcatcaacgaataacctttgtgaagttgaaagttctctttgccttgatgattctctcaaccaatctgaggagctgccgaagagtatttttgtttcagaagccatgcgaacaagatttgcgacagttatgatgagcacttctttggaagaggcattaactcgtatgctgatagagaaacaatcctgcgccttgattgttgatcctgacaatatctttctcggtatacttacactttcagacattcaggaattcagcaaagcaagaaaagaaggaaataatagacccaaggtacgaaattgaatagtctgaaataactatttctttgatcattaattgaagcatttctttggcttaggatatttttgttaatgacatctgttcgaggagtggaggaaaatgtaaagtgccatggactgttacacctgatatggatcttctcgctgcccaaacaatcatgaacaagcatgaactttctcatgttgcagtcgtttcaggcagcattgatgctcccagaatacaccctgttggggtcctggatagagaatgtatcactctaacacgcaggtaaacctgcatctatttcccctcggtttaactgtttgtcccaagatcaccttttcatatggattgtttttaatgaacctaactgactaacctagtcttccatatgacaagagtgtgtagagagtctgtgtaactataacttgggctgccaggtttcccacattggatgtagtagaagttaaattagttaaaaaaaattacttgcaactttttgtttgctcatcagaggaaaggagtgagtcgcaaagtccagtttgctagatttttaattttagagctttcatctgtattagagttgataccgaaaatattgacccagcaaataaggttcctcaattcatttgaaacttttcggtgtagatgctgcattggagatgatactggtttttcttaaccttttctcttgcttgacctggcagggctctagcaaccagaatgtacctcctaaattcgctgtatctgtaaatggtcttgctttgtaactcttctgagctgaccagggtgatttcaatttgtttcttctgtgaggctccgggccaatttttgttctttgtattaagagatttggggagaatgagttggctggtgcagcgtggatgttttttgtctactccatctgttggtttaaatggtgaagcccccatttctcacttaaggtgctgagcaatccaaagggaatcgaaacatggagcgtggttctgagaaaatcttcagaaattttcctgaaaccaaagatatgtgctcaggtgattcgttaccatttacacttttttcttacagattgttactgtaccttacttagtattgtctattttgtaaagtgctttctgacttatatcatattgagaaagttttgactacttaaagactaacagtgtcaacaattgtaagggtttccttgtccactattttgtatattgaagaacattgaaatatattggaatgcccttatttctggtgtgtgtgtctctctcggtgagccgcaagggcatgttgacatctaattgtatggatatttttctctaagaaaattcctagagaaaacagtagtcaggccattgtgttggttaaacaaccctcctaaaaccttttaggtaaagaagaagcaaccccgcatgggttgaatgacctacctaacctatacttacctccatcatgatatagctagtaccctctgaacatgcatggatacacatgctatataatcattcgggtgtgattccatttataccggaaaatg

SEQ ID NO: 31544 - DNA, 3000 bp, Unknown; identical to SEQ ID NO: 3654
  misc_feature (1)..( 3000): 2750-1469P.txt file - cDNA_ID_3043246; gDNA_ID_1620655; Annot_ID_47830

SEQ ID NO: 31545 - DNA, 3000 bp, Unknown; identical to SEQ ID NO: 3654
  misc_feature (1)..( 3000): 2750-1469P.txt file - cDNA_ID_3043246; gDNA_ID_1620655; Annot_ID_163616

SEQ ID NO: 31546 - DNA, 3003 bp, Unknown
  misc_feature (1)..( 3003): 2750-1469P.txt file - cDNA_ID_3043246; gDNA_ID_2926209; Annot_ID_141890
cccaaaccacagtttcttgtttttgttatcaatgtctagttatatgcaccctcttctagggcaagaactgcatctacagagacctgaagattccagaaccccacctgatcaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggttttatttatttattttttgtttctcttaaaacttggtgtgtgaaaaaagaaaacgaacgcttaaatttcctttttctgtttgtttttatgaatagaattggtaagtttcataaaaaaaaaatagtattaatttgtgatttaatatctaaacttacagaaaaatgtcaaatcgaccatattaatcgtgaaaaatgttattattagggaaaaatgttatttaatacctaaacttacaaaaaatggccaaattaaccgtgaactcgtgaaatggccgttttatctctcaacaaaaagttgacttctattttaacttttaagtttgcgttgactcgggctaataaaccaccgttaaaaattcttctaacagcgtaattaacagccgttacagaacatccgttaaggtgatacgatgacgttttgtgctaaagagaaatcaaaatcgagaatagaaattcccaaaacaaaatcaattaccctaaacccaaatcgaaacctaatcctgcccccaaaatcaaaatcgaaaccctaattgcttcaattcgttttctgaaatgccattagttagaaagaatggcgtcgttatgaggattggatctccaatgcttcacgaatcagagaatttggtgggagatggagtcgaagcaccaccgcgaggagaaagagatgaaattggagaagaagttgggggtgaaacgaatgtggtatctgagtcttgtggcggagaagagggagcacaagatgcagctaaaacaacgccggaaggagaagcagatcgaatttgagagagaatgatttttaggatttgggttttgatttggagatttttcagaggtttcgtcgactttgaagtctgttgatagcacaaaacgtcatcgtatcaccttaacggatgttctgtaacggctgttaattacgctgttagaaggatttttaacggtggtttattaaaccgagtcaacgcaaacttaaaggttaaaatagaagtcaactttttgttgagagataaaacggccatttcacgaattcacggttaatttggccattttttgtaagttcaggtattaaataacatttcccccctaattattaggtgagtaatacggagaaaatggactttaattatattcgtaaattgatgttcacacattaaggctctaactaaatcttccgattattgtcatataaacatgttctaatttgtgataaaactgaacttccactgtctcgcagagaagggaaagaatattttgggagaacaactaaaaccctaatatctatgatgatgtcaacttcaaaacacattgaaacttgagaaaaacaaaaatcaaagaaaataaaaataaagcctgcatgcaagagaatatgccttccctccaaggttaaataaaaacaagcttatgtgagagattaagtatgttcataacttcacaattgtgtccattagtcgctgctcacgttagtcaggagttatttctgttgggtcttatcaaaactgttgtttatgtctattttgattatggacttacctttacatttgcattttatattttcattcttagttataaaaaaattgcttatacttttctgttgtttgacccagcaccaagtataagaacaattaaaaaatttgatacctaagaaactaattctataagattaattgaagaattattttcattcaaaatcttttgacataattgctacgtttaatgtgtaatgccctggtctattcgataagattaagaagataattgcaataatggaacaaaattagctgagaatgcaatccgtttgcatggatccgacccggaatgcaatccgtttttaattatgtaaatgacaattatacccctggcactcgacatgtttgacagtttgagcaaagagaatttttttcttgttgaggatcatcgattatcagtttctggatttcgctactacagatttgtcccgtcttgagttacgaaatcatg

SEQ ID NO: 31547 - DNA, 3003 bp, Unknown; identical to SEQ ID NO: 31546
  misc_feature (1)..( 3003): 2750-1469P.txt file - cDNA_ID_3043246; gDNA_ID_2926209; Annot_ID_202472

SEQ ID NO: 31548 - DNA, 3000 bp, Unknown; identical to SEQ ID NO: 8732
  misc_feature (1)..( 3000): 2750-1469P.txt file - cDNA_ID_3043263; gDNA_ID_1971869; Annot_ID_176557

SEQ ID NO: 31549 - DNA, 3000 bp, Unknown
  misc_feature (1)..( 3000): 2750-1469P.txt file - cDNA_ID_3043267; gDNA_ID_1971869; Annot_ID_176551
aaggcggtggggaagaagaaaaagattgataacgatgagggctattgacgttaaaacggggatgaagataccttgggacgtacgctattcattaagtctatttattttcttatcatcaattctttttctttccaacggccaagattatggaatgccgggcgaggatggaggaggaggagctgagccaccgccggagatggcacattgtaacggtattttcatgagctacaactttggtagccgtgaaagagagtacccgcacgtgaagaatgtaaccgcccaatcatgggcgtttaaatcgactgcgatgattgtaaacgcgggtagggaagagcttaagggatggcaaatgttcatagggttccgtcacaaagaactgatcgtttccgcgactggtgcgactcctatggacggagattatcctctagacgcgagcaatggaaccacgttcgttggatcgccaaacatggatttaaaaacctctattgaaacagccggtgatttcactcagatatctgcgaatatcgagatcacaggaactctttttggggtttcaaaagcggtcacgcccatgccaagaactattaagctcaccaacgatggttgggaatgtcccgccgctaaaagaaaaggttagatcaatactcaaatcgtttcaaacgcaactaatttatattttttatcatcaaaatattatttatagggaaattatgaacgcaatgcaaaacgtaaaaaaaaaattgcgtttgcatttgcagtttatgaatcaatttaggttaaatcattaaatatttacactccctaatataattgtcaaacaaaaataaaaaagatgtggtgaatgtgatattcaaaacggtgtgttttgttatcttgcgcaggaggtagtatgcacgtgtgttgcaagagaaaccctaagatcaagaacaagatcggactaaagacaaagtttgcaccgagaaggtacggtgacctgaacatagtctacgatgttctgcaatcattcgacagcaactacttagcccaagtgaccatcgacaatgataatcctctcgggcggttagaccgttggaacctgacttttgaatggatgcgaggagagtttataaacactatgcgaggagcttacactcataagaaagatccatcggaatgcctttatagcaaagctggacagtattacaaagacttagatttctcccaggtcatgaattgtcagagaaaaccagccatttccgatttgcctcctgagaagaaggaagataacatgacaggaaagttacctttctgttgcaaaaacggaactctcttgccacctattatggatccttcgaaatctagatctatgtttcaattgcaggtaaatcatctctttcgtttaaaatatgttatgagatcgtagaaatcttcgggttttgaagtttttgttttctctcaatttgttaggttttcaagttgcctcctgacctaaacagaacagctctatacccacctcagcattggaaaatcgacggtgttctcaatcctcagtacaaatgcgggccaccggttcgtgttgacccgtctcaattccctgatcctagcggtctactggctgtaacctacgccatctccagctggcaagtggtctgcaacataaccaagcctaaagcccaagcctcaagatgttgtgtctctttctctgcattttacaacaactctgcagttccttgcaacacttgtgcttgcggatgcaatgacatcgataccgacacttgcaatgctaacagtaacccgctcctcctccctcctgacgctctccttgttccgttcgataaccgaaccttaaaagctaaagcttgggctaaacaaaatcacatgccagtaccaaagaaacttccttgtccagataactgcggagtcagcattaactggcacgttagcacggattacaaaaatggttggaccgcaaggttaaccgtttttaattggagagatttcgcgtttgaggattggtttgtggcgattgatatgggaaaggcaggtccaggatatgaaaacgtttactcctttaatggaacacgtgttccaccaagcaatcgaaccgttatcttccaaggcttgcctggtatgaactatcttgtaggtcaagttaatggaacaaatccattaagagaccctcccgtgcccggaaagcaacaatctgtcatctccttcaccaagaaaaacatcaaaggactgaatattcccgaaggcgacggtttcccaacaaagcttttcttcaatggagaagaatgtgcgcttccaaaacatttccctaagaagagctcagggcatagacgcggtatcagtgtctcaatgtcctttgttttcgcaacaatcgcggcttttgcactaatgatggattaattactgaggagataactatacttaccattcttgatcagtttttttgatcttcaaattcttaagattggtgttttgatgatgttgctgaacagaggaaggatcaaaaggagcagattgttatatgattgatctaagttggaaaaatattgacaatgttgtattaatacttttgtttggtctataaaagtattaaagtgtatgttgttctctagtaatcccaaaatctcagattagtgttggccttttttttggcatgaagaagatcttagtactttgatttgatgtttttgtgaaatctctcttcgttcttgaagatctttatccgaaaagtaataataaaatataacacaaagattctgaagcaaagaacaaaagccattgacagaagaagcaagtcacatgagattccaaaactgaaacacttctggcatttatgctttgcttagaatttgaaaaaagacaataaaaagcttctctgcaacatttcctcaaaatcaaaaagcatcacctttatataaacccatttgcctttcatcatctcatatcaaaccctataccacactagattcaccttcacctttctaaaatctctgttatttagcttacgaaatg

SEQ ID NO: 31550 - DNA, 3003 bp, Unknown
  misc_feature (1)..( 3003): 2750-1469P.txt file - cDNA_ID_3043271; gDNA_ID_1971869; Annot_ID_176550
aatatgcacaagtaaaacccaaaacaaaaaaaaaaacacttctgagattaagaacatatccaagctaaagaaagaagcagaaatacctcatcatgccttgaggcaatagctctttcaggtgaacgcctactactcctgtgactcctatctgacggtgaagtagacctctcatgtcttcctctagagtatctctcatcatctgttcttgtccttctccttttttcagtatcctctctccctgatcgtcttctcttatccccaacttccctatctctttctccttctccttttctctccctatccctatctcttcctatatctctatccctttccctactgtttctcttctccctttctctaccatcatcttctctctctctacttctcccaatttccttctctcctcgagctcttctcagtctcttcgtacgtggtgaaggagacctagaactaggagccattattggagtcagggtcgttttctctcttctttgcctttggaaagatcacaaattgaaaccagggtcagaaggaaaaggcatgtgagctccagataacacagtaaaccctaattcccaaatgcatagaaactagaaatggagcaaaagccctaaaccaaaaaacgtaagctacagatttcaaatactaaattcagaagttccgggcatagtctagggttgcaagaatcgttaagagaaaaaatcgctgcataacgagaaagaaaaattttacctggtggccggaactgtgactacttcggcggagagaagaggagagagtgaataataataatcgcagagataaaaagaatcagagccaaaacgagaagaatcatttatttggcctcttttgcaaataaatggaaactgaggggttcaatatcaaacaaattgtagacggtatggtaaaacttccattagttgacacgtgtcatatcttgtttggtagaaaggatatgtataattagggcagaagccgcttgtaacgtcgtacccttgtacttccttcgagatttttgtttcttcgtcctagtttgcaacaaagattttataattgatcatcaaacaaatcggtgagcctgtaacaaatcgagtgcaccagctttaccaccaactttgataggatagaagacaaatacaagatcatagatatagttgaggtggatagctaaacgacataaaccatcagaagtgacagtgatcttgttctgattgtaacagagtgcaccaggtttaccaccaactttgatcctctcatgaaggaacttgtggagagaaattttcaacttcgaggaacatatgtcctgaaatcccatctgtagttctccttactaccgatttgtagtcgcaactgttggccttgaagcttatgtggaagacagcattcatagactcgagctttagagacgggtcagtatgagtttctcgggtgatgctttggtttgtcgggtgatggctcatcgaatcccaaatcatgtctccttgtttatttgatgtatctttagtttcatgtatatactagtgtacgccaatattatagacgattaaaaactaattcttgtttacgtatgaacaaaacgatatgtactttgtcattattatattttttgtcaaagattgagaatatttatttttttcgcatcatagacacacaaacaaatgttgtctaatgatctaccagccggcttgtatatctaattcaaatatcggtcatgcatcatgcacttcattagtatcttatgttttgcaaaatactggctagactgtcacatatatcagaatcggtcaccgtcaccttcttcgttattgtcatacggtttcactatgacaaagtccaaattaggtcaaattttaagcgaacatacgtagcctcttacgtcatagattgctgatgaaaaagaggcaaattattataacaaccatcaaagattcggtactaactttacaaattcacacaattcgtatctcacaatctaaaagtgcaatatgtcgtacatgttttgtaagctagacaatagtaaaataattatcctgccggactataaaggttcgagaacgtggaccgactatatttatatatcaattagctatttgtggtgttagcctaatgttgccttcatcacgttttctgtttttttgttgaaggattttcaaatagatgaattgactatcatcaccttgtcacgttataaaccatatatattatcgttaaacacttagtagcagttccccacgaattacatgtctccatcattgacaaatttatatttttgtttgtaagaacactttttccttcctcaacaaattcttgtacttaatacagatatatacttataaatgttacatcaaacgctagataacggagaatataagctaaaatgaaattaatatatcttgtttcagcttctatcgaaattattttcattaatggacaatataaaatttgatccttatctactgtttctgtgaatttgtgattatcatcaggcaaatgtatcattaggcaaatgtttttatctaaattaacacttttattggaaaactaccaaaatacatttaggttcacccatcaaaagtactttatgttgttatgttatatattgtgtgctaactaaaaagattacaatttagcaaatctcaagttgatgtgtacatttataatctccactacaacaagaaggtgatccacttctcttgtatatctttatttgttcttgcacgtacataaagaaatcaaactgttcaactgccatttagaatattaaaaccaacaaaataatattataacaagtaaatacttaaacaataataagaacaaagggccaaaatcgtgccaaacctacaacattcctgacctctgcctcccccactatatagaggtcacatttgagagaattaggcaaataaaaatctaagaaccattttaatagcttctcacatctctctattataatatcaaactactcttcaccagccctcttaattatctaagaaagtctcaatg

SEQ ID NO: 31551 - DNA, 3003 bp, Unknown
  misc_feature (1)..( 3003): 2750-1469P.txt file - cDNA_ID_3043275; gDNA_ID_1971869; Annot_ID_176547
cccaaatttaaccatccatttatcaggaaaaaaggaaacataaaataaacaatcaaacataagggaaagattctaagtggcaaactcatttttgtttgttccttctttcttttgaggccaaaagagaccagattcatttttggtttcttcaaaggccaaaccttattttcttattttctcagacaaacccttttgccatattacaaaataaaatttattcgtctgagaattatcttgatcccttttggattcgaggttcaagaacattcatgaacttcgagtaaatcaatcatcttcttgtagtaataatccaggaagatacattatcaacacacataaaacagaatgaaaatcaattgcttgttctgttgtatgtcccacagacgatttaacagacgatcatcatcgagacaaagcatcaaagactgcattgatgcaaagaacaatataactacatttgacaacatctcttttaaaacaggtcccattttctaacctttttcattatatgcattctcaaatcccttaaaagcttttctttctaaaagaagcgaggcgtatttgcacatacctgcagatagcagtaggcgaagatacatatccgaggagatagcaaaactcggtaaagggaacatcagtgctcatatttttacattcagagagctttgcgtcgctaccaagaacttcaaccccgataatcagctcggtgaaggcgggtttggaagggtttacaaagggcagatagaaaccccggaacaagtacttataacattctctctcatacaacatcgatccatcatattctgctcagtggtttgattctgattcttgcgtgtttaggttgttgcggttaagcagctagacaggaatggttaccaagggaacagagagtttcttgtggaagtcatgatgttgagtctcttacatcatcaaaaccttgtcaatttggtcggatattgcgcagacggtgatcaacggattcttgtctatgaatacatgcaaaatggctctttagaggatcatcttctaggtaacatatatctaaacaccatcacaacatactttcacttccacacattctaaagatttaccttttttatacttcagaattggcgcggaacaagaagaagccgttggattgggacacaagaatgaaagttgcggcaggagcagctagagggcttgagtatctacacgaaacagcagatcctcctgttatctacagagacttcaaggcctcaaatatattacttgacgaagaattcaacccaaagctttcggatttcggtttagctaaggttggtccgaccggtggagagactcatgtgtcaacgagagtgatgggaacatacggctattgtgcgcctgagtatgctctcacaggacagctcactgtgaaatccgatgtatacagcttcggagtcgtgttcttggagatgatcacaggaagacgagtcattgacacaacaaaaccaactgaagaacagaacttagtcacttgggtacgcaaaagttcttcaatctgaacaaaaccatttgattggttttcttaatttggttttgctaaaatgcgcaggcgagtccattgttcaaagataggagaaagttcacgttaatggcagatccattgcttgaaggaaagtatccaataaaaggattgtatcaagcgcttgcagtagcagcaatgtgtcttcaagaagaagcagcaacgagaccaatgatgagtgatgtagtcactgcgcttgagtacttagccgtgaccaaaaccgaagaagatggacaaactgtagaaggagaagaagaagaagaagaagacgaaagatccaaactttgagcaaatttttttgtttgttttcgtttgtaattttcaaatgatcggttttaggaaatttgataactttacgaattcaccaatgaaaaaagaagattaaatgagagttttcgtgttccccatcgaacattttaaaggatttgctgagaattttgtatctgggtttcaaaaagtttcagacttgactcatcgctgaacaaaaattacagaattaaaaatcccaactttatcggaaaaatgtcttttttttttggtttatgtatttttttttaaaagtgaaatgattaattaaagaagataaaaggggaaaagggtttaagggtttgtcatagagcaatggctaccagctcagctttgtgataaaacgacaaaattggacaacgataaaccctacttttatctctggaagactcaaaattccttcaagctggggagattagcttcacttactacggccatgggggtttctcttcgtcacttgtctccttcctctttctgggtttcgcgtcgtcctcgtgtttcttcttcaattctttcttttcttgtccctcgccgtcgaatcctttgcaccaggttcacagcttttctcatcttatctgttcccttttctcatttttgttcatcgagaattagatttactcattcattagtcaattgctctgttccgtaaagttggttgttagttttatatagtgatgatgattcacgttttgaggttgttgaagaagcaggttaaaaatgtgtgtttgctcaattgctctgtttcgtaagtttgttgttagttatatagtgatgattcgcgttttaagtttgttgaagaagcaggttaaaaatgtgttttgctgcaatttggtttcagtttctcacttagtctaaattgttcctgtgttaaagttatttaggagtctgcttttgattaagcagaagaatgtattttagttgaggtttggttattattctgagtttgaaggtgtttttctttgtgttgatatcattttttggtggttatgatttgcaggaaagtagcaatcataaagggaaatgcgggatattcgactgctactgattgtggtggttctcatgggtttcatcattcaggtcatcaaaggtcatcctctgttgagtttagtggagagtggaaacttaatttgggatctaagacggcgagaatg

SEQ ID NO: 31552 - DNA, 3003 bp, Unknown
  misc_feature (1)..( 3003): 2750-1469P.txt file - cDNA_ID_3043281; gDNA_ID_1971869; Annot_ID_176545
aaactatgaacaagaattctctgatgtgtccatgccaaacctctgcatcttagtgtctgagattcttgagctaattcaacatattatctacatgaaactaatcacacttacggtgcagttgttatatgatgaaagtagttgatacttatcatgaagggatcgtgtttttttcactttcaggtacaaagatccgtcaccagagtggtcagtcttcagggaagcaagctttggacatggggagcttcagatggtgaattcaacacatgcgctatggacctggcataggaacgatgatgacgaaccaacaaggtctgatgaagtttggttaaactctcttgtgaactccggatgcttgaagaaaaggcctcaagaactcaggaaaatgctcttggaaccttaattatatccataaagtgagaatttcagtaaaatagtccattaaatatagaaatctacaagcttgtaatgttgttagcaatgggactcttaatcacaccattgaagaagattttcaccaactctatagaaatcatagttccaactttaaaattttgtaaacttgcactttgctttgtgttgtttttcccactatttataatcttaaaaaaaaaaatctagaagctaaagtgacatacgttagattttgtcaatgtagatggttcaacgaatgtgacatacaaaacaatgttgaaaactatttccttttgaacattactcacattaggtacaacaactgtcactatcttaaaatgcaatactaaaaaacattcttcatcacattaatataaagttgagatacatataaaattacaaattaattacaattaggccacaaaaatgatggaccgtaagtggaggattagttgtctgaagaccgttgacgaaaaaaggcggaccttttccacgcgctcaccacacaacactttcataaaatcaattcatcgatccatcgtctctatcagatcaattcatcgattgcgatcgctctttcaattttcttcatcaccggtgaaaataatcgaaacccagcacgagaaaaatgcatgatttttgcttcactatcccgtacgggatgcttctcatcggcggaggatttatcgggtacatgaagaaaggaagtataacatctttcgccggaggtgcaggcactggattattactcattctcgctggttatatcagtctcaaagcttttgagaagaagaagaattccactattgctatggttcttcagacaggtttttttcttgcaaatttctttcctttttagcgatctgggtttatatgtctttaacagatatttatgtttaggaagatttattcgtatgattccgttagatgtccatagggaagactttcaattacaagatgtgaatagcttttagtgacttatcacttgagccaaggaattgtttcattttgttttcaatttgttatggttcaatgtgttggatcatgaacttagcttgagagttgatgataggttatgttataaggttaaggatcttattggaccactaacgatctggatctgaataagtgatttgtgtgatgatgctaaacttgctattcaaagataaaaaaaaattaatattttggttgtgtttggatcttcaattgcagcagtatttgaattggtttgctaattttttccactaatgtaatagtgtctctcttggacaagatgctgttttactgcagatgaacattcaatttgagttgttagatgttgtagttgagtagctgtttttaattagtgttcttgccattgattgacaatagaaccaacctcaaagatataacaagcttgcaaaatcgattttcattatctatggtgactgaaactcatctgaatgtttctttttttttcgatacagtcatcgcagctgctctcacactagtcatgggacagcgttacttgctgactggaaagattatgccggctggtttggttgctgggatcaggtaaaaatccttcaacactggctggctagtatctttgtttgcatcaagatttggtatttttaagtttttacaccattgacttaactctagaaccatatctgtattgcagtgctctcatgacctgtttttacgtatacaagatcgctactggtggcaataaatttccagcaaaagctgaatgatggttctgctacatgcagatgatactatccgttgttgaatttgtcgattagaattctttttggtgtacacaatgcggttgtcataacgccttaatagcttgtattagtcaaagaactgcatatggtcttgtgttttcttgtcatcgtgtttttgtaaccacaaactgttttgagctatactactatatatattgagatatatctgccgtttcgatacacacttgggatctggggatgagcacatcgtaaaacaaaatagaagttgatcctcaaaacttctttgtaaccttgtgtcatcacaacaaaaaatcttcaatgtgtttgttctctccttaaagtatatcttgattcatgcagtaacaaaggcaaaactcttttgcaagagtatagaaaccagactcaagctgtgcgatggtgattcttttggagaagttggatttgtgctctgatgtaaagggaaacttaagctaaaaggtccatcaatggaggtgacacatagttttagaaaatgtgcttttctcatgctagaaatgttatggagacccaaaaatgcttttcggaaaaaattctcatgctagtagctaggctctacttaacgaggtgacagctaaaataagttctttttattccattttcagaatagtgacattcttctcacaaatatagaaaaactacaattaatgctactgcagagtctgattacgttttaagctaatttttccatttttaggacgtggtagattgtgtagattattgctaaacagctcatgagttcaataattcacttattcttcactccatcttcagcaaaaaaaaaaaaagtaagaagaaacactgaaagctctccactaccatg

SEQ ID NO: 31553 - DNA, 3003 bp, Unknown
  misc_feature (1)..( 3003): 2750-1469P.txt file - cDNA_ID_3043333; gDNA_ID_1971871; Annot_ID_176600
agtaggggctaaaactcttaactaacattacaaatataattgggaaaacatataacctatttatttccttagtggattagtcctaaaagatcattaaacctaacccaagtcgttggtgctagttatagtttggtaactactttctgtattcaatctgaagagagtattaaaatgcactgtcgaaaccgaccagtctagtccaataagacttgaccaggagggttttcttccttgtcgggtctaactcatgtaacaaaacttttacaaattctgaacttaaaatgatccttcacatttaaaccaacaataactgaagttactcttaaacatttagcatgacccttcccctttgtgttggtaaaatcgctataaaaaatcttgtgatgtatagaccaaaactactagttagtgaaaaatgacaagaatagaattgcacttgtcatgtgcttaagaatttgccgtttccttaaagaaacttgcagacaaacaaatgacttagctgtaagaattaatctcatacgtacccttaagccccacaaaagggtaacacaaaagtcaatagaactgatcaataaagatgtataaatgcatgggtaaaatagtaaacttaccgactaatttctgtaaataacgcttacccgttaccaccaatcgtggtcctcttctgctcgtacacactctttttatataatctctttctttcacataaagagaaagcggaataaaaagtgttcaagagctcataacatcaagaaaaagtatatacattcttctgtatatctctgagaaatattatgattgttgtctgacattgaactttttaaaaagaaaaaaatcataaacttctctctgttttgccagaatcttatattataaagtatattctattcattacagatctgctcttggatttcggattctcctgcaaacgtaaagacgaaggtgttttatctcttcactgcaaaaaaaactcttgaattttatggttttctatagagctgaaatagtaaacgagtcttgacaaaaaaaaaagttcgttttcttttctaatgtttttgtggtagcggaattttagtctttagcctctatattaaataagttttaatctaggcgattttttttttttttttcagttcacattctcattgtttgtgctttgaatcggtgaaagatgattcaaatggatggtggagataggctgagagtgactttattagatcgtatgtcaacggttgagagtagccggagctgtttaactcttgaagctattctaatggctgataaaaacagaacctcgccgcagattctctcaccaccgccgtcgaggagccaatctaaccggtcacttgttgaagtcatgcaaagagagcaccgacacagtagagataaaaccgcttggaaaagtctccgtgaaaagctccgtcttaaacgtaacggttctgtttggatctcgtctaattctatcccgagtttggatacgcctattcctaaccgggataacgttagccaccaacttggtttcctcctttctaactctggaaatgtaacagaggaagcttcgtcggtggagggaaggattcggttaggagctgtgttggcagaggagagagcattatcggctagagaagaggaaacgccggcggagagggaagtggagccggcgaggatgtcattgatggagttgttggaagagaatgaagggcaaatgagttttgtaagtgtcgacggagaggcggaggaggaggtggcggcagtgacggcggcggagataagttgttgtgtgtgtatggttagaagcaaaggagctgcgtttattccgtgtggtcatacgttttgtaggttgtgttctagagagctttgggttcaaagaggaaactgtcctctctgtaataccacaattttagaagttcttgatcttttttagacttttcagtttaattatcttaatttatcataatcaggttgtttcctttgttgttgtaatgtgtcgttgaatatttgatgagtaatccttttgtagaaaattagtttccctcttagctccatggaatcctagtttgtttatgttatttggagtaaacacataaattagatcaatcaaactattatcattaatcagcaacacacaatgttcgaatggttgaaactgttgaggtgacaaatccgtttgtgaattgcaccgtttttatttaccattcataaattataatttatagcgataaggaccgaacaaaataattttttcatcgcggaccaagtataaactatttttacttaagattaaatttatcattgtccgtttcaaaattagagtgatctaatctgctaaatggtaatgatttaatccggttcgctcgcaacatgcattcaaaacttaagtggttagtacttgttgtatgatttgaatggaaaacttgaccaaacccatctatattgcgtataaaatatgtcaaatcaaattaaaatgaaaaaaaagttggcatagtaaaacaaaaggttgatggttgaaccataaattcttaatttaatttggcttgtcactgatgtgtttgatttgaacaagaacaataagtggtcgggctagaggtgaacaatcctccaactacacttatggttacggcaaacacctaactggtggaaagcgtcactggttaactaactcttacctatcttttcaatttgtactttgctttggttaatttagataaccaccggtgttaaaccaaaccgattagcatccggttggctagcccaaaactaggcccataacgagaagtcatgggcttgctttcattagtcaagttttcatttatcttcttaccatttattttccaagaaaataaaaaacagaaaaaattcgtggaaacgccattaacgagatctagcacaaactcgtagtgtggtgtagaagaagacaaaagcaaggagcttcataataaaaccctagagatatttgtttctccaatttcaaaagacgagacgtgaagaagacgatcgaagatg

SEQ ID NO: 31554 - DNA, 3000 bp, Unknown
  misc_feature (1)..( 3000): 2750-1469P.txt file - cDNA_ID_3043345; gDNA_ID_1971872; Annot_ID_176612
ggtagccaagtgattcaaacgtgtgcctcatccgaagaacaaagtgcagatcttcaggtatctgagtaagtttagagaacataaccgcaaagatcccaagtaagagaagacttacaatcttttaaccatgaaccaaaataaaaaagacttacaatcttgcaagaaccaagttgtaaaaggccatgtccggcttgaataacagctatggtctgtaggtacaataagaaaagattacaaaggtgacttgagaaacaagaaagtcaagaacattctcatatatgattagtgttctttattttacccgaatcccagattcgaactgatcattccactctgaaggaatctgcatttttttttagagatagatctcagccggcttacaaatttgcagattaaaatcttattatacgtaaatgcttcattatattataaacaaacttacagcatcgaatgagctttgccagtaactagaggcattagattcagattcagtttgttccttgaaaacccatttatggcatttgtcagaagcaaccttccccattaacctgttggccagaaatatattttgcaaacttaaaaagaggaagataaatagtttctattttgggctaatttgcagtgaatattgaataaggtcaggagctgcatatattcatgcagacatatatgataataaaaagtaattaaggacctaccaagtacccacccttcgccataattatataactgaatagacatcttgctgaaagatttacgaacaggatcttctccttccatgtctccatagcaaccttctgttcctcctcttcctctgcagtatccatcttcccacatcaacatcctgtagccccaaacatcaatatatcaatacgtagcgcatatttgtaaatctactcatcataaatcattcattttcattttcattaatttatttattaattaaaggaagcaatggttattagacaagatcatctaaaagagatgacttgatgtgtttttttccagcaaatcatgattcacaacttaaacgaatggtagatacagtctcatcgcatatatatagatgcatagagctacgtgatcatgatcatgtctaggatctccatgcaacattttttggatttttgttttgttttgttaattcaagcctagagtactaatactagtctgtctagttagtttctttccggggaaagtttccggtgactataatacgataaaccataagggaaaatgttgactttttaatcatgtttcataaagactaactatagtacgctaagtctcttgactatacgggtaacctaatttttttttgtaagaagtgtaacttacaagcttccattgtcgtcgccaactttgcagccgttgccaccgcctcgaactctcctgaagaacaaaaaagacatcgttttgaggagagatagatagatcatgtcaataaaaaaaaaagagaggagctgaggagagagatacgtacggacggggacggatggaccagaagacagagtaagtccagtcggtgttgagacaaacagttctcagggcgtcgtggagagccaccatccctaaagcttctttgctcctttgttgctgctgctgatggttttgatgatgatgttgttgatgatggtgatgatgttccgagcccaccatctatatgaatatgtcggtgtgtgttatatgggtttctcctctagttttggccttctaggttttctttgctgccttccttgctcaagcttctcatggactcttttatgttctaaatttcttttattttcaatgtttataatttttttttctaatttagactaattatatgattaccaaaccaacatttactgtttgtctacacaataatatgctattttagttcttattacttttttgataaaatcttacaatcttgtggcaaggatacgaatttcttggggtttggtatagttaacaataagtaatatataattaattatcagagaaccaattgaacacaaggttaaagttttttgcatgtaaaagttttttatctcttaggccaagaaagtcaaagatacttgaaaatcttcctgaaaaaatcattttagttcgctttatatttgtttgaatggaatccaattatcaaccattgattttctatacttcatattgcttttctgaaagagaaataatcatatggtttcgagtggataaactgttgttgttatgattaaagatacaattacaatgacataattagtcagtcgacatttttatccactaaaaaacacagtcttttagttttagtattatatataactctagtgatacaattaaaaccatgaaatgtgaaagtgttttttcttaagaagaaaaaggcttttatttagttgtcgtcaaacttgggattcggtttaggaccaagattcatattactacgggtgtgacacgcacgcaaattaagggggcacgacaaagagaatatataggaagaagagatttaggagtcacgtgtgcacgtgccgtgtgtaagactcgagtggctttgtcatcaaccatgacccagcgtctggttttgacctcgtggcgcgtataaactacgcatagaaacacagagacaaaccaggaagaagaaacaaaatcgtctgatgaatacaccaaagggtggcgagtgagaagtgtgagtgacgtaaacttaaaaaaataggacaggagtaacagagagttggtctggattgcatcagtctgaaaccctgacgagtcttagctccgcattgaccggctctgttctttacttacaatttttcttttgcgggacccaccgtttattaggaaaaagaaaaacaatttgtgggtaaagaaagtcgaatatgagatcatgttaattgctgcaaaggccgaaacaatggttggtttctagttctacttcctagtatatgggccgttaaatgagcttcaaagcttattgggcttttagtgcttttaacagttgggttgggttgttcttcgtaacaaatg

SEQ ID NO: 31555 - DNA, 3003 bp, Unknown
  misc_feature (1)..( 3003): 2750-1469P.txt file - cDNA_ID_3043367; gDNA_ID_1971873; Annot_ID_176650
aagcttccgaaacatttgaccaaacaagaatatataactccgtaatatatatttttatttatgtatacaactgccaaaaaataccaaacttccattttttaccaaaaaaatatcaatttttttattttataagtatctaactttctaacaaaacttataaaatactttacgtccataccacatattttgacgtacgcagtttgaactagctaggtgtgagcatcgatttttgggtatagtatgtttcagatttttggaaaaattaaagttccttaataaaaaggaagattgaaaaatgtgttagaatagtcgatgttaagcgagagagaaattgtaggttaaaacaaaagtgaaaagtctaactccacttattattaacattgtcattttcaaaataacaaaatatctctttgacaattttgtagaacaattggtatctattttagacaaagtttggtttggacaaaaaacgaaaatttggtattttgttttgtattttttcccatacatgtaaacaaacgtacgtatcttgatatttatccgaccactttcgctttcgatttagtgtttatttattttatttttatagaagaaaattattattgaaaaaaaaatagctcggttttggcaaatcttaacgttataacaggttttaggaatgtgatggtgatataatgtgcaacagatttgcagcgatgtgctgatgatacccgcttttcaagtgatttggtcgatttatagtttattattatactcatcaaggttaaaactagaccaatatcattaattggagaaagttaccataaacaagttcttgttaattatttccctagaggcttgattttcacaatttcacatcattattccatttgatgatgattatcagatcttaacttcttcttcttcttttaacagatatgtatattaatttgggttgatgaggtcgcataaatacagtagcaaacacattatctctataagtaaagaatgatcagaattaagtaaatttcttgtttttgacagttcctcttgggattttactaagaacattcgtatcgactttcttgtacagcttcttcatcttcctcatcaacttacccgccgctgtatccacgtcgtcctcgtacatctcatacataaccggtaaggtttgcatgcttacaaaccctgaacgacacgacgtccattaattccgttaattaataaaagggaattaaatctacatatatagttgagtatcatgacttaattcttcttacctatgaagagaagattcacaaagttgaaatatgtcccgatgatggatacgatataaagcgagatcgttgtctggaaatatagtaaccaatttaagcaaaataataatgaatccaaagttatatatatatatatatataagtggaaaattattattctatataatatcttacgagaaaaaagagaggaggatctcttccacaagcaacgtcaagaagctttgtgaggatttggttgaatctaacatggaagcttcttgctaattgtttgaaagaagattcgtctagtacaacttctggtattagtggtctttccctgcaattttgtttatttaattgtcgttttattggtaaggaaatcttgtaatttgtatatttttaaccaattgatcatgagaaattgaaaaaagattaatcaagtaaagatataaacataccaattgagaaaatcagaagcagtagaccaaatgaagaaaaaaagcatggaggtcatggaagcatgacaaattagggttatgaaattgtattccactacttccattaagaaccataagatgctcactcctatcaccaatgttgctgctattttcggctctctccataacagaatatccgcaactgttaatcacgaatgcaagttgttaaaatttagtgtttgtctacattataattttggtgataattttggataatagcaaaataaaatgtgatatttgaagagaattgatggatataaacatgtactttcacacacgcataccgattgaaccgatataaagtttgaaagagagtgagacaaatacctttaccacctccaaatatagagtgaatagatcgttgacgagtgaagagcttagttgttttatggatcgttctttcgtcttcagaatcggaggacgatcccgtaaatattggcatggttggatcaaatttattaagataaaagttactgcggtaagaaacaacaatgaaatgaatgtaatcactatgtaaaatagttgatttggattaggagaaaatgtgaaaagcaacaaatataagaagaaagaagaagagataggttctaggcttgggaacaaaggtaacaaaaacatattcaagaagcaaagaatgggaatggttttgaccttgttccttctcccatttatttcttcatcttcatgtctcaataaactattcaaacccctcacgtacgttgcatatattttaactgagtgttatcttcccggtataagtgaagacccgaagatctggtctaaaccgtagcaatttgaaccgaaccggtttataacaagacgccgatttaaccggagttgctggagttaagatgattccgttcggaattggccgtgggatttgcccgaggcttggaacgacaaattggtgttcgcggtggtgatgaagaatccgctgagatcaaaaaatgttttcgattttatcatcatcttcttcttcacaactcgtcaattcaactctcaatttccaaaattcgccgaaatctccgatcaccgttatgtcgaagacgtctaaattcaaaaccctgacggagaatttcaccgtgagagtgcttaaagcagagaatcgcgaactgaacgtggctctgctctcacctttcactatcgcttcttcacggcttgattctgtcagtaatgttgcgattcggattgagctcaacgatggatttgtgggttggggagaagctccgattttgccgtcggtaacggcggaggatcagataatggctatg

SEQ ID NO: 31556 - DNA, 539 bp, Unknown
  misc_feature (1)..( 539): 2750-1469P.txt file - cDNA_ID_3043375; gDNA_ID_1971873; Annot_ID_176643
caagtcaataagaaaaaacccaaaaatatagtaactgctaaaaaaaaaacttaattttgcgatacagaaatattttctcaccccaccccagattcaccccattaaccgtttcaaaaggaaattaaggagttgttcatagtttcgtttgtaaattgcaattgtaagtttgtaactgtaatagaattagattatttagggtttgcttgatcctcgatctgtgatcgattgatctcgcttcgcacccagcaggtatcatttttattccattatctctccggccgtgtagttaatttgttaatgcattttatgtttgcatggtgaatctaacgattttttggaattgttttatatcaatccgaaacaaaaatgattaatatttttcgagacaaatctttgcgttgatttatgatatacgaacaaaaagaagaaacaaaccctattacagattttatcggagaaagtttgcataacaaaccatatgtatacagatgttacaatgaaagtgatatttcaggtttatttaatgagcgtgaaagatg

SEQ ID NO: 31557 - DNA, 3003 bp, Unknown
  misc_feature (1)..( 3003): 2750-1469P.txt file - cDNA_ID_3043420; gDNA_ID_1971875; Annot_ID_176702
tcagccttcttagaaggtccaacatattttacacgatctcctgcaaaaagcgtaaacacaaatagaaatgaggaaaagtgaaaaaattgaccacacaaagagaacttagcagtctgacaagtagaagaggaaagagtgaaaggctaagatagaaagacaataccaggaaaattatgactagatagaatacaaaattactaaatcaaacttatttagcaaactgatacattcaagtgtacctagcacttgtaatgatgaagatgccttccagagccttgatattgatgattacctttctttgccggtcgcctggctttatcagaatgctcaacagctgctgcttcgcaagcttcaccatgtagttcttctgctactagctgccacaatttagaggaggtaagcaaatttcagcaatttctgaaactcaatttaattggaagttcaaaaaaggaacaatgcaaagagtcgcatgtagaaccaagaaacagcattcaaacggcaggaatggtgaaaccttctaattcatgcatagtaactctaataacaagttcatacaaataagataaatcaagaatcagaaaacttatatgacagggtcccaagatcacattgtccacggggtatcgcaaaaagaaaaagaaataccatggtattaccaactaaattaggaaaagaacaatcagtacagactaaaatttctgaatctcaattaatgcaatcataccttttcgaactcttcaagttttggcacaattttcttgatagcttcctcagaaacctcgagacaagcttcctcactgtcactcccatctgctttcgcttcagaatcctcttcgctctgagcactagaatcttcctcagcatcagactctgtcgtggattcatctgcttccgcttctgcgttctcaccatcagattcagattcttcattgtagtcatcagcaaaatcctgatccagaattaaaaaatattacataaacaccaaaaagaacgaaagaaaaatggtggcatgttataggcaaattactcataagaatctcacatatggggcaagaacgctgctgtcaagaaccaacaggggaacttgtacatctcgagcaagtgctcgtaccaacctctcccggtaaagctcagtacctgaataaaattcaaatttcttattggtcatctaacatttcctcaatatttttacttgataacagaagagcaacatcaaatcctggtctgccatttttattctatagtcaataacaaacctggaacactctggagcaatattcttccacttgaagaatctaaacgggcaccatatatggaagcggcattcttttgtcttatatgtgaggtaacacattccaccaaaatatctttcgtgtggtcgctgtgaaaagataatgagcagaatccataagcagaaatggagaaagaaacacaacaagcgagaaaaaaaaacatgttgtagattattactggatgtagtaagggaaggtctcccaagaaagctgtattttttcccaaggttggattctccgtaagaactcgtttttgaatctttctcgtctattaacgaaaggtgactccttctttttgcattcactagcaagcttctcattattgagccattctatttggtcttgttctccaagttgagcatgagaatccaaatgcccaacaccgttattacttttctccttcccggtttttccatcatctacaccattctctttgttcaaagagatatgtttatcctcactagcattccttccatcaccctcagaactaaaactacgcaactggctattcttcaaaatacttaaatgatttcccgaggcaatagtaccaccgcggggagaaaatgaaccaagtagagactttcttgtcaaattttcactattggttaatttatttgtgaatccacaatatctggaaaccgtatagtcacgaacgactggcctaactaagtacttggcttgctgcaataccaaaccccatctctggttcctctttaatgcccttgtatacatcacaaagtcccttctcttccaatataactacaaaaaaaaaaacagagatcattgatttagaatcactttcagggtccatttcttgtactatccaacctaaatgcattgcaacatgtaattgcaccattaaaaaaaaaaaaaaacgagatcaatatcaacgcaaaacatactatagtaactcggaaagaaacatagattctatacaatttatttcgactagaggaataacaacacacttcagggaattaattgattaagaacagacatcaattaaaatgaacgattatgacgcataacggaaaatccaatgtaacaacgaatatgaggcatcgatatagaaatgatgatatattcagcttttgtcatccataactattacaaaacacgaaccgtttaacagagatggacaacaaaactggttctattcatcccccaagctctaagaatcaggcttggtgcaaagaggagatgtaattaggaacgagatagggtgaagaagagagagaaaatcccgacagaggagagagagataaagaccgatctaaagtctgtaggttcttcttctgaagctgaagctgggttcgaagttcagcttcgttgatgcagtgttgtcgttttgacgcaaaattgctacttgccttcctatggatatgggcctaactataaaggcccactaaacatataagagtcggtattttcctgacaaaaaagccctaacaagttgtcggatttacaatcgtacccctatttttaagccgcgcttatctcgaacctatacctgtagagaggaaataagcatttgggggaaatcaatcgaaaaccctaggagagataaaaacaaaaatctagacggagatttatggcgacagcgaatcctggccgtggaggtggtagaagaggcggtggagctatggatgacgataagttggtcttcgagactaccgatggaattgagcccatcacgagcttcaatgatatg

SEQ ID NO: 31558 - DNA, 3000 bp, Unknown; identical to SEQ ID NO: 8752
  misc_feature (1)..( 3000): 2750-1469P.txt file - cDNA_ID_3043431; gDNA_ID_1971875; Annot_ID_176687

SEQ ID NO: 31559 - DNA, 3000 bp, Unknown
  misc_feature (1)..( 3000): 2750-1469P.txt file - cDNA_ID_3043439; gDNA_ID_1971876; Annot_ID_176729
atcctttcattaacaaaggaacagttttgttggttacttgtcgatttattggtgtctcattttgtttttaatctttgtcagaggatagctctttggcttttgagtactggttctgctccgattaaattgaatgatgctgctactcgggcaaaaatcgtcaaatgcaaagagtccttgtggaaattgttgtattatgctgcttgtgactttttcgttctacaagtcatttatcacgagccgtgggctagagatatcaaactctacttccacggttggcctaatcaagagttgaagtgagtattcacttttgctagctgccttgagtttcttggtttagaattatgcccgtagagttcattttcatggcatagtacccaggacatgtgatacattagaatgttgttttctttttttttgtaggctttcaataaagctttactatatgtgccagtgcggtttttatgtgtatggtgtggctgcgttgcttgcatgggagacaagaagaaaggattttgctgtcatgatgtctcaccatgtaattacaatcatcctgcttagctactcctacttaaccaggtaattacaccttgattcatcattttgcatcagaacatcctttgttgaaaagagttaatcaattagcacctagatttaatcagttcatatcttaagtagcacctagattttgaaaggatttgctaagtttaacaaatcaattcaatctaaaagagcttttactgtaaaaaagttctttgcatttgttttcttgttaaaaagattctgttgactgatgttttgttgtttagtgagctatagagcaacctagaaagattaaaagactactgggaattgttttgttttcttctgcagttttttccggattggagcaatcatcctagcccttcatgatgcaagtgatgtctttatggaaactgctaaaattttcaagtactctgaaaaagaatttggagcaagtgtatgttttgcattatttgctgtctcctggctattgctacggttgatatacttcccattttggatcatcagggccacgaggtagacatactatatttgaactctatttagttttaatgtcttttacttgatgtcaatgtttgatctgagattcacatttttgtttgttgaagcattgaactcctggattatttggatatgacatcagctgaaggcacattgatgtactattctttcaacactatgttactaatgctgcttgttttccacatatattggtggtatctcatttgtgccatgattgtaagactacttaaaaacagaggaaaagttggagaagacataagatccggtaagacttgtttatatctttcatatgagtccgggtcatctttctctattgctaaactggctagctttaaggggaaatgactttcttacttacttgcaaagccacaagctattatagtcttcttcattgttgtatgttgtgttgggtatgtaatgtgatctattgaagtttttgtgtaaccatagtttggttcttttgtgaatggcagattcagaggatgatgatgattagtcttgtaagatacggaacatgtttccacttctccaaccaaaccatttagctgctgaagaatttgttttcagcttcattaccttactgactagcgttggaggtaaacaaaaaaaagaagaaaaggttatagattttttttcagttttgtattggtctgagtccatttcgacattagactgcatattctctttgacatataagaaaaaaaaaacagaaactctgggtttcttgtgttgttcggtgatgtataaaacaatattggaagtctctctgtaaatgcaattcctcattgtatggttttcaacaccatagccttttgttatggagctcactcttgaaaattttatctgttcagtggttgcttatattcattagttttattttttgttttccaattaaatcagttttttgatagctgttcacaaaatgtatatgttttgagtaaaagccaaatgtcattcaacatagggctgggcacaagtcaaatacttgccaatttggaggtacttgtgactcgacttgccttgtccaagtaattggatttttggcttgttacttgccttgttaaaacgactacttggtctagcaagtacttgtctaaattttgattacttgcaagttacttgacccgccttgttacttgccaaaattaaatacttttacttagaacctaaaatatttggaataaaaaaccctatttcatacataatatttaaggtcaatgagttttgttacaataaattttaaatttttagcttttataggccaaaccaaaattttaaatctattataataatttaagcattagtatgttagtaacaagtatacaatgttcaacaattaacaaggtaagtaatagaaatttatttatatccagacctaattattagtgatcccacaagtcacatgtacaaataacgagtaacagagcaagtaaaaggacaaacatcaaaatgaggcaagtaacgaggcaagtaacgggacaagtatcaaaacgaggcaagtaacgaggcaagtatcaaaaaaaaattatgatacttgatacttggcttgcacttgcaagtaataaaataaaccgacttgttacttgacttgcctatgacgagtaacttgaattttcaaggtgagtacgagccgagtagcgagtacttgtgccccggcctaattcaacacattcacacggtaacaaaaagccaaacactacaagatcttgtaacagtaattgtgcatgaatcggctctcaacaattgactcatgacactcatccttcaacaagatcttgtagcagtaacagctctttgagactttgagtccttgttttggttttactaatatgactagacgaaaaagacaataattaagtctttcaattgattaccatttaaagtcaacgttatgagtcagtagctttccattgatgaatcaagttcagcttttcgatg

SEQ ID NO: 31560 - DNA, 3003 bp, Unknown
  misc_feature (1)..( 3003): 2750-1469P.txt file - cDNA_ID_3043463; gDNA_ID_1971876; Annot_ID_176728
aaaactttagtttctcttataactatagtgaacacttttggtcaggctatcagattcgcatgtctaggcttgctgttaaatgcagagaggaggggaaagacaagtttacagtgtgcggagactagggagctttgcaagtgactcaggaattgctccagtgaactgattgtcctctaaatgtctgcctcatcccacaaaacaaaacggtaagtccaataatctaaatctcttgcacaacacttagaagtttggttgcaaaaaggcatacagagtttccaatctcgtcattggactcaaatctgggatcggtcctgtgagcttgttcttccccaaccatctgcaaatccggaagttgcagctgagtcttatttaacaaaaagaaaaaatctcagacaaaattttaggatgtgaagtccttacagatctttaagggcagtcatcttgtttatgcttggtggtagagacccagatagtccaagatttgtcaaatttctagcaagagaaccaggttcttggagatttagacttagtaattgacgacagctgcataaaaagcttcactagagtattgagttttgacttacagagaaatcactctggcgattttgtctttggagcaagttaggccagtccacgagttagcacgagggaggcatgggtcgccggaccaatccactggaggcttcatgatgctctctaacagatcttccatagcaattgctgcagaagagaatgtttttgttccagtggcttcagttattacaaaatagacaaaaacatgaagaagaaggaaacatttacagtaccatctttaatattagtggttccaccaagaggaagaatttgaaacacttctccggcgttaatgaaaggtccaaccggcgcatccttggccggagtcaatgtgatctgagtctgacccgataatggccactggccagagtaaaccataaccccattagtgctcacattgagcttccttaaaaaggaaagtccattgactgagacatcaaaagccctccagctcatggggcctggactccgattgtcctgaaaatacaaagctacatagtactttgtggccggaagaggaaaaggtggccattgaagctctagaggcttccctttacttgctgtgaaaccttccacaaaggcttcagcaggtggaatgttccagaagtttgacgggttaattctgcttcgagaagtcaccgtcagatgcttctggtccgaaaacggttgccataaacggttgtatttgtcatctggatagctaggtttccaacatgtaacataccatcaaaagtcaggcaagaaaaagtgcttttcagatcaccaaactatggaatcaaaaagggcacctgatgatctccccatctcctccaaagctgttcctggctatgaggctgagcttgtaggacccgaggtctgtggaattgtacattgtatcttcaagagattggacatctaaagacgatataaaaggagaggaagaaagggtatgtgcattcttggctagacaaacacttagtctgttcccaggaacaccaacaatgatctcgtaataagaactctgacccttggcgtaatcctctgacgtattcacgacgctccattttgtgcctccaatgatctgatcaaacacaggtgggttgtttttaccgtcaaagttaccgtagtagtaagtggttcgaataaggtacttggaggtctttgcgacagggaaattataacagtgttttcgcgatgacttgtcgggaaagtaacgtagtgtggagaggatcggaacgaggtctttttgcttaatggtcgtcgtatttcccacggaaatgaatccttcgtccggtgtgtattctatctcgttgaggtttgttgaagaagatgatccacaatttaagaagaaacctttcacatggaatgaaactcgacgttttagggtagtctataacaattgtaagcatggattcaagagtgtttttggaaattctgtaaatggattatcaagattcgatcgaaaatgtaaaaaaaaaaatcagaaaaataataaataagaatcgcaaaaacgaaatttacctcgaggaggagggagagcgtgagagatggagaagcataataagagaaagaagaacagagacattattgtgacgtattttgttgaagaaacagacaaagaagaagaagaagaagatcagattctttccattgtcgttaatggagatcatacaaagattgaaagtagagaaaatgtctgaaaaatgttaatttcttttttttgcaataaagttaagagttaatttaataagacatacaatatagaataagaaagcgcctgtagctcagtggatagagcgtctgtttcctaagcagaaggtcgtaggttcgacccctacctggcgcgtttttattttggccttatctattatttttcatgtaaccttttctctgtgtttcatactactttcaattatctcgattatcatctttttatacgtgaataatgcaaaaatatttgtattttcataggagagtttacaaccttttctctttgtattttcaaatgtatgaatttaaaaatattttaaatgtacaacctttgtaacaattaaatatataaagtgaaagattattgtgagttctaataagttttaacaatagtaaatggttttttttagaacgactctgtctgcaacagagtgactcggagtgaccaacgcgtcctaaaagcgttgcgtcatgttgaagcaaacccaactttattccgacgctaaccaacagattcacgaaaccctataaatacttagaaatccctaatcctcctctaaatccctaacttcttcccctacactctctcacacaattttctcgagaaattttccaatttcctttcgatttcgcccagaaatttcggtaactttcagattctgttcagaacgaagaaacttgttatttttggctacttctctccgattctgttcttcttgtagtagctgatcgcattccatg

SEQ ID NO: 31561 - DNA, 3003 bp, Unknown
  misc_feature (1)..( 3003): 2750-1469P.txt file - cDNA_ID_3043477; gDNA_ID_1971877; Annot_ID_176770
agtagcttggcaaagcatatgcttgtagtcatcaacaagcttaagagtacacttctccacaatggtggtggtatgcagaggtgacggttctgcattagaaaacatcagattcagatacaacaaactagcaattgtgcagacctcaagcacaacaacagtagtatttatggagatacaaatacagtgactcaaggaaccaatgtatcgtctaaccatcagatttcaaatccacttaataagatgaacaacatttctaataacatgatttccaaatgcctaaaacccagaaacctaaacgcaatgaagcaaaattcaaagtcaaatcatcaaaattcgtattacaacaactgagtcaaaatttgagacaatcagggatcatcataacgcaccgttttggagataagagccgtatttggtggcagagagatgcatcttgatatcgtctaggttctcacactgacatagattattgtaatcggcggtggtgagaagcccagcacggtggcctctaacgatcgcctccaaatatccgccatggatgttgaaggtaagcgcctcgaatccgtacatctttctctccttaacgtaagatattcagatctcaatgattgtcgccggagatctgaagaagaaatcgatacagagatcaacgcgaagaagaagatagcttcgaattgattggatttgtttgcaaactcgtgttggcacgtttaattacggttgtgtcctttaaaccggtgtgttaaaccgaagaatgtacgctgcaaaattattttcgtctctcaattttgctttgatttgttttggtttatcgatataatataataaataaatataaagacagaatttcagaaatccagtactttaataaaattctgatactttaaaatccagatgcaacaaatatcttgatatccaaatggtatctttaataaataaataaaaaactaatatgtgaaaaacaacaaacttttatttatatggaatatttacattttttaaatatttttattcgtagcaaaaaaatatgtgaaataaatccaacacaaaacacaaaatgcttgggatattttttggataagcaaattcgaatttatatgttttgagagaacaccaaaattgtgttagattaccggtaatatagattatgtgattcaactcatagaaaagtgaatttatctacattttttcttttatctggacctctagaaaatcgtagattgtattaagatggtgttgaaaaactaaaaatggtttgtcattattttttatttactttaagtagaaatgaataataaattagttgaagattagttttatgaaagaagcggtaatactttattgagaaactcccacaaatagcacacttttaagttttttggacaaaaatagcatgaaaaagttttttagacataaatagcacttaaataattatttgagaaattcctaaaagtagcactaaaataagttttatggacaataataatactacaattttatataaaatctattcaaccaaaataaattagaaataaatttaaaatattatatttgggttctctatttccaatttagagaatatatttcaattatttaaaagaaattttgattcattttaatattagtttatggtattatatttgggtttcctatttccaatttagggtatatattttcaccatttaaaagagatttttcattttaaaattagtttgtaatattatatttgggtttttttatttccaatttagagtatatatttctactatttaaaagttttttgattcaatttaatattagattagtatttgctctcatttttatttggaggattgatacaaatggtaataaaaaaacttttattatttaattaatttatagaggattaaaactttatatgctatttttggaagtttcaaaagaatatgctatttttggaataataaagtttttagtgctatttgtcttaattcccctagtttattcaggggcatagtaaaagaggtttcatagctcaatcgtttatttaaacgtagtttgaacttttcaggtaacatattcgatcaaagatattttattttagaatttggaaaaatttaagaaaaatttattgaatataatgatatagaaaattctacaaattgaaatagttcattagagttttactgtgcaaaaatgtaaagagatgaaagaacttaggttgccaccaagaacataatgattcaagattaatacttttataaaaatgaaaggaaaatgcattatattgatgttctaaacacatatttttagaaatctctactagctaaaatcctaattatatgggcaaatgtatttaatcgtaagattctatcttagacctcttatggactctttaattgatacttcttgcaaacttaccgtaatatcactcaggtacattaaaatgagaagctagatatgaagagatgaaagaagtcgagtcgaccaaagcaaggcgtttgtacatggaaagatatttctctagatatcatactttagatcatattatcaaaagataggtacgtagagttgtactgtccgataacactatcttttgtttaattttaaagtcgataacaatctcaacatttaaatgatattttggaagttctaaagttcacaattgaaacatatttttttgcatatttttaactttttttcgattcctcatttatttttttcattggtgagaaatgggaactgagatcttcaataaattaaaatttaaactttaaagagaaaattaatgaattaaagttggacagagaaatatttaaccgggtgtgcgtgtcttcgatttagcagaccggtttagggatactggtttaaagcttgcaaacaaatccagtcaatttcaaagttatcttcttcttcgcgatcacaatctctgcttcgatttcttcttcttcttcagaattcagatcagatctccggcgataatctttgagatctgaaatttcttacaatcaggagagaaagatg

SEQ ID NO: 31562 - DNA, 3000 bp, Unknown; identical to SEQ ID NO: 8768
  misc_feature (1)..( 3000): 2750-1469P.txt file - cDNA_ID_3043481; gDNA_ID_1971877; Annot_ID_176769

SEQ ID NO: 31563 - DNA, 3003 bp, Unknown
  misc_feature (1)..( 3003): 2750-1469P.txt file - cDNA_ID_3043496; gDNA_ID_1971877; Annot_ID_176765
gaataaattaatatcaaaaggggatgtagctcagatggtagagcgctcgcttagcatgcgagaggtacggggatcgataccccgcatctccacttttctttttcttattttatatttataccacctcaatgtttcaataattgtatagtttgaactgtttatttgttggaatactaatgttaaaagttttaaaaaaaaatcttgttagtaaaacttgaaataaaaattacgtgttctatattttgttgtactttattagttactttacatcttcgattaattaataattcttttgtaataataaaatgtatttttgtatattatttttttaaccaggcctttcccaaaatctccttcaattttaaaacaaccatattaaataagttgaactttgaaccaaaaacataagagaactaaactcttaattttatttcactagaccaatatcttattaataaaatgtatatttgttacaaaaacaataaaaattaaaaagataattgtcctaactcctaacatcacaagtttcaacatattgaaaaaaaactcaaattcatctcttttaaaataaagctctccctttttttctacaaaagtttatgtcgccacctactaagattatcggtttcaatggctttttcagccggggtttctttgttttagtctctctaattttgatttcttatgagtttgatgttatctgaatcttattttcttccaactatttcagatctaactctataaagtctaaatcctttattcttctggatttgctgtttattttgtctccttcatccttcatctgcagctttagttccgactgttccaaccataaaggcaggttttgtcgatccttcaacgcttcaaatacatatttttcactattaaagatctcgatttccttcctttcttcataagactttggggtaagaagagccttggttttattttctttagatagatctctagtctcagatatgtttttattttttaatttaattcggacttacacttatactttagttttgaaatctttagttatgagtttgagaaatttgggttcagtatcaatgttgttgtttttttatatataattttggatttttcctcctttggatctatctttattcgagagatatcgtttgctcgtcgacttagtttttggaatgattgttttttttgctgacatatgtatttcaccatttgtattccatctctctatcaatgaaactagtgaaaaaataaataaattaactcctcacatcttgttgagtataagagatagtcatttagttggtaaggttccatttccactagaaatattcatggtatcgttataacgttattcaacaacacatattctagatgttagatttgtcttatattaaaatccataaacaaaacaccttatacatgttaccatcggtccttgtacgttcgccgcatatctccgacttctctccgccgtccactggtgactctacgctcactctaaaaatctgtttactatataaaaaaaactaaacaaaagagaggattagattcattggtctaagtctagagtcaagaacaccaccaccacctgtaatcccaacaagtttagttgcctaccgtttatcgttatctaaaacaccttaatgtttccacgtgtcatcatctcacaagaatgtcacaaaaaagcttatattcttctagatgtaacattagcataactatatcccaaaaaagtctaccctttcgtcttgtttattttaacctcaattattacctttttatacatataattatgggactatatatgaactgattaatactattttcgaatcttaaaatgagttaataaagttatcaacatacactcatactcgcttaaactaagatatcttaacatttctaagatctaaagaataatttggtgaaagagaacaccaaaatatatcatcaaattttacttagattatgttacaataaaaaaaaattaaacatgtcaattgtaaaaataacattaccaattattcttatttttcatagaaaaattttatgtaccaaaataatctattttaaaccacaaacaaaatacatattaaattattattccaactcttttttaatggtaagaaattcaaatacttgtagaagacaaccttgttttgtcatgtgttataatatctatatattaattggaaattaatttctgttaattaaataatattttttaaagagctaataaataatattcttacattcaatttattgcattgaattattaacatatggtaaaaagttcttacaaataaatatataattttttcgaaaattgttataaaaaaaactttatataattggccaaagattatattgaccaaatcaatcatcattaaatttctattcttgtacgcgtattttataacaatttaagtaagattagtgtaaacattatacaagattataagttttcataaaaataagatttgtaggcgtactttatttgttgcccaagctgaccaaattacttatctctcttactcaagctgcccaatctgcccgttgctgaccactttcactctctctctctctgaagatgccctttcgtagctctctagctctcacgcacgcaaaaaaaatctccccttttgactaaaactttctccaccaatttgttttcttttgttcttccttctcttctttgtccccaattaaggagctcaaattcacttctactgaactgggttttaccatttgcttttgatctttggtttctgttcgattttggaggaaaaaaggatcaaactttatattaagagagaattgggtttcgttgatcttcatctttctattgatttcattatctgggtttgatcaaagttttgttttttggtacataaatatgtgatcagagagagtgatctactctagggttgattcgcttgactttttttggtttttgaattattggtgtttgtgtgttggctatggtgatttgatttggaattagggttcatg

SEQ ID NO: 31564 - DNA, 3000 bp, Unknown; identical to SEQ ID NO: 8787
  misc_feature (1)..( 3000): 2750-1469P.txt file - cDNA_ID_3043556; gDNA_ID_1971889; Annot_ID_176827

SEQ ID NO: 31565 - DNA, 3003 bp, Unknown
  misc_feature (1)..( 3003): 2750-1469P.txt file - cDNA_ID_3043560; gDNA_ID_1971889; Annot_ID_58474
gagagcgaaaatcaccggagccgacgatcatatgtggcactggcaagtggcaacggtcatctttatacatggagaggaggagacacacttgtacacgtcttctggtggtctactgccacgtggcagtattcaaatggtggattttatacatccgtgaatcttggagttgattttccttaatttaaatggtcgtactaccgacagccaaaaacttgtctttcaccaacaaatatgttttggaaggctgaatatcatcacacaaacaaaataaaaaactaacatttattttgtatgaaactacatcttttatttctgttcagaattttcgaaaccgttgaatttgtttgtcgattggaaataactagtgaacgtacgtaactcgaggattaattattaaacaaattcaagtattaaaaaaaatggacaatgcatgtttttctttacttttgaattttattttttatgatcacgattttacgtttgattcaatttctcatattacatgctactattgacaatatttatatttttcttattataacaatatcttttttcttttctttttttaacaatatctttttttttaacaatatcttattttaaacatctttaatttgtatgaacacaaatagatacatgaatatttctacgcgtgtgttaatttcctatttttgtgaaacaatatcaacgtctccgcgaatgcgttgaatataagtcatgattttatatatttttttatggttttgaacccacatctgatatctaagtgaagtatagcattctataaaatgtaactaaactttagatcatcgagtgttatcatgagtaacgtaaatgaaatacttaagttagataattacatacacaagggtggtagatcatctcattttgaaaaacaaaaaggaattacaagaattgaataataaaaccattaagtgagataaatacatgcacatgggtggtagatcgcataataaacgccgtacgatggatgagtattaaaaaaacaatgaaaatgcagctttggagttagaactcgagattcaaaatccaactattggtaaatctcaagtgattaatgcattattttgaagttatgatcgttgtcagtactattgattatgtagcctttaatgtatgcttaagaatatgaaggtttttcttagcttgtttcttaattttgaatacgtaacaaccattgttgtctccgcgagtccttgtctgcgtttagcaacatgttgatcaaggggatcttgattgtgagcgtataacaaccatcgttgttttgttctcttctataaatgatcttctaatctcacttttctttttccgttcgtttttctataacaaaaaattaacgtcaaggactcaaggggatttgaacgtttgacttttgatatttagatgaggaatggggagagactggtgactttcaaagttgttacgtggctaattaactcccctaggatttgtgggagaatccaaatcacgatcgatttttgctcaaaggagctgaatataagatggatagcaaagatacaaaataaaataactcagtaagagctttatttagtgcaaggggaaataaagaacgctaagcttaatcagtaaatcttagattgatgtcttgaaatgatgaagaaggagagttgtggatagtggctggcaacttccaaaattagctacattgatgcttataagttataacaacatatttctgtgaatctaaacttgctagaaatttctaattacatggttttgcgggcttctaattgaatcataattgggcttcttgtgaattctctaaatgcttcaaaatgaatttggatttaacaactctatccaaacaaacctcagcaaagccgtacgttctagctttttaaggtatcttcagtgcagattgtgtatatactgactgtaagaacaagaaatttataatgtagtatgtaataactccaaaaacattcatcaagctaaggaaaataatcaataatgggatgtcttgtctacttcttcaagcccattgaagaaggcacggatgggcccatacgaaaagatttttaacaagtctagccttcaaatttcctaatggctaattaaatagtttttattagataatgaccatgttctttgattgatcgctacgtcagctacctgcgatctaaaaaaagctctcatctctctttcacttttatttttcctctctttcatctttgccgcagcgactgtaattcggctattccgtagacgctggaattttcaacgtctcaaattccctttctcctatctcttcagatctatcgctgcgactctttcattcatctcaccttcatctttccttcttttttcttttatattttgtgccgccggtgcttgtcgcagcgatcaacaaaagaataaggtaaatattcattttgggtagtataatatacagtagtgagacatgggcttatgtcacatacactcacatgtgtcacacatacacctatttttgattattttagtcttgtttgtgtccattggaccttgagagaatcataattcattatctgtatcatgaagatttcaattcaagaatttatattcttacaggtccattactcaaaaacaaaaaagtaaagaaaaagagagcgagataaaatgatttcaatgaaaaataatttgaaaaagaaataattaataataaatatattgtactaacatacgcccaaaaattccactatagcgtatctcaagattcaagatctccttcttcttcagctctcgtcatcatcattctctgcttcttttcatttgctcctgttaacaaatttgccaactttcttccattttcgaatccctcttaacgcaaagttaggttttttgttaattcatttcattgcttggatcctaaggaaaaaaaaaacagaaatgaaaaaacccaaattgtcgaaagtggaaaaaatcgacaagattgatctgttctcttcactatggaagcagagatcggttcgtgtaataatg

SEQ ID NO: 31566 - DNA, 3003 bp, Unknown
  misc_feature (1)..( 3003): 2750-1469P.txt file - cDNA_ID_3043560; gDNA_ID_1971889; Annot_ID_176826
aaaatcagagaaagaaagaatgaaacatgcaatatactaagtgatgttaaagtattacaaagagaccaagcaaacaagtgtggccgcagagagagcgaaaatcaccggagccgacgatcatatgtggcactggcaagtggcaacggtcatctttatacatggagaggaggagacacacttgtacacgtcttctggtggtctactgccacgtggcagtattcaaatggtggattttatacatccgtgaatcttggagttgattttccttaatttaaatggtcgtactaccgacagccaaaaacttgtctttcaccaacaaatatgttttggaaggctgaatatcatcacacaaacaaaataaaaaactaacatttattttgtatgaaactacatcttttatttctgttcagaattttcgaaaccgttgaatttgtttgtcgattggaaataactagtgaacgtacgtaactcgaggattaattattaaacaaattcaagtattaaaaaaaatggacaatgcatgtttttctttacttttgaattttattttttatgatcacgattttacgtttgattcaatttctcatattacatgctactattgacaatatttatatttttcttattataacaatatcttttttcttttctttttttaacaatatctttttttttaacaatatcttattttaaacatctttaatttgtatgaacacaaatagatacatgaatatttctacgcgtgtgttaatttcctatttttgtgaaacaatatcaacgtctccgcgaatgcgttgaatataagtcatgattttatatatttttttatggttttgaacccacatctgatatctaagtgaagtatagcattctataaaatgtaactaaactttagatcatcgagtgttatcatgagtaacgtaaatgaaatacttaagttagataattacatacacaagggtggtagatcatctcattttgaaaaacaaaaaggaattacaagaattgaataataaaaccattaagtgagataaatacatgcacatgggtggtagatcgcataataaacgccgtacgatggatgagtattaaaaaaacaatgaaaatgcagctttggagttagaactcgagattcaaaatccaactattggtaaatctcaagtgattaatgcattattttgaagttatgatcgttgtcagtactattgattatgtagcctttaatgtatgcttaagaatatgaaggtttttcttagcttgtttcttaattttgaatacgtaacaaccattgttgtctccgcgagtccttgtctgcgtttagcaacatgttgatcaaggggatcttgattgtgagcgtataacaaccatcgttgttttgttctcttctataaatgatcttctaatctcacttttctttttccgttcgtttttctataacaaaaaattaacgtcaaggactcaaggggatttgaacgtttgacttttgatatttagatgaggaatggggagagactggtgactttcaaagttgttacgtggctaattaactcccctaggatttgtgggagaatccaaatcacgatcgatttttgctcaaaggagctgaatataagatggatagcaaagatacaaaataaaataactcagtaagagctttatttagtgcaaggggaaataaagaacgctaagcttaatcagtaaatcttagattgatgtcttgaaatgatgaagaaggagagttgtggatagtggctggcaacttccaaaattagctacattgatgcttataagttataacaacatatttctgtgaatctaaacttgctagaaatttctaattacatggttttgcgggcttctaattgaatcataattgggcttcttgtgaattctctaaatgcttcaaaatgaatttggatttaacaactctatccaaacaaacctcagcaaagccgtacgttctagctttttaaggtatcttcagtgcagattgtgtatatactgactgtaagaacaagaaatttataatgtagtatgtaataactccaaaaacattcatcaagctaaggaaaataatcaataatgggatgtcttgtctacttcttcaagcccattgaagaaggcacggatgggcccatacgaaaagatttttaacaagtctagccttcaaatttcctaatggctaattaaatagtttttattagataatgaccatgttctttgattgatcgctacgtcagctacctgcgatctaaaaaaagctctcatctctctttcacttttatttttcctctctttcatctttgccgcagcgactgtaattcggctattccgtagacgctggaattttcaacgtctcaaattccctttctcctatctcttcagatctatcgctgcgactctttcattcatctcaccttcatctttccttcttttttcttttatattttgtgccgccggtgcttgtcgcagcgatcaacaaaagaataaggtaaatattcattttgggtagtataatatacagtagtgagacatgggcttatgtcacatacactcacatgtgtcacacatacacctatttttgattattttagtcttgtttgtgtccattggaccttgagagaatcataattcattatctgtatcatgaagatttcaattcaagaatttatattcttacaggtccattactcaaaaacaaaaaagtaaagaaaaagagagcgagataaaatgatttcaatgaaaaataatttgaaaaagaaataattaataataaatatattgtactaacatacgcccaaaaattccactatagcgtatctcaagattcaagatctccttcttcttcagctctcgtcatcatcattctctgcttcttttcatttgctcctgttaacaaatttgccaactttcttccattttcgaatccctcttaacgcaaagttaggttttttgttaattcatttcattgcttggatcctaaggaaaaaaaaaacagaaatg

SEQ ID NO: 31567 - DNA, 3000 bp, Unknown; identical to SEQ ID NO: 8796
  misc_feature (1)..( 3000): 2750-1469P.txt file - cDNA_ID_3043564; gDNA_ID_1971889; Annot_ID_176823

SEQ ID NO: 31568 - DNA, 3003 bp, Unknown; identical to SEQ ID NO: 21414
  misc_feature (1)..( 3003): 2750-1469P.txt file - cDNA_ID_3043568; gDNA_ID_2684202; Annot_ID_191259

SEQ ID NO: 31569 - DNA, 3003 bp, Unknown; identical to SEQ ID NO: 21414
  misc_feature (1)..( 3003): 2750-1469P.txt file - cDNA_ID_3043568; gDNA_ID_1971889; Annot_ID_176819

SEQ ID NO: 31570 - DNA, 3003 bp, Unknown
  misc_feature (1)..( 3003): 2750-1469P.txt file - cDNA_ID_3043598; gDNA_ID_1971893; Annot_ID_176881
aaagagtatatcctacctattttactaccaaaacaagtttagttccaaaattaacacaattaatccaaaaaataccataaactaggtttaacagtttagcaaatattagataaattttaacaacttttaataacactaccatgacatttgttaaaaaaaagcatcgaaatttgaacaatacttgtgacagtttaagacagattattaaataaattaatcaaacacgagaaaaaacagagtgagagtgaaagaaagaaacgaacttgagcaatgcggaaccattcataggagtcgaatgaagcagcggtcaagatgacttgaggaaagctggtagcagctttaaccgttccgttaaaccggattcctggaccggcgtaggctacgccgtgtaaagcttctgaccaccattcgtacgccggaactccaagacgcggtatccctggagctgtattcaccagctgcgagatcttctcgtctatggttagcctcgagacgagatcacgcgctcgcttgccaattgggaggtcagtgcggcagaactggtagagtttcgtggttggatttgaagggtcacaggagtgcggcggaggagctgattcaacgccgtggacgatgaagagaaggagaagaagaagcagttgtttagccatggcttcgaaatgcggaaaagagatgagaaagtgatgagtgtaagagagtgacagagtctctgttcttcttattcgttccccaattatgtctgtaataaattgacttaaataaccttcttgattcaacagggtaacctaaaaatttattatattgttgtttttcaataactctttttttttgcaattaatggacatcttaaattttttattcaatagttgaataagtataatgaagttgttaaattttggtgttgtgaagtttttgtgtctttttctgatttgctattttcattattattttcagatttttatctaatcctatatccttgagatcaattagtttatagaaaatgttttaaaaacagttatatcaaaactcatcattttttaactatataaatagagatttggttcctttaatttggacacatagaaaatcgtattagattgcatattatctcaaataaaataaacaaaaagtatttgatttttatctatttctgtttaatttaatttgctaataaactatttaattcttaatcatttaatttaataaaaatcaggatagactgttgaattttattaaataaaataattgtagaatagaaaaaaatagtatatatatatatatgtttaattattagatggaaaagataacaaaaataatgtgaaaaagaaggaaaaaaaatgttgaattatattataccattataaatggtcttacgggccaaagcccaataatattttttccaaatagcttttaaggtctttgcgttaagtcatttagcatatatttttttcccagtgtacagcccaataagtctttcaaaacgttttggtatcaaaacatgtaatagcgtttttatatatcaagaattgtttaagaaatgtactgaaccgtccaaccaaccatataagtgataatggatagcaatattattataaccttatcaggtcaggccatatgtcacaatcaacctaattgtgatctataaaagttcacctggtcacgtatctaggtttgactggataaaaattgtcggtttcaaacaattaatacaacaatattactagtagataatttgtttctgtctcagctaaatgtttggtggaaggagctttgtagagaaattcatttgaagtaaaaaaatctaacacaaattcaacatgttcagaataataattcacagctgggtaaattttaatttacaattattgagtttttttttttttttgtttatgtcaaactcaaaactagtgccacgtggaggaagctaagcctataaacgattatgaccgacagttgtcactctagaagtagcggtccttgtgacggcataagctggtcataaccgcttagtggtgatgatttgacgaaattgcccattaagcgactgtgagatgtcggtagactacgatggccacgttccacagagagtgacactaacaaccaaaacctattttattactattttttcttttgtcattagtattttattactaattgtttgaatatttcctcgtggtctattattattaaacactctagtcctcttattgttcattaaaattgtctgacgcttgtctcttcctttcgttttctactagaaaattcagctattttcttaatgttttatatctcgtaaactcttaagttgtaacagtgtttcaatataatttgaacacatattgaagtttagtccaaaattcttcttctccagaatatatccaaatcgagtcacaatggaaaacaaattctcctttgtaggtaaatagaaacaaacaataattgtggcattaaagtgttttaaaacgagatcccaataatttacatcagtaagatttcaaaagtgtgtaattagaataaacaataaacctccacaatttggaagatattttgtttccatatttgtcgcgtataatttattatattgtcaattctcgagaatttttaacgttttgttttgaccaggtaacgactgttccggtaaatatgtaggtccaaaaacttcccgcggacttaactcgttttgaaatccgctgtttggttttctttttttattaccggctctaaccggtcctacccaaaaccttgtcatgtcctctcattcctccaccgtttataagtaggcccttaactccaattcccaccgtttcttcgctaaccacacaaagcttgttcttctccttccttctccaatttcgtaagctcaaagatttcgatttcgattttgattattgccaaaggtacaaacttttgaacacaggtttgtttattttgtttcactctgttcgattttatggggttttatttatattttgttcttgatcgattttaccaggtttaaagatg

SEQ ID NO: 31571 - DNA, 3003 bp, Unknown
  misc_feature (1)..( 3003): 2750-1469P.txt file - cDNA_ID_3043606; gDNA_ID_1971893; Annot_ID_176876
tctcctttatttgaaacagcctatgattctggtgatgaacaaaattgactgtgctcctcctggtagctgtgatcaactagaagatcagaggaaaaaggaagaagttttccataagtctgtcttcacttctgctgtaactggtcaaggaattgaagagcttgaagatgcaatattggagattcttggtcttgatcgtgtccccactggaggacatcaatggactgtgaatcaggtctgtctcaattctacctgttattctgtttctgtccattaacttttgactgttgcatttatatcctctttgtgtgtttatcagagacaatgcgagcaattggtgcggacgaaagaagcgctagtgaggctgagagaagctatcgaagacgagattccgattgatttctggacgatcgagcttagagaagctgctttatctcttgctcaaatcagtggtcaagatgtctctgaagaggttttatcttccatttttgctaagttttgcattggtaaataaacagttgccacttaattaaaccccaaacaaatcataagtgtcttattaaccctttttcacatacattgaagtttgtttttgtgtgtttattgtatcatcgacgtacatacataaatgattagattcaacatacacatacctgattatatgtatcaatgcactttgtatatgacaagaaggtattttttggtccttgtaaatttataacaaaaaatgtcaaaaaggcaataatgaaagcgaataatgaaaaagaacctctcccgaccaaaaaataataatgaagtgtgtggaccagatgttgaagcccactagtgggaaaatgggcccgctagtgaaagagaaaagggcccactatcaatttccgaagttgatatttggaagttgggaccaattacgtttggttactgtagaataatatataaccttttttgttattgtgtccaaaacatgaacgaatcagagagtcgagaaaattaaataaattttaacgtctcttcacttttttgactcacctgtgtccacttgtcttctcaatcataccaaatcatctactacataccaaattccacgtcagcttcagttttcattgtcatatttgtcatttaattcaaaaagaaaattgacacaataatttaacggttccaaaagttatatgtgatgttttcaaattctagtcactaaatttatcctccaagcataatcaaatgaaatttgttaaaaaataaaaaaaagcataatcaaatgaatactaacgtatttgtgtgtttgtgtattgttgatgcttggatcgaataatttatataaaaaagaattcagggaaaaacgaaaagttttttattaaacgagtttagagttcagagttcggcgattgcaagaagataattacaaagacgaacagaatgttcgaacaagatgtaaaccgatacgtttgagctgaactaaagatgccgagcaaaagtgatcggtcaaaatgctcggttacgaagctttgtgaagaaggtgaagtaaaaatttcatgttgcattcaataatttaactcttacttcagttttcaattaattctgttcaaagttcccaccgtcacattgtaaggaaaagaagtaaaagaaacttatactagtatttatttaatgaggaaatgtcttggagacctacgatgttgagacttgagaccgaccattttggtataatgtgccactctgtaaaatctttaatttttctgtgttaaagaggtcacaatgcaccaatcagcataagcttttgttgtgattttcaatcagaaaaaaaaaatataaggaaccaagagcttttggcccaagtatcttccccatgacaaaaatatactcttaatttgttggcattaaattcataaggttaaaatgttgaaatttggtgagagatgatgtgaagaggagaaacgagagaagggctctataaaattgcaaaggccaaattgaagtacaaattgttgtcatttgtgaagaaggtggtccattcttttggtagcccagacgttaggaaccaaataacaacataattttctatttattttcatctatttttattttggaaaatgagttttcttgtaataataattattgttttatttttggactttactttcatgaaagaaaacgactgggtggagaaatggacaattaattcttgggggcaactatcgtatgatgtggaaagttaattattgttaatttagtgggtccattgggcctaacgggcccttcttgaatgattttatgagaattttctactgtaagatattgtaagacactgtaactttaatgaatgggggatatacgatgttttttttttattttaacaatccatcgttttatacacatgtttcgaagttcacaaacttcgcagacaaactaggtttgaaattttttaactaatattccaagtttttgtttgttttattaacctttccgtctataaaagaattaagagaaaagaaccataaaattaatgaatctacttagcaatattctaagatttgctgtctttaaataatgaaacaaagcttaagaaaataagattcttaatatttaaaaaaatactatgaaatttggacagaattgctgagttttcttatttatgtacaaacaccactaagtaatatgtatcattagcttatgtatttttaccaagtttgagaggaccatacaactaatattatcacgaattctattattgcatattgcaaagtacaaacagaattaatgcaaaaatgttctttttaaaataaatgtcaagaatcatgacgtggcataatcgtgacgataacataactttgatcagaaatactcaacggtctagattgagtcctgagtttatggttcttctttatcttccatgtctcttctccttcctcactcccctcttccctctctttatctctctcaagatttgctctgtccagagctccaaatttcaagaacataaacactacacacaaaacactgaatacgatg

SEQ ID NO: 31572 - DNA, 3003 bp, Unknown
  misc_feature (1)..( 3003): 2750-1469P.txt file - cDNA_ID_3043609; gDNA_ID_1971893; Annot_ID_176874
tgacccaaaattgtatatcgtttaatgcaataaacgtaattaagctctcgtatacttcaaatgcccaaatatcatttcaagtcagcctaaaactataccaaattttgaagttcgaccctaaacgtatatatttaaaaactcaatttcaatttttcacatcgtagaaagtttgtgtagctagagaaacatgttaatatatatagtttcgaattcatcggatatatatttaagtgtagttggtcctacatcccaatatcccatgatgtttttttggtagttcggtttctcaagttggttggtacttggttcggtttctcaacttggcccatgatatgaagcatataatatgcatacatacatctacattttcttttttaaagtgttacattcacaaatttacaaatcgaaacttgttataatatgcatacatatgcaaaacataatgtgttaccgacttcaatcgtgggtacgtatttttgagattgatgataacgtataatacatatctaaacagattataacagctgtttaggacattcagtttaatacccaaaaaaaaaaaaaagaaacaacgacaaaatagttgacgaatatacatttaaaaaaaaaaaattatagtaagatagtgtgtggctggccgtgaaccaacatggagaacaaatagctcgtagccaccaaagcactatctagcgcgtagcgaacacgtagtcaatggctaattgtaccaaagacgaacctagccacattatagtccacgttcaaacgaggcccaccagtttctataaaagtcaacttcaccccccaaaaaaaacgctcctaacttttgaccttttcgcttttcttgatttggagccagtggcattgtcgtaaaatcatttgatctaaccgctttgatgttcttgcttagtttccattacttctgtcattatcacctttatatttttttctcctaaaaaagccaaatattcgtaatcacgatctttatctcttataatttaatgtttattccaatttaaaacattaaatttataaaagctcagatctatatttctttttcccctcacttttgttaaataattttttttatctcttgtttatctttcttgaatttttttccagtttgaagcaaaatctattttctctgtaaattttgtacttttctcacaaaatactagggttttcgttttgtattttgatgagagagtgattcagtgaaccgggacatgattcaggtttactgattttactgttttaaaactttagaaaagaatagtgaacatgaacaatctggtgttctaaaatctaaaaaggggaggcttttaactaatatctctcgtgtactttttctctaattcttaaatcgttctctcttttctgtttctactttttaagatcccttttcgctttaataaattaaaataaatcacgtaaaaggtctaatttggaggaaaaaggctaaaaagcgagatcgaattcttcttcttctttttccaggtaagtgggtgtttcaccttccaactatcaatggctatgcataacaccaattaatttattttgaaacctctcatttatagaatacacgtgcatataatgtttaatcatcttcttcttttttggtgaaaatagtataatactagttgattcctttttcaattgtgtttttgtctatgtgtatagatatcagattaatcacccaattttataactggcaattatacaataatgaatagaactaggaaaatgttgaagaggtatcgtctggtgtaggagtttacgattacagcgtctcttcgatcggtagaatattaattaactcactatcaatcatgcatacttgtctacattacaaagtcaacacatgtggtgctcactttggctccagcaaaaactgattacaatatttgtgttttaaagtatataaaaattagtcagaaaagagaatcgtattattttttatagctttttgtgatcgaaattggcttatgtgacagaaaaacgccggttaattccttagaaaaacttaggttgaaaatgaattgcggctagtttttataataatcatgtcattgtccatcaacttgcacaagttaaagcttttgtctaaaaaatgggtgatttaaaatgttggtttaatgcattctaatgaacaagtcaatatgctggtattgacagaacatctacatagagtttggacaagagatcaagtcccaattagaaccaccaaaaaagaacatatgaattaggttttatataatagccttttaggtattctttccaaatttctgttcagttaggtttgttttctaagttttcttaagtccttttctaaagtttatgtccaacccaaaacgatgataaaaaaatccagaaatcaaatgttaattaataaggttctcttcgtctactcttagctaaaattaaattattttataaaaaaaaaaacgaaaggatatgattaacgttagttcttcctcgtttattgagggataactgttgcatttttaaaaaatctcactatgtgccacgtggctattctggtcaactatctctccttatagcaaaaaagtaaacgagatcattgaattgagattgttttcagtattgcacacaaagtttgccacagaaaccattgacttaatttgtttaaactttaatgtcgatcaacgccaattaaaaattgcatcttttctagttagacttttttcaatgttcttaatgtacttggtctcttagtaatccagattcatcaaattgtatatgaccaccactctcttatcattaaattaaaacaaaactatcctaaactttcgttataaataagcttcatcaatgttgctccaaaattcacacttaaaagtcatctttcaacccaattatctctatcctttctcctggttcgataccattactccatccacacaatttatataatctcaaaaacttgcaaagtaaagtactaatctaagtagtctcctgttctgtttgcagagttacatagctatg

SEQ ID NO: 31573 - DNA, 3003 bp, Unknown
  misc_feature (1)..( 3003): 2750-1469P.txt file - cDNA_ID_3043617; gDNA_ID_1971893; Annot_ID_176866
atctaaaatcaagtgtgtatgcgctttcaaaatctctaagacaaagtgtagttgtttttaaagaaactatttttacgtcgattgctgattgttgtgccccttttcacaattttgattatcccttcgagattagtttgcatctttttagtagataattttggattgatctgtagacaaaaggaaatattgatcggtcatcggtccattaagaaaataaaagtttttagagaagtcataacagctacagcatgcgagcataagatacagtaaaaaaagactaaagtataatcaaaatttcatcattaacttttctgtcgtttagtatgtgaatattttgttttcactttttaataatttgatggatactgagaatttcagtttcaaattagtaaacgataaagtagatgataattaaattcatgtcatagccatgaacgaatgttatgttaaaaaaatttcatgtaagtaaattctttggagttcgattcttcttttgtccttacacaatcaaagatttttctttcaactttttttacttaacagcattaactctttctcagatcttcaattgttttcctaaacgaaattatcattaaattgtttaaaaaatacacatttaatataacatatatcataacaagatatattatatttatgaaaaagagatgtagtactacagcatatggtggcaaacaaacccactaaattcagtaaaatggaacccaccaaatttatctataaataagtccccaaacctctcccccaaaaatgcaacaacactcatctttcccaatataagtttttaccaaacaacaacttttgttttgcctttcctcaaaacataattttgtcttattttctaaaccggtaaaagatgtcgctagctatcgcagaagtttacacggtgaggaagtttcacagagagagtatgaagaaaccggccaaacagacggttaccggcgagggagatgaaaagattggcggaggaagtttcaaggaggcgccggtgaagtcaggtgggtgtagaagattcggacggtggttttttgggaagccgggaatgaagaaaagctctgctaaagtttcggatcccatggcgattgagtgatgaagaagaaattaaaacttttctcttctttgccttttttttttttctttctttattttgttttattttcattggtctttttttaatggctttttctagtgtcttctctttttctttattgggtgattttataaatagtcggtaaacattgtacaatatgaactacaaaaatatgagaaaatctatatatgtatgtagaatggatgtattccctaaataccacagctagtttgataagttttatgccaaaccaactaaacttgtatgccacgatatttcgtatttcagaaaatcgaaaattgttattttttagtgttttttaaaccatatatatatatatatatatatatacaaaaatacaaacatatgaaaataaacatatctagatttagtttttagttggttaaccatttggcacttttgacatagttttagtttaataatctatcactaactgtactaatcttcttcttctttttttaactgcaactcacataaaagaatatctagatttaaaccatgatattgcataaaccattaaattcggttgtagcaatatttatccaaatatgaattcggcgctatacaaatataaaaacaaactattttggcgctcttattatatgtcacgacaaatcacacacattaaatatatacaaagacacaaaaacaagataaaatatataggaaaatacttttaaaagaaaaagtagtggggttttaagaatataaagaaaattagtggatgttcaaaatattgagtagtgaaaaataaaccaaaacaaaaataatctatgagggtgattaggagaaggttctgctcgtgacggtttgttttttcagccaatcaaaaagcttttaagtggatctcactagatttcatagcatacgctaacgacctaacgttaaagtcaggcaaaatctatgtttaaaatttgcgtcgttcaaaaaccattccacaaaaaatacaagctaaactggcggcagagtctcagttcaatgaatccattacgagctttgtttgaagaaatatttaacccactgactcattaataaagcaaccaaaacaaaatcctttaactataaaataattaaacgaaagtaaagaacacacgaaaacaacaataaaagaagaaaaagcaaaagtaaacgacaacaaaattaccttaaatatatattctctcgtaacaagttggcatatctaatctagttatattgagatagtgtcatgcatcatgatattagatgttttatcttataacattgcttttatttttaccgatttaacaaaatcgtatattgtatgcaggtagtcaaaattgatacagacttgttttatatcagccaaacatatcaattcagtcaagtgagttaacaatgtatgtcaacaagggggaattgagcaatttaaagagttaaaagaccattaactaaacagacaaagagtttaggagcaaaaagtaataaagtaataataaaaggtcaaaaagtgtaagaaaaaaagaaaagaagaggaaggttctgtgcacgtaacttgaattcgtaaaagtccattgctccttcttccttaagctctttgctaaatcttcacgcaatgactctctccttcaaattcaatcctccttcttctcttctattctcttcccgcttcatcctcctcctacgtcatccggacgctacgtttccccggcgccggcggattctaccggtcagttctctccgatcaaactcttatgctcattgtctcctggaatttcaacaatcttttgattagaacttttagattggtgttctgatgggagaatattgttgaattgacagattcattgcgttagatttgtcactgagccctaagaatttggggaattttggtctgcttcggcgaaggatcgatg

SEQ ID NO: 31574 - DNA, 3003 bp, Unknown
  misc_feature (1)..( 3003): 2750-1469P.txt file - cDNA_ID_3043625; gDNA_ID_1971893; Annot_ID_176859
ccggagactgagattattattacgaagacgcagatggtgaatctcaagtgtgctgcttgtgggtttatctctgaggtcgacatgagggataagttgactaatttcattctcaagaacccacctgagcagaagaaggtgtcaaaggataagaaagcaatgaggaaagctgagaaggagaggcttaaagaaggcgagctagctgatgaggagcagagaaagctgaaagctaagaagaaagcattgtctaacggcaaggattctaagacgtctaagaaccattcttctgatgaggatataagcccgaagcatgatgagaatgctctagaggtggatgaggatgaagatgatgatgatggtgtcgagtggcaaactgatacttcccgagaagctgctgagaaaagaatgatggaacagttgagtgctaaaactgccgaaatggtgatgctctctgcaatggaagtagaagagaaaaaggcgcccaaaagcaaatctaacgggaacgttgtgaaaactgagaatcctcctccgcaagagaagaatctcgtgcaggatatgaaagagtatctgaagaaagggtcaccaataagcgcgctcaaaagtttcatctcgtctctctctgaacctcctcaagacatcatggacgcactcttcaatgctctctttgatggtgtgggaaagggattcgccaaagaagtgactaagaagaagaattacttagcggctgctgcaacaatgcaagaggatggatcacagatgcatctgctcaattcgattgggacattctgtggaaagaatggaaacgaagaagctttgaaagaggtggctctggttcttaaagcattgtacgaccaagacatcattgaggaagaggtagtgttggattggtacgaaaagggtctcaccggagctgacaaaagctcgccggtttggaagaatgttaagccttttgtggagtggcttcagagcgctgagtctgagtccgaagaggaggattgagtcacttttttcttccctcctaacttttctttgcggcatttcttataatacttcgtcagttttcagaattcttaaatctttttgctgtgttcttataaagaaacatcatctattaaagttgtcttcgtttggatttggttttgacgactttgggaaatatttatgtttaagaaggtttcattggtcattgacttttatatattatatcgtaaccatgatgtgatagtgggccttagatcaacaaacatgcgaaaaacagaagcagaggcccgtttcaacggagcataataaattgcattctctgtcttttgtttttaggttttttttttaactgatagatgtgccgtcgaaaataatattgatatttaaaaattcacaacaaacattcttaactgacccacccatctatctgctattcccacgcgccaaggaaaataataataatagcgaaattgatttttacatttatttattgatagataatttgtgtattgttaagattaacagattttaagggattaaagtggaaaaggtaaaccgaagacaacttgccatttactgatttacaacaatccaaatttaaaaacaaatggtcccagtttttagggttgtcacttaaatttatcgaaatatttacactttaattgggtaaaacataatggacagaaaaacaaatattgtgacaaacaaaaaaacatgttttcaccaagaaaaacaaaaacaaaaaagatgtaaagcttttcttacatctgtacaaaataaaagcagacgaaattgtactttattttccttattaaattgtcggtatgttttatatgttgtgaaaagtagaatggataaccaaataaaaattactgacatcttaataaagttggttcaaccggtttaaaatgtatttttttagtgttaacaacttaaagcttttttcgattatcgaattgcaacaaacaaatatattaacagaaaaaaggaatcatgtatctatttcaatatcctgttttttttcttccatttggatatttagatctttttctgaatttatcttgttcttaaattaaaacagaaaaaaagattaaaagtaagacagcttgctaatggcaaccgcaacaaacaagataattttgaaacggatccacttggattttctttgattttgtagaaaaattgacaaattgcttttgtataaaaacaaaaaatgtaccgtaaaaacacacacataaaaaataaaaagtgataatgacaaacaaataaagtggtatttttcttttatctactaatgtgattataaaaaaatcgacattgaaaatttcaacacatctttttcgccaaaacctgaaaatggtcttattataacataaattagtttttttgtctttctattatatattcaataactcatcccaacttgaacaaacctatttcaaatttttttgtcttgaataatgataagttccgtagtgttcttttctgttgtgacaaaaaatactagctaacgagggataagcacaaaaacatgattaatgtttctctaatcattctaaaaatctacaggaatattcccttttcagttttttctttcttaaatgcatttcttagttcttcataattcagtgagttttaataacaataataaaaaaaagagcatcattaattgaacctaaaaataatgagaagaaaaaccaaaaagatagagagtaagatgcacgcgctaaagatcgaacggttaatagaatcaggttagtgaagagagatattaaaagtttgttgtcgtgtggcaaaaactataatttccttctcacaaacaaaaaaaataaaatcaaacacaaaatcccgtagcatcgtaacagtaattcgctattatctcctcaccctccgctttcgcttcccttctctgcccgtttcaattccttctaagacatcacggtctctctctataaaaacagtacctacctcttcttcttcttcttcattcgctgacttcgtttacactgaaaacaaatacctatg

SEQ ID NO: 31575 - DNA, 3003 bp, Unknown; identical to SEQ ID NO: 21425
  misc_feature (1)..( 3003): 2750-1469P.txt file - cDNA_ID_3043669; gDNA_ID_1971898; Annot_ID_176931

SEQ ID NO: 31576 - DNA, 3000 bp, Unknown
  misc_feature (1)..( 3000): 2750-1469P.txt file - cDNA_ID_3043697; gDNA_ID_2684104; Annot_ID_190340
acagagatacaaaagcttatgcctataaagacaaaacaggattaaagtatttcagtagataattccaattcttttagcctaccatcttacaaaaccccagttgaccaaatcgagaatctatatggagagagtaaataggttgaacgaacctctgagaaggcgcatgctcggacaatatgcttgtgctcaaaagaatgcagcacatcccctgttaacgcatcccaaagtttgctgaacaaaacaagataacaaaaaattggataaatgtgctgtatctaagaacataaaacatacgcaaataatgacttaatgaaccaaaaaaaattaaacacatacgctgaaaaatcggcagaagcagatgcagcacgtaatgcattgttatccagacaagaactccaaactgcacctttatgcccttcaaatgtaccaatccagtctccagtttccccatttctcaacattggatgcgaatctaaaccatcaagacatgagtattctcaaaactctatgaactacgaaataagtattactcagagaaaactcaaagacttttgtaagttctcaattcgatcaacatgaatttttgcacagttctagtaactaaattgaccaaaaaaatccaaacttttgtaagaaaccaaaagtattatcacctttgctagcgctgatgaggaagaaaccgtcaggagtaattggactgtagaacaaatcaacaacaggtcttgaatggccatgacacacttgtggaatcgtcaccttcttcttctccatctatcctaaaccctaattaagcgactctttgaaattaaaggaaagggttttcgatttcaaacgattcaaggtagactcagagtagctgaaaatctaattttttttgtagtaatttctacagaaatattgggagaaacaatcccgaatctataaaagttcgatcgatctacagttaattagagaaaccagtagcttacagtggaatgctgattcctgggaattctacagaaccaaagatgaattgaaagtataaaagttaaaaaaaaaaggggacaatttgtagaggaaagcgtaggaattgggtggtttttatttgtacaagccccgtatgcaaaacagtagcaagttttagggatttctacatctagacgggaaggagaagacctttatttgtattttttaatttagttcctatacgtttcatatgttgcaataagcgaccctatattttcgtaattgacaaaacaattcacaataccatttgtaaataatttatttagaaaaaaaaatcgtaaatcagtagtgtattttactgtacgttttttttttgtcagcatgattttgaaaataaagtaaaacaaagtatgattcttaaataaataaattaaaatttcgtttggtggtttaatgttttgttttttaaagtttataatgttatattcaataattggccaaatcccaaattggcccagggcttttactaaaggaaaatcggaaaggcattgccgtcaccggaggagcgcatctgatactggtgactaccggaggcagagaaccagtttggaggtttaatgttttaacatctaatttgaggtttgattctagaaaatgtgaattgtggagagaaaaacttacaagaatgaataatagatcacagacactttacattttgtggttcttcattgaacattataaaaagatcttaatagagaggaaagatgtatcaccactacattgaaacaacgagacgactatattaaaagattcgacacaaccaaattcacgatcatcgttaagaataagatctggagtggttttaattagtgttggcttttcagtgagaaatgtcacaaaatattatagttcgtctatgtggaatttgtaaaacaagaccgaattcaagttgtgaagtagaaaagctgtccgaattcaagttctgaagtagataaccgttgagaaaatgttatatttagacattttcagaccaaagtcaagttctgatgtagatttagagaacacaatgtcttaaatttgagataagataaaagagctaactagggaacacatgtctaaaaataacaagtggaaatccaacggttgattacagaagaaacagaaagggaactagagtttacaacacacaaagaccaaacacaagccaacggttcaaatgaaaaaggagcaccgatagaagatggtctgcatcctacaagaacactgaattaagaaaaaaaagattaattattcattaattgattcgtctccagatctgacccgaatccgtttcaatcctcgactcggccggtgatatcagacgcaagtcgagaagcaatggcggagtgatacattacgtcatggaacgtggaagcttctgcggttttcctcctcaactgcttagctttctcctccgtaaaacaaccgcgacgaaacttttgacccgacccggaaatatcggttttatccggattcacggtggagcatgagctttcgatgttgaggtaatctggatcggagggtaaaccgaagagaggagcccaccaagcagcagatttcttacggttttgatccgggttaagggatccggatccggaagatgctcggatcgtgggtagagcggagcaggtgataatcaaagccattgaaagtgaaaatgtagatagaaaagtaacgtgaagatttagggatttaaaggaagaagattgatgagagaatgagatagattttagggtcaaatttatatgattaacaaattgaaagtggatatggttcgttggatatgtaatcaacgtacaagctttttactgaattttgcttgtgtagggagatttaaaggtggacacgcatgcattggattgttaacctagggagatagataagtctacacgcttttttttctttgtcagattgcaatgtcttgatatgcactttctccgaaatacaattattttaaacgtgaaagagccatttgatttatgcaatttgcatacaaaacaatgatattttagaatg

SEQ ID NO: 31577 - DNA, 3003 bp, Unknown
  misc_feature (1)..( 3003): 2750-1469P.txt file - cDNA_ID_3043697; gDNA_ID_1971898; Annot_ID_176901
aacacagagatacaaaagcttatgcctataaagacaaaacaggattaaagtatttcagtagataattccaattcttttagcctaccatcttacaaaaccccagttgaccaaatcgagaatctatatggagagagtaaataggttgaacgaacctctgagaaggcgcatgctcggacaatatgcttgtgctcaaaagaatgcagcacatcccctgttaacgcatcccaaagtttgctgaacaaaacaagataacaaaaaattggataaatgtgctgtatctaagaacataaaacatacgcaaataatgacttaatgaaccaaaaaaaattaaacacatacgctgaaaaatcggcagaagcagatgcagcacgtaatgcattgttatccagacaagaactccaaactgcacctttatgcccttcaaatgtaccaatccagtctccagtttccccatttctcaacattggatgcgaatctaaaccatcaagacatgagtattctcaaaactctatgaactacgaaataagtattactcagagaaaactcaaagacttttgtaagttctcaattcgatcaacatgaatttttgcacagttctagtaactaaattgaccaaaaaaatccaaacttttgtaagaaaccaaaagtattatcacctttgctagcgctgatgaggaagaaaccgtcaggagtaattggactgtagaacaaatcaacaacaggtcttgaatggccatgacacacttgtggaatcgtcaccttcttcttctccatctatcctaaaccctaattaagcgactctttgaaattaaaggaaagggttttcgatttcaaacgattcaaggtagactcagagtagctgaaaatctaattttttttgtagtaatttctacagaaatattgggagaaacaatcccgaatctataaaagttcgatcgatctacagttaattagagaaaccagtagcttacagtggaatgctgattcctgggaattctacagaaccaaagatgaattgaaagtataaaagttaaaaaaaaaaggggacaatttgtagaggaaagcgtaggaattgggtggtttttatttgtacaagccccgtatgcaaaacagtagcaagttttagggatttctacatctagacgggaaggagaagacctttatttgtattttttaatttagttcctatacgtttcatatgttgcaataagcgaccctatattttcgtaattgacaaaacaattcacaataccatttgtaaataatttatttagaaaaaaaaatcgtaaatcagtagtgtattttactgtacgttttttttttgtcagcatgattttgaaaataaagtaaaacaaagtatgattcttaaataaataaattaaaatttcgtttggtggtttaatgttttgttttttaaagtttataatgttatattcaataattggccaaatcccaaattggcccagggcttttactaaaggaaaatcggaaaggcattgccgtcaccggaggagcgcatctgatactggtgactaccggaggcagagaaccagtttggaggtttaatgttttaacatctaatttgaggtttgattctagaaaatgtgaattgtggagagaaaaacttacaagaatgaataatagatcacagacactttacattttgtggttcttcattgaacattataaaaagatcttaatagagaggaaagatgtatcaccactacattgaaacaacgagacgactatattaaaagattcgacacaaccaaattcacgatcatcgttaagaataagatctggagtggttttaattagtgttggcttttcagtgagaaatgtcacaaaatattatagttcgtctatgtggaatttgtaaaacaagaccgaattcaagttgtgaagtagaaaagctgtccgaattcaagttctgaagtagataaccgttgagaaaatgttatatttagacattttcagaccaaagtcaagttctgatgtagatttagagaacacaatgtcttaaatttgagataagataaaagagctaactagggaacacatgtctaaaaataacaagtggaaatccaacggttgattacagaagaaacagaaagggaactagagtttacaacacacaaagaccaaacacaagccaacggttcaaatgaaaaaggagcaccgatagaagatggtctgcatcctacaagaacactgaattaagaaaaaaaagattaattattcattaattgattcgtctccagatctgacccgaatccgtttcaatcctcgactcggccggtgatatcagacgcaagtcgagaagcaatggcggagtgatacattacgtcatggaacgtggaagcttctgcggttttcctcctcaactgcttagctttctcctccgtaaaacaaccgcgacgaaacttttgacccgacccggaaatatcggttttatccggattcacggtggagcatgagctttcgatgttgaggtaatctggatcggagggtaaaccgaagagaggagcccaccaagcagcagatttcttacggttttgatccgggttaagggatccggatccggaagatgctcggatcgtgggtagagcggagcaggtgataatcaaagccattgaaagtgaaaatgtagatagaaaagtaacgtgaagatttagggatttaaaggaagaagattgatgagagaatgagatagattttagggtcaaatttatatgattaacaaattgaaagtggatatggttcgttggatatgtaatcaacgtacaagctttttactgaattttgcttgtgtagggagatttaaaggtggacacgcatgcattggattgttaacctagggagatagataagtctacacgcttttttttctttgtcagattgcaatgtcttgatatgcactttctccgaaatacaattattttaaacgtgaaagagccatttgatttatgcaatttgcatacaaaacaatgatattttagaatg

SEQ ID NO: 31578 - DNA, 3003 bp, Unknown
  misc_feature (1)..( 3003): 2750-1469P.txt file - cDNA_ID_3043733; gDNA_ID_2936560; Annot_ID_194391
cactgtaataccaatacttttctataaggaatcaaatctataaatagcatactaactagcactataaaaacattatgaatcctcctatgagcaaatcacttttaaatttgttaacactcttttaaaagaacaaaaaaagcaaaaaaaaaataaagatattatcaccatggctaacgcaagaagtttggtcgccaaggcaaacaatattaacgtaggttcattgattctaatggccttggtgtttggttcttgcgtggctaatggtgaatatctcggcggccgccgtggtctcgctgctaattccggtaaccccacggtctatgatattactaagtttggagccgtaggagatggttccaccaatacttttaaggtaaagtttagtttcattttcgatccataacctttttgagtattttatagtaaaatgcatgtgacattctaacgattgatccaataacattcatgcaggcgtttttgaacacatggatacaagtgtgtgacagtccagtaccagcaacgctactagttcctaagggaacatttttggctggtccagtcattttcgccggtccatgcaagagcaaagtgaccgtcaatgttataggcacaatcatcgctacgaccagcgggtacgcaactcccgagtggttcttgttcgagcgtgttgacaatctcgtcctcaccggaaccggcacattccacgggaaaggtgaagctgtctggaaagcagatggttgtggtaaaaaggtccaatgcaatcttcctccaacggtaagaccaaataactatatattatttcaaatcatgtatatatagatacttgcaataactaatcacacatttgtacgcatacatgcagtctctcaaattcaggaacatgaaaaatgttgaaatcaatggcataagctcggtgaacgcaaaggccttccacatgttcttagtcaaaactgagaatgttaacatccaaaacattaagcttaccgcaccagctgaaagccccaacaccgatggtatccatttgagcaatgcagacaacgttagcatcctcgacagtaccatagcgactggagacgattgtgtttcagtcggtcgtggctccaacaacgtaaccgtcgaacgtgtgatttgtggtccaggacacggtctaagtgtcggtagtcttggtaagtacaagaacgaggaagacgttagcggaatccacgttaacaactgcacgatgattgagaccgacaatggtcttaggatcaagacatggggtgggtcagacccaagcaaggctgtggacattaagtttgaaaacatcatcatgcagagtgtcaagaacccaatcatcattgatcaaaactacggttcaagaggcggagtaagtatatacatcactgaaaatgtctcaaaccaactattcttttgaatatatgcgttaacaattccttttttttggcatgttttgtaggattcacaagttgctataagtgatattttgttcaagaacattagaggaacaacaattacaaaagatgttgttcagattatgtgtagcaaatcggtgccgtgccaaggagtaaacgttgttgacgtgaacttggactatgtaggcaagacaggaggagagaagaagtcgtcatcaggcggtttggtcggagctctttgcgataacgccaatgttatcttcggtggaaaacttagtttccctatgtgtcccaaataagctttttggtataaataatttaatattaaaaaaaaaaatcaaaagtttcacaaacattgttttgtttgtgagttagtttgggaatttatcaacaagaaataatcagtggaatatttgacttttgataatgttttttttcccgattttttttgattttttttttggttttatgtataaataaacagatccttcagctggttgcttaatagtttctggttagaaaatttggtctgtgggtattagtgtgtacaatcattttattgctctatctaaagtcatcgatttctttctttctaagtggcaaaatatctctttcataaaaaaaaaaggaaagaataataaataaaaatatctctttcattctaacttggcattaaaatttagcaaaaactatttgtggaacttgaaaaaaatattactagctcagacttaaacttaaatagtaacaagcatattaaaagtcatgctaactgagatattgatttcctcatctcaagaaactatcttatgaatctgtttccgattattttagtttcccatcaatcatctttaatttctaggaagtttgattttttgaaaatttctccacctgcttaaatttcattacaatttttaatcttagataaacaactgtaatttatgcaaaatgaactgattatataagtcgttatgaatatttatattttttaaaaacatttcagcaaaactgatatactttttttttttttttttttgcaagcaaataaacaaacttccttgaataaaacgtgaaaaataataagagtctttaaagataaacgttgttcatatacattacgtcatataatatatataacaattaagacaatacaaacatatatacaattctcattgggttgaaacattataaagataagataaacatctgtatatatacattggtatacaatatttttcataaatttttttttctctaatcgacagttatatatatacagaaccataatttttaaagcatgctttccaaagcggtttttttttttttttttttttttgtaaaccaaagccgtgtttctaaacctcaatttataaatttggtgtagcttttcaaccttgatgaaattattacatagaatcattcgttaaaagacttataattgggtttagaaaagcccattttaaatttaaagcccaatatactgctcgaaaaggaggaaaccctagaaacattgtggtatataaattcttttcgtctcgttcgctaatcagttctccgccacaccaatctccagaaaaggggagaagcaaaaatg

SEQ ID NO: 31579 - DNA, 3003 bp, Unknown
  misc_feature (1)..( 3003): 2750-1469P.txt file - cDNA_ID_3043733; gDNA_ID_1971906; Annot_ID_177006
cactgtaataccaatacttttctataaggaatcaaatctataaatagcatactaactagcactataaaaacattatgaatcctcctatgagcaaatcacttttaaatttgttaacactcttttaaaagaacaaaaaaagcaaaaaaaaaataaagatattatcaccatggctaacgcaagaagtttggtcgccaaggcaaacaatattaacgtaggttcattgattctaatggccttggtgtttggttcttgcgtggctaatggtgaatatctcggcggccgccgtggtctcgctgctaattccggtaaccccacggtctatgatattactaagtttggagccgtaggagatggttccaccaatacttttaaggtaaagtttagtttcattttcgatccataacctttttgagtattttatagtaaaatgcatgtgacattctaacgattgatccaataacattcatgcaggcgtttttgaacacatggatacaagtgtgtgacagtccagtaccagcaacgctactagttcctaagggaacatttttggctggtccagtcattttcgccggtccatgcaagagcaaagtgaccgtcaatgttataggcacaatcatcgctacgaccagcgggtacgcaactcccgagtggttcttgttcgagcgtgttgacaatctcgtcctcaccggaaccggcacattccacgggaaaggtgaagctgtctggaaagcagatggttgtggtaaaaaggtccaatgcaatcttcctccaacggtaagaccaaataactatatattatttcaaatcatgtatatatagatacttgcaataactaatcacacatttgtacgcatacatgcagtctctcaaattcaggaacatgaaaaatgttgaaatcaatggcataagctcggtgaacgcaaaggccttccacatgttcttagtcaaaactgagaatgttaacatccaaaacattaagcttaccgcaccagctgaaagccccaacaccgatggtatccatttgagcaatgcagacaacgttagcatcctcgacagtaccatagcgactggagacgattgtgtttcagtcggtcgtggctccaacaacgtaaccgtcgaacgtgtgatttgtggtccaggacacggtctaagtgtcggtagtcttggtaagtacaagaacgaggaagacgttagcggaatccacgttaacaactgcacgatgattgagaccgacaatggtcttaggatcaagacatggggtgggtcagacccaagcaaggctgtggacattaagtttgaaaacatcatcatgcagagtgtcaagaacccaatcatcattgatcaaaactacggttcaagaggcggagtaagtatatacatcactgaaaatgtctcaaaccaactattcttttgaatatatgcgttaacaattccttttttttggcatgttttgtaggattcacaagttgctataagtgatattttgttcaagaacattagaggaacaacaattacaaaagatgttgttcagattatgtgtagcaaatcggtgccgtgccaaggagtaaacgttgttgacgtgaacttggactatgtaggcaagacaggaggagagaagaagtcgtcatcaggcggtttggtcggagctctttgcgataacgccaatgttatcttcggtggaaaacttagtttccctatgtgtcccaaataagctttttggtataaataatttaatattaaaaaaaaaaatcaaaagtttcacaaacattgttttgtttgtgagttagtttgggaatttatcaacaagaaataatcagtggaatatttgacttttgataatgttttttttcccgattttttttgattttttttttggttttatgtataaataaacagatccttcagctggttgcttaatagtttctggttagaaaatttggtctgtgggtattagtgtgtacaatcattttattgctctatctaaagtcatcgatttctttctttctaagtggcaaaatatctctttcataaaaaaaaaaggaaagaataataaataaaaatatctctttcattctaacttggcattaaaatttagcaaaaactatttgtggaacttgaaaaaaatattactagctcagacttaaacttaaatagtaacaagcatattaaaagtcatgctaactgagatattgatttcctcatctcaagaaactatcttatgaatctgtttccgattattttagtttcccatcaatcatctttaatttctaggaagtttgattttttgaaaatttctccacctgcttaaatttcattacaatttttaatcttagataaacaactgtaatttatgcaaaatgaactgattatataagtcgttatgaatatttatattttttaaaaacatttcagcaaaactgatatactttttttttttttttttttgcaagcaaataaacaaacttccttgaataaaacgtgaaaaataataagagtctttaaagataaacgttgttcatatacattacgtcatataatatatataacaattaagacaatacaaacatatatacaattctcattgggttgaaacattataaagataagataaacatctgtatatatacattggtatacaatatttttcataaatttttttttctctaatcgacagttatatatatacagaaccataatttttaaagcatgctttccaatgcgttttttttttttttttttttttttgtaaaccaaagccgtgtttctaaacctcaatttataaatttggtgtagcttttcaaccttgatgaaattattacatagaatcattcgttaaaagacttataattgggtttagaaaagcccattttaaatttaaagcccaatatactgctcgaaaaggaggaaaccctagaaacattgtggtatataaattcttttcgtctcgttcgctaatcagttctccgccacaccaatctccagaaaaggggagaagcaaaaatg

SEQ ID NO: 31580 - DNA, 3000 bp, Unknown; identical to SEQ ID NO: 8856
  misc_feature (1)..( 3000): 2750-1469P.txt file - cDNA_ID_3043737; gDNA_ID_1971906; Annot_ID_176995

SEQ ID NO: 31581 - DNA, 3003 bp, Unknown
  misc_feature (1)..( 3003): 2750-1469P.txt file - cDNA_ID_3043744; gDNA_ID_1971906; Annot_ID_176992
gtttccttatgtctttgttaatggttcttggcaggtccttagcaaaaatcagctagtctgccctgacattgaaatcttgtgcatcaaagatcaaacccttccttctgatagtgggcatctttaacttttccttctttctttctttctttcttgagcatctggttatttgtctaatcgaaaaccatatgattaataggtgtggagaaagtggttggctttgctttcaatcaccatcttatgaactgctcagaacctacagtcaaggacaacaagcttatcatctcggcagaaaggtgagctgaaaatattgatcatgtggattcggagtgtgatattttcttgcgaataactgtttggtgtgtgttgcagcatcacatatggcctgcagctgttgcatgagattcaaaacgaaaacaagagcacaaagaaatctctgaaagtaattatatagaaatcttatgctattttgactccaaattaacttctggattttaacaattattatgctatattatttcaggatgttgttacagagaatgaattcgagaaaaaactactatcagacgtcattcctccaagtgatatcggtgtttctttcagtgatattggggctttggaaaatgtgaaagataccttgaaggagttggtgatgcttcctcttcaaagacccgaattgtttggcaaaggtcaacttacaaaggtacctttcttgctttttaaaatcaaatcgttgtttcattcaatattctatggaaactgaattataactgttttttttttcatgcagcctacaaagggtatactattgtttggaccgcctggtacggggaagacaatgctggcaaaagctgtagcaaccgaggctggggcaaactttatcaatatttcaatgtccagcattacttcaaaggtattgatcacttaaaacggttacctgactctatagtgttttctttgagattagacttgacttgagatttcgtgtagtggtttggtgagggagagaagtacgttaaagctgttttctctttagcaagtaagatagctccaagcgtcatttttgttgatgaggtatgttgctagacgttaagaacagctctcatacctgtttattacagttcctttttctttctgaatatcttttgaacgggatcaaaattatgtaggttgatagcatgctgggaagacgtgagaatccaggagaacatgaagctatgcgtaagatgaagaacgaattcatgataaactgggacggcttacgcacaaaggataaagaaagggttttagtattggctgctaccaacagaccatttgaccttgacgaagcagtaattagacggcttccccgaaggtaatgaatgataaactgtcaattattctctgatttctgtatctttgtcatctttgaagcgttgcttaagagaagatcttctgtgcaggttgatggttaatctgccggattcagcaaacagatcgaagatcttgagcgtgattttggcgaaagaagagatggcagaagacgtagacttagaagcaatagcaaatatgacagatgggtactcagggagtgacttaaaggtctgtaacttcctccatccaaagcacaaactgaaaacccatttcataaaaatccacattctaatcaaattgtctggtttgcagaatctttgcgtgaccgcggcacatcttcctatccgagagattcttgaaaaagaaaagaaggtttgtctctgttttaaaaatcataataatggttatgattgtggtttttgaaaccatggttttgttgactcgcaggagagaagtgtggctcaagccgaaaaccgagcaatgccacagctatatagcagtacagacgttagacccttgaacatgaatgatttcaaaaccgcacatgatcaggtttgagaaactgaaacatacaaattagtttcaccatttggtctagttttgggatataacggagtgtttttttttattattgttggaaggtatgtgcgagtgtggcgtctgattcatcgaacatgaatgagctccagcaatggaacgagctctatggagaaggaggctcgaggaagaagacatcactgagttacttcatgtaaagagaaaacagagaggttgtgttttgttagtttatatatatatatatatatatatataaatctctctctaatttatatgttgtacagagagattgagagagaagagagtcagtcccctcttgaattgtctaaaaaatgttttgctcggagctgcctcaattcttttctttctttctccaaaaaaatattctaatatcagatgtacaatcaatttaaatgcttgatgtgatatgttactatatatatatatataatgtatataaagtttagatatttttatactcctaattttatttactttcttctttagtttttggtggtgaaattcattattgtttttataaaatgtcttcaactggatactaatggttgattaataggttgagcgaaacagacagatctgaaatcaacggtccacgcaggaataaattctattttaaacttaaatattttgtgatattttgaagtcttttacaattgaaaatattttgtaataccatctctaaatctccctcttttgatctccaagtcctccatggttttagggcttttgctttgccgattgatacctaggctctgatttgatttttcctttagaaaactttcaaaaagtttcagtagattggcttaattggctctgttggtccttgtaaagaggataccttttcgtggttggaaaaaaagtcacgttttggcgaaacgctagtttaatgagatagagacgtggccatctttgaaaagtcaacgtttggtcgcaatcggtgacgtacactgtctatatttaatttttcagcaaccacagtgatttattgaatgaatcaatacataacaacaaaattatcagaaacacaattccttcttcttcttcttcttcttcttgtctccgatgtcagccatg

SEQ ID NO: 31582 - DNA, 3003 bp, Unknown
  misc_feature (1)..( 3003): 2750-1469P.txt file - cDNA_ID_3043748; gDNA_ID_1971906; Annot_ID_176991
cactcccaacaattctccaattaataataattaactaatttgcataatcattttttttcatttcactgtcaagtggcatttctgttaataccgaaataacacaagtaaaatttcgaaactataatgtaagttcaaaaaattctattgtaactacagaaatcaaaaattctaaacagaagctcgttaaattttcaaaattttaatataacaaagagaaaatgttactagtattcgaatcaacaagttattgtcatgctatgtctcatattcttctaaataaatactgaaacttttaataaaaacacaaaatagaatttgaaaaacaaaacaaaaaaagagaaaaaaaaatcttcaacaactacaaaattaaaaaatcgagtccacgcactcaccatgtatatataaacattaacttaagcaataataaccaaacaaaagaacccaaagaaaggcaagaaaatggacaagtcctttactctgttcttaactcttacgattctcgtcgtcttcatcatctcttcacctccggtccaagccggcttcgccaacgacctcggtggtgtagcatgggctacgactggagacaatggttcaggctgccacggttcaatagcagagtgtatcggggcggaggaagaagaaatggactcagagatcaatagaagaatattggcgaccacaaaatacataagctatcagtctttgaaacggaacagtgtgccttgttcaagaagaggtgcgtcttattacaattgtcagaacggagctcaggctaatccttatagtcgtggttgcagcaaaattgctcgttgcaggagttagacctacaaacaagaaagctatcttcttgatcttgacttatgttttctttgatccatcaagcgttttcattttaattaaatctttaaatattcatcatgtctctgcacaatagtaaagacctatgttttgatcaaattgggttgatttgtaatattttatgtgaataatcatggtcttaatgatccatgaagttgtttggtttttaattattacaaagagacgagtattcaaagagttattacctacgtttgatcaaaccgggtttggtttgtacctcagccgctttcacagtcggattgaataaccggtctcaagttgcaacacacaagtgaccaactctcaacctaacccttaccaactctcggcgcgtttacgggaattagtttgttttgaaaattaatattttatatatattggtcgatttgaaccaaaccggatcgtaagaaattggttttatccatgataccactttttctcttcgaagggtttgagaaactgaaacatgggcttggaaacatagaaggaaattcactacaaaacaaaacatacttgaattagtaacaaaaagcgtgaaacatgcagacattattataacaaactaacatttttggttcttgtctaatcaattaggggttgtctcaataaaacatgtcgcccatcagcttgacaacatggttctaacacggtttcttttaggttaaattggccaagttgctaatcaggagaacactatcttaataattaaatcaagtagttgaaccatccgtaacaacatcaattttataaatcattttcatgtaatttgcaaaattttatagttaaaacttaaaaacgttccatcgttgaaagaaaatagaggtactacaaataacaataatataggtagaagatccatgataatggatttttgattttttttggtttgttaaaaggtattcattaatcatggcaaaaattcgcaacatgtttgcttgcatacgctagaaaagaaagaacatgatgagttacaattttttttaatcttctccctagctatcccaaatatccgaaaataaagaagaagataatattcaggattgagtttctctttttataaacaatagaaaacatcttcttctttggttgatccttatcccaaaaaatgattggccacaaaattttgaaatattttcttatacattttccattccaccattaaatgtctcgtctttctctttttccctctttcaataagtgatggatttgaaccaaccgacttaaaatgggccggtcttaaagccgcaccacactaatgggcctttacctatttacaatttttctgtctattgaacagtagacttactgctcatataattggcgggatcaatacacgtgcttaatactagaacattcggttcgttcctaactgcaaacgagtttggtaatttagttaccccataattatcaccacagttgaccttagttttaagtttgaaattcatctaaaacaccatatatttgaatacattacaaatacaatgaaacatatgacacacttgtgtgatggtttagataaaatacgtattgaaatagctgtaagaatgttacttgaaatgcaataaaacgcatgtcaagttgtcaacatgtaaacccaacaaattaaacgattaaaaaaatcagccacaaaaacaggtagagcatgcagcaaaatattccaatgcttgggtctctatgttaagttctgtaattcgtctttattatatatatatttggcaaaatttaaatattgaccgttggatgtttttggttttaaatctgtaccaataagcgaatgagagaatctacttcttcaatataattccctcaaaatctacttgtgatcattttataatgctttggtcaaaagtgctgattttgtaattaattaatttttgtcgtttctaatacgagggtgaaatttgtttcttaaagtaaaaaaatggaaacttgttaaatgttttagaaatatgacaaagaaaaaggaaaaaaaaaaaaaaaaaagagtggagatacgaacttttatataagaagaagagaaagttgcagcacttgtctgaatattattatttaagataaaaccgacttttgcagtgaaaatctcttctttgaatcaagcggcggagacggcggcggtgaagaagaagaattagagagagagatatg

SEQ ID NO: 31583 - DNA, 3003 bp, Unknown
  misc_feature (1)..( 3003): 2750-1469P.txt file - cDNA_ID_3043752; gDNA_ID_1971906; Annot_ID_176985
ctcctgagaagttgtctttgagaaagaacttggcaacttctgatttgccgaattgattgttgttggcttgagtagttttttttgaggagctatagggaatttgattgtggtttgaccatagttggcttcaatattgtagagaggattactacttcaaacaaagctcgaaaaactcataggtacatataatatatccattttgcggtcaagccttttctacgactatttaacttcagtcaagtttcacaaagagcttctgtgttgtttccaggttgtggtgagctaaattatgctagggaaaccggtgatgtaactctggaagcaactgtgagtctttttcgttgcaaattcttttgtgcagcttcttttttggaggaatattggaatcaaatggtgatgagagaaatttcctttttagctacggaagatatcatcctctcttgaagatgtggtcgaagttcctgactcccccgaggagagttatatttcttcttccagaagaactggattagcatgcatatctgctcaggaaaatgggtcagatgatgaggttaccttctaatcttggagtccatttcactcatgcatcttgataagttcttcaaattggtgacagtatcctctacttatgttttgaatggtgattgttgttgccttcagattacacatgatgaacaagtggcaacttggtctgctataagtaaagaaaccaagtcactaatccatttgaatggtgttgcttcagtcgcatcatcccatctatctggcttcagagccaagaaaagtagtaatggtactgttttatccaaaactcttcttggtatttttttaccgtacaagttaaagaacgttgcaccacgtatgaaaactcaaagaaacagatcatgtatgcacgattttctgaaatctctgagttgggtttctaatgtatatgcaggtctcaaagatcatgggaggccaaaattttcatttaactcacatactcatggagaaacgtcatccaagataagtgacatggctgaaatctttgagcctgatgtggaggatcaggctatagaagaggatccaattattgaatgccccaacagttttgatgaaagatcagaaaacaggcagggtgtttctgttgctgagtcgagagaagttttgcacgagtgcactaaagatgcggtacccaagcttcaagaaattcctctagataaaattagactgataaaaagaagctctgaactggtattattgattatacagtggattagcatttgatttgctgctttgctctcagacatctgtttcattcgtttggcctcctttctgctccaggacagcagacatgaagcaaaaagtcggaaatttactcataagggaaattcatctaacttccaagatagtgatactgatgatgaacttcctggacctatggatagtggatcatcaagcgatgatgaggttttattcttttcctttcttgtgatttgggtaatctccttctcctcagtttacagtcaaattcaaattatattgttctgtgacatagcctagttatcaaagctcagtgccaaacatttccaaccagaagaaacaatttgttggggaccggtttgatgaagcaataaaagcttcctctttgagcaaagaaggtctcttgttcggttcacctaaattatctgggtaatcaaactctcaacatcttttatgcaccacactcttaaaatcacacatcagttaacatgaaaacccatttttggttgcatcaatttgcagtggctctagcctgtatggcaagctgcaacagatcatgaaacaagaaaaagagacggaaatggaaatcatgaggaaattgcaaagcggaatcggagaagcaggtaactctttttgtaactcccatataaacaaaatctagttcatacctctgttactcgttccaatttcccaactcagattcatcgggctatgttgatgttaaagtcatgtcaagacacttggagggaaagcttgtcgtctgcaaatgctctgtcattgacctctctggggtttatctctccatctctttgacgcatctgataaacctgctcctttaattagacccttaagcaattgatttagtcacattcgattttgtaggactccctattactcaagaacacacaagctcttgcggcaaaagaaacagaaacaacaattatttttagtccgaaagtttgtgcggatgttgatatcgaaatagggaactttatccgagtatatgcgccatggtcagttttgattccactctttagactcttatcccatgtcactaaactcttttgtgatatttagcttttcaattttcaacaggaaggagttggaagtgcagaaaaccaatgatgtgattattttgtcttcatatttctcaagtttgtaatataactcacacaaatgtcaagatgtggaaaaaacttgcaaatgattttatcagtgtgtataaaaacgataattaaagctctctgattgataacaatcatactgatcagagcttaaagtgttttttgatttatcgtgttttcttctttgggtttactactgattaaaggcgttaatcagttctcacaaatgattcaactcgttttagttatttatacatgaactgtttgttggtttgattcctgtcgtgtgctttggtaaacctcaaagtaaagcataatcatagtattcgtcttgtttattaattagcacttaaaataatggaacaaaaaggataataaaagaaccagaaaggataaataatgaaataaaacggtagatccctagtttacattgtatcattggaacaattcatctctcaatacacaagaaaggtggactctttacgtggatgtcaaggaaaaacaaaatgttcctcagcttttgtattgcaaagaaaaagcatataactaagttggtatatataatagggtttatggaggatacatgcagaaattaaacaagtgtatctatatcgtatatatggactgcttacagatg

SEQ ID NO: 31584 - DNA, 3003 bp, Unknown
  misc_feature (1)..( 3003): 2750-1469P.txt file - cDNA_ID_3043756; gDNA_ID_1971906; Annot_ID_176984
atataagggaaaccatctcaaatctaaagtcagatcttgaaatcgtaatactaactaatcccaaaattcaactacctagaagataacgatagatctcgaattagatatacacagctaagaaatgccagagttaacgaagatttaccagaagaagtcttggctaagaataaagtccttctctccgcaattggcatctgaatcagcggaacccaactgatttcggagttccgaagaatccgaatccaggagaccctgaaacgccgatgaagcaacattcgacgacggacgattttcgaaagaaatcttcgacaattgaccgaattgaagcagagagtgacgctccaatgtcccttccatcttccgaatcttcttcgatgccctggttttgattgtcccttgggttttcctcttcgccaacagtgttcttccgttcttctcgaacatgacgatgaatattattactttgggtggtgattcaactaaggaaaaataattgaaataaattaataaattcaaaatttgcgcgctctcgtcttttagagtttcgagctaaaatttgggaatagtcatctgcatgactgactacggtgcacttcctatataatcaattctggaccgttcaatcttcaggattgaaatattttgctacagataaagtaaaggtgcagcggatcttctgtagagcgtatcatgtacgctttgatgggtctttaataaataatatttttttctataatagcactagcattttttttgttacgattcactaatttaaatattcaactttcttaagaaatataatattttttgttacgattcactaattaaaattttgaattagtattttttgttaattaatttaacaatttgtatttttattggtcaaacaactaaaaagtttctcatttttttttttccaaacatgaattaactctccttaatccttataactaaagaccagtaatttgtactagaatgtgaaattaaggaattgccagattaatgtttgattaattctaaaatgtgggatataaaacatgggaattgggcctattaaagcccaattactaatactaaaagaaagtaaactcagagaagggcccatatccaagcatactaacggcaaggacggtataaaggtgcacgccggcgagatcgatttgaacggtgacggcgaatgtgacggcgaagaaaccttccggtgactgttctacatctctgagaattgtttgcttttgcgatttcttttattgttggattaatttgattttgagttttgcttttgttcttgttggattttcaggggaatccagattccgatcagagcatctctggtgagaactgatgattgcttttatcatctgaaatttcgattttagatcttagtgtttaggtcgctcattgtctaacaagtgattcgcaagctgttgtttggtcttttagaggaggaggaagagatcatcaatgttagtttgggagaaaatgatatgtggccaagcgagaatgcaaaggaagaagaggtaatgtttaatctcaacttgagcttgcataaagctctctgggaactcctgagaatttgtctttgagaaagaacatgggaacttttgattttgcccaattcctgattgttgttggcttgactagttttgaggagctatagggtgaatttgattgtggtttgaccatagttggcttgaatattgtagggaggattaatacttcaaacaaagctcgaaaaactcataggtatatattttgcgatcaagccttttctatgactatcttaacttcagtcaggtttcccgtaccttcttgcagttcatagattaactgattaaggaaagtgttttcataaggagcttatgtgttgttttcaggttgtggtgcgctaaattatgctagggatcccggtgatgtaacggtggaagcaactgtgagtcgttttcgttttcaaattcttttgcgcagcttcttgttctgaggaatattggaatcaaatggtgatgagagaaatttcctttttagctacggaagatatcagaataactaaaccagaattgtgttacagatacttacaagtactgatttgatgccgaagatttaccagaattgtgttacaggaaatgccgaagatttaccagaagaagtcttggctaagaataaagtccttatctccgcaattggcacctgaatcagcggagcccaactgattccggagctccgacgagtccgaatcgagaagaccctgaaactccgatgaagcaacattcgacgatggacgattctcaaaagaaagcttcgaaaattgaccgaattgaagcagaatagtgtcgctccaatgtcccttccatctttcgaatcttcttcgttcttctcggttgatggttcctagggttttcctcttagccaacagtgttctttcgttcttcaaaatttgatggaaagtaaagacaataaataaatatattcaaaatttgcgcgctctagtcttttctcgtttcgagcttgggaataatcagctgtatcaatgactacggtggatttcctatttaaccgttagatgaaaggatagtaatattttgttacagataaagtagaggtgcagtggatcttctggaaggcgtgtcatgtaatttaataaataatactaaaattaaaattaaaattttaatatttatttaaagttaaattattttctgttttatagtataattttaatcattttatacataatacaaatttttacttgttattatggatagatacatcaattttagaaaattaaattaaagtatttataattttttaattcttttattggttttaaaagttaaaaaaaattaaactaaaagaaatattgataaacaagttattcttattgtcaaccttcttgagactcaaaattattcggacagcgaaccttatacttgtttttttatatattctaacataaagaggatatgatatgaagagaaaatcggaaaaagtgttatagcgatgatg

SEQ ID NO: 31585 - DNA, 3003 bp, Unknown
  misc_feature (1)..( 3003): 2750-1469P.txt file - cDNA_ID_3043774; gDNA_ID_1971909; Annot_ID_177044
ggacagaataccaatcctgcacttgtacagagcaacactttcagtacaccttccactggctttgggaacacgttttcaagctcttcatccttaactacaagcatctccccctttggtcaaataacggttagtttttctgtaactaatttaaatgccagttcacttcagagttgatgtctctttcacttccgtttgagttatgtagggatttctaatatgagtttatttttgcagcctgctgttacgccctttcaatcagctcagccaactcaaccattaggtgcttttggtttcaacaactttggtcaaacccaaataggtatgtgaatcagtcaaaggcaccctgaatattatcatcttgaatactcgaagccaagtcttgtatgtttatgtttctgaagctaatacaactgacattgcaggtgcaatgggaacttttagccaaggaaactttaagcaacagtatggtctctctgacctcagtgtttccgactcttatttccgactagataccactagtttaattgtactttggaagttgcgtctctggagcttaattcttttctttttgttttgttttgttgacaggcctgcattgggtaactctgctgttatgcaaccaactcctgttacaaacccatttggaacacttcctgctttgcctcagatttcaattgctcaaggtggaaattcaccttcgattcagtatggtatctccagcatgcctgtaagtttttctgcctttttcaacacccacacacaccaccctttttcttcataacttctttccaaatttgaagcaaataaaatatagatattctcaaagatacaatgttacagaaacaaatgactactccatgttattaccctgaatattttcctttcttctcaggtcgttgataagcctgctcctgttagagtatcaccactcctaacttctcgacaccttttacaaaggcgggtcaggctaccaacaagaaagtaccgtcctagtgatgatggtccaaaggtatgtttttctattttctgaattttggctttgtcttgaatatttcagtctttagtgatgtttactgaaggtctttctacctgtttgtttcaccaatgtttgtccaggttccattcttcagcgatgaagaggagaattccagtacaccaaaggctgatgcgtttttcattccaagggagaaccctagagctttatttatacgcccagttgaaagggtaaaatcagaacatccaaaggatagcccgaccccactgcaggagaacggtaagcttcccttttttttttcattcattggcttatttattgcaagatttagagctttgtttcaattgcaaaaagaagcttttcattgtcccaatagctcggaagatgatctgcttgcatattaatatagtggctgaatttgatcatatctgaccccttattacatttgaaattcaggtaagaggtcgaatggggttactaatggagccaaccatgagagtgagtattttaaatatgcatttgtaacaaaattgtgattaaagtttgtgcattggtgaggccattcactgactctactgttaatatgtgcagctaaggataacggtgcaattcgtgaagctcccccggtaaaagtcaatcagaaacagaacgggacacatgaaaatcacggaggcgacaaaaacggttcacacagttcaccaagtggagcagatattgagtcattaatgccgaagttgcatcactctgaatatttcacagagcctcggatccaagaactggctgcaaaagaaagggttgaacagggttattgcaagcgggtaaaggactttgttgttgggagacacggttacgggagcataaagtttctaggagagacggatgtgtgtagactcgacctggaaatggtggttcagttcaaaaaccgggaagtgaatgtgtacatggacgagagcaaaaaaccgccggtgggtcaaggattgaataagcctgcggtggtaactttgctgaacataaaatgtatggacaagaagaccggcacgcaagtgatggaaggcgagagattggacaagtacaaggaaatgctcaagaggaaagctggggaacaaggagctcagtttgtgtcttatgatcctgtgaatggcgagtggactttcaaggtcgaacatttcagttcctacaagcttggagatgaatatgatgtgtagaaaaggaccaaagtcgttgtcatatgtagactagtgtctcgattattttttattttttttaccttgtggggttttgtctattggtcttttgcaatataatgtcaaaatgatacgtcttttacctcattggctcaacctggaaaaattcaatattcattttgttgttttcgccaattaatataataatatctcactaagaagcagaaaaaaaaaatagagtcgtggaggacacaaaactggtctcaccagttgtttcgtggtttcttctaaagatattattagttcctaatttataaaaaattttgatgactttaatcacatcctaaaaagtaaataaaagaaagattataaactatttagagaattttttataattttattgattagcttttataattttgtaaaatttctcaaataatttttctattttaataatatttttcatgactttctatgactttattttgtgaaaaaaatgtagaaagttatgaaccaataacataataattcaaatcattaacaatcagaaattattatattttaattgaataacacaaaacttttactgattttataagagtatgaatctaataactccaaatttatgaagattttagattactttttacaaatcttatttgaataacataaactttaacatatttttaaaaagtcttgattgaatatcaacagattctacataacactttaaatcactaactttttttttgaaatcatatataaaccaataacaccccctaattgtatacctaaactaaaaataatttagacaaaacaaagatg

SEQ ID NO: 31586 - DNA, 3003 bp, Unknown
  misc_feature (1)..( 3003): 2750-1469P.txt file - cDNA_ID_3043803; gDNA_ID_1971909; Annot_ID_177043
agcttcctgttgttactaccaccccgactaagctcccatcaatccttgttgtaaatgttcaggtatattgtctagttccatggttaaactgttcctcttttgcatcgtctttggtgtttcggtttaatgatgatgttgctatcggaatcatagattccattgtatccagctgcaatttttcatggtgaaactgatggagaaggaatgaatttcgttttatactttaaactttcggataactatttaaaggagcttccaccacattttcaagaaagcattcaggtagtttaatcttccacgtcgtgattctgtttttttgtgctgtactcttgtgttgaaaacgcatttttgaatcgctttgtctttggatatatgcagagattactagatgatgaggttgagaaagttagaggctacactactgacacgaatgtaccctttagagaacggttaaagatattgggtcgtgttgcgaatgtagacgatcttcagttgaatggtgcagagaaaaaactcatgaatgcttataacgaaaaacctgtgctttcacgtccacagcacgagttctactcggtatgtcacaattatcataacaaatgcaaatcctattgaaacttgcaatataatgctgaactaacttaactttgaaatttgatcttgtagggtgaaaattactttgagattgatattgatatgcatagattcagttatatatcgcggaaaggatttgaagcatttttagacaggctaaagaactgtgttcttgatgttggactcacaattcaggtaatgtgtttcaatttgttacttctttgatgaatttttgggtctaattgctgtggttatttaactgtataatctcattttcaggggaataaaccggaggagttaccggagcagattttgtgttgcatccggttaaatgggattgattacatgaattatcatcagttagctcttagtcaagaagtcctatgatactaaacaaaagatatgacctttttttttgttgttgttctttatcttcttttcttttgttcctcaagaacacaaaatctaagagatacatcgttttgaagaagaagtcaataatggaagcatgagtatatacatgatacatcattccgaaacctgatcatttctcggagattgcctacgactctgtacagtggccaatattgctcatcataaatatcataattcaatgagaaatcaccaacaacagtaggatttaatgatgtcttcggaaaaccgttttctgatattataatgatgtatccgtaagaatatacatattttctctaaccaaatcatatcaaagctggtacgactataagtttcagtttgcttttactggttataaggggatggttttgacttttgagcaatgatcttgacccggggttttgagagaggagcaaggcaaagggctttcatatgtttcctctctagtctctacatgatgaacaaggcatttgggtttagacttcgtttaacctagtgtcgtcactaagtttctgttgtctctttataagttttagcttcttggttttggttttggcttttctatttgtgacttttgtccctctaactagttttggattcggtctctttcttttgggattagttttccaaagattttaccatattccgcatatcttttataattctcgtaacttagaaccaaattcacatcaaaaagaaccaaagattttgtctctctacctagttttggactagtctatattaaccgcgaacggaaatataatgtctaaaccaacctcactaaacccataaagtagcaggttgacaaatgtgcttaaaatttttcttctacaaataattgaaaaattaatcttcaaatattattatactaacaatttttaggtttaaaataactttagtatcactctttttgtaaatattataattcttctacattacattttttttaacacattaaatatccttatcaaatttgtaccttttgttttaacattaaatttttatttactcattttagaaaaagaaaaaaaatgttgtatttaatagaagaggataaaaattggaaaaaaagaagtaaaaaacagtaacaataaagaaacagaacagtgtttaaaaaaaaaaaagaacaaaaacaaattcacgtgggcgaaccgggaggaaatgaaccataattcgagtcggtccaatcaatcccatttcacaaaccgagctttggaaagacgctagattgacttattaaatacaacgcgagtcggtcgaaccgaataatcaatcctggttaacaaaccgagcgtcggagagacgctacactgacttgaatacaacgcagaaactcactgtttatatataaactcagcctcctcctccacttttcattctacgtacaaaaatactcttttaggctttttgattccggcgaggtctctgcttctttctcctccttctccgtcgtctccatatcgtgatacttcaggttacattcctcaaatcctcttttttgattctacgacgaacgacatcgctttccttaacagtttcggcgggtttatcacgcctgaatcctaatttttccaacatctgacgaacgagtacagaaatttctggttatttatcttgtgtgacattcgtgagacgtagtttagtttagttagattgatttccatcggattcatcataggtaatatttgttgaagtttatgtcatcgatttggttttgattttttgtactctgttttctaatttgatgattcctggttatgaaatacacaacttgtgatgttgccttgttcaatgtcgatcctatatacgactaattgtgttgttaattggtgtaaattggttcgttttggggttcttggtgtatatgattcatgatttggaacttgaaaagttccattacagtgtttgctaatgtacatgtttttttgttgttgtaccaggctagaagaaacaattcctttggctgagccgagagacgtgaatatatagacgaagatg

SEQ ID NO: 31587 - DNA, 3003 bp, Unknown
  misc_feature (1)..( 3003): 2750-1469P.txt file - cDNA_ID_3043807; gDNA_ID_1971909; Annot_ID_177042
atacgaatttgactttcacagtgtagaaataaatatatatttaaccagtaaaattagtttgcatattatacactcacgtaataagtttttttccattgacttcacaaattagtttgctcctcctacgaacatgtcatttgataatttcccgtaacaagtttttttttgttttatgattttttttgtcaaaaatctcaagcacatctaattatcaagatattgtctatttgtatagtttaataaaaagggcaagacaacaagtcgacgtgtgaaaacaacatcagacgctagtaaagatttgacgcgtgtaatttagatggccatactttgcctaacaaatgaaataaacaaatacaatatactagaaaatgatacatgataatactttttgttacctaaagtttctttgtaaagtatatataagttttatggttttatggttggaacgaagaagtcaaaagataatgaatgcactaatgcaccacatatacgtttgaagacactttttgacgcatgtttcagtcgaagtcaatcttttgcttctctagtctagaaataacttgtgtttattgtttaatgctcatctcttcacaaattatacttgttttgttgttgttaatacaaattatatatattttggacgatcgatgttaatttatgttaataaatattttctttgtagtaaattgtttagtaactcaccttcacccattttctaaccattgtcttggttcaagttccatatctacttacatataattgtactcttagggcgtgtttttttagtgtcgatgtaacacacattggtgacacaaaattcaaaggaaaaagagagtttaccttattttggactaatcggcagcttatttttttttttaccaaaacttgtatctccatcgagagtgtctttaaaaagccttcaagaatcggatcagagattgtagatctcgtaactagcattaacagattcgtttctcaaaaaattttggtaatgttttttttggctatcattgtatccaaaaacatagacacctaagttagagaatctttgaacaagagacggcgtttaatcctcatagtttgtcccaaatacatgttacacaccatgagcgtcttgcagctggtgttattcaagacgcaaagaatatatacataatcgatagtcatgtttctgaaaaaataagaaactaaaacataaatcgacaaatgttatgttttttgggtttttcttaattatatattttagtttaaattataaattgaaattgtttttctttttcttgggaataattttaaaaaataacaatcaaggttaattagtctttttacacaaatatctatatatacatttttgcagccattttgtgaaataaatcctgtagttgggacttatttacaatggctgccactgaattttaatgtttgtttttgataattaaaaaaaaatcttcgaaataaatatttgacatttaacaatcttccctaaatctctccacatcagttactaaaataaaactttcaaaatatttactatcatttaattacttcaaaattatcatttttgatattgcttttctccatgactataacaattcgattataatcatcaaatcgcagagatatttgatagcatttaattactacaaaattacaaaatatttagataataattcataaacatatcataaataagatcaacattaataaaataaatattttttttacgggacgggttggcgggacgggtttggcaggatgttacttaataacaattgtaaactataaaataaaaatattttatacatagatacaatttgcaaacttttatgtatactaacttcaaaaaataaattgtttccgcggtgtaccgcgagttaaaatctagtgagttagtatagttctagactgcgacgagagtcattttagttaattatgctaagatttaagtcataataggtaaatctcagtatatatatacgtgtatttttggataaactcttacctgtcgtaacgacacaaaaagaatacgcgccattaaatataaagatgtatatttcaaagaaattatatatatcttttttattgttaaaaagttatatgaaaaatgtattactataacattaaactaaacaaagaaactacaaaactacaaccgcgtattttaatgatcctaaatatttgttttgatattcaatattcagtgataattattgtatagttttcaattgtacatttgtgctgtcatcatatattcatttgatcaatatacatttttttaaaaaaaggaaaaatatattctgtgaactgaacaatctcttacctatactaaacaaatccaaattagattctaataactaaaagatattgatctttcacctacatgtcattaaaagaaaattatttgccatcctaatccacacaaataagcatatcgtatgtaatttactaattagagattagtacaaaacgttaaacaagataaaaccaaatgtgttgttgcttcaatcgtaaatctctaaaataagtgaccataattgctttttggacgatgccgttaactcaccgataactattgcaaaatttaacaacttgtcatttcataattacccaaaattttcattgacttcacatatctcaagaaaaatattttaaccaatcaaaaaattacttcttctttttttttttacttatttgtgaaaaaaagcttcttcttcaccaaacagtttgtctagttgtctgtgtctcatttaccatattttctctctaaatttttcccattactggatttgaagatcgtgtctggcagattttatctgattttctgatcagagagaagtaaaaggaaacaacttttttgttagctttctctctctacaagttttgggtttttaagagaaagagataaaggagacagctttctctctctgtctctctctaaaagttctgggtttagaaagagatctttcttatatgttgaatttgtgatcagaggtgagagagatg

SEQ ID NO: 31588 - DNA, 3000 bp, Unknown
  misc_feature (1)..( 3000): 2750-1469P.txt file - cDNA_ID_3043814; gDNA_ID_1971909; Annot_ID_177040
attccgtgacgtagacaattagttcattttcacataagttacgtattttccacgtgcataatatatttgtatgtgaaaatgaactacatggtgttaatagtgaatttgtaccgtaatgggttgctgatgggccacttttgcaaaatgggatgctatttgattatcgatcatgggatataagcgaaatacaactctgccaaccgggtcagccatattcaaagtcatccaacatgatttctagatttgcatcccttccttggatttagagaagatcattataagcattgcagtcacctgtcaccttccatgattatcagcatatcacaaacaagagaaacaccttcttcttctaaatcaatacttgcttgtttaagttttgaactagcaaagataatgatgcattttgttaagcaatgctgctcatgttgtgagctagattagctatagctgtcattatatttacaattaaccatcccaaaacttcttagcatcattgtaaggacgccgttaaagattgaatcatttaacgacttctaattggtctctatataaacaaacaaaaaacatgtcatagatgatagatgttaactatgattttcatatttctttcttgatcattactcggatgttaatcatcgagaatgtgttggagtgtatttgattcacatatagatgtacttatataatacaattatgtttactttaaatggaaactaattctttttcttaacaagaattgagaaattaaaaagataaagataaaagaaaaaacgttgttccgtcgcactttaatccatctgaaaagagttgagttaggcggaacatggtacggcgatgattgcgtgatgctcacttactcacgtagttgtcgggaatcatcaaggacacgtgtcgaaatgtgataggagagagacatgggcggtactgagttacggaatagaagaaggaaggagaaacaaagagctttataggtgaaagggaagcctaacgaatatttaacataagaaatggtcacaagcaagagtttggcacaaactactattccttttcctctcaaccataaagctgaacacttaaataaatttatatgttatattttcaaccaagcaacatttatcatataaattatcaacgacttaaagtatttatcataaatacagaattattttttttttcttataaaattatacaaaacatattaacgaaacgcctataacgacagattaatatgtatacttaggagtttattagaaaagttatacaattaaatttagattctaacactattgatgttctttagatatccaagtggtttttttaaaagtctttagcccattgatcatattcgaataattttttagttctcaaagtatgttttatagccaaagtttagactaaacattaacaagatattcatgtggtttactgcaatttataatttgttttaagccattttagggtttagttcaacgatactaaaataatacttttctattttagactatatgttatttaactaattaagttttgaaaagaaacaaataaaatttccaccttactctcattaatatattccatcatttcttagattggttaaatatattaaagtaatagattataaaacgagatatttcgttaaaaacaattgcactaaaataactataacgatattctgaaacaaatataagcttataattatgtcaaaaaaatttgtaagacctaaaaggttaagtaaattgaaaaatccaaaataggattatccatcatccttagagcaactccaaccattgacaccaaaacaccaaattttaacaccaaatttagtgttttggtattcatattttttttctatctccaaccataaacaccaaatcccacaccaaaaacaaaatttttattattatattattaaatataaatatttaatttaataatagttattttaataatttgataaaaactaattcaatttagaactgcttaattttaatttaattaatataagattacaatcgataaatattaaataataaaaaatacattacattgtactaaatttcagaattaatatattcggaccacaagtgctcaattaatgtgatatttatttcaaaaatttgtgcactttatcattttctattaatttaattaaaatttgatattacaaaaacaaaagcattcaaaaaaatattgatagtatacttgtcttttatttgaaaatcaacaatttaaatataaaactaaatcaaaaacataaatagaataatatatattttttagtgttttgtgaacaatgttacatcaaatatggcatccattatgatgttaggttggagaagaattatcaccaaatttagtgatttggcgtctccttggagatgatcttagtccttacttacacatcattaaaatccacaaccccatcattgcccatcactaatcaataaagggcattactaaacccaaaaacagattatcgaaacatacgtgggtccccacttcccccaagtcattttccattttcataaagtatgtttctttcccattatcacacatagccttacgtgtttcacttaaccaccatcgattcagatcttaaataatcaaacagtaagcataagagcagcgtaggtacactcgcgtcgcagaagatcaaaagtcaacgataggtcagagtaaggaaacctcgccatgaagtgaaagttaataaacaccgtagctcccgaggtacaagaaacagaaaaacaaatatatttatgtctgaaaacttgaataaaataataatatttatatatttaaatatgttgggaatattattaatttattaacaagaacacagtaacgcaatcacagactccacagtccaaggagttttgcatactcaccaagccacaatcatttctctcttctctatctctctggttttgaatcggcgacgactgagtcaactcggtgttgttactggtttcgtcgtatgtgttgtaactgattaagttgatg

SEQ ID NO: 31589 - DNA, 3000 bp, Unknown
  misc_feature (1)..( 3000): 2750-1469P.txt file - cDNA_ID_3043833; gDNA_ID_2936559; Annot_ID_194359
gacaaatctcattcctcgtgtgatcgaaagtaataatatagcttttggcactcacaggaatcgattcgaaatctgttggtactacttccaaaactttattttcacaagcatacacaaagatgctctagtattgttgaagattactactctagcaatgttgtggatagtggaccaaaagttaatggaccaatattcagatatttggttttatttttttgttttctatattgaaggttaattaataagtatgattatcacggttattcagggccggtccagaggtcacataaaccaatcaacgattagggctcaaaaaattataggttattgaaagttaaactttgttttgtttttgttctgattttttgacttaaattttatgaaactttctcacgttcttttcacttataagcttattacattcaaaaatgattacaaaaattataattttgacttttgagtaaggcctgccataaatttgtaaccggttctgggattattattagcatgagtaattcatgtataatgtattcgactcatttagaataaacattataaaaaatataaatatgcacctaaactagaaatctttaatagtttgatctaaatgattatacacgttgtagagaagtaatataatatttacgcatatatagttttaaataccttaaaatgttttcgaataaaaatattaactagccatataatccatgcaaatcttgatgatatatgtcttgaacaaattctattaactggctagttgtatattataacccatgcaaatcttgatacgtggcaaaacataaatttgacaaaattgatcactgagctcgacaaatcatataatttggattctaaaaccaaaggcatcttaaaaaaaaaatcaatggaggtgtgtagctacggacaaggtcctacggatagttacgtccgttttgtttgctaacgtaaaaagagcgacgcgggggaacgaagtaagtaaatgcagaatatgaataaaggaaagaatccaacatttgtaaaagttttaatgcgaacaaattagtatcatccataatactcttatcactcagattgaaagatttttttttatataaaaaaaactgtttttaatatatattcttcttctcgtggatcatatacatatgtaaagtttccaggtcacaatttggaatcaccttttttgttagatagtccaaaacttgaatatcaaccttttacttgagatgattccaagagtaccacttttatttacactaacaaaaactttcaagttccaacatattataacattccaagaagtgaatcattgttatcacttgtttttacccataggttatgtaagttacttatgacacaaattttacaattgcacatatataagagagatgtgacacatggacagtcacaactcacaaacagaaaacaaaggaaacaattgtaaatcgaaaccgaattgttataatgtttaatgaatatagaaatgtgtgatttaatttgtttattacatctcaatctaattctggtttgaaaatcaacctaaataaatctttcaggaacaacccaaaccggaaactcatagggacaaagtttattcagttatgcaaaaaaaaaaaaaaaggcagcttttggctttggaaaagctaagttgcgtcaggcaaggtaaggcaaggtaaggcaaggcagaaagtcagagagagtacaatgtcgcatgtgaaacctttgtgtcttgtctctttcactacccactaattctagtacttcagaaacaataagacaacaacactgtaaaatgtttaaggaaaattacacacttgagtaaatcagtgaacttatctgtttcctgctttgttggttctttttacctattcaactcaaagattcaaagttactttcatttgtttcactgactattcacagagagttaattatgatgatgccagtggaatctgtcagtgattgcttctccacacaacacactgtaaaaaagaaaggaaggtaaaagtgagaggcttttattactttcatggtgataacaagtaaaagaaaaacatgcattagaactcacaacaaatctctgtcttaaaatggttccagatatctattgcatcaacactttaattaaagtaagtgatctcatttgttctatttccatctttcaatctgtaattcctccacttctacatagaatctttatataagcaatagtgataataataaatgttaacacaagaaagaaatcaaaagggttagatcgtatataagcatctactctattcgtttgtttgtcctggtccatacacgtgataattatccatgtctaaaaaacaatatatatcaaacaaaaaaacagtgatcagatcctaagttacggtaaatgcatttccaataagagtctaccaaaagaagacctcaaggttgcaagcaaacgaattcaatagtcacatcaatttattaggagtactttttgttttgttcctaaacaacaaaaagattgttatgagtttaagcctatgtgtaaattatggaccttgatgtactattgcacacagtggcaggccaataaagacttcctcttaaaggcaaccaatgatatcatcatggtaaaaaagatcttaaatttgaaacaaattttcagattgaacttcaaacactaaactaggaaaactgatctttagttttcatattactatcaattatttcttgaatctaaatcaaacaaactaatgaaaatgtttttaatacttatctatgtaaatctctttttctttctttcccaaactttaatttttatttttctgagctagcacatcaacgtaatcatgcacttattccaccagagaaacgtacaagaacacagtggtccatctcccgactttacttcaccttttaaacccttcaatttcgtcaacaatatcatcaagtcccattcctcaaacattgcttaacctattagagtttccttcctccaacaaaccatctttataagactccaaaatg

SEQ ID NO: 31590 - DNA, 3000 bp, Unknown; identical to SEQ ID NO: 31589
  misc_feature (1)..( 3000): 2750-1469P.txt file - cDNA_ID_3043833; gDNA_ID_1971910; Annot_ID_177102

SEQ ID NO: 31591 - DNA, 3000 bp, Unknown; identical to SEQ ID NO: 8878
  misc_feature (1)..( 3000): 2750-1469P.txt file - cDNA_ID_3043857; gDNA_ID_1971910; Annot_ID_177094

SEQ ID NO: 31592 - DNA, 3000 bp, Unknown
  misc_feature (1)..( 3000): 2750-1469P.txt file - cDNA_ID_3043861; gDNA_ID_1971910; Annot_ID_177092
aacagtgggatcaaattcaacaattccatctcccaaagaggcttcgttttcttcagagatcgcatagagttgtggtggaggtgtaacatagggagtactcatcacttttaccttcgtatccatccttgtctccgagtcactgatagacaaatgggaaacttttttatttttcatgacggaagtctctgaatcttttctcgcagaaacctctgacgccaaagagcacaccgactcatccctgcctgaacactcaaccagactaccagatcctgattccgatatgttggatacgcttccattgtcatctgcatcttcaggctgcaactccttcaagaatttattacaccacatcttgtagaatgagattcctataaacagattggcccgtggaagcattgcgaaatcacggttctgcattaagctaccaaaagataaagagaatcatcaaaaccaattcacacaagaacgtagcaaaccaccctcaggaaggtggaattacacattggtggataaaagactgactatctccagataattagctgaacatacaaaactatcatacacattacaatataacatatgcattaaaaatgaaatcctaacatccaatttaaaactagttcaagaagatatcaattgtacctgattacagtactataggcctcattgttcatctcatgctcaataaaatgacaaatttgctcgtaccaaaccaagagcctctcctgtccaaatgatcaagtaaaccaatgttatcatccagccatagagcaatattcaatcaaaatgctatattgtccaataactacaagttaaagaattacaaatctaaaaaagggacctctttatgttgtttaccaatctgcccaatccaagtatcatatattcttccaatctcatcagctttgtttttattagtttccgagtgactcacaatttgtatatgagcctgccaaacaaaaaagaacacaataagaaacagagagcaacaaacactgtttcgatctttgagagataaaagcaaacctcgtatttgaggcgattcatcttcggacaaggatcgttaattgtccctttcatcagaacagaaagcacacggcttgcatcattccagtgtctattacgaagtagctcacgaagtaatcctggtaatctattgaggtactcacttcggcttgactttggcccaatacatagaagataagatggtttcgctctgcagcgttgaattctcttgtacttttgtgtatcagagtcgatttctgagctactcacgcgacgacgcttagctttaatcttctcaagcttatcagttttctcttcggtttccactttaatcttctcaagcttatcagttttctcttcggtttccaccattacccttaatccctaaatcttggtgtgaatcaatatacacccacaagttgcagaactgtgagctcggaggttacgatttcggcgagaattgctgaacccaggaggaggatgacgaagaagacttgtaagagaagtttaaaagtcacaaaaggatgaagcttttctcaggtgagattaggggttttccaaaaccctaataccaccaccatagaaacagcaagagagaagaaaggtgcaaggagatgtcttctgacttttcagatttcgctcctttctttatgggctttaggccaatactaaactaggcccaattattgatctcattcgaaaatacccaaacatgcgtgttgttttttttaaagacaaaactacgtgacgttttgattctttgacattactcaaacgcagctcagcgtcagcgtcttcaccgctcttttggtcaacactttcgtttgatatttttctataaatacagaattcagacaaatcatattttaaatagttatgatttttgtatggtatctaatctaactataatgtcggcaaaattgacaaatatttgatttttgccctctcttaagctttattattacaagtgtggccgcgtaatcaaatctggtaataatgactaacgaacgtttctaagcaaataaaacgtacggttcccgaatcgcccttacctacttttatttcattttttcagcttctgcctattatattgttgcgattgaccccgaaagttttttaagttgagactaaggtcaaataattttttaactataaataaatattgcaagaaaattaatttatgctgtatatatagaaaaaaatcagcctctcataaataaccgaaattttgaaaaaagtagacatatctaccccacaaaaaaaaatcatcataaatccggatgaattgatgactaccttatctgtttttgaacttttatactagtggagtatttaaatttatatagtatttaaatatcaaaatgctaaaaaagaaaataaataaatgctgaacaaatccattgttgaatttgaggaatcccattaatgtagggaagaagtacttgtagtacccaatacgtttacttttactttttgtagtgggcaaattttatattgttaatttattaataacacaccctaataagtaacaactaattttggcatctttcttctagatgtaaccaaattttgtattattaataacttacactaacaaatttatattcccccttttcttatacacccaaattttgtattattggtatattcctaaattgactaattaaacataaacagaagaaaatcttggaaaaaatcaaacgatttggtacttactacataaataatggtgtagtgccaaattaacagggctaaaatggtaattagtcactgccttcttcgtcttccttattagctttatcatcttctccaaacaaaaaaaactgccccacacgaattacacacacacaactttattatctgtacacgtatatgtgtgtgtgtatatatatacatactcatccacaaaaactcgactgattgatttctccatgaacaacgtcctcctttgatttcacctttttttgttgtcttcttctttcgaaatcaatcatg

SEQ ID NO: 31593 - DNA, 3003 bp, Unknown
  misc_feature (1)..( 3003): 2750-1469P.txt file - cDNA_ID_3043873; gDNA_ID_1971910; Annot_ID_177086
ttttaaaattagacatttcattattaaagtaggattatttggaaatataataaataaaacgataataaagtaggattatttggaaatataataaataaaactacttataaaagtaaacacttcattaataaaattaaataacataagatttaccagtgcatgattcttacctatatatatatatatatatatacaaagtttgtagtgaacatatatataattatttatacaagaaaaaatgagtatgaaaaaatgtgttgtattgatggtggtggtgttggtagttatggtggctatggtagatgacgttgaagggcggctttcatatgctacatgcatggatctttgcgagaccaagtgtaactttttttttacacatccagaaaaatactgtaaagataaatgtaaccgcaaatgtcgtagacttcaatcatctcagtaataatctcttcatttattttattgaatttctttttttttctttttatgttgtgtgtataaaatttttgacataaattatatgaaaaaattgcagggtggagactataggaatgagaaacataaatggataaataagttgacaaaatagttgatatatttgtaaacttgatgaagctttcatattaataacaatttttttttagaaatttaactctttttttgcaactatatatgtgacgtttcaaaattaaaatacatatcaattcttcatccattagtaaaaccgtaatataactctcatgtatattataaaagattgcagaatgacatagttttctatagttacattttaatctaagaaattgtaaaataagaggttcgaaccctgttttagttttaaaactaatggtataatgatgtaactaagtacatattttagctataaaacttataagtacttcccgattaatagtatcagattttgcattaggtgagttatcattttaagccaagacatctgtaatgaaatgttcttgaaaatccgacaacttgtatgtctctttcattatctttaaatcataaaaagttgcttcaatgttaagagttaagacacaaaagcaatcgtgttatatcattgtctcttgattccacacaaagccaactctcatatttattatcttcatctcctttcaaaattaaaaagaaaatatcaaaagaagatagaggagtacaaaccaattttttagggttaaattttgtattataaattatcggactcaaaatgttcatcaatacaaagcaatatatcatcaatgcaaatctttactttgcatcattttcaacatgcaaatctcatcttcacttgaaaaccttcctttggttcttctccttcatgtctttgtatgcaatatgggacattatacacatattttttcatcgattgagtaatctattttaaaaatatttgaatcacattatatgcataaaaaatctaatattttattaactataagtattttatagaaatttaaaataaattaaataaataaagtcaaataaaagtgaaagaagaatcatatatttatgtttaaattagatagataggttttaaaaaattagcaattaataaaaaaggcaatgtttgtggagtgctaaatcttttattttgatattttttgatatttttatattttaataaaaaaggcaatgtttgtggagtgccattgtaaataagttgaaaggctaaagttttttttatctcaaatatctccaaaattaattatatcattttaaaatatattaaataaactatttataaaaaattataagatttagaaattagttctaaaattaaacatttcattaataaagtgggattatttggaaatataataaataaaactataataaagtaggatcatgtggaaatataataaataaaacgtaaacatattattaatgacattaaataacataagatttaccagtgcatgattcttacctatatatatatatatatacaaagtttgtagtgaacatatatataattatttatacaagaaaaaatgagtcttaaaaaatgtgttgtattgatggtggtggtgttggtagttatggttgctatggtagaagaagtagaagggctttcatatgctacatgcatggacctttgcgagaccaagtgtaactttttttttacacatccagaaaaatactgtaaagataaatgtgaccgcaaatgtcgtagacttcagtcagctcaatcatcccagtaataatctcttcacttgttttatttagtttgattaaaaaaatattttgtataaagaaattgacatgatttatataaaaaaattgcaggatggagactatagaaatgagaaacataaatgggtagataagttgacaaaatagtcgagatatttgtaagattgatgaagttttcatatcaataaaaatattttttaaattataaaacttttttttataccaattataaaagaagcaaagattaaaagaagatagaagagtgaaaaccaacatttttggtttacttttgtagtattataaattatcggactcaaaatgttcatcaatacaaagcaacatctcatcaatgcaaatctgcactttgcataattttcaacatgcaaatctcatctactccactcggaaaccttccttaattgggttcacaacttcataagttcacatcatagatctgtgttattgggctgttttatggcttgtaaaagttggactagacccactaatcattatagcctggactaggcatgtattttcttttctttctcctacaatattatctctcatcaatacatcaaaaccacaacaagtttatgaacaaaactctgaaccgggaagttgttttctgataaaccaaactacacgccgtcttgagttgattgatgacgtgttaaaagattaatggctgattgtcattttccatccaatcacattaaaacacgtcaggataaagcccgtttcatcactgcttctctttcatcaaaagttctttaaggaaaaaaaaaaacgtcaatg

SEQ ID NO: 31594 - DNA, 3000 bp, Unknown; identical to SEQ ID NO: 8882
  misc_feature (1)..( 3000): 2750-1469P.txt file - cDNA_ID_3043879; gDNA_ID_1971910; Annot_ID_177079

SEQ ID NO: 31595 - DNA, 3003 bp, Unknown
  misc_feature (1)..( 3003): 2750-1469P.txt file - cDNA_ID_3043883; gDNA_ID_1971910; Annot_ID_177077
gcttccgtaagcatccgcactagtaaagtgtccaaatggatgccgtcaaaacaacaaaagtgttttaaaaaagaaccgaaacaagttttcacacttggtccttagcttctcaaactcttcttcgtcctgataatggactttaattatcatgttatacgtcaaccaagttatcagctaaccatcatcactttattaagtatatgcagccttgtgctcataatattcattatattatactaaaagtctaatcatatgaagaaaggaaaaaaaaaaaaagaggcttgtttatgaaattaaggagtgcacgtaaggccatatttataattctatttcagaaaatgtaaattcaaacacggcaaatatgttagtttcatggtgcatgcatgatgcatttccaactgtttctttttttggggatgaaaatgtatttccaccggttaattaacgaagcttctatttcatgtttccgttttcttttactttttttttttgtttttacttcatatatatcatttgacaaagttaaggctttaaaatggcagtagtttcttaatttgtttttagattttggatttatggtgtttagttcttagtttttttttgcagtaaatttttagttttatataaatgtatgtacccaatacatatcactatatattttatagtccaaaagaattttatgtgatggtgaaaagaaaaaaatgtgtgatcattcgctgaaattaataaattttgcagtatattaaagaaaactagaaaagtgagtacctaatattccaacaattagactgtatcactcatgcctgtcgtctgtcgactgttgacttgtgttataataaagacatttcaaattatccgaatattccattagcacatatgaagatatccaatttttgaataattggagtcgaccaatgtaaaatattcataacgtgacatcacatcacatacatgtacgactttgtcacttaccaaaaatgatctagttatgataataacatcatcacatgagtaagaatgataaggcatgatctaatcagcatcatataccgctactttatttactatcacattttcgttcacaagagtaatattatatttgattttatatatgtctaaaaatttatcgtagactgccgattttagattttgggaggttagaagaactaataaaaccgaaagaaatagatgatggtcggttaaatacttaagtcctttataagaaagaaaaattaaaagtcaactttatcgctgaaagtgaaagttaggttgaaagttcagagatttattcatcaacttccgtgcattgacacatgctcttctctacattcgctcacgtgaattttagaacaacaaattattttacaaacactataatcttccggtaatttaaccacaataaagagataaataatctttatattaaatcgatcgaattctaattctgtaggtactgtgagtcaaacatgaaagtgtaaattttcaaaatatgattggtgttaacttaggtgaatcaatttttgatgtttttttgttgattatataaatcaaaattacggaagaatgcatgttgtttacataagtgatataattaattttttactgatatattaaaaataaaaatattttatgttattgttttggttatttttttgttccacaaaaattaattaatcataatatttctttcttgactatcactagattcaatgaaaatctctcttttatacataaataaaaatcttctcaatgcattaataaatatatataaattgaggaaaaaaagagatagaaatcatggaaaaaaaggttaaaaattccaactataagcgagcatcacatatagaaatagaataatgtataggaatccatcatgatctcactctctatatataggtaagccaagtatcttatttttggttatgtatctctgaaatctgaatctgactgacttcaaaggacacagcttttacttctataactggttagcttctccacacacacacacacttgttagatttacttttcctccgcactatcagcagatttttctcatctgggtctgtttgtttctgttgactcaaagtttccgactttcttattttctgtctccgatttcatcgccgaaatctcagtcaattttgtctttagatctttaatttttggatccctttaattattttgtttggtcttacttcagagcgaagcaggtgaaaaaatggcgaatcggaagttagagaagatggcatcgattgatgttcatcttcgtcaactggttcctggcaaagttagtgaagacgacaagcttgttgagtatgatgctttgcttctagatcggtttctcgatatcctccaggatttgcacggtgaagatctccgtgaaactgtacgttttctccattttggatttgacccttttgctataagatcctgaaactacatgctctgttttgagtattgactaaaggtttcaactttttttgattcgatcatggattagattagttagggttttgaaacgcaggaagatttaaactttatgttagttttgagattagtagtttcatgtgatctaattttgatgatcttattgtgtgtgttgttgtatataggttcaagagctttatgagcattctgcagaatacgaagggaagcatgaacctaagaagctagaggagctagggagtgtgctaacgagtttagatccaggagattccattgttatcgctaaagctttctctcatatgcttaacttagccaatttggctgaggaagtgcagattgcttatcgccgtaggatcaagaagctgaagaaaggtgattttgttgatgagagctctgctactactgaatctgatcttgaagaaactttcaagaagcttgttggagatctgaacaagtctcctgaagagatctttgatgctctcaagaatcagactgtggatttggttttgactgctcatcctactcagtctgtgagaagatcattgcttcagaaacatg

SEQ ID NO: 31596 - DNA, 3003 bp, Unknown
  misc_feature (1)..( 3003): 2750-1469P.txt file - cDNA_ID_3043916; gDNA_ID_1971911; Annot_ID_177136
agcttctttcaagtccatgaaacacgattttaccggaggcgttgagtctcggactatccgccgtcacggtgagaccccgagattcgatacacgccgacgatgatgatgatccgtcaacggaaggcgtcgacggtggatgattccgtcttggtttggctaatctgattcttggttggttaaggtttcgtgaatgagtccgcgacggagcaaagggattcgcacttggtttatcgaggtcaagcgagagtcttggaagatcatcgatctcgtggctagaggaagacgatgaagagagtgagagacgtgaagatgcgactgagattgattcggagatatctgattctttttgcaacggcgacgatgcggcggtagaagatttagatccccggtgaagaaattgcttaaacgatgacgttttggggtttgtggatgaagaagaagaagaagctttaatagattcttcttgttccttggcgttgacgagtctcttgagacctaaaagctctctccatcgagtcgtacaacgaggagctttaggagagaagaggtcagagatctccatctcaagtctccggcatgatttcagaacctctggtgatcctcttggttcggtggtagttgtgttgactgtcgttgacgtcgtcgtcgtcgtcgtcttagggccagagaacttcaaaggtacgagctttccgtcggagaagagctcatcggcagagagcattgtgaccggatcctcaaggcaaaactcgaaatccacaactggatcttggatttccggtaatgggtcagattgttgcttgtcaacggaggaagagcgtctgttgtcgtctctggttaaagacatccgagggctcgtccatccgtacgacgagaacttctccggcgaaacaccggcacttttaacgcaagcggaagccattaagtttgtgtgttggacttgttgataggagaaaaaagaagaatctttggagcatttgccggcaaagaactatgttaagagttagggagagaagtgggagtgacagagacaagcattatatacacagctcactctcaggtacaccgtacacacttgtttcatttaccggaaccattcgggtcggttgtttttaatgggccgggttcacctatcttatgggctcagtattatttgaccctttttttgttgtcaatgcttgtgttattgatagagtgaatgactgaatgttatgaaatttagatctggttcgtgtgagtatttatttttataagttttttttttgttattatgtgaatcgagtattattttttctcattatggtcacctaccaaccaataattgagtctgatcataggcacacgtttcgtgtattcatgcatataagcattgttttctttcaccaaaaacaatccctctttgattaagaaaaatatggtttacatccatagctaatcaatatgagaacacaaatctttttttataagaaacgataacgttacaattctagcatttcaaagcagaaaatatgttctgtcttaaaataaaataactagaattgcaaaagcttaagatcaaagagcttagcggcaagagcggatcaatctttatattatgataccattctaggcaactcttgttgagtttccgataaatggtgagcaatatagattaacatacgtattgcatgcccatattatgctttctaatttgagatgaagccgatacgagacaaaatctacgaataagcaatatatacatatttataacaaatcttcataaaactttatataagtatgcattacacatttcattggtgtaacctgaaaatgcaattcttagtcaaatttgataaaaataattaagagatacgatatacagataaattgttaatagttaatactgtcttttggaacctagctagctcctttccacaacgataaaagattccaaatcacattctatataattatgttgtcatatatgatatataaattatcataaggttgtgtcatattgtgggtattggatattactattcttcaatcgaatatgtaaaatctatgtcaaggaaatatcggaagggactcttggagtgacttgctatctaacataaaatctatatctcacccaccggtcgaatatttgtcttgattcaaaatttaatcttggacatacattaataatagcatatgcatggcctagattgcgatgtaaccatgctctacataataataatgataaaattttataaatcatttcaattacaaaatatacatttaaaatatatatagttgaatgatactttacctaatacgatattaagatgtattttctcttattgttcgaaggcatatccgaataaaattttggcatgcactgtcttttcctacggtgataagccttgatccgttagaaccctcagccgaaataaacttatcaaaaaaacaaaaacaataattcgtatgcatgggctaaaacatacaatattgtatcataatggaatgcacaataccgcacataatccaagaactttggttctatccaatcgaacggagaggaactataactccgatcaaagtacagttgaaattaaatagaaactcaaatagcttttgtctctatccaatattatcaaaaagttaatagaatcgaagtagtttgaccaagtcaactacaaacaaagcttttgttagttgttgttgtggccatcacttctacttctccaatgtcacaaacgacaacatcgaacccaatactttcactactctttcattgaatcttacatctatatatatggaccagcttcttcttcctcttcattattcaataatctctaataaacatgattttagttagttaacattcattattgttgttctaatcgctaataaatatttcaaatcatttaacgactactagcatgtaaacattaattacgatgatctgaggtaatggcgaaaacgacactggctttgttttatacacgaggcacagcaatgaaatagacatatccacaattaatg

SEQ ID NO: 31597 - DNA, 3003 bp, Unknown; identical to SEQ ID NO: 31596
  misc_feature (1)..( 3003): 2750-1469P.txt file - cDNA_ID_3043916; gDNA_ID_2926287; Annot_ID_205441

SEQ ID NO: 31598 - DNA, 3000 bp, Unknown; identical to SEQ ID NO: 8885
  misc_feature (1)..( 3000): 2750-1469P.txt file - cDNA_ID_3043928; gDNA_ID_1971911; Annot_ID_177132

SEQ ID NO: 31599 - DNA, 3003 bp, Unknown
  misc_feature (1)..( 3003): 2750-1469P.txt file - cDNA_ID_3043940; gDNA_ID_1971911; Annot_ID_177129
cggatttcacccgtagtacaccattccatattaatatcgaatcaaacccgtcaattctatgatttcacctgtggtagtatttaattgtataattatattttaattgtcattctatgatttcactcctaattctatcgcaaattattatcaacccaaaccagacaattctaaaatattccgtagtacaccatcccatattaatatcgaatcaagcccgtcaattctaggatttcacccgtggtagtatttaattgtataattatattttaattatcattctaggatttcactcctaattctatcgcaaattcttatcaacccaaacagtcaattataaaatttcacccgtagtataatgtttaaatatttataatgtttaaatatttataatgtttaaatttcttataaaagaatcaaaatgtgttttaaaaaaattaaagttttaagtttttttttttaatattgttaattttgtttagtgtttaagattatataattatattatgattgttattatatgtttttttccatagcatactatcccatgttattatccactcaaacccgtcacaccatataaccccgtcccgtgaaattaaacacaaatttgtcattttattataaatttcaaatatttataaaattagaaacttcaaaaaagattaatattgacccaaacttcatcattgaattttgagtgttatatctaagatttctctcgcagtatatcgtcccgtattaatatcttttatattgtttaaatttcttgtaaaatttaatttataattttttaaactttttaaagtttcaattttttaaaataaataaccctagtaaacaaaccattttaattttggacacctcataaatcaagtttcatgctcattcgtaatcgaaatcattttggtcctttttatagtatggctcttgaccattgtccaatttttttaagcgatgtgggacattctaaaatcgtaattattatccacccaaacccgtcctaccatataacccagtcacgtgaaattaaacataattttgtcattttcttataaatttcaatattataaaatttggaacttaaaaaaatacaatatcgacccaaaattcatcattgaattttgattgttatatttaagattttttctgtaatatatcgtctcgtattaataaattttttatatatttataatgttaaatttcttgtaaaattcaatttataattcttaaaactttataagttttaaaattataaatatttaaagcattttttaaagataaactttataaaaaaatttaaaattataatatttaacttttgataaagttataatatttataattttttgagacattttaaagtttcaattctttaaaataaaaaatcccagtaaaatcggataactattttaattttggacgcctgataaatcaagcttcctgctcattcgtaatcagaatcattttggtccttttataatatgggtctgaaccattgtccaatttttctaagcgatgtgggacattgtacacatattatttcttcataggttgaataatatatgtccatttaaaaaaattagaattacatcatattcagaaaaaaatataatattttattaattatatatattttatataaattcaaaataaataaagtataagatcaaataaaattgaaagaagaattatatatttatgtttaaattaggtagaaatattttaggaaattagttaaggtaaataagaaatatggttagtttagagatattgtttatattaaatttggtaattaaatcattaattttcgtttttaattattagtttttaggtaacttttccaaaaattaatgttatctaagatcagaacagaattaaacatgttatccagaatccgaacagagttaaaccgggtaaaacccacccatttgaattaattgttgaattatggctcaaatcttcaacattatcttcaaaaatcccctccaaaaatgtatatatagataacggaaacaagattaatgtatcatcattcattccttgttgatttaattaaacagatgaacaaatgatatgtaataataaggtctcggtttacagtgaaagtgatttaatttagtatctttgttacttcgattattgaattgagcgtgtgtacttatgaagattaaatcgatgatgcatgggctcatgaagattaaaaaactcaatagacacttaaccagaattaatgatattggcccgatgagtattggcccattaaggcccattaagagagcgaaaaccctaaacgagaaacaagggatatactcagagcatcttccttggttactatataataagctttaggctgctagacgcctgcctccttgcacctcttttctttctctcgttctcatctttctctctaaggttagtcccttgtgtagatcctctcttcatcgattcaatttcatcttccttggtttgatttaggaattttgtcacgatttggtgtttagatgatggagtcttgctgttgatctatgtttatagcactttgtttccatggttctgttgtttcttaccgtttgttgtgcatcgatctggttttggtagatccctcgtagataataatctgaatatgtcaaagttttcttacaagtctgttgtgttttcagttttgattgatattgttatccatgtagtagtcgatcatccaaaaactggttcagtgtgattctccgatcatcgccgctgattttatatttatcatcatgtatagatttgcaggttttattttgttcgttgtgtgtttttgttctttgttaaatttaacctctatgcatttgatgtacatgtttttgtgttggtctcagtttctcttattctgtataagctaagctaaagtctccatggttagtgtctgtttagtattaaaatatttcaatttgctaattctttatgtttttgtgatgatattgcagagattttgtaggtgacaatcaaaagtttgacaaaatg

SEQ ID NO: 31600 - DNA, 3003 bp, Unknown
  misc_feature (1)..( 3003): 2750-1469P.txt file - cDNA_ID_3043958; gDNA_ID_1971911; Annot_ID_177124
taaacccctgaaaccctagtttcgttcgttgtatatttcttctcgctcagtaggtctttagggttttagtttcttctcctcaaaaaatggcgatgtatgttatctacgagtcttcttccggctatggtctcttcgaggttcacggactagatgagatcggacagaacactgaggcggttcggacttctgtctccgacctcagtcgctttggccgtgttgttcagctcacagcgtttcatccctttgagtctgctctcgatgctctcaaccaagtcaacgccgtctctgaaggtcagactcttcattactctcttcttattctttgttctgtatattcatgtgttgtgttgagtagcttgttcttgtatttagagctagagtagacacttcgatttaaaaccttatagttcaaatttcctggatatattgtagaaagagctttaatttatggttgattcttgtttttgtgttctgtttttgtttcattgttttggttttgtcattgatgcttttggaattggttttaatgtgatattggtaggtgttatgactgatgagcttagaagttttctggagttgaatcttcctaaggtcaaggagggaaagaaacccaagttcagtttaggattggctgagcctaaactcggttcacatatatttgaagctactaaaatcccatgccagagcaatgagtttgttcttgagcttctcagaggtgttcgccagcattttgataggtttatcaaggacttaaaggtgtgatctcctttctatgtgtttaaaatctttttgtctgtttgcttatctcatatggtttgtgttctcataaaaaatttctgtttatgtagcctggtgatcttgaaaaatctcagcttggattagctcacagctacagcagagccaaggtgaagttcaatgttaaccgagtggataacatggttattcaagctatcttcatgcttgacacgcttgataaggatatcaattcctttgccatgagagtcaggtttgttttgtgcttttccctttcagattgtgtgttttcctcgagaaaattggtagctgaactgtttataatgttattacagggaatggtattcgtggcacttccccgaactagtgaagatagtcaatgacaactatctttacgcccgtgtttcaaagatgattgatgacaagtcaaagttgactgaagatcacatccccatgcttactgaagtcttaggggatgaagataaggcaaaggaggtcatcgaagctggaaaagcatccatgggtaaaaattttgagctgacttttttggtagctttgagttaatgtgtgtttctgttaacttatgtcctgagacatttactctcttccctattggcaggctcggatttatcaccgcttgacttaatcaacgtacagacctttgctcagaaagttatggaccttgctgactacaggaagaagctctatgattatcttgtcactaagatgagcgacattgcccctaatttggctgctttgattggagaaatggtcggtgcccgtttgatttcacatgctggaagtctgactaaccttgctaaatgcccatcttccaccctccagattcttggagccgagaaggctcttttcaggtgcaatatctggcactatatttttaatgttcaccagtttccttttagtgctgcttgtgacatgaactgctgtggtatttcagggcacttaaaacacgtggaaacactcccaagtatggattgattttccattcttccttcattggccgagcatctgctaagaacaagggccgtatcgctcgttatcttgcaaacaagtgctctatagcatcccggattgattgttttgctggtaaaaatctgaaactccttgaagaagagttttggattatgaattctgttgtgaaagtgttaaattatgtgccctgatgtcctatgcagatggtgcaactactgcttttggtgagaagcttcgcgaacaagttgaggaaaggctagaattttatgacaaaggtgttgccccacgcaagaacgtggatgtaatgaaggaggtgatagagaatctaaagcaaggtatttcttgtagctgtttttttttggttgtaatcagagtcctctttatgatggcaaactcagtgtttttttatctgttcctcctttagaagaggaagggaaggagccagttgatgcctcggtgaagaaaagcaagaagaagaaggcaaagggtgaagaagaagaagaggtggtggcaatggaggaggacaagtcagagaaaaagaagaagaaagagaagaggaagatggagactgcagaggagaacgagaaatcagagaagaagaagacaaagaagagtaaagctggaggagaagaggagactgatgatggtcacagcaccaagaagaagaagaagaagtctaagagcgctgaatagaaagggatgcaacattaacaaaccctgtattgtattttttttttgagctaaattaatgtcgtctgtttttcgtagtgaacatcggagaatttttgttttggtctggaaacgattcaaggtttggcaatatcttaagtttgtttaggttttcactattttgacgtttgcaaccgtgaaggaggctcctccattttataaaatacaattaccaattccagtgctttgcaaatgtttcaataatagctaaactaactaccaaattggaaaactagcttaacaagtttgtgaaaatgaatttggagccatatgatttattattttacccaaatggagtaatagaagaagagcagctcgcgtttgaatggtcagttaacattaacaaaaggtaaaattgaatagatgttaaaacttgtgtaagtaaacaatagagctacctccttttgagaaggatagataaactcgtgaccaaccacattcccagtcccatattcttagtacaaataagaaattcacacccctcaaagaaatataacataatcaatcataggaaatatacttcgcataatg

SEQ ID NO: 31601 - DNA, 3003 bp, Unknown
  misc_feature (1)..( 3003): 2750-1469P.txt file - cDNA_ID_3043962; gDNA_ID_1971911; Annot_ID_177123
gtaacaaaaagataccctcacaaattatgttctccatgttgaatgtgcaaacatatggacagggctccaatgtcttattggaaaaaaattgttttaagactttcgctattgactggtgtctagattataacttttcgatcaactgcggaggcccagagataaggtctgttagtggagcactatttgaaaaggaggacgcggatcttggaccagcttcgtttgttgtgagtgctgcaaagagatgggcagccagtagtgtaggaaattttgctggcagtagcaacaatatatacatagctacttcactagcacaatttatcaacactatggactcagagctttttcagtcagcacgactttctgcatcttccctaaggtattatgggttggggctagaaaatggagggtacaccgtaacacttcagtttgctgaagtacaaattgaaggttctaactcttggaaaggtattggaagacgacgttttaacatttatgtccaggtctgcaccacttgatcgagctttccggttcacaaatgttactttttggttctgatgaattctaagatctagctccatttttccagggaagacttgttgaaaaggattttgatatacgcagaacagctggtggctcttcggttcgagcagttcagagagaatataaaacaaatgtatcagaaaatcatctcgaagtccatcttttctgggctggaaaaggaacatgttgtattcctatccaaggggcttatgggccattaatagcggccgtcagtgcgacaccaggtaacacaaacggttgatatattttttttcctctgattttcactatctcccgatactagttagtgccgtgtcacatattcttgttcagatttcacaccaactgtggctaataggccaccatcaaagggaaagagcaggactggtactattgtgggtgtcattgttggtgttggacttttgagcatctttgcgggtgtggttatcctcgtcattcgaaaaagaagaaaaccgtacacagatgatgaaggtacagatgtaataagaacataaacaagcccttgagctgaataactttagctctctgatcaaaattaaagttgactatcatctgttaaattggttgattttaagtagtgaattttttatggcagagatacttagtatggacgtaaagccttacacctttacttactcggaacttaagaatgcaacacaagattttgatctctcaaacaagcttggagagggagggtttggggctgtttataaggtaagtcccttactgaatcgaacaaaatagctgtatatttttctgagatactaggaaagaagggtacatgtaataccttttaatacgttttgttttgaataacacgttcaacagggaaacctcaatgatggaagagaggtggcggtgaagcagttgtcaattggatcacggcaagggaagggacaatttgttgcagaaattattgcaatttcttcagttctacatcgcaacctagtaaaactttacgggtgctgctttgaaggagatcatcgtttgctcgtatatgagtatctccctaatggaagtctcgatcaggcattatttggtaatgaacagaaacatgacttacctatctctgcttctgccaagctaaagtaatcattatgccattgggttggatgttacaggggataagagtttgcatcttgattggtcaacccgttatgagatatgtctgggagtagccagaggtctagtttatctccacgaggaagcaagtgttcgcataatacacagagatgtgaaggccagcaacattttactggactctgaactggtcccaaaagtttctgattttgggcttgcaaaactatatgatgacaagaaaacccatattagtaccagagtggcagggacgatgtaagcaaaatccatagaccctgacattttgtttgcaacacaattatggctttatagctcatgttagttgtatcaatgcagtgggtatcttgcgccagagtatgccatgcgtggacatctaacagagaaaacagatgtgtatgcctttggtgttgtggctcttgagctagtgagtggaaggaaaaactctgatgagaacctggaagagggaaaaaaatatcttcttgaatgggtacgtctatatttgtcatataggcgaagttgaagatggtgtgataaatgacaaaagccgataatccttttgtatttcttgtatacaggcatggaatctacacgagaaaaaccgtgacgttgaactaatagatgatgagctaagtgaatacaacatggaagaagtgaaacgcatgattggcattgctctgctttgcactcagtcatcttatgcgttgagaccaccaatgtcacgagtagtagccatgttgtcaggagatgctgaggtcaatgatgccacctctaagccaggctacctaaccgactgtacatttgatgacaccacaagctcctcattcagcaactttcaaacgaaagacactagcttctcgacgagctttatagcgcctggcccggagatgccacttagagacggcgaatcgaagccaatggttggattcaagatcaaggagggaagatgaagattgtcccctctataatttgatatgcttgtatatggaagttgacaattttcttctatataaggatgtggagaaacagatttcactttcattcaataataatattttagttgacaatttttcaatttttgtaacaaacttttgatatcttgcaaggatgaccaaaaaaaaaaaaaaaaaaaaaaaaaaagaaagttaacctgttgtgatgggccgggcattttataagctagtacaactaacacaccgttaaatgggcctggcccattgaatttttcaagagcagcgccatcaacagatgcgcttattaaacccctgaaaccctagtttcgttcgttgtatatttcttctcgctcagtaggtctttagggttttagtttcttctcctcaaaaaatg

SEQ ID NO: 31602 - DNA, 3003 bp, Unknown
  misc_feature (1)..( 3003): 2750-1469P.txt file - cDNA_ID_3043966; gDNA_ID_1971911; Annot_ID_177122
atgatggaagagtggtcgcggtgaagctattgtcggtgggatcccgtcaagggaagggacaatttgttgcagaaattgtagcaatttcttcagttctacatcgcaacctagtaaaactttatgggtgctgctttgaaggagagcatcgtatgctcgtatatgagtatctacctaatggaagtcttgatcaggcgctatttggtaatgaacagaaacatgacttatctatcactgcttctgcgaaccttaagtactcatttatgcccttggtttgcatgtttcaggggataagaccttacatcttgattggtcaacccgttatgagatatgcctgggagtagccagaggtctagtttatctccacgaggaggcgagtgttcgcatagtacacagggatgtgaaggccagtaacattttgctcgactctagactggtcccacaaatttctgattttggacttgcaaaactgtacgatgacaagaaaacccacataagtacccgagtggcagggacgatgtaagtaatccacaaactctgacctttggtttgcatcacaattacaaattagtgagacatgttagtgatgttgctgtatcaatgcagtgggtatcttgcgccagagtatgccatgcgtggacatctaacagagaaaacggatgtgtatgcctttggtgttgtggctcttgagctagtgagtggaaggccaaactctgatgagaatctggaggaggaaaaaaaatatcttcttgaatgggtacgttcttgcttattatgattgattgtaaatggatggagtttagaatggcaaaagccaataatacttgtgtattttctgtatacaggcatggaatttacacgagaaaagccgtgacattgaactaatcgatgataagctgactgatttcaacatggaagaagcaaagcgcatgattggcattgctctgttgtgcacacagacatctcatgccttgaggccaccaatgtcacgagtggtggccatgctttcaggagatgttgagatcggtgatgtcacttctaagccaggctacgtaagcgactggagatttgatgacaccacaggctcatctctcagcggatttcaaatcaaagacacaacaggctattccatgagccttgtggcgcctggctccgagatatcacccagagacagcgactttaagccaatgcttggatccaagatcaatgagggaagatgacaatgtatcatctacgatttatggctatagagatgtttgtatatatgtaagatgacaattttgtacaaaaaaaaaaagggattgacaattttcatctttgattgggaaaaacagatttcactttgattcgataataataatttagtagttagaagttgaaattgatctttaaccgttagtgatgggcctcgcattattcatgtacttagccaaatcaatgcagtctctgaaggtgactgactctgtagtatattcatgtgttgtaatgttttatttgggagtcaaaaatgaaataatctctgtactactttcatgagtgggggttccaggagctctaactggattttcaaagctgcaattcaaatatgtatgcttatgtcatgaagatgtagacgtcacatgagcaaagatcgtgtaaataagtgggggagaaaaccagagctaagcatattggatactttacagtcctagtgtaaatgaagttttgtattgaaagtctattagtgttgaatcaggacgaaacacttgaagctcctctccaaattatgatcagaaacagaaacatatcagttcaggtcttcaaatgatctatatatgtacctctaactcaaaagatcatagcattgctccagcatcagtttctcttgtgcggccctccatcgatctgctaatggaagatattaggttattacacactagtttaatacacgatttatcatgtcacgtttgtcctcaaaacctaccgtgggagaaacgtaattaactattcactgttgaaatgatagcatcagtgactgcttctgcattcttaagcttattccagtttccaagcggttccactgaggatcccaagccggatcagagctcaagaaatctccaaatgatgttgagatacaacaaaaagggaatcaagaaaagacctcaacgtttagccatgcatgcatggacgactctcattacggtacgtttaactaatcgaacattgcttgtatatcgaaactcttaactatgcgtttacttaaaataaaaataaaatacttctttgattcaataaaaatattttagtagctctaagttggacttggagtggatctctaaccggtcgtgatggggctcgcactattcatgtcgttttaagtctttaaccaaatcaaccggtgcagtctctaaaggtgattgactcttccgtagcaacttcttccttccttgatatgtaatcatgtgttatgtcttggaattcaaaaggaaataatgattaagatcactttcatgagtgggttccacgagcactaaatggatattggcatatctaaaggagacttaccaaataatccttaagtctcaagtcccctttttatcaaaaaagaagaaaaaaatctcaagtggttgaaaatggacgacgacttgaaactcgaagtttcgtttatagtcaatcttacattgttgatcagttacactaattctcttggctgtgtgtcaacaagtgggaagatttcatagtaagtcttctctcatagtactagtaattaagtcttctctctgctatagagtgtggagactaaaaaaagaagaagacaacattgtttttatattattatgtgaagtagtgtagtggtgaagaaggaagaattttccaactctacgaaccatagcaatcatagcctgatagccattaacgtctctatacagagaaaacagagagcccattcgctgatcggcaaatctctttataaacacactcatagtggtcttgtttttctgaaccaaagttatatctgttgaaatg

SEQ ID NO: 31603 - DNA, 3003 bp, Unknown
  misc_feature (1)..( 3003): 2750-1469P.txt file - cDNA_ID_3043970; gDNA_ID_1971911; Annot_ID_177121
gtccaggtctgcactacttgaccgagctttctgctttacaaattaaattttggtgtaattatctgcttccgacttttgattctgatgaattctaagactagctcactttttccagggaagacttgttgaaaaggacttcgatgtacgcagaacagctggtgactccactgttcgagcagttcagagagaatataaagcaaatgtatcacaaaatcatctcgaaattcatcttttctgggctggaaaaggaacatgctgtattcctatccaaggggcttatgggccattaatatcggccgtcggtgcaacaccaggtaaataaatggtgaattcttcttgttttacaccatctcctgatgctagttagtgcttaagtgttacatatttctgttcagatttcacaccaactgtgggtaataggccaccatcaaagggaaagagcatgactggtactattgtgggtgtcattgttggcgttggacttttgagcatcatttctggtgtggttatctttatcatccgaaaaagaagaaagcggtacacagatgatgaaggtatagatgtaaaaagctcttgaactgtagaattttggccctctgattaaaaattagttatatatcatctctcatattggtcgattttaagaaccgaattgtttctggcagagatacttagtatggacgttaagccttacaccttcacttactcggaacttaaaagtgcaactcaagattttgatccctcaaacaagcttggagagggaggatttggccctgtttataaggtaagtccctactgaaatttgtacatatttgagatattaggaaagaagagtatatgtgtactatcttttgttttgatattaccttttgttttgacaatatcatttattgaataatgcattcaacagggaaaactcaatgatggaagagaggtagcagtgaagctattgtcggtgggatcccgacaagggaagggacaatttgttgcagaaattgtagcaatttctgcagtccaacatcgcaacttagtaaaactttatgggtgctgctatgaaggagagcatcgtttgcttgtatatgaataccttcctaacggaagtcttgatcaggctctatttggtacgcacagaagcatgtttatcgatccatgcttctgccaggctaaaatcactcattatgtacatgtcattggtttgaatgttgcaggggaaaagactttgcatcttgattggtcaacccgttatgagatatgcctgggagtagccagaggtctagtctatctccatgaggaggcaaggcttcgcatagtacacagggatgtgaaggccagcaacattttgcttgactctaaattagtaccaaaagtttctgattttgggcttgcaaaactgtacgatgacaagaaaacccacataagtacccgggttgcagggacaatgtaagtaactcccaaccctgacctctggtttgcaacacaactatggatttataacacatgttggtgattttactgtatcaatgcagtgggtatcttgcgccagagtatgccatgcgtggacatctaacagagaaaacggatgtatatgcctttggtgttgtggctcttgagctagtgagtggaaggccaaactctgatgagaacttggaggatgaaaaaagatatcttcttgaatgggtacgtccatacttcaacactttttgataatgaacacaacttcaatgtatgtgaccatgagaggctaatctgggttatgccctttagcaaaagctgatattgattgtgtaacttgttcacaggcatggaatctacacgagaaaggccgtgaagttgaacttattgatcatcagctgactgaattcaacatggaagaagggaaacgcatgattggcatagccctgctgtgtacacaaacatctcatgccttgagaccaccaatgtcacgagtggtggccatgctttcaggagatgttgaggtcagtgatgtcacttcaaagccaggctacctaaccgactggagatttgatgacaccacagcctcctcaatcagcggctttccattaagaaacacacaggcttctgaatccttcacgagctttgtggcgcctagatccgagatatcaccgagaaacaacgacgctaggccaatgcttggagcccagatgaatgagggaagatgacaaagaccctatatggtggctatagatatagtcatatagagattatgtttgtgtatatgaggttcactttattcttcttggattggaaaaactctagatttcactttggttaaataataataatattttagctcctctgacttccacaagcggtcgtgatgggccacgtactattcacgtcctcaaccaaatcaatgccgtctcttttacagtgtaactgtgttggtttccaaatgaaggaagttattaagaacacttttcatgagtggttcaacgagctcgaaccggatatgacctgagattctaaagaatatttatgagtcccaagtcggagatggacgacgatttgaaacttgaaacgtgtgcttttgtttttatattttggtgtttgtcttacattattaaaagtcaataaagaaatggttcaggcaatttaagcaagccatgttgatcaattacataatcttataaacgtcacattgagattgtgttctgttgaattgaatgtttttggtctaattggtgatgtttattacggacgactcgcagcgcagccgccaccgtcgttgacacagcaggtgcactcctcggtccacgcacgtgagcttacacgccctcgctatcgggacaagaccattaattaattcaaattagcaaatgcatctcttagtttggtaacggcaattgttatagtatttaaactgaaatcataaatgaaccaaaagcttagacctctcaactaaattttgcaaagagcagaaataaactctttctaaaaagcatttgtgttttttaaccaaaagcaaaaccaccgtcgtcgatg

SEQ ID NO: 31604 - DNA, 3003 bp, Unknown
  misc_feature (1)..( 3003): 2750-1469P.txt file - cDNA_ID_3043974; gDNA_ID_1971911; Annot_ID_177120
tttttcgtaagtaaaacgcagagatgggcagtcagcaatgtaggactatttactgggagtaacagtaatcaatacatagctctttcggcaacgcaatttgcaaacacgtcagactcagagcttttccaatcagcgagactctctgcatcttctttaaggtattacggactggggctagaaaatggaggctatagtgtaacggttcagtttgctgagatacaaatacaaggttctaatacctggaaaagtcttggaaggcgaattttcgacatatatgtccaggtctctactattcttaccaatattaacttcgtcttctctgtgaattagttattttggttttgtgaactaggtccgtactctgtagtaactattttgaactagagagagaagatccttgataagctttggcatacaagagatcctttttctattagagtatctggtacaaggttgtagcacatatttcgttcaagtgggggtgaaaattagatgcatcgttttaaggctcaactcttcatgaacgatattctctactctcaaaaatggtttctgacctctgagttccttttgtttctcagggaaaacttgttgagaaggattttgacatgcaaaaagctgctaacggttctagtatccgagttattcaaagagtctataaagcaaatgtatcagaaaattaccttgaagttcatcttttctgggctggaaaagggacctgctgtattcctgctcaaggcacttatgggccattagtctcagctatcagtgcaactccaggtatacatacagcagaaactttcatgatcttcgtagagtccaatgtatcttctaactagcggcttttattctctgcagatttcatacctactgtaaaaaataagttgccctcgaaatccaagaaaaacattgttatcattgtaggggctattgtaggagcagggatgttatgtatattggtgattgctatcctcttattcatccgtaggaaaagaaaaagggcggctgatgaagaaggtaaatgaaaagtcttagctgtggcagttttattaaagtctaatcgttaacaactgtaaccttctaagtggtatttatcaaatatttctcaaatgcagtgctaaacagtctgcacataaggccctacacctttagttactcagaactcagaactgcaactcaagattttgatccttccaacaagcttggggagggaggatttggacctgtttttaaggtaagaccgtacacagaatgtgtaccaatattgggagtctagtgtactagaaagttatgtaaaattttacattatctatattctaaaaatattcattggtacagggaaaactgaacgacggaagagagatagccgtgaagcaattgtcagttgcatccaggcaaggaaagggtcaatttgttgcggagattgccactatatcagctgttcagcatcgcaaccttgtaaaattgtatggatgctgcattgagggaaatcagcgcatgcttgtatatgaatacctctcaaacaagagtctagatcaagctctattcggtaagtgcatgagatcttacatgtgttatccttgtaaaaaaaacaaatgctgttaccttacatgttgcgtgactgtggcagaggaaaagagtttgcagcttggttggtcacagcgtttcgagatatgcttgggagtagcaaaaggtttagcatatatgcatgaggagtcaaatccccgtatagtgcatagggatgtgaaggcaagcaatattcttctggactcggatctggtcccgaaactctcagattttgggttggccaaactatatgatgataagaagacccacataagtacccgagttgcagggacgatgtaaatatcctgaaaacctcacattggatgtggtttgtcaaatgggctaaaacttaccgttgttaaatgttatattgcagcggatatctgtcaccagagtacgtgatgcttggacatcttacggagaagacggatgtgtttgcctttggtatagtggccttggaaattgtcagcggaaggcctaactcctctccagaattagatgatgacaaacaataccttctcgaatgggtatatatctaacttttcctacaaacacatcctttttaattccaaatttggtgaataatttggtctttgcaggcatggagcctacaccaagagcagcgtgatatggaagtagtagatccggatctgacagaatttgacaaggaagaagtgaaacgtgtaataggagtagcgttcttgtgcacacaaacagatcatgcaatacgaccaactatgtcccgagtggtaggtatgttgaccggtgatgtggagataacggaagccaatgccaagccagggtacgtctctgagagaacatttgagaatgcaatgagcttcatgagtggttcaacgagctcgagctggatattgcctgaaactccaaaagattcttccaagtcccaagttgaagaacatggacgacgacattgaaacttgaaaacttgtggtttttctattttttgttcttacataaaaaaaaagaagtcaatatagaaatcgttgttggtaaataacacatatacatattcgtttgaccaaaattggatttgactgtttctcctgaaagttgtgtttggtcccatttttaacattaaaatcccttaaaaccatcattggcatttagtatcaaagtccaaaggtggtgatgcttcttgcactcgtaggcagcagccgccattgttgaaatctcccgttgacaacgcagcggaatctcggtttaagcgcgtccacttcacggcttgtggatgcatcgcgtgagacgcactgctccgcgtagttggttagaccattaattaaattcaaattaagccaaatgaaaagtatctcttcaaagtccaacataaacaccatttttgaaccaaattaaaaccttctccgtctagttttggcggctatcatcttcttctccgtttaattttagtttccgacgatg

SEQ ID NO: 31605 - DNA, 3003 bp, Unknown
  misc_feature (1)..( 3003): 2750-1469P.txt file - cDNA_ID_3043978; gDNA_ID_1971911; Annot_ID_177119
ttcttttctctctttttacagatttttagaaaccatgcatgattaatgttcttttaaaaagttgttgcatggttgtttttattattgcaaacgtagtagaaggaagaacagtgtcaagtctattagtgcatgcggttatatataatccaaatgataaatacggatatagtactgctttctaaagatgagttagtgaaattaatgaattttgggggaaataaacgccgtactatggtccattcgtacagaatgacccaccaactgactttatatttcttccatttacgtgtcataccaataataccaacacgacttttcttctaaaattaaatgcatgtatctgttctttgaaatgatgattttcttattaggtactgcatagagaacaccactatttgcttcatagttcatacaacgttttaaagtgaagtttagtttggtaaaagttgcatttacatactcaataatttaacagacgttgtgctacttgcgagtaatcactactggtcaattaatatataactcttccggagttactcaaatagtgtgtatagatatatagcaaattagcaatggtttaaatgcgaaagcgtgggctgccccaactgtccagccgtacgctccatgctacggacactttgctttcaacttcgacatttatgtttcttatttaataccatgagaattttggatatgagtttgtcctcacacatcaaataaaaatcatttagacaatcatacaaccaaatcttatctaactgaatcaatttgaatacttgatcctaaaacattgttagctcgaagtctctagttaagttccatcattgttccataaacacaatcttgaaatcaaacatttcaccacggtgatctctaaaagtagaccactagtttgtgcctcgctcaaggccagtgaaatatctgttagttatgtagtcaaaatttcagtcggactttgataataatagccaagagagattgtcaagccagaattttataatgaataactaaataatatgagaagatttagttgttcgttacagacagctctctgcactaacagttctatttaactgacttgaacaacgaagaagacagattcttaatgagttcttgggccttaattattagtaatcgattaaaaaaaaaatagaatttctactgtgaaaatttcaatttatgagtttagtatcatcgatttcatattggaacattcatatgtttgtcgagtgaaatttttaaaagaaaataagactccgaaatattgagatcactgatacaagaaattaaatgtcctcatcaagttaagagaaaccaagagaaaaacctagagattcaacaaagttttccaacctgacactgataggtcatgaattgggcttgtgggctttatattgtttaaagcctgttattcttagtattgctttctatttaagtttgttgtcttgcttggtaaacgtttatcgattaagaactcaagaatgtttatcttcttcatcatctcctttcttcttcctttccttctctgatttcttcagcatctcaacctatttcttctattatctcatctcctttctgttactaaaattgataagcaccattaatttatatgaacgtttacataataattataacatatatttatacttaaccttatggatgtgcacaattatcaatgttgtattcacagctcaaaaccctatttgaccattctttcgacaaaattggctatgcagaattgtttttaggtgtaaggttttagctttgttttttggatgtataaggaggctaattttttattttttttacggtatattataatttatgacattgtacggtttcatagtttattcacatacataattagtaataaaaaatgttttactaaaaatgatattcaaaccaaaacatctaaacgtttattttggaaatcggtcattttatactcgacctaaatttaagtggtcaattcatacaatatttttcttttcttatgtgctaatatattcaaattatatatccaaatttaccaaatcatacaagattatacattctagttcattctactgatgtagatgccacatttttgattattttgatgacgtagttaccacgctcttgacgatgtccgtgtcacgtcctcatcaccttatttttttttgtttcttcacctttttcttcttatattttttattttttgtcttctttatcactattgctcgaggaagctgtaaaaatattatgtgtttgatgcatgtaaaaagactagaaaaattattttcgatactaatgagtaataaccattatttaaatgaaagaacaaaaatctaatagagtttatagtcaattcatcaagtcattcagataaacattgtattattgttttcgttagaaaagtagtaacggcaagaatgtttttaaaacatggtcaaacctattaacttgtatttgacgtccttgtccgaatcataactctatcgcgaaatggtcgtttagtattagcaattggattgcatcagacgtatgtatctttgcgaatattttatacaaagtggaagaaaagaaacacgtatgtattttggtttcaaaatgagacaactggctgatgtcattgatatgtcatatacggttcgattaatcaactctatttaacccggttccaccaaatcagcagtttaaaattgaaattcggaaataacacttgatcacctaattcattagtttaatactaatgattaacaagtaaacaacgactaatgataaaacggccagggctttccgacacactttttttgttttattcatttattggataactaaatacaggaaaaagcttacccacatggcgacattatttatcaaaaaaaagtaattaggctgttaaattctaaagttaaaaccatataatatacatttatttatacgcataacaagaacaaaaatggctagttggtttactctggatccctcccgactctctcacatctttggtcgtcgacgatg

SEQ ID NO: 31606 - DNA, 3000 bp, Unknown; identical to SEQ ID NO: 20327
  misc_feature (1)..( 3000): 2750-1469P.txt file - cDNA_ID_3044023; gDNA_ID_1971923; Annot_ID_177199

SEQ ID NO: 31607 - DNA, 3000 bp, Unknown; identical to SEQ ID NO: 20327
  misc_feature (1)..( 3000): 2750-1469P.txt file - cDNA_ID_3044023; gDNA_ID_2926219; Annot_ID_203209

SEQ ID NO: 31608 - DNA, 3003 bp, Unknown; identical to SEQ ID NO: 20329
  misc_feature (1)..( 3003): 2750-1469P.txt file - cDNA_ID_3044026; gDNA_ID_1971923; Annot_ID_177194

SEQ ID NO: 31609 - DNA, 3003 bp, Unknown; identical to SEQ ID NO: 20329
  misc_feature (1)..( 3003): 2750-1469P.txt file - cDNA_ID_3044026; gDNA_ID_2926219; Annot_ID_203204

SEQ ID NO: 31610 - DNA, 3000 bp, Unknown
  misc_feature (1)..( 3000): 2750-1469P.txt file - cDNA_ID_3044030; gDNA_ID_1971936; Annot_ID_177266
agttattttggctgaagctgggaaggattttgttgatgtgctctgtagtcttttgactcttcctatgggtaccattgtcaggttgctcgagaagcatcagaatccgcagtcttcagtcgttggttgtttacacaatctttacaaaagtgttgcagacatggacgttgataatttcgagtctcaagcttgtaagcatttcttgctgcatcctcggagtgcgaaggggagtcatggcagagatctaaagctcaacattgatgacaccgaggcgaccaagttctttgtctgcccaaattttgtttctactgaagcatgccgtaagttattcagcaatgttagtaccatgaagtgtcgttgtggaagctctatgcaccgtgagattccggttgaagaacagcaagctgatggagtatttcccagctgcagaacatcatttgttattacggatgatctcaaagtggcattgaactctatgggtcttgttttgaatgtcctcaatgattttggttactctggttttgataagctgcaagaaatgcttattgatgttggttttgaagaggtacttgaactttttatatctacccttgatgacaacttcttaataacgatctttcttacactactttcttttgtaaatgtagattctaactttgctagggtgtttgttcacttcggaagctccattgacagacaccttcctgaggaaacattgcatgtcaaggaaacgtaaaatgttgacaccacttgtacaagaaagcagtgttgcaggagctgcagacaatctcttaactttgaaagtttatgttagaaagacagacagggctgttctctatgctgagtgcagagaagaattcgttgattttcttttcacttttcttgccatcccgattgagtttgcttgggaactttctattgacattggtaatatgggctgtgttggtaatctgtgcagaagtgtgaaagatttgagctttgagaagcagaaagcagccacagtttctcaatgcatgcttccttatttctactggaagggcacaacctcttgatgttgttatccaggaatcaccagaatatgaatgcttggtcacccattatggtcataacatgctctgtaaaaagattaacaaggctgtgctttcaaacggtgaaataattgcaaagttcacttcagcttctgctagtattggacttgtgaagggagaaacaaatttcatagtgtcagatgatctggttgtcactcctatgaactcgtcctcaacaatttcattgttaagcaagctgcagatgaacattggtgatattgaggagcaagtaattagcattggcaaagctgaggtatggtgcctctaccttttaatttatagtctttgattcttgagttcttaatatttttgaaactacttttgtgttacaggccactagcttacttagagcttctttgatcacaacctctgccttaaccaatggtctctcaaacttcctctcaaagatggacccggacgaagtaactcaatctacacctaagattcaaaagtctgacaaaccaaatgaagcttggcagcttctgtagctatgttcctttttcttgttttgctgcagacagaatctttgagagcatggcgtttgtttgattgtactccatttgctctatgtaaggatttttctgaattaacactatgttgaggatcttgacaactcttattaagaaatcttacagagaaatgtctcaaatgtatgacgtgattgtattatctttgttattgtgatgtttcttgaatctattttaaactggaatatctctttttaaatgatattcaacagattcagacaacgaagactagatgaatcatgaaggtagagtagaagaaacaaactttctgattcatcttagaagttagaacgattacataggagcctcttatatacgtagagcgttctggtttacaaccacttaaccgagataaattatatggttgtttcaacgtggataatcttatagagattttttttctattttaagaagaaatttgtcattttccaaataataacttgtccaagccaatttttttttttttaacttttgcattaaaattacaaaaaaaaaatcgtcatttttcctccacatcattacatccgttgtattttcttttcactatttttattttttaatctctgcaaattggtaaatgaatactcataaaatgataaaaacgtgaaaaaggtaatgttttttcctccacgtcattaaattatcaagggattatttgtattttctcatttgtatttttttgattaccaataagtttttgccttgactcgactggcctcagtatataaggaagacttggtctttctctctctcctttctcaactactctctatctctctcttcctttcgtgaattttctctctctagggtttcgatttcaattttttccactgaacccgcgatttgaactgaaccttcaccgtccatcaccatctccggtggatttcgtaggcatctacggagcttacttgtttcaaagaaccttggatgttgtttccgattctccgaaagctctgtgttctttagtttgatacctcagatattggatgcccttggtgagttttcgcacttattagtgatacgcatgattttgatgtccatatgttttcgagaagaggacgaatttcaaatgttcggctgagatttcgttgattcgtagcttctagggttttattttcctatggtagtcgagttaagttggagaaggataccgagagtatatggatctcttgctctgctttggatcttatttgcttcaattttcggctttgttactctatattgagagaattgggaaatgattttgagtttgcattctggtctgtgttcccgaggttgataatattgtgctttcttcatgcttcagatataacttaggtagcttcttacagaggaaggatatgttaggttaatttctgttcatttgcccttggatggttgctacgatg

SEQ ID NO: 31611 - DNA, 3000 bp, Unknown; identical to SEQ ID NO: 8931
  misc_feature (1)..( 3000): 2750-1469P.txt file - cDNA_ID_3044034; gDNA_ID_1971936; Annot_ID_177265

SEQ ID NO: 31612 - DNA, 3000 bp, Unknown
  misc_feature (1)..( 3000): 2750-1469P.txt file - cDNA_ID_3044042; gDNA_ID_1971936; Annot_ID_177260
tgatgaattatacttacgtgggaacgagttagtttacttgggagattcttacccacacgtccgataatatatatatacacacgaatacacatcctttctatatatcaatctgctcaagattacttaaaaaaaaaaaaaaaaaaaaaaggaagaagtgaagaatgtaatcgaataattaaaagggtatatgcactagatgaccataaaatccataatattatataaactaaccataggcgtatagtacttgtcggaaaccaactttaaattactctaatatttctataataggattttggttgagggggacaaatagctttataggcaaatagttttaccactaaagctttcataacctcctcttcccttacaacaataaccaccactagatccgtaacaccaccgcctcctccgtatttagtattattagatctgtaaacactaccgcctccgtattcaccaccatatccataacaccaccgcctcttccgtattcatcaccaccgccgtttacttttgttgacatgtatttttattctaaaacattgtatttttcaaagtttcttttaaataatacttgttctttactaaaattacaatgatccgtatgtctcaattcaaacgatagcatgtaatttttgaatacttcatgctatttttctatttttctatttgatatgtatattttcctaaaacgtttatattttttgataagataatatttttttaaagataatgtgcattttacaaataatctatgtttttttactaaaatcacaagtaagttagtgattcatgatttatgtttttttttataatcacatgcaaatttgtacaatcacatgtaatctataaataacacatatgtggtttgcttatctctgttgaaacccatttaccatattgtcaaaacaataaacctacattttaatgtaataaaaataaatagcatgtccttaaatatcttatgcaatatttctatactcaatcacaactgtttctaaatggctatcttttaactaagttttcttttacgtatacatttttaaggtataagagatattgcgtgtgattttaataagtagtggtctaatattgcatgattttttaagaagtagcggtgtaatcattatttcgtattatcttttgtttcctacatgtagcagctattgtcggaaagaaagagtttatctcatttataaagggtaaaatagttatttcgaaggataaaaaaatgttatttacccaacttttctgcacgaaggctattttattaataatgctgtcaaatttggtcatcctctaatattaccttaattaaaatacgatagtaaattatatcttacgatggttactagaatgttagtacagtatgttgtagtttatacgaaagaacaaaatgattcaccaaacgagcggcgtttaggtgaaggacaatatttgtttcccatgctagagacattcggagacccgtacgtactatagttcctaaatcatattaatagcaaatatatatatttgaatatctaaattgaatattattctgtggggaaaacagaaagaaaagaaaagccaagacaaatttgatcagataaaggaataaaactaaagttaaagttatatagaatgcatatcacaacaaaaaaagaaagcatacaaataatacagtctttgataacgaaaacttgatcaatgttttctcgtgttttttcttgactataacctctcttcttcttgcaaacagtataactttaaaaatgaattttgaaagtacttgatttttgttatgaattattcgtcttaattttaaacctctgtttttcgtcttaatgttagaatatcgagaagattagtttggagaaatgtatgaatatataacacagaaaaacaaaagagagaaaaagaaaaaggaaagaagagagaaagcgaaaggagagagtgtcatagagacaagaaattaggagtgtgatggcgtgatttgcttttccttttttttttgggtccgaatctttttaattccaaagtatctctttttaaaatttctttaaattaaaaacaaatactagtaaattcttagttgttactgtggttaaagcgggtaaattccatagttgacgcctgttgctatgattgatgcgataattgacatgattattacggtagcactgtaagaaatgcacaagatgcagcactatcaaaatactactagtattaactaatcaattaatatcgttgaaataatttgtttgtaactttaaacggactttattagatcaacaaaatcatcatgtactaaataacacacgcaccccatacttatcgttgaatcacgatagagttattgttttagattaaaatgaagcatgtgttgttgctttttgaaaattttgtcaaaagtagtgtgaaaattttgattttttagttaaaattgcttttgacaaagcagggaaaaaaatccactttgccaccgacccaacaagtaacgggtttatattagcattacatgagacaaaaatcgacagaacataaggtcaatttagacatatcatatttctccaattaatttgcatgttaacaaaaaaaaaatgtaactgacaaagaaaataaaaagcaaaatattgaagtggacaaaggtttaatatgttttatgttagatatagtacataaaaataagatttggcttatatcatatgaataaatctgaacaaaatttctagataaccgtacattaacacgctaaaaccatatcctaaaacttttgtttatttgaaaacactaatttggtttttctataataattcttttgttttgtttttttcttgttcatctcctttctctttcaattaccgttggaacaagacgaagtttcagagacaacactacccaatctctctctctaaccttaagtgttgtctttctctctataagccagagaccagacagtgatgacgatatagtatatgagaccagagggaggattaaccaccatttcccgtcatg

SEQ ID NO: 31613 - DNA, 3003 bp, Unknown
  misc_feature (1)..( 3003): 2750-1469P.txt file - cDNA_ID_3044046; gDNA_ID_1971936; Annot_ID_177256
caggagaaactttgtagacaaggaagatgattccaagagagggatgatttcgaaaattgaagcaggaggtgaccggctctttgtttctcgggaatgtatggaaggtgtggaggtctgggaaacttctagtttctccggtgtggtatccgtcgagtaatggtttcccgaagaacggtgatcgatcaccctctgttttcccgggaaaatcttgttaatttcgcaggaaagtaacaaatcttcaaactttccagggtctagtagaagactagtagtactgattgtctctacccaggtccacacttgaacagaatgaagaacatcatcaagattcacactttaccattatataaagtactagagaacactctcttatgttgtaaattgatccatagatattgtctttgtaaagttttggttctagtggataaataattatagtcacaagtaactaacaaatccagtttagagacagaagcttaaaaaaaaaaaaaagacactaattgttgcgggaaaattttgtttaaaaacaatgtaaaggtatgatggaagtgatgtcggtaaaaggagaaaaaactaaccttccttgttcatcttcattgtatttaatctaattgatctatgatttctccatattttaatacccttttaagtactcaacattatctcagcgtaatgattatatctcttttagtttgcaaagcaagtttccattgtatagctaaaattcaactactctttttgtctttctcaacctactctacctaatactcttcgttcttttcttttttgatgaaatgtttaccttttttaacaagacaaagaatctttctttatgtattgctttctttgccaatgtaataaaaccttttgttgcaacttctgtgtagtgcattccacacaaggtcttgaaaggagagaggaacccacatttttaaatgcaagtccttcattggattctttagatagtattgatacattatgtttttgttaggtcagattttggacctacaatttccgaaacgcttaaagtttgttatgatgaaaaaattaaatttcatccttcttttaagaaatgtcttggaattttccttttgtagtatatattaacaagaaataataaaattttgattaatgtaatatggggtcaaaaaaagaagaaagccaagtggggatttcccatgagctttcttgtctttggtcctttgacgccgacccctccttttgaatttaaacctggcttctctctctcttttttatttttttggtcggttacaaaatatcaacgtaacttgtttaaaacaatggaaagttaataaaaacagtgtgatattttattttattgtaaaaaccttagtttgctcaatgaattttgaaaagaagatcaagaataaccatttctagtcaagaacgataaatatttctgttatcgaaaataagaaatttaaaacactcctatacaattctctaacattacagaaaaaaaaaacagagaataggagctctctgtttgaccggacgcaaatccaaaccgggtaaaatcaagaagaagaccacgttgagactgagtttgatctcgacagaggaaaagaagagttcaagaactcaatgcaatcttcaatagcttctgctcgatgagactctgtctcgtttacagactttgacctcttcatataaatagctgacgaagaagaagacgacgacgacgaaggcaacaaaaacgatgacgtttttcttctatcagtagtatttcttctgaaggaaataaaacgcagcgttttggcgaatcttgctccaatacgttggatcaatttcctcgcggccggcgagctccttagaccaaaactgagaattccgacgagaaccacccttctccggctgtgatgtgacgagcttaaaccgtcgtgttttgggaatatgggttcgtctgtggcttctgggttcgggttaaagcttactcttttgcatgctcttcgtgacatattttttgttgtctgaaattgcggtgaagagagagagagagacagggcgaggagaaacagagagagagagaggggttgagagaagaccaaatagcaaatactaaagagaagcaaatgggatattttgaagactatttatggggtgttgtctaatgacataaaagacattggggtgaaattgtaaagatataaatatggtggggtcagtttaacaaccttactaaaaattgaaacttgtaactcacaattttctactttctaattgtataatgtggatttagtgtgagagtggttatatggaaatatttatcttatcttttctacagtttttccttatctataagagctacctactactacatgtgtgtattaatgaaaaaataagagcaacttaaacaaatgctgatcatgatcatggggatgagtactggctcgtcaagggtattgttcgctcgtggaatgagttataagtttttgctcatcttcttaatgaaaaaatagaataaacacacattttgttatactactaggcttttcctaaacccatttcaaactctttaaggtaagtttattaaccaaattatgatccgtcactctaacattaaatggaagtttgttaaccaaaaaaaaaaaaaaagttagtttacattagtactatttatagatttgaacaatcgatctgtccttagatatgtaaataatttatactaattctaactgcgtataagcaaaacttaatggtactaaaatcaaccttagtcagcaaccactactaagacagagagagaaagtgagtgtgtctgtgagggcgaatcaatgtctctgctttctccagaagatgatatttactttttgtgtcaattagctgtataacgtcttcttcacataaaacaagaacactccacttactaaaaaaaataattatttcttcttgaagagtggaattctttctcgaatcttagaaaattccatttagaactaaagaagagagagagatccagtttctcgtcccagttaagctatg

SEQ ID NO: 31614 - DNA, 3000 bp, Unknown
  misc_feature (1)..( 3000): 2750-1469P.txt file - cDNA_ID_3044053; gDNA_ID_1972154; Annot_ID_179399
tcgcgagggacttctccttctcctactgtgaattcgttgagtaaggctccgtcccgagggacttctccttctcctactttgaattcgtcgaggccgtggaaaccaccagagatgcctggtttctctttagaagctccaccgaatctgaggacgactttagcagacagaccggtctcagcttcaagaggcagacctggagtagcctcagcaccaggttcaagatctggttccatagaacgcggaggtggccccaccagcggcggcagcggaaatgcaagaaggcaatcttgttcgccgtccagaggtcgggctcctatcgggaacaccaacgggagtctcactggtgtgcgtgggcgagcaaaggcaagcaacggcggaagtggctgtgataacttgagcccagtggctatgggtaataaaatggttgagagagtggtgaacatgaggaaactaggtccaccgcggctaaccgagaatggtggtcgaggatcggggaaatctagctcagcttttaacagccttggatatggtagaaacctctccaaaagctcaatcgatatggccataagacatatggtacgatcacgtctcacaattttagtcaaattttctttgttgagagtagagtagcatccgaaaatcttcgattgagagtttctcacaagctcgctatagattaaacattgggcccaagctggatgatctgactcgcaagaagagtgtttcttaaagttctctggtaataataacacaattgtcgatctttggtgtgtaggatataagacgaggcatgactggaaacctccggccgcttgtgacaaaagttccggcatcatcaatgtacagtgtgagaagtcggccgggtagtgtctcaagctctccggtggccacgagcagcactgtgagctcatctgacccgagtgttgacaacatcaacattctgtgcttagacggaaacgaagccgaaaatgatgatcttcttagtgaaagaagctatgctgcttctccgcggaaccagtaccccaagttcacatcttgacccatattattatgtaatctgtgttcttgttttttgttctcacgcttcgaagcaacttgtttctaagtgatcaaccgtataatctataaacctcaggcatcaaatgtcttttttccttcataaatgttctcccaaagcaattgctaaatgctgtgtctgatattttaaaccaagatatagaacaaagtgagaatcgagaaacagaacaaaacatggaaatagtaaagaagacaaaacagagcatagaagaagaatttaacgagtttggtacctaaatctcgcgggacaaccctctttgtaaatccactaaattacttgaaaatttacagcttttggcatgtaccaaaatggttcattccaatatgaccgatacaaaaaaaaaagttgtacgataagaatctccagatatatatttgaatcttttatactatatgaagggacgaaacagagacatgtaaatgggtttcggttttcttacaagtgtaaacaaaggaacatattcataaacttgtctcgttaggtttataagagagtcaaatatacttgaagaacatgtcgttgtgaggatttggattcggtgaatcgtcttcacgtttagagacaacaagaaatcagacctttaagtgacgagtaaagtaagtagttacatgccacaactccaccaaaatcgtgtttatactttttttttttataaatacttttattactacaattttataacgattactatttcttattgaaaattggtcaaaaacattttagaactttattttactttttttgtcaacaaggtggacttttcaagttttgattttgtggcgcaaataagaaataatggaggattttcgtggaacgatgatgtcatgtgccaactgtaaattcaatttcagaccgcaatcgatagaaattaacaaacgattcgttttaagaaagaaagaaagacgcaaggcaatgtgaaaacaaaaattcctttttggatcattgagttgggatttgagaattcgaactttctctttggatgattgaatgtcagcgtagtgatgacgtcaagtaaaagctcgtttgatgacgttataaaatgttggcaaaaatttcttttttaagagaaaaatataaatgcatggttgtctgaacggcgagaagaacttggtcaaattaaatgtgccgtgtagtttggtcaggtaaacaaaactttattagtaactatcgctcttaattcatacgtatgtacgtatgagtctatgagaacctttcttagttaaacggtacgaggacaattattgtaaaatgtaaaaaaaaggtaggtaagtgatagaatttgtttggcgtatttgtgtgacttaaattgtaataaacaggtctataaaatccattgaagttgaattcttctaaccttgccttagttacaggcagaagaaaataattaaagaagaaatctaatcagtgcgacttttataatagtctcgtcgtgtgaaaaaagtaaaataaaatatagtaataaaagtctcgtcgtcgtgtagctgtcactttcgtttgtcactttcgagcatcagcagccgaacataaacaacaaaataaaattgaataccttttagcgtattcactgttcatgagttctgggtttggtttgctttgtatgctcaacaatttattgacatcttcacgaaaaagtttaaattttaaatcagacaaaagcagtctcatgatttctctttgattaactcaatatagatttcttcttcgcactagcaaataaacacattatcttcttcttcttcttctctcatcgttactttatagatttagtatcgaggagacaggtcgaaattgaggttcttttaaagaaaagttccatttcatatctctatcaaacccttttctgaatattattttgcttgtgaatttgaatttgagcttttttcctctgttcttgggaggaatttttgtctgtgtttgtgatg

SEQ ID NO: 31615 - DNA, 3003 bp, Unknown
  misc_feature (1)..( 3003): 2750-1469P.txt file - cDNA_ID_3044053; gDNA_ID_1971936; Annot_ID_177251
ccgtcgcgagggacttctccttctcctactgtgaattcgttgagtaaggctccgtcccgagggacttctccttctcctactttgaattcgtcgaggccgtggaaaccaccagagatgcctggtttctctttagaagctccaccgaatctgaggacgactttagcagacagaccggtctcagcttcaagaggcagacctggagtagcctcagcaccaggttcaagatctggttccatagaacgcggaggtggccccaccagcggcggcagcggaaatgcaagaaggcaatcttgttcgccgtccagaggtcgggctcctatcgggaacaccaacgggagtctcactggtgtgcgtgggcgagcaaaggcaagcaacggcggaagtggctgtgataacttgagcccagtggctatgggtaataaaatggttgagagagtggtgaacatgaggaaactaggtccaccgcggctaaccgagaatggtggtcgaggatcggggaaatctagctcagcttttaacagccttggatatggtagaaacctctccaaaagctcaatcgatatggccataagacatatggtacgatcacgtctcacaattttagtcaaattttctttgttgagagtagagtagcatccgaaaatcttcgattgagagtttctcacaagctcgctatagattaaacattgggcccaagctggatgatctgactcgcaagaagagtgtttcttaaagttctctggtaataataacacaattgtcgatctttggtgtgtaggatataagacgaggcatgactggaaacctccggccgcttgtgacaaaagttccggcatcatcaatgtacagtgtgagaagtcggccgggtagtgtctcaagctctccggtggccacgagcagcactgtgagctcatctgacccgagtgttgacaacatcaacattctgtgcttagacggaaacgaagccgaaaatgatgatcttcttagtgaaagaagctatgctgcttctccgcggaaccagtaccccaagttcacatcttgacccatattattatgtaatctgtgttcttgttttttgttctcacgcttcgaagcaacttgtttctaagtgatcaaccgtataatctataaacctcaggcatcaaatgtcttttttccttcataaatgttctcccaaagcaattgctaaatgctgtgtctgatattttaaaccaagatatagaacaaagtgagaatcgagaaacagaacaaaacatggaaatagtaaagaagacaaaacagagcatagaagaagaatttaacgagtttggtacctaaatctcgcgggacaaccctctttgtaaatccactaaattacttgaaaatttacagcttttggcatgtaccaaaatggttcattccaatatgaccgatacaaaaaaaaaagttgtacgataagaatctccagatatatatttgaatcttttatactatatgaagggacgaaacagagacatgtaaatgggtttcggttttcttacaagtgtaaacaaaggaacatattcataaacttgtctcgttaggtttataagagagtcaaatatacttgaagaacatgtcgttgtgaggatttggattcggtgaatcgtcttcacgtttagagacaacaagaaatcagacctttaagtgacgagtaaagtaagtagttacatgccacaactccaccaaaatcgtgtttatactttttttttttataaatacttttattactacaattttataacgattactatttcttattgaaaattggtcaaaaacattttagaactttattttactttttttgtcaacaaggtggacttttcaagttttgattttgtggcgcaaataagaaataatggaggattttcgtggaacgatgatgtcatgtgccaactgtaaattcaatttcagaccgcaatcgatagaaattaacaaacgattcgttttaagaaagaaagaaagacgcaaggcaatgtgaaaacaaaaattcctttttggatcattgagttgggatttgagaattcgaactttctctttggatgattgaatgtcagcgtagtgatgacgtcaagtaaaagctcgtttgatgacgttataaaatgttggcaaaaatttcttttttaagagaaaaatataaatgcatggttgtctgaacggcgagaagaacttggtcaaattaaatgtgccgtgtagtttggtcaggtaaacaaaactttattagtaactatcgctcttaattcatacgtatgtacgtatgagtctatgagaacctttcttagttaaacggtacgaggacaattattgtaaaatgtaaaaaaaaggtaggtaagtgatagaatttgtttggcgtatttgtgtgacttaaattgtaataaacaggtctataaaatccattgaagttgaattcttctaaccttgccttagttacaggcagaagaaaataattaaagaagaaatctaatcagtgcgacttttataatagtctcgtcgtgtgaaaaaagtaaaataaaatatagtaataaaagtctcgtcgtcgtgtagctgtcactttcgtttgtcactttcgagcatcagcagccgaacataaacaacaaaataaaattgaataccttttagcgtattcactgttcatgagttctgggtttggtttgctttgtatgctcaacaatttattgacatcttcacgaaaaagtttaaattttaaatcagacaaaagcagtctcatgatttctctttgattaactcaatatagatttcttcttcgcactagcaaataaacacattatcttcttcttcttcttctctcatcgttactttatagatttagtatcgaggagacaggtcgaaattgaggttcttttaaagaaaagttccatttcatatctctatcaaacccttttctgaatattattttgcttgtgaatttgaatttgagcttttttcctctgttcttgggaggaatttttgtctgtgtttgtgatg

SEQ ID NO: 31616 - DNA, 3000 bp, Unknown; identical to SEQ ID NO: 14992
  misc_feature (1)..( 3000): 2750-1469P.txt file - cDNA_ID_3044064; gDNA_ID_2684240; Annot_ID_192547

SEQ ID NO: 31617 - DNA, 3000 bp, Unknown; identical to SEQ ID NO: 14992
  misc_feature (1)..( 3000): 2750-1469P.txt file - cDNA_ID_3044064; gDNA_ID_2684240; Annot_ID_137747

SEQ ID NO: 31618 - DNA, 3000 bp, Unknown; identical to SEQ ID NO: 21458
  misc_feature (1)..( 3000): 2750-1469P.txt file - cDNA_ID_3044109; gDNA_ID_1971948; Annot_ID_177320

SEQ ID NO: 31619 - DNA, 3000 bp, Unknown
  misc_feature (1)..( 3000): 2750-1469P.txt file - cDNA_ID_3044130; gDNA_ID_1971948; Annot_ID_58607
acaacaactccaacatagaaccctcctaaaggttcagggctggatccaaatttagcagacgagagatcccagaaaacatcgatattacaggcatacgcctctagagtcttggacccttttcgtttagtgaagagccacggcttaatctcgactttacacagacttcggttgcaagaatcatcaacccccacggtaacacactgacccatcagattcttagtccatgtgactgtgatcaagcaagtcctacctcggatgcggcaacggtagatgcatattaccaaattctgagcatttcttccagcgctcgaggaagacgaagagtccgcaatctgaacaccattttcaccagagcaagaaggaaaatctctcatttttttttccttacagaattcccaatttcgagcttctctctctctccggaatttcaacaaacaccttgtggccaaaactgggcaacgctgagaaattcaaaggcggcgaatttaacttcagtttagtaacgaaatttcgtaaaagcaagtgtttagactataggatttacctgaaagtgataagtttcatcaaaagaaagagaaacccaatctcaaaaaagcatcgaaatctggaaaaatgtcaacagatttgatctgggttctatcaaatcgatccagtttcatcaaccaaggagagaatgagaagttaagagaaagcctgagactccgggagagagagagagagaatgcacaaaaggcgaaattcgccaaaatagaagagaatgtgtgtgtgcctactactgtagtcaaaaataaaagacagaaacagacaaaaaggaaactttgttttcactgtctgagtcattttttctaaaaacgttaaaataattacccgattttcttggcaaagtaccaaattcgaatttaattcagcggaaaacgactgtaacaataaatttcggacaaaaacattatttacattcttttcttttttacatcatcttagattttaatcaaaaaatttacaaactttggttcgaactttgttatttttgacacaaatactcacattttcttctgtgctttaagttaaataataaagggttttaactttgtctcattatagtgaattttttatgtatattcttaaaaaaaaaagtaggataaaaattaaaaaagtatatgaaaggctggaaggaatggttgccacgtgtggtatgataaccattggtatctcatgacttgtagtaggcatgtagttaatacccacgattgagcccactctcactgctctcttgggctttcgctaatggattaattagtcatataccgtttttagaggtagtttagcgattgaatttttcatacgataatcaatcatatgtcttgactcttcattccattgtcaaccaaataggtgggtgaagagcatatgtttaattatcaaaacgaacaaagttatcataccaaataggttaaactgtttccttttgtttggcaatgctaccgcaaaagtcttggaataattaattatcattatgtatgtttccgattgaaatttggaccaacctgtaataaagcaggtcccagtagtttaacattattttcttgggatctgattttttatttttttattttatcgtagtctcattttcgttattaatattatcgtgttgttggtgtcgtttgttattttatactagtattgatttaaaattaataatatgtctccctatctacttgtgagcgacggacatcttctcaaaacagaagataaaaatgcaaataaaaaatcctaaacattgacaaagattgtaatttgtaggatgagtcgtttctttcaagaagctataaaatcttaaaaacgttaaaacaaaacagaaataagtgatactaggatttaacccgtggtacaccacgggacaaatattttatttatatatataataatattaaattttatggttttaatttaatattaaagttatataattttatattaatattgtaaataaaaaattagtgatgataaaataataaataaatatttaacccgtgttatatcaatccaaatccgcttcactatataacttgtctcatgatatttttattattatttgttttttgggcaaaatattttaattattttagaagtttaaatttggaaagatttaaatgattttaagttaattttaagttagtgtgtagtatattttagtttagatttgaaaagatttaaatgatttctgtgactatttttctttttgttttctaaattttagtaacaaaattgatttatatttagatttaagaataaatttattaaaatattaaatgccaatagcattggattgtaaataaacctcaatttcaggatttatggatttatttcataaaagtgttgcaaaaatatatatatatagatgttgccaaacaaaaatattgttttgggtctcagcctttttaaatacaccagcccatatttgattcggattatcatttcttgagacttaacaacgaataaccgagattatagcctaaacgttttaggcggctaaccagagaatcaatttctatgtctctcaactcaagtgaaaagttaaaactctttctttcgaacataaactaaaaggttaggaaagctcgaatcagattattaatttttggtaatgtgaactaaaagtttagtaaaaaatcgtttcaatctttttcttatctaagtaccatctaaaatgggtttaggctcaattcttcacctaatttcatttcgaataggttttgatcatataaaaaagaaaaaaaattggttaagcgcactgaagacagttgttagcaccacagagttttatgaggagagaaagcatcatacatcatcacaaacaagtttcttcatcgctcattgttagtcattagtactttacttcttccttcttcctcttttattataagaagagaaagaaaaaaacatcatcttttttttcttgaataacagagcgattgctcttatctcagttgattggccatg

SEQ ID NO: 31620 - DNA, 3000 bp, Unknown; identical to SEQ ID NO: 31619
  misc_feature (1)..( 3000): 2750-1469P.txt file - cDNA_ID_3044130; gDNA_ID_1971948; Annot_ID_177311

SEQ ID NO: 31621 - DNA, 3000 bp, Unknown
  misc_feature (1)..( 3000): 2750-1469P.txt file - cDNA_ID_3044134; gDNA_ID_1971948; Annot_ID_177301
gctctaccaaataaccgcgtttagaaaacgctattagttaccgagtgtggttgggaccgagtgaggacgtcacggctccaaccaatccgcaaataaggaagcgcgtgtgtgtaagtagtgggtgaccactttgcctagtcttaaacgttaagtctggaaataccaaaactacccctggtttggtcgaagattctcacgcccctaccacccaacccaatcacaatcctcgtgaacgaacacaccaccttctctccaatctggatctggttcctcttcttcttggtctcttctccatctcatcggagctgatctcgaattgttctccgttcatttgttacggtggagatgacatcggatcaccgcgacgctcttttctctctggaactggaatcgcctgatccggacgaaggaggtgtagcagacggaggagaatctgataccgacgaggatttgcgcgacaacgatgatgttgttatgccgggaacgaacgaagctgaagctgaagacgacgatcccgaagaggaagatctcaattctccgtctacatcatcactccccatggtttctacgatctcagcgactgctgttgtttccgggaccccgacggcgacttcctctacaggcgccgtgaccgttgcacttccggctggatccgccgtccctgtctccgtgattcccgttgattccgatccgaagtggcaccgtatgacggagatcgtccatcagagaccaccgatcgatgattctagacgccttttccagaggctgtggacagacgaagacgagatcgagcttcttcgtggttttctcgattacatgacgatgcaccgcggaagcagctcgcatccgccggatacggcgccgttttatgagcagataaagtcgaaacttcagctggatttcaacaagaaccagctggtggagaagcttcggagattgaagaagaagtacaggaatgtgatgagcaagatcagctctggtaaagaggtattcttcaagagccctcatgatcagtctactttcgagatttctagaaaaatctggaaccaaactgggaaaatcataggctttgaagataacaacgtaatggatttcgaagaaaccaataaccatcataacaccaccaatggtaactactcaacctttaacagccctagttctaatcctactctggagctcgactccgaaaatggaatcgagaagaaattgacaatgagtagcagtagcgtgtcgagaaaacgatcacgatcaagaattgggaagattgaggaagacaacaaacctgtcatcactccctctgatgggccaatagctagcaatgtcaacctcaacgaagctgcagctgttggtattggaggaaatctcgggggtttgatcgaagagactgtgaaaaactgtgtctctcctgtgatcaaagagatgatgaatgggacaacaagtatgatgatggctgcaatgggaggagggtttccgggtcttggtggtggtggtggtggtggtggtggtcatggttttggctcgctaagccccatgtttacacggccgttcaatttcggttttggtgtagagggaggaggaaacaaggcggttgcagatgagcggtggaggaaacaacagattctggaattggaagtgtattcaaggagattagagttggttcaagagcagattagaacgacattgaacgagttaaagacgatgccgagtggtatatgatgaagggcgagaagaataagacaacaaggaaccatttaggttgatatttgatatctttgagttaaccttctggtgtgtgagtgagtatagtaagagatttggatctttttaagttataaattggtaaggtattgtgatctttctctaggttttttcatcattttgatttttttttcttcttcttatctttaaattatttgtcaatagggatgaatcataggaggggggtttgtgtataaccttttgtattagattatagttcttttttcgtagaatcatttgttcaataacaaacagactttctagctgtttttctttcaaaaagaagaaaaataataattctaaattgtgtgctactctttctttgtctaataaaatctgtaataacatgtttatttctagatcggatactgttattgaagtgtattaaactttgacctctttctttatcatgttgattaatgtagttacttaaaaacttttgtgtttgaaaaaaagaaccaatgttgtgtttcttgctagtacgcatcagaagattcctttcctgattaagtaaaaaaaaaaaggcataatcaaaacaatttaaagattcaagaaggcagaaacttgtccacgtgacgaggcaaagaatgttaggtaggtttgttattgactttatagtttatacaatgattttaacaaaatacctatggaagatacatgattattttttataaatgtataaacgagtggatatatttggtggtggatgatggtgtgtgtgtatatgcaaataattcactttataaaagcttatcgctaatttgacagaacactagaacagttctctctttttgtcgacagtcttcttcttcttcttcttcttcgattggatctggaactggtaagctcttctataagtctctggttttgtatctttcgaactgttcttttgtttctctctccaaaaatttcaaactttcataatttcgcctcctcaagttcgatttcagctcaagaacacgaatgcttcactcacttgtttcattgttaaatcttatatttagtttgatactcatgttttctgctgttcgatttttttttttctctgatttatattcgagtttgaacttaaatcatggttttggtttcactttacaattttggatctcatgcagtttcaaaacactcttcgatttatatgaatgttttatattattagggacattgcttgcagactgtgtcttaaatctttttgattttcttgtgatcttcagaactcaaattgggaagaattttgacatg

SEQ ID NO: 31622 - DNA, 3000 bp, Unknown; identical to SEQ ID NO: 8976
  misc_feature (1)..( 3000): 2750-1469P.txt file - cDNA_ID_3044167; gDNA_ID_1972049; Annot_ID_178321

SEQ ID NO: 31623 - DNA, 3000 bp, Unknown; identical to SEQ ID NO: 8976
  misc_feature (1)..( 3000): 2750-1469P.txt file - cDNA_ID_3044167; gDNA_ID_1971952; Annot_ID_177366

SEQ ID NO: 31624 - DNA, 3003 bp, Unknown
  misc_feature (1)..( 3003): 2750-1469P.txt file - cDNA_ID_3044171; gDNA_ID_1971952; Annot_ID_177365
cctaatattcaaaatcgtaaaaaaatgtccctgaagaaggagatgtgggattccaacgaaaagacatgcgacgattcgaaccagcctatacttgtcgtggacctgattagatcaatcttggaacgtttgagctttgttgatttccatcgagccagatgcatttcttcattatggtacactgcttcggaatcatgcatcggaggaccatcaactccatggatcatcctctttccgaacgaatttgttgaaagaaacaacgattcatgtaagttgtatgatcctcgtaactatagttcctacatagtaagagatctcaggtttgatatggctaggagtcgttgtttggccagtccgatagctggttccttatgttagactataacaacgatttccacgttttgaatctgtttactcgagagaggattcctcttccgtctctagaatcaaccgatggatttccgatgaatattacgaatagactagacactgcggttttgtgggtagatgaaaaaagcagagattacttagttgcttggagttacggtgacatttttgcatatcgcaagaatggagatggaaacaatagctggaaagtgattgagcctttaaagaatcaacgatgcgttgatatggtgtgtaaagaaagcaagctttacgtgtttagtgatactcgagtcactgtgtttgatttctcccgtagtgattctccaatggaatgtgcaagtttattttttatctggagtttcacaaaagtcctgttgtgactttgtctggagaagttttggtcattgctagcagagtggaaccacatcctgggacgttcttattcttcgtctacaagttggatcctaagtcatcaaaatggagcataatcaaatctataggggacgaagcattgattttggatcttggaataattgttgcagcaaaagatggagttatgaaaaattgcatatatttagtaatgatcattttcataagtacagtgggattagtctatgcggtgataacggtaacagtattttcatctaccatattgggaccaaaaaggtgatccaagtgtttgaacatcttactgcttcattgccaatactattcaggatgctcgttggtttttccccactatcggtggaaaatgtttgctttaaaactatctagttttgtcttttttgtaaggctacattatttgcttgtctctcgtggaacaagagtgtttacaagttttctttttatattcaagtgttttggacttagaaaggtttgaaaaatcgtactcaaattatctatatatcaacaactaatcctctttagatggttttgtttttgtagataaatttggcttttagttcccatcaacatttcttccatgggtttaagtgttgatcatgagcttaacaagtcattagctatatcaaattaccaaaagactgattctcaaaaccgatcaagaaagagcatcattttataatctaactcgtgtagagtactgaaattttgatttggaaattaattctcaccgacttaacatggaccaaatgtacttgatgtgcaccgacttaacatggaccaacttggtcgatatcaatacaattctggacatctagaggacgcttatggtacgttgattaggcttcccgtgtgtattttgcttgtgatctcggcattccattgccgaaggttcgaggatgcgcgcattctttcgattgaactatctacaaacgcacccaagcttgatgacgctgatgacaggaaagcaatccattataaatccttatgtggacgaggcttagccaacatggctttaggccactattacacagccgctgttttggtacgtaaactcatatagatatatttatgttttgtttataattatgtttggtataacttatattcatcaatatttattgttttcgcagtttgcgcatttggtcaaatgctatgccaagtggtcaaaaaactcttttgacctctttacttgggaggatttgttcatgtacacggcatggtgtggtcttgccacgatgaaaaaagatgagcttgaggtaatacaatattaatcgattatatatatataaaaataaataagccgacttgtaaactttttttattgatgattttttaggagatttctgagaggatgggaagtcaaaaagttggccaccatttccaacacttgattagaaaaactcttggagggtaatatataactcttaaaaaatttctattgaatacacttgtcggcaattaaacaagcttggtttatttgttgcaggatgtttaaaccaccatgcttggattttttgaaaactcattcaaaaccaaagcacttttggacttatacctccacgaccatgtgaatgctcttgagatcctcatccaggagaaatttagggtgtgatgcatggttgctttaaaactatctagttttgtcttttttgtaaggctacagtattttcttgtctctcttggaacaagagtgtttgcaagttttcttttatattcaagtgtgttggacttagaaaagtttgaaaaatcgtactcaatatcaacaacgaatcctcttaagatggttttgtttttgtagataaatttggcttttagttcccaccaacatttcttccatgggtttaagtgttgatcatgagcttaacaagtcattagctatatcaaattgccaaaagactgattctcaaaaccgatcaagaaagaaagcatcattttataatctaacttgtgtagagtactgaaaatttgatttggaaattaattctcaccgacttaacatggaccaaatgtacttgatcattttcaatataacaaactagtgcaccgtaccgtattataaagtctttatgtatttttttttaatataaaaacattttcagatatatttatttccaataaattcatttattttaagaaattaaccaaaaagaaataaaaatgaacaaacatatataagtatcttgattagaagaagcaggagacaaaccctagatg

SEQ ID NO: 31625 - DNA, 3000 bp, Unknown; identical to SEQ ID NO: 8964
  misc_feature (1)..( 3000): 2750-1469P.txt file - cDNA_ID_3044175; gDNA_ID_1971952; Annot_ID_58631

SEQ ID NO: 31626 - DNA, 3000 bp, Unknown; identical to SEQ ID NO: 8971
  misc_feature (1)..( 3000): 2750-1469P.txt file - cDNA_ID_3044175; gDNA_ID_1971952; Annot_ID_177355

SEQ ID NO: 31627 - DNA, 3000 bp, Unknown; identical to SEQ ID NO: 8962
  misc_feature (1)..( 3000): 2750-1469P.txt file - cDNA_ID_3044194; gDNA_ID_1971952; Annot_ID_58624

SEQ ID NO: 31628 - DNA, 3000 bp, Unknown; identical to SEQ ID NO: 8974
  misc_feature (1)..( 3000): 2750-1469P.txt file - cDNA_ID_3044194; gDNA_ID_1971952; Annot_ID_177345

SEQ ID NO: 31629 - DNA, 3003 bp, Unknown
  misc_feature (1)..( 3003): 2750-1469P.txt file - cDNA_ID_3044198; gDNA_ID_1971952; Annot_ID_177343
taaatgctctctcaagggaccaagtctcattattaccatcacctccgagcgttctcttctctccatctgtctgccgctcctttaacgtcggttcccattttcttattcacaatgaccccaagaaactcgaggagatggaaaaaagcaaaaggtaaaacaaaaacaaaaaagctttcttcgagaaccagagcacattgattccaaggtaattactttctcaatgccatggaaaaggacccattttgttcccctttcctgtaatctaatcgtttcaatccgtgattatctctgtcagcttggaggaaatgacttagatttcataaatcgattcatgagttgtcagaaaggatttaaattttgttggtttgttcttatttcttctgtagctgctatgaatttttagatttagtttggctatgattctaaacctacgtctttatgaaagcacttacattttctagacacaagatcatagtgagttcatatgatgcggaaaagttattattctcttggtcttccagtttatatttatggaggaacatagtctcattaacaagcttgcattgttctgttccattggattgttataaaaatattcattggtcaattgagaaatcagtgtctaattttttttgaacgtgtctttgcagattgaatgctgtttctggtggattagtttctctgagttttggtgatagatcagattaacaggcagaattttgagaatgtcgacagtgggaaattcaacgaacatattttggcaagaatcccccattgggaaaactgaaaggcagaagttgttaaatcagaagggttgtgtggtgtggatcacagggctcagtggctcaggtcaatcttctaaaaaatcttaaattcttttcccattgtgatacttacttaagatgccttctttatatctctgtctatattctaaaatcttagcctcaaactttgtgcagggaaaagcacgttagcttgctcgcttagtagagagctgaacaaccggggaaagctatcatatattcttgatggtgacaatcttcgtcatggtttgaacaaagatcttggtttcaaggcagaggatagagtggaaaatatacgcagggtcggtaagtagtacatagttgcttactatcttttgctttcagttgatgaaagtctgattccgaagaaactcactaatacaaatgcaaatcctttaaaaaggtgtctcatatgtagtgatagtttacatggtaccaatacctcattgatatacatattggtatacacctaaaagctgatagattctggttaatgttgaaagaaacttctctaaagggcaaaatactaaagaagaccaacaatttgttctaaatgcaggagaagtagccaaactctttgcggatgctggtttaatctgtattgccagcctcatatccccgtatagaaaagaccgtgacgcctgcagggaaatgatacagaattcatcttttattgaggcaagctattcaaaaccaggctttacagtttgtaacccccattcggttggatcttaaaaacatcttgtttgatattgtggccaaatttgttaggttttcatgaacatgtctctgcaattgtgtgaagcaagggaccctaaaggcctatacaagcttgcacgtgcaggaaagatcaaaggtgagataacatagcttcaaggttccatataaacagaagatagcaagttgcttcaatatcatttgagttgttctataaaagtttttttttcttcatacccttttgtgtaggtttcacaggaatagatgatccgtatgagtctcccttgaactgtgaggtatgtgatccatgtgaacataagattcttcttcaagaatattgcaaacaacgcgtatgtgaatacgtttctctgtttcttttgtatgttttgaaacataacagatagagttgaaagagaaagagggagagtgtccttcccctgtagctatggctgaggaagtgatctcttatctagaagacaaaggtttccttcaaaacgagtaacgtccatcataatctaacgaccgagatttgtttttccttttactttttatgggtgttctctgtttgttactttcctgaaacactgcaaattcttaagaagtttcaactaatgaagacatatatagcttcttctccttcttctgaaacttgtcttctacactgaaactctagtcagtcaataccagaattcgatcctatacaacaacaagagccatgccattgttttcattgttaatttatactacgatacaacgattatactaagacaaccattaatttacatagtgtcatagtatttagaattttagtttttttgggggtcaaaaacaatagttttagttatgttagtgaataaatagattcagaaaaaactgtcgatcttatttgaatagttcgtaaaagagagggttctgtttgcaattttcctaacttttagatcctgagttctgcaatataaataaagaacaaaacaaaacacgatcacgaggcaattttgagacaagaatggtgttgaatagtcgattggtggagacaacagttaatctgtcggcggatctctggcaatatgttgcgtgtaaccccgagatacttcctcgcgccaccgtcatccatttcatcttctgcatccctctcctccaactccgccgtctcgcttcctctctaggatcatacctatgcttcgattccggcgccggagttgatcaccgtactcattccgattaagttaccggcgcgtttccatgaatcgtctgttaaatttcgacttttgattgtgtaatttttgttctgattgtaatgtaattttgtttgtttgtaaaccgaaagggacatacaaatttaataccagaataaaccggaaacatttaaatacacacagaaccaaaccgggttgtgtggaattgttgtcgtcacaggagagaaataagcagagacgtgtaaaccaaagaacaacgaaggtttcgtttcgtggggaagaagatg

SEQ ID NO: 31630 - DNA, 3000 bp, Unknown; identical to SEQ ID NO: 9379
  misc_feature (1)..( 3000): 2750-1469P.txt file - cDNA_ID_3044202; gDNA_ID_1972110; Annot_ID_178737

SEQ ID NO: 31631 - DNA, 3003 bp, Unknown
  misc_feature (1)..( 3003): 2750-1469P.txt file - cDNA_ID_3044202; gDNA_ID_1971952; Annot_ID_177342
tgttttggtttgatgaaaaaaaaacagagtaaaacaaacctctggatgatatctgattccacctttcatgggacctcttgcattgtcgtgttgaactctgaatccaacaaaggatgctagagttccatcgtcttttggtatggtacattccacctgcaatagttggttagttccgttcaaatgatcttgaaccggatcggttctgcagatctgttatagatggaagaagaaaacagaggaaaacatcgaaccttgatctctctgaagggaatgagaagacttttctcgagctttgagtctaaaccaagaagcctagaagcaagcttgaagtttctgttggttgctgctaaagcattcatggctttcttctctcttctttattttgggtttatttgatcagagagtctgatatgaagacagttggaaaaatgtgagtcttgcttatgttattgcaagtttatttatatagagtgatacgtacacacttcgtgttatggaatatgagaatgaaaattttgttatttatatttataataaaagataatttatataaggaatatgaataatcatataagatgatacccataattgatcctgattttgagtattcagaatactatgtgtctgtttagcaaagttctcacacaaaaaaaatatatagattatagaaatagcccatgtcttcaccatgtgtataaactagatcagaataatggaatattcattaatgaaaaggaaatccgtagactaatcaagcagaataaatatattcttttcattacaaaaagatcagaataaaaataggaaaaatcaagatttcacaagattataaatattacatggatgaaagagatagctcgtaaaatttatcttattgtgtcacacactgtcattttattcattttaaatctagattaaaggaaaaaataacatttcgtattacctaattagtacccacctaataagcaaggaccaagatattgtttttcagaatttgtttttttttttaaataagaaaatatgatacaataatgatctagcaatagcatgcattggaccggatgactatactcgtgcatgaaaaatcatagtcaaattgtaatacgttaatgtgggacgataataatactttttttttgttttattatctacgattatatatatattaataatcatttacatatttgtgatatacgacccgaaatgaatcttgcatgtcataagatctttacgtgttattaacttattcaattctacttgcccctacacatataggcatagcgtatacacttttgtgagagggtgacaaaaaaaaacgtatacactttagtgagctagtgggaaaaaaacgtataaacttatcacacacatacaatattcagttttaattgaaaagattctacggatatatgtttttttagatactcaaatcagaatctttttggaattagaggaggacacgagaggatgcaacaaatcaagaaacatatagaattacaagattccaccatgaaagaatctttttggaaaagagattccccatgatttatgcttccactaatataattgatttattgtggatttccaccaagatttctttctctttcaatttccaaaagaagatatcaatttcgtaataacaacattgaccgtaaatagtgtttccaaatttgatctcaccctctttggtcaaaccaatatatagaaataataccccaataaagaatccggttcatggtaggcttggtagctaatgtcaaggatttagtatttttaaaacgttatgcattagctttctatcactttttaatacatgaaaaaaaaaaaaaaaaaaaaaaccaattggactttctcctaaaaggccattccctaataaacaacaaactacgaaaagctaaacatgtatttaaaatattaaagtgatagaaagctaatgcataacaattaaatgaagcaatttttttatattctttggtcaaaccaatatatatacagaaataataccccattaaagaatactgttcatggtagctaatgtcaaggatttagtatttttaaaacgttatgcattagctttctatcactttttaataaatgaaaaataataactcaaacaaatataaaaggccattccctctacgaaaagcaaaacatgtatttagaatattaaaaagtctaaaatcaaacctaaaattcaaaaatcaattaaaggccacaattgtcctataaaattatgggcttgaagcccaataatatctaagtgaaaaactaaacttaaatgctctctcaagggaccaagtctcattattaccatcacctccgagcgttctcttctctccatctgtctgccgctcctttaacgtcggttcccattttcttattcacaatgaccccaagaaactcgaggagatggaaaaaagcaaaaggtaaaacaaaaacaaaaaagctttcttcgagaaccagagcacattgattccaaggtaattactttctcaatgccatggaaaaggacccattttgttcccctttcctgtaatctaatcgtttcaatccgtgattatctctgtcagcttggaggaaatgacttagatttcataaatcgattcatgagttgtcagaaaggatttaaattttgttggtttgttcttatttcttctgtagctgctatgaatttttagatttagtttggctatgattctaaacctacgtctttatgaaagcacttacattttctagacacaagatcatagtgagttcatatgatgcggaaaagttattattctcttggtcttccagtttatatttatggaggaacatagtctcattaacaagcttgcattgttctgttccattggattgttataaaaatattcattggtcaattgagaaatcagtgtctaattttttttgaacgtgtctttgcagattgaatgctgtttctggtggattagtttctctgagttttggtgatagatcagattaacaggcagaattttgagaatg

SEQ ID NO: 31632 - DNA, 3000 bp, Unknown; identical to SEQ ID NO: 8996
  misc_feature (1)..( 3000): 2750-1469P.txt file - cDNA_ID_3044221; gDNA_ID_1971953; Annot_ID_177411

SEQ ID NO: 31633 - DNA, 3003 bp, Unknown
  misc_feature (1)..( 3003): 2750-1469P.txt file - cDNA_ID_3044226; gDNA_ID_1971953; Annot_ID_177408
tccttggattatgcacaccaatctcccctagtatctctttcaatgttttgacaggtttatctctgtttgtgcaaatcagataactcctaaggtgctgcaagtgtgggctaggatactgtgtgcagttcccaattctcgtctagtggtaaaatgcaaacctttctgctgcgatagcattaggcagaggtttctcaccacgctggagcagcttgggttagaatcaaagcgtgttgatctcttgcctttgattcttttcaatcacgaccatatgcaagcctattccttgatggatattaggtaagatttgacacatagtgctctgtaaaacaccgaggcttatagattcacatatttaatttacatttattgcagtttggacacattcccttatgctggaactaccactacctgtgagtctctctacatgggagttccatgtgttacaatggctggctcagtacatgctcataatgttggtgtcagtcttctcactaaagttggtaagctcttagcaaaatttttttttttttttttgcaaaaattgttgttagtcggacatcttttagctaattcagccatttcttgattcaggattaggacacctggttgccaaaaatgaggatgagtatgttcagctatctgttgatctagcctctgatgtcacagctctttctaaattgagaatgagtctccgggatctaatggctggatctcctgtttgtaatggtccttcctttgctgttggtcttgaatccgcatatcggaatatgtggaaaaagtactgcaaaggtgaagtgccgtccttaaggcgaatggaaatgctgcaaaaagaggtccatgatgatcccttaatctcaaaagacttgggaccatcaagagtcagcgttactggagaagccactccgtctctcaaggccaatggttctgctcctgtaccttcctctttaccaacccaatccccgcagctctcaaagagaatggactccactagctagataaccagcaaatcgagctgctgcgaaatgccggcagagagtcttgacccatctggaaaaggtgtgaaagaaagagtcgatgagcttttcctgctatttacttccaagacaataggaactagactttagattactgcttgtgtagtaaaaagaatagtaaaaccagctctttcttttgttgtatctctttctactcttagtttagctttacatgattcttgggaagtcgttaggtggtagtggatttggagtttttcttctcatttgagagatcaagttgttgtgtatcgattagggttttaaggctttttaggatgttttcatgtgttggattttgactcatatgatagtaaatatagttatagaaagcttttcggtgcctttacctatttcataatataattatctaaaactcctgcttaagcttaatcccataggtgagacccaatgaaagacttttgacttgtatgattatgttgccaactccatatctctctttaattaattaatatggagagagtaaaaaggcaagcaactaactactcttcaattcaacacttcttctgctccattgcttccaccagaaccctaaagaccttataaaacccaatcccaaatccctttgctcattcaccaccaaagcatccaactttctttgcttcctctttcaaagcaacacaaaatattaaatctcaagaaacaaagtaaagaaaaatgaagaacgaatctaccttcattgatgtccctgcagaatccagctcagccatgaaaggcaaagctcctctaatcggtgtagcaagagaccacactactagtggctcaggtggatacaacagaggactcgccatctttgacttcctcctccgtttagctgccattgttgcagctttagctgctgccgccacgatgggaacaagcgacgagactcttcccttcttcacacagttcttacagttcgaagctagctacgacgatctaccaactttccagtacgactcatagatgcttgattgatcaaacagatgcttgtgtttttcttgagaaacacgtcacctaattaggtcatattttttcttcaggttctttgtgattgccatggcccttgtaggaggatatctcgttctgtctcttccaatctccgtcgtcacaatccttcgccctctcgccaccgccccaagactcctcttgctcgttcttgacactgtatacactcaaaactcttcaaattatattgctttaaaataaaactttagtatcaagtaaaatactaagaattgtgttgggaacagggggtcctggcgttgaacacggcggctgcatcatcggcggcagcaatatcatatctagcacacagtggtaaccagaacacgaactggctccccatttgccaacagtttggagacttctgtcaaaaatccagcggagctgttgtctctgcctttgtctccgtcgtattcttcaccatcctcgttgtcatctccggcgtcgctctgaaaagacactaatcaaaaccttatatgtgtgttcatcattattgtaaaatttatgtcaccattgtgtaattattactcatccatggccttgtgaattgtgttgtattaatctttttaaaaaggaaaatgaaagtgtgattgtagctctgcttttctggaaaaaaattgaaatgagtttctcaattttttgtccaccaaagcctatgagattataaatgtctcctatatttgtctctacgaaaatacccggtaatgataatgttacagtgagtagcagagaaatatcttacgtggtgttatcttagtggacgttcacggagttgtcgttggtcataatgtttctgtcttcctttttttggtttaaggataaacgagccttcctggtgccacgtcaccttttcgtcttctgctacttcgtcttcttcactaaatgattcagtattttctcctcaatcttctccattttctcaccaaaccaaaatcgtgaaagaatattttcccgcttcatgtagatg

SEQ ID NO: 31634 - DNA, 3003 bp, Unknown
  misc_feature (1)..( 3003): 2750-1469P.txt file - cDNA_ID_3044230; gDNA_ID_1971953; Annot_ID_177406
ctccggtcaagaacttcgctgcgtctatccacctgcgttttatggacgagccaatttggtaatcgatctttcgtttaactcaaagaagcaataaagtctctagtaactaaccctccaccgtcccgactaataaggaattgggttgagcctcctccaaagaacatacaaggcataggcaccactacatacatgagtgctgatagcattggccaccagttaccatatatcgcgcatgcctgaccattatgaacaaatagttatcactatatctcccagatgactataacacgtgttactcattgcatggtataaccaggtataccaaaggaaatcacaaaatatgggaaacgtatcagatttgtaaatcagatgatcctttcttcttctaatcgaagtgcaaaaaaaaaaaaaaactatacctatacaaggacctgatataagctgaggagagaagatgcttgagtttatagaagttgttcagaaagtctaagtcaattaacaagttagacattgaggtcggctaaggaccccagcttaccatatgctccggtcaaatagtgttgtaaggataagaattctaagtgtaattttggtttttgggatccagagatcgctagtcaacatactacaagagagtaaagctcaaaacttcaaatatgaaagaaggtttgaatgtaacaaactttacttcacagagtatctctcccagtaaaacgggccaaaagactcacaactctgtttgctacatcaacaagggtacaaaaggagaccagtatactcagctcacaacctaacagcagaactagctaaccatctcttgcaggatttaaagctactaagtcatgatcttatgatcaagcttcaagggttataagcagatagctatattcagaaacgtaccaggatctgtaggaggatactagatgaaaacatgaaagcaagtccagcaagtctgtgcaatcaagaaaaataaaatctgtaagatcacgacacacgagaatacactggcagatgtaacaacaagggtaattaaagagcatcaagtcttagaacttacactgtaccaagaaagcaatttgagcattccagaagaaatcagcatcggaaaaaatttagaaaagagcaaacaatgagtgagtttgaacaatgcaaaacccagaaaccctagctcacaaaattaaacaattcacgaagcacaaaataactataatctgagtaaatcaataccaatctctaatacgtatggaatatatgaacatagagcaagggagaaaagtaaaaggggaaaatcgacttgaatctgattcgattccgtcgggaaatgatacagttggaagataggtgattgattaccttcgatggtcatcgccatgtcggcgaatgaaaatgttctgattaccggagatcgagtcttgaatgatcgccggtgacgataaaagagaaggtgatgatttcgttgttccccttagagagatacagaaggagagagcccagagaggagtcgcgatttgagagcaaaatgaaaattagtgaccggtcaaaattggttttctcaccgttcatcgatttcatctttttggtttggttggtttattttggttataattggtttccaggattgtggttttgataatacagctagtagtcgattttaaaatatcacaaactaaatgacatgaaaaaaaaattacgatcaaaatttgggttgcaaggaccacataaaactcattcctaaatcatacgtaataaaaatgattttataactgaaatttttaaccaaagttcataccaatcatcaaaatatgtgaaatgctaaatatttttttcttttcattttttgttatttaaatgcaatcaactatgattgaaactgcatcaacgaaaaagtattattaaactattaagcaaccataagttgagttgattcgtttccataattttagttagagtacgtaaatctccatcataatacactatctatgctatcattgtttgttttttttttcttttttttgctaagaatgtaaatatcattagaaatgaaatgtttggtattacaagagacgtattacctaaattaaattaaccttggcaaaaagaaataaaaacaaggttaagataaagagtagttaatcaggagagattaatggatccaaagtagcataagttgtttccaatgctttctatgtcttcgagaagtaatggtattgcgcacctcacgatctatgctatcatggttggtgcgtttatgacatgctgctgctggtgacgattcaaaagtgtttatcagttgttcattatgatgccattgtgatgtaccattactaatttcttacttaaataaggtgttgttttttgttttgctccaaataataaggtgttgtttaaaaggggctctttcgttttggagtaaaagtctctctgagtagctgtatattatttaagtagcatagtccaattatttgacaatgaaaaaaagtgtatagtccaatgaataccaaatgaattgacgtcaccactagttgagacctgagacaagcaagtgatcgttaaatcaaggagaacgcaagtggacgaggccgacatgatcctaactattggactcccacttgtgaaacttacttgatccatttcccacttcataatttcgtaaaaaaattaagacaatgagaatgaatttatttatttatttttcggtagaacaatgatttttattttgtccaaataaaacaatcgtgaaaaattatgttttggacattatcaactttgtgagtaaaacaaattttgtagtttcttttaaccaatattttcgaagtcaacttttttctacgtgtgagtgtattgagtaaatgatagatatgtcaataataacataactcatcaatcaatctggcttcaatagaactagagaagttataacgtttttttttttttagacaagagggttttataactctagactagtttcatagtccatgaaaaaaacatcaaatctcctaaatg

SEQ ID NO: 31635 - DNA, 3000 bp, Unknown; identical to SEQ ID NO: 8990
  misc_feature (1)..( 3000): 2750-1469P.txt file - cDNA_ID_3044234; gDNA_ID_1971953; Annot_ID_177403

SEQ ID NO: 31636 - DNA, 3003 bp, Unknown; identical to SEQ ID NO: 21482
  misc_feature (1)..( 3003): 2750-1469P.txt file - cDNA_ID_3044238; gDNA_ID_1971953; Annot_ID_177395

SEQ ID NO: 31637 - DNA, 3003 bp, Unknown
  misc_feature (1)..( 3003): 2750-1469P.txt file - cDNA_ID_3044247; gDNA_ID_1971953; Annot_ID_177386
atcctggaataataatttgttgagaatttaattacaaagtaaacgatgacttacatataaaattcgtaaagtcttggtcaatcttaattataaagaacaagttggtcattgcttattataaaaaaaaaatgaaaatgcttgttgtcaagtaacattaactccattttttcttgcatttactcaacttcaccaaatcgtagagaagttggagaaataaatgatcagaaacacacatcaatcgcaaccaagcggtcaataaaatactaaatagacaaagaagaagtagctccagctcctccgccttggattatttttacaccggagaagcaaaaaagaaaagaagatggacatgaaagaagtgcctccacctcctccaccttctggattcaaacgatataagaaaaaaagaagcaaaaagatggacaacaaagaagtgcctccacctcctcctcctcctcctccacctgttctgcctcatatccgatcaagaaaaaagatggacatcaaagaagtgcatctacctcttccacgtcactatcctcctcctcctccgcctcttccgcctcctccgccttatggattcagacgacatcataaccaaagcggcaacgagcttgagaaacgaatagcacgtctaggctttccaactcttcgcccttttcaatccaaacgatatgataaccaaacccttccaaacccaagatgtcctctgtctaatccaacctacccccacacactcaatcctaagttcagcgtaaacactacaaatggttgttttacatgcggtgaaaacacatccccctggattgaccaccataatgtccatttcttctgcaagaggtgccatgtcgagttccactttggttgccacacgtaccctagtgagttaacacatccttatcacctccaacaccctcttattttcacatttcataactatcaaactggggtcatatcagacgccaggatagatgaatccttttgcactacagttttgtctggctccgatcctaagaagtctggctctatagataaatgttcatggtgtggaaaaaatatccaagggaattggttctatcgttgttctatatgcaaattttgtttggatctctcttgctcccaaactgatccacctctgctcgttgcaaacccaaagagtcatcaccattcactcgtattctatgctcgaccactcttgactccgtgtgatgcttgtgggtcggtcaatgtgttggatccaagttatgcttgctttcaatgtaactacatggtccatcaaagttgcatcgacttaccacgagtcataaagatcactcgtcaccagcatcgtctttttcatactccttacctccattccacgattccaccatgtcggatctgctacaaaccagttgacatcaagtacggtcagtattcttgcaaacacgaggatttctcttacgttgtccattccaaatgtgcaacacatgagaatgtatgggatgggaaagaactcgaagaggaaccagaagaacccgacaacattgaagatatcgtcccatttgagaaggttagtaatgatatgatcaagcatttctctcatgaacatcatcttctgaagctagaaaagtatgaccgtgttcgagatgcagagaagcaatgccaagcatgcatccttcctatcaactctcacgacttcttctataactgcatggaatgtgattttttcctccacgaggtatgtgctggtctacttagaaaattggatcatgcgttgcacgttcaccctcttgtcctagacccttctcctcaacgacactataatcaaaatggttgtttgggttgttcgagaaaatctactggtttcaggtacaagtgctccatagagaaatgtgtgcttctcgataacgttcagatagatgttagatgtatcttagttccagattttttcacccatacagctcatgaacatcccctatttatatccacatccgagaaagggaaaagtaagatttgttgcgaggcttgcaaggagatatgtcttgtgtcctacctacagtgttctgaatgcaaatttgctatgtgttatcagtgcgctaccattccaaacgaagtctactacaaatacgacaagcattttctctccctttgctacggagaagtagtgtttggtacgtattggtgtgaagtatgtgagaaagaggtagatccaagggattggttttacgcatgcaacaaatgttgtatcactgtccatcttcaatgtgtattcggatcctctggttatgtgaagcctggtttcacattatatcattacttcacaaaaatggaagttttaagcaacagtaagagcactcgaccgttttgcactgaatgtggtcaacgttgtccaagttccgtctactacaaacttggttggttgggaactagtactttttgttcgttgaattgcttaacgtcaaaagaaaaattgatggtgttgtcaacatgatgagtttttttttaatgtgttattggaattttttttttttaataatgtttttcagagatttgtgtagttattatttagatccagagagtttttcagagattattggattttaatgtgttattggattttttgtttttaatgatgtgcaacaaagagagttttttcttggacatatataattaacattcaatggacattaacgtctgggtagtgtagtcggttatcacgctagtctcacacactagaggtccccggttcgaacccgggctcagacatttttttctccttcatatttacgtttctgccacgtcatcatccgctacacggacgctaggttctgattcactttttctttcgtcttgggaaaaaagcaaacacaaaacctgagaacaaaaacatccgcagaatcgatatccccagaatcactactctacaaattcgaatccaaagttcaaaccctattcttcgattttcgtagagcagattattgtttccctttaggtgtctccatagtttctgaagagagaaggatg

SEQ ID NO: 31638 - DNA, 3003 bp, Unknown
  misc_feature (1)..( 3003): 2750-1469P.txt file - cDNA_ID_3044251; gDNA_ID_1971953; Annot_ID_177382
aagacactcatgcagagcacgtttatctccgatcaaaccagggttggacttgcataaatgttttcatatataacacaccaaaattttatgatatatcattgcatattatatttatgataaaaatcaacattatattatactacttttatgtaccactctcatataatagtataaaataatatgatatttaataataaataaaaattacaactaaatatttgttttttccggcattacagctaaatatatttaaatttttcaaagtataattaatttgaaaattttctatacaagaatttcatttttaattagggctaaacccttaccagaggtagcccatataaatcggaatgggtgaatgcaaacttaagccgattatctttatttttttttattttttttatttttttctcaatgctggaggatttaatatcatcatataaaacattcttttagaaagaaaaaaaaaatcatcagaaggtttaactatcatcatcggacatgagcatgaggcataatcttcagcgacacgcaaagcgaatcctcgcttacagtaacaggcctcgatttttctgctcctacaccaacgtaacactatcgtctccggcgacgaaccaaactctgcagagtcggatcgaagcggcttcacatcagaaagcagaaatcacaacggtgcttgagcaatggctacagcaacaacaacaacaggggaagcagttaaacccttcgttattaagaggaatcgtcgagaagctcagaagttctaaccgacctcgccaagccctagaggtatcagactggatggtcgaacaaaagatgtacaatctcccggaagacttctcagctagatttcatctgactgagaaggttttaaatttggaagaagcagagaagttctttgagagcatcccggagaatatgagattcgagtcaatgtacaattctctattaagaagttacgcaagacaatccggagaaaaagctctgaagaaagccgaatctgttttcaagaagatgaagaagctagggttgctcttgagaccttcaccgtacaactcgatgacatcactctatagctctctcggaaacagagataaagtcgatgagattcttcgagagatgaaggagaacaacgttgagctcgataatgtcaccgtgaacaacgctttgcgagtatacgctgctgtatctgatgtagcgacaatggacaagtttctagctgataggaaagagattacaaggcttgatgggctcacaatgcttgcgatggcaaaggcttatgtgagagacggttctaaacaaaaggctaggaggatgcttcatgaaacagaggaatgattgggtcatgactataaggaactcatgagcctatatggtgaagcaggagagatagaagatgttcaccgtgtatgggacaagtacaaggcgacaagacagaaggataatgaagaatttcgaactttgattggttctctcttgaagcttggtgataccaaaggagcagagaagatatactacaatgagtgggagtgctccggtcttgagtttgataaccgaatccccgatatgttggtgtcgggttatcgcgaaaagggaatggtgatgaaggcagataaactggtgaacaagactttgtggatcagaggattggctacaccaatcactctgttgctggaagaaatggataaaaaggggaataaagtgagtccgccgggcttgagagacctcatcaagaatctacgtgattcaaatcagttgtccaaagcacttgaggcatcaacatggatgtgtcaaaaaaaggtgtttaatctcttttcagaagattatgcaacaaggcttcatctgactgagaaagtgttgggtttggaggaagcagagaactttttcgaaagcagcatcccggagaatatgaaagattactctgtctacgatacactcttaagctgttatgcaagatctagcaacactcaaagtaaagctgaagccgttttcgagaagatgagagagctaggtttacaatccaaactttccccattcaactcgttgatatctctctacagtgggcaagggaaactaagtgtggtcaatatacttctatgtgatatgaagcataagaatatagagcctgatattgtcacgaggaacaacgttttgagagcaaacgcatacatattggccatagactcgatggagaaagtataagagagagtgggatggttttgagagcaaacgcatacatacgtgatcatggtgattataacgtgatatcgtcatctagaatgtcgtttttgttaaccgtactgtcattcctagttctctagatctaccactttgttgatatgctggtattggaacgataccgcatgttctcgaaaatgtgcaacatcgttgaccacttaactcagtcttataattattgtatatgttccattttaataagaggatgttaagataatatttcaatttatttaacatatttctttttaagtaattttactgaaaaaaattaatgctctgttattttaaattcttcatataagatggatctaaatcttgtatatttctttgaatgtgcacagcctggaaacaggtcttgagaacaaaaaagtaatgagcatttattaaaagtaagcgaaagtataaaatagtgttacagaaatgttattactctgttattttaatcctagaactaatcttgatcttaatcttaatcttagtattttattttataatgtgcattactgcattgcacagcgtggaaacaggtcttgcgaataaagttaatgataattctatctattacaaaagtaaacgatgaccgaaatatgaaatcgtattttctggtcattcttaattataaaaacagcaagttggtcattgtctactaggacatatgtgaatgtttgtttattaatatgaacactgccatttactctactccacgataagtggaaataaattagcagaaacatacatcgatcataaccaaaggatcaaaagatg

SEQ ID NO: 31639 - DNA, 3003 bp, Unknown
  misc_feature (1)..( 3003): 2750-1469P.txt file - cDNA_ID_3044270; gDNA_ID_1971954; Annot_ID_177474
gaaggtggtgagctttttgatcggattgtttctaaaggtcattttagtgagcgtgaagctgtcaagcttattaagacgattcttggtgttgttgaggcttgtcattctcttggtgttatgcatagagatctcaaacctgagaatttcttgtttgatagtcctaaagatgatgctaagcttaaggctaccgattttggtttgtctgtcttctataagccaggtttgatttttctcttttggttgattgattcattaatcttgcaattggtgttttggtttgatgatgattttttcgttgcttaagggaattttgctttgtatcttcattgagtctttgaaagtttatgtgttgattggaatgattctgcatttgtgtattttggcttgtatctgtgattctttgaaaccttattgttggtggttcatcgcctaattggttttagtttactcttcaggacaatgtctataaggtgtagttagggagcttgctttggttagttgttactcattgaggagtctttgaatgtgtggattggaactattctgcatttgattaagtctttggtttggtttcttgtagaatcaggttatttgtgttttctatgaatcgaaaattgaaacaaagtggtttcttgatagaaacaggtttgttgtgttttatatggattgcaaatcgaaataaggttttcggtatgtataggtttgatgatctgtttggttggattcaaatttgttaccttcttagagggaacattgtattgatcgaaattaatgtgtatagatgttcgtcattgaggagtctctgaaacttaatgtgtagatcgaaattattctgcatttgtgtgtctggcttgaaccttctcattaatgccagtttatcggctaattggtttttgtttgcttcttcaggacaatatttatatgacgtagttggaagtccgtactatgttgcaccagaggtgctaaagaaatgttatggacctgaaatagatgtgtggagtgctggtgttatcctctacattttactcagcggtgttcctcccttctgggcaggttagtctactaaaaaagtagagtcttttctatttacaagtttcgagtttttgtttgaatgatgtattcttttctcttgggcattgcagagactgagtctggaatctttagacagatattgcaagggaagttagatttcaaatctgacccgtggcctactatctcagaagctgctaaagatttgatctataaaatgctcgaaaggagccccaagaaacgcatttctgctcatgaagccttgtgtatgttcattctttgttgttcatttggaattagcaactgttgtgaattgtttttatggtaaataatgagtattgagtttgctctgaatgttatataggtcacccatggattgtcgatgaacaagcagcaccagacaagcctcttgatccagcagtcttatctcgtctaaagcagttttctcaaatgaataagattaagaaaatggcattacgggtatgaattcgagtaatatacattcgctttttctttatgtccaatccgtatgctgatttctctgaacacaggtaattgctgagagactttcagaggaagaaattggaggtctgaaggaattgttcaagatgatagacacagacaacagcggaacgattacttttgaagagctcaaagcgggtttgaagagagtcggatctgaactgatggaatcagaaatcaagtctctcatggatgcggtatgaaagaaccaaaacaaactctttcctcttttcaaaaacttttgtttccgtttaacatcctctgtgtgttgtggtcacaggctgatatcgacaacagtggtacaatagactacggagaattcctagcagcaaccttacacatgaacaagatggagagagaggagaatctggtggctgcattttcgtactttgacaaagacggaagcggttatatcaccatcgatgagcttcagtcagcttgcacagagtttggtctatgtgatacacctctggacgacatgatcaaggagattgatcttgacaatgtaaaccactcttcttcttcttctctttgtttacctccttcttcaatgttactttactataaccgagagcttttgaattatgtaggacgggaagatcgatttctcggagtttacagcaatgatgaggaaaggagatggagttgggagaagcagaaccatgatgaagaacttgaacttcaacattgctgatgcttttggagttgatggtgaaaaatctgatgactgactcatcattcttccacaatttctgttttttttctctttaatttcgtttatattttgaattctaatttctaaggatacaaaaatatattctggcttgttttttgctttcctttttatttttgtacatgagcaactttctaaatttttatcctcatatggataatttttgcttcatataaaagtttttgaattccaaagaaatgtgatttagggatggcgaaaagaaaccgaaccgaaccaaaatcggatttcataagtaattttcttataatacaaactgtgaaactgtagaaaattcttataacaacccaaaccaaatctaaattcttataacaacccagaccaaatctcaaattgaaaccaaatttggtgaatttgtaattaaccaatattcagaattaatataactaattaaatataaagtacatttaaatacactaaacactataaagagattaagagtagttagaattataatttttgtcaaaaatcgaacaaaaccaaaattgatgtgtatataatatattacttaattggaaaacccaaaatctgaaccgaaataaaccggtaaaccgaaattgcaagcttagaaattaaaccaatttgaagacaggggtacaatggtaattttcaaaggaagtggataggataacactgcggatttattctccgtcgagctccaaagtctcgagcttagagctctctctcagtcgaaaacaatg

SEQ ID NO: 31640 - DNA, 3003 bp, Unknown
  misc_feature (1)..( 3003): 2750-1469P.txt file - cDNA_ID_3044299; gDNA_ID_1971954; Annot_ID_177453
ggtaaccaacgatgacttcttacaaatcattacatattcgaagaaaaaacttgataacaacacaagtgtaccaaagatataatcaaataatcgaattgacggattgatgaactatgagattataagagacaaatttgtgtacttagtttttaaattcagccgtaaacacttacctcggaagacggatgagacgacgttttctcatccctaatatctcacattccaaagagcaaaaaatcattctatgagttgatcgattgctatgattgtagtaatatgtagcattccttctgtagccttcgtagaagatcaaaccggtacaacggttgtgacacatataacagagttgtcgagtgttactattgtttcgaaaaacttgcacctttccataataatcacgaaatatggaaccaggtttcataaagacagaagatccaaatatgcaatgaaggtggatggtgatgcaacatttgttacatgtgtagaaccattcttttggatccaattgtttttcacacacctcgcaccaatacgtgttatccgcgctttccccacaagaaagggtgagaggatgcttgtcaaatttgtagtgtatttcatctggaatgatagcacatgagtaacacatagtaaactcgcataacgtacactgtagatgagcccccaaacatcttttcttgcaaactttgcagaggatctcgtctttactgttgtaggatgtggagataaaaatgggatgttcgtgacttctatggatgaaatactctagcactgagatgcatcgaacatctagaacaaaatcttggcaacctttattagagcatatgtaactgaaaccagtggattctcgggaacaagctgaacaacaaaactttccgggagatggagataggataagagtgtgattgtgcaatgcatgatccagttttcgagaaaggccagcacatacctcgtggagagagtaattgcatttcttgcaatggtaaaattggtgagaaacaattggatatatgcacgctcgacattgcttttctgtgtctcgagcaccatcatgattcttgagcttcaaacggtgtttgtgacaaaaatgctttatgaaaccatcacctaggttcctaaaaggtgaaatatcttcagtttcatcagactcgatttcccactcgagttccttcccatcccaaacattttcatgtgttgcacatttagaatggactacataaaaacaatcttggagatggcaagaatattgcccatacttgatatcaacctctttatagcagatttggcatgacgaagtcaaagatgaacaataaggagtatgagagagccggtgcgggtgacgcgtgatttttatgactcggggtaagtctatgcaattctgatgaaccatgtaattacattggaaacaagcataacttggttccaacccgtcaaccaacccacaagcatcacatggaactaataatggccggggtaagaagacgagagagtggtgatggcttttcgggtttgtaatagtaagaagtggaagagttgccgcacaagagagatccaagcaaaaactacagatcaaacaacgataaaaccaatcacctttgaaatcttttgcacaccaagtgcatttgttgaatatgatatcagacttatacgggacgatatccacgaattcatacttctctggacctgatgtatcctcaattttaccaggacaagcatcagggatgatgttggatataactctggtttcggggtttcgatagaagagagtaagaggatgttggaggtgataaggatgtgttatccttcttggacgttgatggcaaccattgtggaacgtcacctcgcaggtggtgcagtagtagtagagacaatccggcgtcgtagcagctgctttcccgccacatgtaaagcaaccgatacgaaagttgaatctgtatcgaacggacaagttatgagaagggtgagctggatgagacataagacatcttggtccatcttcaaaacccatttgcttaactgctttatgttgcgaacttgcgatctttctaaatctacaaatatttgtggtcttcctttcattattcatctattatatgcttttattattattttatctcgtgaattgtaagaaattttagaaaacaacaaagtttaataaaataacaagctagctccaaatatccatgtaaaacatttgaccaaatttgttttggtcggcgaccaacggtcgtctacatatgaccaactttatttatttagttaataagcagctccatatgcacgcatgctcgttttaggttttctatgtttttggaatttgaattgtctcagttgatttatcatttgaattataattattacttaaataaaaattagtagcaatcaaactgatgtttagatgccaattttcaacatgtatacaataaaaaagatgtctttgaatgttttattgaattaagattttaggatataagtagatgtaataatataaagattcaaataagagaatctacaatagatgaccatagaagatttgataattaactgacaagattatacactgtttgagtagtttatatatcataataatgacatataaacccctatatgcctatcaaactttaagacacatatatgtaaactaacaggtgtgtgtcaggacgagagatatcatatctcttccagagatttgatttacaaaatttttttgggaatagttgtcatattaatcaagagaacaatgctaatccgaagagttgcgttgttttgtttctcattcaactgctttttctatcagtactagtcttatttcgtctctttctctctgtttttcttttttttttccgatgttcaaattgattctccaattcaagtgtggggttttccgatcaattcgtccaagtaagtatctaaatcaaatgcaatttttgtttattgtttctgaattcagttctactttggtgttcctaatttttattttttctgggattgacttttgagatg

SEQ ID NO: 31641 - DNA, 3003 bp, Unknown
  misc_feature (1)..( 3003): 2750-1469P.txt file - cDNA_ID_3044312; gDNA_ID_1971954; Annot_ID_177440
tacatctttaatgctgcaggggaagcgaacagagaagaagatcttgaatttcctcagctttcttcacccatgaggttcagtaacgaattggcaggagagtcttctttccctgagagaaaggttcagcataagtgcaacgattataacattgtgtctacaaccactgaattgagaactcctcagaaggaggtaggtttggccaacggaacagaatgcttggctgtttctcctattcctgaggattggagaactcccttggcgaatctgacaaacacaaacagcagcgctcgcaaagattggcgggtgagttctggagaaaagttagaaactcttcgacagcctcgcaagttgaagagactacgtagacttggagattgctcgagtgctgtaaaggagaattatcctggtattacagaggcagaccatatcagatctcgttctcgcggtaaaaagcacattagaggtaactggttctgtattttcttttactacattgaaatgatctgggagttgacaatgaccgaaaatttacggattctgatgttgcttaacatcaccagaatctccccagtatatgtatgtataccaattggtttgattgattaggaatccataagatcttaatagaatattgccagtgtcatagtgaagtggaaaagtgctgagagttggtttacactttcttctgttgcttttgcgttggtgacaaaaaaggtcaattttcaattaaaatttgagttatttgtggtatacatctgcgttagatcaatgtcttgatgtgctgagagaaatgaaacatttgtcatgttgatctgtttgagtgattgctgcttggttgctctgtgtcttaaggtaagaagaagatgatcatggatgatgatgtccaagtcttcattgacgaggaagctgagtaagttcttctctaatctaaaaataaacatctgatggtctttcttacttccacaaaacagcgagagacaacataacaaaagtagtctttctgactacaaagttgatgttagttgtttcaaacctctctattttgatcagggtctcttcgggagcagagatgtcggctgatgagaacgaagatgtgactggcgattcatttgaagatagtttcatagatgacggaacaatgcctacagcaaatactcaagccgagtctggtaaagttgacatgatggctgtttacaggtacatacaaccaaagatatctttcttctactgcgaggtcaatgagcttattaaaaatcacaaggtatccttccacaggcgttctcttctcagccagtcaccattaccggcgagatttcgtgatttagccgcatcaagtctgagtccttattctgctggacccttgacgagaataaatgagagcagaagcgactcagataaatcattgtcttctcttcgaacaccaaaaacaacaaactctgagtcaaaccaagatgcaatgatgataggaaacctttcggtagtacaaatctcgtcagatagccggaaaaggaaatttagcttatgcaactcggcgaatgcccccgtgattaacttagaaagcaagtttgcagctcatgcacaagccacggagaaggaaagccatgaaggcgtgagaagcaatgcaggtgcgttagagtacaatgatgatgatgatgatgcattctttgcgacactagactttgatgcaatggaagcacaagccacattgttattgtcgaaacagagatccgaagcaaaagagaaagaagacgcaacggttatacctaatccaggcatgcagagaagtgatggtatggagaaagatgcaccatcttttgatcttggtctgtggtgattcttctttcatacgaagatactaagttatgtatatagattgacaaaggagacagtagagcataggcatttggatgtatgttttgtgtattaagtttaggtatatcctattgaagtacagtgcttaaggcagtgcacatggttaaatcaaggttaatgcctcaattcgttgaaccctttaagtaatgacacaaatatgactacatcggccaacactctcacacctctcaaccctaaactgacattacaaagcaacatttaccattggcacgaaaagaaaactaaaataaaataaaagaattagatgtacaatagacgctataaactctagaaattaataatattgggatcataaaattttattaatttataatgatattaatatagatcttataattttatatttattaatttatcgaataaatgaatatttattaatttaaagaaatatttatgcaaaatataatactattttttttatagaattttctttatttagattttctatgctttattgtttgcatattcaattatgttaaattttggttattagaatagaagttgaacttgaagttgtgattaacaatcctagttattagaatagaatagatgtaaatagtctactcgaccatctgagtgcaaatgaagcatgcttagagtttagaagaaattgtagcttatatctataatgttggtgaaaaaattgaagacgataatgtagaatctttggaaatagtgacatataaggaagaaattaccgcgtcaaatacttttcataacttttggattcagatcgaaaagataacaccataattttttgatgcaataagaaaattagagacgaatttcaacgagattctaagtttaagaaaaaacaaacaacactagattcatattatactggattatcttagaatgtatgtttaagatttattcttaatttatgatattattgggaccatatatatatatatatttcaaaaaaataatatcttattatcttatcgatttaggttaatttttacctaggtccgacttgagaccgacaaaatttattaatttatcgtgtttattattttataaagtattaatttatagagtttctattgtattcacttttgagttgtgtctattcatgagctatttccatgtatttataaaaattagatg

SEQ ID NO: 31642 - DNA, 471 bp, Unknown
  misc_feature (1)..( 471): 2750-1469P.txt file - cDNA_ID_3044322; gDNA_ID_1971954; Annot_ID_177433
gaattcctcgaagcttttgtagtattgtgtaccaataaacccagtctgaataaaccaatggtggagtctattatgggaaagtgaaaaagcaaaaataactgagaaaataatagaccaaataaagcataaggacaagaattgttgttttcacgaaaaccacgcaatgtaaatcatcaacatggattgtttcaatatggtatcttcctctatttagtgatctagagattgtttcttgtttttttttttttttgcattctaaggagaagaggtgatcgaaaccaaccacacgggaggagcttatgccattttcctccccgtggaaggtctaacaatcacacgtctcctaatctcgtacgtcttcttaggtatgttctttgcatgttaaagaaactgtatcttcaattcttgtcattacatgataatggttttcttatacatgttttgctcataccttataggttttgaagaatg

SEQ ID NO: 31643 - DNA, 3003 bp, Unknown
  misc_feature (1)..( 3003): 2750-1469P.txt file - cDNA_ID_3044364; gDNA_ID_1971973; Annot_ID_177524
ccagcaagaaaactaacgacgtcaagacttagcactattctttctagagttttctgtcctaattcttacttctttctttttttgttctttagagattctttgatttttcgttttcaaatagagattattgtaaatgttacatgtattacagaaatttacagtagaagtttaggaaaaatgaggattttatttggtaatgtaagtcgaaatgatcaagacttagactatcatcttgtatcgtttcatcaatatttctttgataaacgttaatcagctttttaatttctatgattatgtatcaattttatttagactaagaaagtcttttaagttaaacgcataaaagagtcaaggataccatttgaattgacattgtattagtgtttgggtaacttccaagaaagagataaaattaaaagataagaatggggccaaggcgtaaagaatcaaaagttaggcgaaatatgtataaattgaattgaacgcgttttttatgagacttgactatgatccattttccacaacgcagacacaaagataatgcatttttattacacaagtgtgtatgcattatttcacaaatttcattaatcccaaatttcttcgttataatattcctgtcatatatgtgtcgagtagtgaaaaacgagaaaattagttattgttttattgaaatgaggtaattattataccaataagattccgttttgttttcttcgtagaataaacaatagcgctttctgacaataatagcaaatttttattcttgaaaactttcattgtaaaacaacgtaccacacagctgagttgagcaaatcttaaaaaccaaagagacactgtaagtttgtttcagacaaccttaaaacaaaagctgagctggaactggttcatctccttatgtcatcgtgtaaacgattcagttgttttccttctcataaacctcgcttgcatatttccagttgatcactttccatacattcttcagatactcaggcctcacatttttgtactgaatgagagaatacagattgattagagagcttaatcttttaagctaactcatgagacttaaggtatcaaaagtgttgttacctgcaagtagtaggcgtgctcccaaacatctatacccaccagaggtaccaagcttcctccttttgtcactaatggatcctgcaccaaccgaaacaaactctttttctttaaaacccattattctcacagatgttcatgagtaccaagaaatcttttgaacatattcaatagcgcattcctgatcatggataagttacctgattggcagttgtgtcaacaactagcttcttcagttctttgtctagtccgagccactgaattaatcaacagaaacaagcgaatcaaggaccatggttattatacgtaaagcaccagagtcgacaatgtgagcagatgaaataaaaaggtgaaactagactacagaccacccatcctgagccttgcactgcagcaccctcagcactcatctttttcaccagaccttcaagggagccaaagtgagcgtcaatggcactaccaagagatccttttggtggctctccaccaccttcctgttatacattaaaacaaaccatcaattacagaacaacaaaatcgaagaaatacacagaaactcaaaacacaagctcacactggaaggagcaaggttcttccagaaaatcgaatggttgacatgacctgcacgttagaaataaagtcgatcaattcccattctctagcacacaaaaaactcaatttatttccaatagtttctctgccaatttctcttctatcaatccaaccggtccggagctcaagaagcaacaatcctaataccaaactatagtcatcaaaattaatcaacagcttcaatgttcctaacaaaagttctatactaaatcaactggttatgatctcaagacccagcaaacaaaagtagctatctaagaaagcttgcattaccgataaaagtttcattgattcttacagaagtttcatcccaattcatcaaaattactcatcagcttcactgttcaaaccaaatttctctcctaaatcaactacttcatttgctaatatcatccaaacacgatctaaacacaaaccaatcgatcaaacacatagaaatcgagatcgtaaaaaaaaaaaaaaaagagagtcagacacacaaacacacctccgccgttgaatttgatggcgctctgcaacttaacaacagtggaagcatctcccttgttcacagcttgatcaagctgctcaagagcattattgtaattagtaacataagcctggtgatgcttctggtgatgaatctgcatgatctctccactaatggccggttccaatgcgccataatcgtaaggaagatcaggaagcgtaaaagtctgaatccctctgatcctcaatagcctcgatgatgtctccttcaagccggctagggtttttctactcgctacacaacgaatcgccattgttggaatgaagatttgtttctccttctagtggtcgccaaaaatgaacatgtgtataagtggagggttatgataatatcactgcctgtcatgtatagagaaaagtgactgttttgacacgtagacatgtgatttttatttatgggccgtaatattggattagtgagcccaaggccttaatataataaagcgtaatttttaatattttgtgacggctaaatgttacttttttgtttgttcacaggaaaaaaataaagaaatgaagaaagttgactagaaacggagaatttccaaatgttgaatttgttggatgcatgtgaaagccaattctatttggttcctccttgataatccacccaatcgctgtcattctcccatcaatctagctgctttcacaaaccattgtactgagatcgtatctttaaggtaaatttcaaatcggagtcggcgagatcgaaataggaacctggaagtcggagaatttgtgtaaattcggttttttttttttaattctccgatg

SEQ ID NO: 31644 - DNA, 3000 bp, Unknown; identical to SEQ ID NO: 9021
  misc_feature (1)..( 3000): 2750-1469P.txt file - cDNA_ID_3044371; gDNA_ID_1971973; Annot_ID_177515

SEQ ID NO: 31645 - DNA, 3003 bp, Unknown
  misc_feature (1)..( 3003): 2750-1469P.txt file - cDNA_ID_3044392; gDNA_ID_1971973; Annot_ID_177497
gagctcagtgaagagaagaaggaatcatcgtttccgaagaaatggccgctaggctacgaagccgatgctgaaacgccatcgttttgccttgacgccgactgttcaaccgactcgagcgagttaaatctgagttcgctccgtgagttcactcggactctagagaaagttggactgaagacggtagagatgctggcgaatgcacttgggtttggatatgattcaacccggtttaatactctgatgtgggttaaccaaggtgttcctgatgatgaaccggaggtaaccaacggattttatccttttgttgtttgtttacagtatcagataagggaacagaagtattgtttgctaaccgagtctggttgggtgtccgttttaccccgagttgactcggttcttgtgacgttgggtgacattgctcaggttagttctcttttgcttttgacaattgacagaacacatatatctcttttatttatctataattaattggttagttgtcttccttaaataattatcaaattatcatcctttgtaatggaactttattccactataccgttaactggctgttttaatgtattttaaacattatccaaaataaatgttttccaacgcatcgttcaaaaagagaacaagaatttggatatttccgatatttattgttgacaacaacaacaattgtggagcataaccggggaatgtgttttcacttttcgtttgaaacagatttatggcattgggaaagaaataagaatttggaaatttccgatatttaaatacttatacacatcacatcgcaattgtacttagtgtcctatagaattcaacaattcttttttttttaggtcaaaacctaacagctttctacaatatagttttcaacttttgaacagctaacaaacaacttaaaattggcaggtttggagaaatggagaggtcaaaagagtgaaatatcgaccagtgttgtgttcaggacaaaaagatggtccagtaaagtgtgtaacaatgacattgatgcttacacttcccatggacagtatggtttcatcattgaaggatatgatcagtgacggcgacaaagaagaagagtatgcagaggaggaggaagaagatggaggagcaagaagtgatgagagaagggcatttaggccttttagtttcaaggagtacgcatggagagtgtaccaagaacgtctcttcttcagggatccacttgacagatacagaatcaaatctttaaaagattgacgaaccgatgtttgatttgtttgtttctttcttgggttgaattggtactatagttcttgttgttactttttttcccccataaaatcttttgattttcagcggattgttagcattttagcattgagatatttttgtttttgttcgattcagttcagagaatgttctattttgatagtcactccatcattcaactaattttttcatatatactcatatcaaaactgtcactatttcaaaatcaaacttttaggttacaccaatgactctatcacactaaactcaactcctagattttatatagaagaatctatgactttgatgatgtactttaaaactgagtcttttgagatcataaccaaattctacttcataacttttgttttccaatgttgattatttgttataattagaaggtgacacaaacgcttatagcatcctgtttttgaaaatgaggaaatacagtgttggcttttaatctctcattgaggcagaatatcaatgaatgacttcaaatctacgtatacatgtttacttatttagtgatccatattggtgttgctctttaattttcttgtgagaatgaattatatacatcaaaattgattatatcatttaattcgagttaaaattataagtaatacaatcttcactaaacactaattaaatcgacgtaaatttcttatacgattttttcatgcaacacttaaatcgacataaatttaaatattttggtcttcataccctaattttgataagatataatagaaaatttcgtatatctttttttttttttggtaaaaagtttttttttttttgtttcatctccatatttagaaaatttatttcaaacttcgttctcgtttgtgttcatcttaatttttaaccatgattgagtcattgaccattgctcaaaacatacgcataaaattcccaaaaagtagtgtgtgtcgtgacaaaacccgacccgtcgatttacgcggtttgaaactcgacccgaatactatccgaacccgtaactttggcaaaagcacatcgtacagctcaggcacttgtagcacgtcgtctctcctttggtttctctccttatattcgacgagtgactccgattggatcgctatttcgtcatttctcactttccaaaaagaaaaaaacgaatctctctccaccatcatcacctttctccttcacttgcctcagatctggctgcgatttcaaatcttccttagtttctctcgcatcgctcggccgttgacggtcccgtcctttccgtggatctgattctggccccggattctctcgccgcgatctgaggtcaaacatggcggctgctaacgcgcccatcattatgaaggaggtcctaacggtgagttctctgtttttaaatctccgggaatcgagctaaaattttggacgattaacatgtttctatagttgtagtctctgatttctatcgatttggttctgctcacactgttatatgattgattcaagtttcattctgttctcaattctacccgatcgttgagatcaagttctctgatcagattttctctgcggacgctcagatctgtgttatctgaatgtatatagtccttagttttaagttattgtgttgcgcaatgtgcttatctactcggatcttgtaactaagttaatgaactatgccaattgattacttttgttttggaaattttccagcttccgagcgttgggatcggtcaacagttcatcacctttacaaatgttactatg

SEQ ID NO: 31646 - DNA, 3003 bp, Unknown
  misc_feature (1)..( 3003): 2750-1469P.txt file - cDNA_ID_3044414; gDNA_ID_1971974; Annot_ID_58697
ctgcaaatactctttatatattagtacacaatacatacatgggtatgcatctttatacgactttatcaatatatgcttacacacatactatggatatgtatatattgttgatcaagaaaaagcattccactttaatttgatagctagattaatgcaatatgagatcggtaacaaactgtcatccatgatatacgtacatataactaaatatgattggcctctaaatattaataattacactttagttataagaatttcctaaattacttaaccatcataatataacatttttgtgcataacacttcctcattccaccgtatttcttccgctgcagttaattattcaaaatcctcgtattcctatttttcgattcaacggtaaatatattaataagaatgatgttttatatataagatatacagatgtgaaaatatgcttaattatgatattgtctcctttcattccatgtgttagccagttggatatctatggacctttccaataaaggaatatctttcagcatccatataagaataaaagaggtaaaaaaacatttgatttaaaaataaaataaaatagtagtagtacgtactgaagaaaaattaaaagataaaaagaaatttgccgttctacgaatgagtttttttttttcacttatccccaaaagataacaatcttacagacttacacacacacacaaataaaagagagaataaaattcataatcattatatgattgatatgtaacccaattccaaatttaaacctctctgtcttctaaatagattccaattttttttctattatcacaattcacaagctctaattctacatatataatatcttaaattgtcattagataactagtaagttgactccttaaatcctatgatctcgaaatgtttttttagaaaataatctttgataggtacacgtatagcttataattgaatgtatattgttttcattaatttctcaacttagccctaatttcttatagaggaaaaccttgactagtttttgtgttcatttagaaaaatctcaaatcgaaggaaaaatatcttcatcttattaagatatatagcaacacaaaaaagaatccatgtttttccttttgttataatttttcttcacaactaagctacgaggccttgaaaatggtggcatctttttcattggatagtgtcttcagaggttttcctttttatttttccaaaaataggggactttttttctttatacctctattatttgctttaccaaaaaagatgattggcacaaatagttcatgtttaaagcattaaagtacaaaattatggattaaagaaacaccgggttacaaaaacggattatatttgaagaaatagttttgcagttgtggatcgtcgtctatggatgatttaatgttgttcatttcagcaaaaactgaggcgtcgataaaattttaatatggaaaaatggtgtttaagaagaaaggaaagaaaagaaaagaaaagaagcagaacacctgagaggaacaatgactttaggacgtgttggtagtggactgtgtcgccatgtgtgtggttctctgaaaagaagatcaatctataaaggtgtgagcaccattcttagtttaatagttttccccactatcttttttttccttcttctatatatttcttaatacgaaaatactaacttaaaattcaaaaatacaaggaaacctttttttttgtaataaagggaaactttcactggaatcgtaagtcgtaactatctgtcatgatataatcatattttagcttctttatattaattttttttcagggccacgatgtcattttcagaaagatgaaaaggatataactattaaaatttatatataaacaaaagtatattcagtcttttcgtttgagaaggtccattcattatggtatgggttttcaattctcactgtacgcgaacagtgatattcaacttcatcatctcaagccacacacgtatacacatttaactttacagatacttacatttatagaattgtacaacagttcttgttacgcgtatgtacattcgtcacgtaaccctttactaaagcatatacagtgtcagtattagtatatatatcatgtcgaaactatttttgatttctagcaatttcttttgaaagtgataaattctatatcgtcaagcaatatttaataatgaacttgcgtttcctttttaaccttatacgtatttatattaggaaagaaagtacatgagcaattgagcatacatctttaagtaatcaactaatcaaaaaaataccttattaaagactggattatttatagcatgaataaagtaccagctacaatattagccccctccccccactatatttatatgtaaattacgtttgtgttgacttcatttaaagatgtcagtatgtcactaatattggacgtaaggtgataatgcaagactctaatgaagtccacttccaaacaaatgaagaaaatgaaattaacattttcatcacaaagaaattacatatatgtgttgtgttagttttttttctttcagaaaagtcgaaaccgaaatcacataacggattcactatgattctataactaacagataatacaaacaaagcccaactaacgacccatcatagtaaatcacagaaaaagatgataactaaacagatcgtgcaaagaaagcccaactaacggcccatcataataaattacaaaaagaaagaatccggaagaaaattgaaatcttatccagagtgtagagagaaagaagcggagtcacaaaaaccccttatcctcttcttcttcatcatcatctctaattcaaatatccgacgcagacattttagacaaagttactctctttctttctcatgttcttttcggacagaacaaaactccctaatccaaatgtcaattcctttggtctctctctgaataatcatctctcttcaaaccctattcaattttaactatcgatcttcggctaagtctccaatg

SEQ ID NO: 31647 - DNA, 3003 bp, Unknown; identical to SEQ ID NO: 21497
  misc_feature (1)..( 3003): 2750-1469P.txt file - cDNA_ID_3044422; gDNA_ID_1971974; Annot_ID_177581

SEQ ID NO: 31648 - DNA, 3000 bp, Unknown; identical to SEQ ID NO: 9270
  misc_feature (1)..( 3000): 2750-1469P.txt file - cDNA_ID_3044430; gDNA_ID_1972047; Annot_ID_178239

SEQ ID NO: 31649 - DNA, 3000 bp, Unknown; identical to SEQ ID NO: 9054
  misc_feature (1)..( 3000): 2750-1469P.txt file - cDNA_ID_3044430; gDNA_ID_1971974; Annot_ID_177578

SEQ ID NO: 31650 - DNA, 3003 bp, Unknown; identical to SEQ ID NO: 27969
  misc_feature (1)..( 3003): 2750-1469P.txt file - cDNA_ID_3044434; gDNA_ID_1971974; Annot_ID_177575

SEQ ID NO: 31651 - DNA, 3003 bp, Unknown; identical to SEQ ID NO: 21499
  misc_feature (1)..( 3003): 2750-1469P.txt file - cDNA_ID_3044438; gDNA_ID_1971974; Annot_ID_177574

SEQ ID NO: 31652 - DNA, 3000 bp, Unknown; identical to SEQ ID NO: 9043
  misc_feature (1)..( 3000): 2750-1469P.txt file - cDNA_ID_3044444; gDNA_ID_1971974; Annot_ID_177558

SEQ ID NO: 31653 - DNA, 3000 bp, Unknown
  misc_feature (1)..( 3000): 2750-1469P.txt file - cDNA_ID_3044448; gDNA_ID_1971974; Annot_ID_177552
aaattaactgtattatttgtcgtggttttcaaaatctgtaataagcagcggcgttgacgcctttttccctcttatgtttgctgcctttagaagcactttgcttgagcccatgcacgtgcgatgctgcgaagaatcacgtgcgccgggctcaaaggccgccacgtcgatgctcctctttaattctttaggtaacaaagttttcaccgtccaactgtcagtatgtcagtgacacgtacgcacacacccaacggtcttcttgcaacaagagtcgcgttctcattctgctgcgtttgcgtcactgaccgcaatatcttcttccgttttggacacagagtatgtaatgtaatgacacgttctccttttttggttgactttaagaagtcaacggcgttagctgtacgtgtgttgtggaccgcatttggataacccgtaatacaagtaattttattaatcacggacaatatactataatgcaactagtcgatctttgtcaaattactggttttgatatgtgtgacactaatatgttcataacttcatatatacgcgttccacggccggtgacggactccattatgaatattcttcttaaatttaaacttatatgcattggaccagaagatgcatgttgacaaaagaaagtgatcagaaagcatagaagagaccaaataagttggtttagtcgaatacgtattcaattcatgttaaaaaaaaaaatcaaatatacaaatataatcattgtcatgattaatcacacatgagaaaattgatatttgatagcacaaaacatccccatttctgcatttctggtttttgttggttcttctgttaaactcttaatgcttaaagcaaatatggagatgttgatctgatttaattagtagtaacccgaaactgcgaagaattagctccggagaaggccggccctgaatttgggcaaatttgggcttgattaggctacaaatagtatgttcaaactcgaactgaaaacattaattagactctattaaaaaatgactatggttaagctgccaactcattgctccacatgaaattgagaaatgtaacatggagatcgatctttatataatatttagtgataattaaaagaagcaatctttggattattcttcgaagaatatgacagattacaattccaacagcaatgtttaatttatatggcagaacatgccaatatggacttcaatgttgctattcgttgggaaatggatattggcatgtggtacaattatttaatcatgcttgtttctatgcctaattttatcaaataagaatgttaatttggccttgagtcatttgtcagggagattttagtgccgacgggttcaaaagacaatatgtttattgcaaagttgttatagcaaggttcggaaaagtcatttataaattcgctaaaagttgcgtttgattaaattatgcttattttgtttaatcttagaggataacaactattggactcctagtgaaagtgaaacatatgataactaatttattttagttattttgactaatcatttgtttgtaactgttaaacttggaaattattcagcaaaaaaacatttcttgtatttgcaaagtcacagaatatgatgaataggttttattataatagaataaatcacgagttcacacaattctttaaagaattacagaaatcgtaaaatgattatgccaaatctgatttcacgtctaacatatttggttggttgataagaataaaatcatactttaggttaccccctcatcgtcagcattgacgtttataatttcaatattctcataaacaaatacctcgaaagcgaccacgttttatcgcctagtattgacgaacaagctaactaaaccactcccacatgttacatgtaatgacattatatatacagacacatagacacagcaagtttacagggacgcgaatcgtaaacaagacgtaaaaaacaatgcaggatttttcttcaacggtgtcgtatagcccaagcttcagttactacgcttccggtgaattcgccgccgctgcagttaaagtttcccgcgaaaacgaaagctacaatatcagagatcatgagtccgttaaagtcaactccgtcaatgacgaagacgttgacttcgagtttgaaacgtcgccgttacatgaagaaaccttcgtccacttcccgacgttcaaaaccaacgtcgtttccactactaacaagacagacaaagaagccgccgctgaaaaaatatcggagcgtttccccggaaattgtctgtggagtccactcagatctccggctgcttcgaaacactcagaatcatctactagcacaccgaaacggtgccgtttgaagaaatttctaacgagaagtcatagcgacggtggtgttttgccctcaagtgcatcaaaacggtgctatacttttaaggatcttaagcggaggagccacagcgacggcggcggcgacaccagtaagaggagctcgccgaccgtgaaagttaagaacaaaacggtgtcgtataaggtcggggaaggtgacaagagaagaaaatcttatttgccttaccggcaagatttgatcggagttttcgccgtgattagagggttacgtcgttaattgaagctcaattaatttgtatagttttacacaactggacaaaaaattactataatagcaattaggtacttgtttaaatattgtatttataaatatttccatgtaacttttgtttcgtgtattgaagtccaattcaatgcgttgactcaaaggaacgtttgatattttttttttccattttttttttctcactgagaggaaaagacacgtgtcatgtgttgataaaaaggaaattagatacttccacgagaaagcgggacctacgtgaagacacgtggaccactaatttctttcttaccttcctctgccgcctcgttttctgctcacagttccaacttcttccatacacacacattctcggaaaaatctctattggatcggtttaatg

SEQ ID NO: 31654 - DNA, 3000 bp, Unknown; identical to SEQ ID NO: 9073
  misc_feature (1)..( 3000): 2750-1469P.txt file - cDNA_ID_3044454; gDNA_ID_1971974; Annot_ID_177550

SEQ ID NO: 31655 - DNA, 3003 bp, Unknown; identical to SEQ ID NO: 31646
  misc_feature (1)..( 3003): 2750-1469P.txt file - cDNA_ID_3044458; gDNA_ID_1971974; Annot_ID_177548

SEQ ID NO: 31656 - DNA, 3000 bp, Unknown; identical to SEQ ID NO: 9086
  misc_feature (1)..( 3000): 2750-1469P.txt file - cDNA_ID_3044527; gDNA_ID_1971979; Annot_ID_177668

SEQ ID NO: 31657 - DNA, 3003 bp, Unknown
  misc_feature (1)..( 3003): 2750-1469P.txt file - cDNA_ID_3044555; gDNA_ID_1971984; Annot_ID_58736
aagaaggtgaatagagacttatgatttctcaagaatgaagaagaagattgtagagtgttagtgtttagttctgttcttctggtaatctgtgttttttttaatgtaaattacacaagtatgcaaaacttttgtaaggggctactgttatatgatgtaatgggatttataagaaaaaatgtaaaaatcaaacatcataactgggtttacacaagacaataagaagaagatacaatgtatctgatacatagttacaacttctaccaagtaagcaacagaaacaacataattttggtattgaatgagtttttcttttgcaagtattaacacacaacagcagaaacagaagatgattgttcttttgtctctttgatcagagatgatggtacaattctgttgagagacaccatttttactggtctgtaagcaatttggaacctggataagaaaacaacctcacagaattcacataacttaactccgcaagctcttccttcttcatgtttgacaggttcgcaacataatctagtacctattcatcacggaaaagattagacaagtaatgagctgaaataagcaaaaagtcagatgatgataagaacatacagcaagaatgtttgcaggctcattgagagttggttttggatccgaagaactctcatctgattttggtaacccgtcaggtgaatccgtctccaataagagcctatcggaaggaatctttaccagaccaggtaaaaagaattcaatacattcgttttccagaagtttgtataattacagaggaaaaaagcaaaccgatttcaaagtcttcttggcaattttctcatcaatgtaagtgaaccagccagaaaaagagaagtatgcaccaagctcagcgagtttaggaacaacttcagctgaaccattgaatgaatgaagaatcaccccagcaggaaaaggccctatggatctgcgtgtatttattttgagaaacttagtgctatatctttgtaaatgcaacatgtagatatacatacctcattatctctaggagatcatcaaatgcatcgatgcaatgaactgctactggtttgttcagttcttttgcaagttcaagctgtgggcgaaacacgactagctggtctgagtaatcaattcctcctgctaagggacctttgtctaaaccaatctgcaaaacacacattaaattttatgaagatgttaatctaatgagatctcagccaaaaggggtttcattacaacatatcattttgcagtttacactaaatcttgaaccaacaaagcaaacatttcagaattcaaaaagaaattgaagacaaagattttagtttagatgaataagtgataaagacacaaacttctccaacagcagcagtaggagtggtctcaaagaacttcttcaatgttttaaaccaatgagggcttctatcagcaataaacctgcaaaccaaaacagagaaaagaaaaagaagaaactttgatctgaaacttttgtgcatcaattgcaaaaaggatcgtctgtacataaaacccatatataccaaggatggagtccaaagcaaggaacaacagaaggatacgtctctcccatctctttcaccaagttccaatctttctggctccattaacaaaacctcttaaaaatatgtatacgtttgtgtaatatagatgacagtgaccaagcgatcatgaaaatttgggaacaaacctcggaggttccattgactgcgaaattggtaacaccgacagctaaagcagcagatatgagctgcgaggctttgtcgatgaccctcttgtcttggaggtgacaatgagcatcaaacaacttcattttcaccgtgaggttcttggttctaacagatccctgtgacttctttcttctctttgaggttcttaaagtatatggagatatatatatatagataggttatgtacctgtgtttatagcttaaccctaaagatatggtttgatcatatgatcaacacaaagagttgacttttgagatagtttgaggtttaagagacgctacaaaactctgatctggatttacttgaacttgaagagtaaaatgactaacctttgtgtttaatagattatctacagtaaacaaatacttttcgtattaacctaacttgtgtcagattagagtaaggaataaaaataagagttatctctatctgtgatattattaagaacaaagagtacaagtcatatgttttgtcaaacgcacatacaaaggcaggcatgtcttggtttctagaccacctgaagaccaaaaatagatgaaatgtgtacaagataatagaagtgttacctgtctgaagacagagtcaatgaaggcagaaacatcttcttagctgacattttcttcagttactccagaataattggaagcaagattgaagtaacacattgttggcattgaagtttcgaccaaataaagattcgaatcgctttagtcacacttgtgtaagctttgttctgttttcatctgagcaagggcatgaaccacattctgaagctcctcccatatggcttctttatacatcatccttcgactgttcactgatgatttccccttgaacgccgctgataccaccttaatgctgcatcagaattctgatttatagtttggttagcttgttcttctcttctgtttctgttgcaaaatttgatcaattttttttgaaaaatctttttttttccttttggaaaaataaataaaataaaaacaaagtgatctcagccgttgggtcgagtactttggctaaaaataaagtgatctcagccgttggatcgtgtactttggcttcaccgcaactaaaagaagcgtcatcatataaatcaatcgcaccgtctgtgtcgaaacaaggcaaacccaaaagaggtttcttcttctgtcaaatctttctctcctctctctctctgatattcttcgtcgtcccatctgcgaattgtttacacagagatatagagaggaagagaaccgcctaaggaaaatg

SEQ ID NO: 31658 - DNA, 3003 bp, Unknown; identical to SEQ ID NO: 31657
  misc_feature (1)..( 3003): 2750-1469P.txt file - cDNA_ID_3044555; gDNA_ID_1971984; Annot_ID_177681

SEQ ID NO: 31659 - DNA, 3003 bp, Unknown; identical to SEQ ID NO: 21515
  misc_feature (1)..( 3003): 2750-1469P.txt file - cDNA_ID_3044586; gDNA_ID_1971984; Annot_ID_177698

SEQ ID NO: 31660 - DNA, 3000 bp, Unknown
  misc_feature (1)..( 3000): 2750-1469P.txt file - cDNA_ID_3044591; gDNA_ID_1971984; Annot_ID_177695
taaggaaacactggacttcacgaagttttatatagattgtatggttatttgatattttaggtgaacaaggaatggttgatgaagcccagaaagccctggaagaggctgaagctcttaagaaggtgtgttctctttcttatttctttttcttttccccctacttttattagtcactaataattgttgggcctaaatttgtttcagcttacagttagacgagaacctccagcagattcaacgaagtacaccgctgttgatgtgcgcatcgtaagttaccatcactcctcccaatgatgccttaaagattcacattccttctatatttatcagtttgttttggaaagtaccgttgaatataggaatgacaacagtcatatattaacgtttaggtaaagagtaatagtttatttgagtaaacccgtttgattgctttcataaaagttactatttggaccaaaagtataacatcttcgcatcccctgtttaatgtatctacacattggtttcatcttctaacctcacttattgttcctatatcttctcagacagaccaaaagttgcgtctatgtgacatatgtggagcattcttgagcgtctatgacaggttaagttccttgctcaaactttctgcattattgtttcccttttggattgaaagagaaaaaaggtagaaatagtcttttgactccggctattgtacctcctcctttcaccagcaggctttttgggcaggattacttttgcagctataataaatgtgcgttcttttcttgattttattgtgcttgaaggatcttactagtagagattaactaatggagtttttaacgttatactgttttaatatgctatcgtcaaatgtttagcatttggctatgctaattggaacttttgtgatgctacagtgatcgccgtttagctgatcattttggggggaagcttcatctaggatacatgctagtccgggacaaattaacagagcttctggtaaactaataacacaatctactttatctgatgatggatgaaactgccttcttatatttctcttcgtttacttcaggatgagaaggccaatatacgcaaggaaaggttaggttttagttctagcttcttgtttcattgttttattacggtgttgatttgaaattgacttcatagtgaatacttaaaaccatacttagatcaaaggaacggaacagtaaggagagagaatcaagtaaagaccgagagaaagaacaagaaactagtcgtgaacatcgaagagattatgatcgcaggagtagagatcgagataggcaccatgaccgtgatcgtgaacaagacagagactatgatcggtcacactcaagaagcagacgtaggtcacgctcacggtccaggtcaagagatagaccaagggactatgatcgccacaggtataaaaccagagtcatggttgtcttcttttttccctaagaacttcacattttccttacaaatggttatgtcaaaattctttttgcaggcgtcacaaccgctactagatcgatcggtcttgctgtctaacagggtttacaagttacaaatggttttaggatctatcaccgaaacttttttctgtctacatgtatgttactcaagtatgttagatgagtttcagaaaatttcacatctttttcttttaccacaaactaaagacttggaagaaacaagatgtggtttatgtttttaccacatctgagaagcgtgtatgcactatcatcgaacgaaacaaccgcgcgaatagattctcgaactatctatgtaccttgattacaatcgtggaagtaattagaaattatatgattttgtagttatctatattggaattcagaatttgttatacttaaactagaccagttatttcagttaggaatttatctacttgtctcgattacaaacaaggacctttgataacgactttttaagattgaaagcggatatttattaactttttcacgtacattattactttagtaatcaaaatattaaagttcttagagaaatacagaaaaggaagaaagataagatacaatataacttagaagtgagtgatcatgaagtcaataagtcatcataatcatatgggaatggaacgagagaccttgggataaacatgggtggccggatgacccataatgcggcgacctttggcgtgcttaaagatataaaccaatgctccgaccggccattcaactattccggctgctacaaacgccacaagccctaacgtcggtcctaccactttgcatctacaagggtttccgcccgttccgcactgcacgcatatcggaatcatcgttggttaaaaactgatcaagccgatgaaatgtttgttgatgttatagggatatgatgtatggaatatgagtagaacaagaagtggaagatgatggagagttggattgtgatgtttatatagagactcaagcgaatcatttcactctctttttaaattcttcttcttaattgtttttatcaagtacgtagggtcggtccgtattattctcatctttcactttaacacgtgttgtgttctagagtatacatgtggtttaaggtggatacgtgttgcttcgatagttctttatgctcccgaaaattttcaaacgaaattaaaactctttttttagcttcttcactgaaaaagagatgggccttaaaacaggccggattcaaaagcaaccaggccagtccattacaaaaatcctataaccttatataggactaatggtaaccagaaaaaattgacctcgtcaatctaagacttattcaaaactgaagaaccttacaattttgcattttaatgtgtatgatctggtctccaccaaatgcatataggtgatgtagagatatgacgctgcatatactttacatgcacatgcatttcgtttatatatgtatgctttatatgtgttattttttgcaaatcttgaaatcaaaagacatttcccattaatcataataatcatgatcatg

SEQ ID NO: 31661 - DNA, 3000 bp, Unknown; identical to SEQ ID NO: 9097
  misc_feature (1)..( 3000): 2750-1469P.txt file - cDNA_ID_3044595; gDNA_ID_1971984; Annot_ID_177694

SEQ ID NO: 31662 - DNA, 3003 bp, Unknown
  misc_feature (1)..( 3003): 2750-1469P.txt file - cDNA_ID_3044612; gDNA_ID_1971986; Annot_ID_177747
gtgagtaatgtctttttagttgacggtgatctcttcttggactcatcacagcatttaacaacatctttcttgaagcacttcaccagcttagtgagcttggtgaggagtgaagggcgagagtagagtgtgtcggagatctcatccagatagatctttgtccttgtgagtgagaccaccttcgagtagtctcctgatctttccgacactatcatcttaccgcctctgttccctccagccgagattggtttggcctcgggcggcggacagcagtagcagggtttccactcggactcgaagaagaaatcaagagtcttgtaggtaaagcaaagcaggaaatcaacaatgtcgaggatgaagaagacgaagacgcccacggtgcggttgagcgaccgtgagaatcccatgctgtggagtttgagtcttgtggaagacgtgtatgtatgtaagttgtatgtatgtatggtggtgatgttgcaaagacaaaatgcgtgagagagagaaattaagttaatgaagagagagaggaaaacagatggcagctgcatgaatttattgatcgcatttaacatacattgttggctaaaatgatgaaatttggtggccgttgaatcttcttcctttttttttgcaacactagaccacgcatatccagcacataccgtaatatcttttttaacttcaaaacaggaatcaatactaaggaacatgtgatgtcgattggtccggtgatgatccaaaatgccgctatagctacatacacacaaagtcagtcaagtcattatggatgtgcggttccttccttagggttacaagaaattatgtttaataatgtgaaaataatatgctaagaaggcatgtaattttgtatttgaaaacaatcaaaaccctagatagtcccaataattaatgatactcatatatgctctgtttggtaaggccactattgaggattttggccggttgatgacttttggggtctaaaactacaaggagggcaactaaactatatggatataaatgtgttttttttttgggctatggatacaaatgtgattacgtaccgtgaaagtgaaactaatacagacatcaaataattgaagtaatggcacagagtagtaaatgtaaatgttgatagcgaaataagataaagaatggacaagtgatatgatggcatgtggccacaacttatatccatcactctgaatgcccagcagcccatctaaacagcctagctgacctgtttttagacaattctataatatgtatacacattttggtaaaacaggagttaaaagagttagtctgtcagtatccatatatagatagtagtattggtaatatttcatgaggacaaggacgtgtgcgtggcatcaagcaacagctaatcgcatctctttactcaacataccattctctctaatctgttagggtgaaaatattaatgaagtagaaatattcgagtgtgcttttatgagaaaagagtgatatacatatatagtagtatggtaaggaacgtgagaccatgtgctatgtttaataggttttcaaaagtcttgcgtcacacaatcttaaagagggcctgagagcttatttttaataatacttaaccaaacgagtggcttgattctaactagatcccggtatgtagtatagatacgacaagctactgatggagacagatatatatagtccccctcaagtcaagccttctatattcattttctgtcattgtatgtactcttcttgcaaccttttcatatgtatcactataatttgttttttcctcttgaagacttgaacaatctggtggagcaccagaagattcactaacagccaagtatttttttgatatcattcataagttttagggtaatggagtgaaattagctagaggaatttagtctaaagctcaaactgcgaccacccgatggagttgttttggtagagcagaaaaataagttgaaatgtaagaaagagaattagttacaactgtaagttacaagtaatgacacaattgtaatgcagaggtcaacgacgactgacatacatataagtgcactccattccaacatgtagtagcattcgaattggttttggactgacaaaattgagtaactacaacaaataataataataataataaaagtatgtgaaggaaaaataaaaaagtcaaaagaccttaaatgcgtagttgatggaggttggtagggagtgtctttaatttatagttttacatattttgaaacttgaaaagtgctcctctcctctttgatttatccctacttgctaattattttactcatccacgttaccatatcaatgtaatgacactcggtatatgattggccatcgacatgtatacatattgaaaaaatgtcaaaaacaagtttcacctatcaaagttggataagaaaaaaccccgtttaacagctcgatgcactacaatatcaagtgatttaacgacatggctaagttaggtttagtcaaatgaaacttcgttattacatatttacattgacaagtcaacgaaaatttaagagtttaggttcttagccgaaagttggtgattatttttattttaactaactttgaaaggtaatctttttttttttgtgatatttttcccataactttaagaatcagtatatgttttacacataattgatatatataacttaaaacataagcttatttgggcaaagttaaattaaataaaaattcgaaataacttgtaatctaacacatattaaataattgaataaatatttgaaaaaaatattctcaatgaaagataggcctcagtgaaacgggccaatgttttttgtgtgggcttatatagtccacccaaaactttacttgtttaagaggcaaacaaagtggacacttgtaagtggtaaggttgtggtcacgtttgtgtggcccttaatgcagtaaaagcagagtatgagatgatggtggtagggaagaagagcaacgagggcgagagatatcttcttatccatg

SEQ ID NO: 31663 - DNA, 3003 bp, Unknown
  misc_feature (1)..( 3003): 2750-1469P.txt file - cDNA_ID_3044630; gDNA_ID_1971986; Annot_ID_177727
gtttcttgactattctgcttttgtctcccaaggctatactattgttgatcgtatggattctctcgttgaagctagactagatcttcgattgtgggtgtcaactgattcttatgatagtgattatgaagacaaagattttgatgtctatcgtccatatgatgtttttggtgatgttacaagcctggtttcagggatacgcaaagttaagacccttcacctgtctcctgattctcttgaggtcagttctgttctgctactgctgactgatgggtggttttatcggttttgtatcatgtctatatgtgtttactggttgtgattataaaccaggcgtttttcttctgctgcaatcacatgccggtcttcaacaacctccgtaatctatctcttgagagcgacgaagaaaaaggatggcaagcattgcctcttctgctcaataattctctaaatcttcatactctatctatcaaagtatgacatgtttttgagaaattaatacacaatgttctttttggctcttatgtaaaagaagtttgtctgatttgttgttatggtttttagggtcttgtgcacagagttactagtagatgtggagacgcatgcgcctgcattagcgagaggaagacaggaatgtgttgtttatcggcatgtcgaatcaaggtgctagagattacagggtatggaggaagttttatagagctgaaacaaatgaggcattttttgggaaaactgcaatgtcttgaaactgtgagaattggtgttgaaagggacggcaacaacgagcacctgcgagccaatctaagctctcttcatagagcttcatcagagtgcaacatccagttcatttgatctctctttaaacaagttatagataatatgagtttgttagtaataaaaatatgacattttgtttaatttggtaaagttttgcactgattggcgaaacaattaagaggtctagttttggtaaaatccaaattgctaatctatcatctctcaaacatgtgttaacaaaaacaaaattgaggacttttgatttcacaatggccttgagccatgttaagagggaacaacgttaaccggattaaatcataatatttggtttggtttagtaaattagaaaacgtactgtatactctctctgcctgagggagaaggttccaaatagccctaaaaagcttcgccttctctccttgccttcatttcgggtgtggaggaaagttatcaaatcagtttttgtggaattttgaatctcgtcgcttctgtgttggctatgactgaagttgcgagctcagtggtgtatgaagtgctcggacgcagagctcaggatgtggacgagccgattatggactacatcattaatgtcctcgctgatgaggatttcgacttcggtgaggaaggtgaaggcgcctttgatgccgtcggtgagctcctcgtcgctgctgaatgcgtttccgatttcgaagagtgccgtttggtaagtaaccattcgcagcttgttgcttggctttcttcatttcaattatcgtaattctagattcgttttatctttgcttgtttgtatttatgggattttttcgttagggcctctgtgactgttgaaatggtttcaataaggtctcgcttttgaatgagctgagatatttaattggatgtggtgtgtgtaggtttgtagcaaactgtcggataagtttggaaagcatggattggtgaagcctacacctactgtgaggagtcttgctatgcctgtgcggatgaacgatgggatggatgatggacctgttaagaagaagaagccagagcctgtggatgggcctttgctcactgaacgtgacttggctaagattgaaaggagaaagaaaaaggatgatcgccaaagagaggtatacagtaatggcagtttttttaccggttttgaactgagaatttgtttcttatcttgtgtttatttactggtttcttgtttatgcagctacaatatcagcagcatgttgctgaaatggaagccgctaaagcagggatgcctactgttagtgtcaatcatgacactggtggtggctctgctatcagagatattcatatggataactttaatgtttctgttggaggccgtgatctcattgtcgatggatcaatcaccctctcttttggacgtcattacggtgggtttgatcttcgtttttatttgttttagctgtctgtttaatccaaggaatagacggtatggaaaatctaccttacaaatgggtatttgctctctttggatgactttacaggtcttgtaggacgtaatggtaccggaaaaacaacttttttgaggtatatggctatgcatgctatagagggtattcctactaattgccagatattgcatgttgaacaagaagtcgttggtgacaagacaacagccttacagtgcgttcttaacactgatattgaaagaaccaaactgttggaagaagagattcaaatactagcaaagcaggttagacacaagctactttactaatatgtattagcatttactcactcaggtgttttaccttttcgtataatctgtctttggtggtaatgttgacttttgtttggttatctgaagagagaaacggaagaacccacagctaaggatggaatgcctaccaaagacacagttgaaggagatcttatgtctcaaaggcttgaagaaatatacaaaaggcttgatgcaattgatgcttatactgctgaggctcgggcagctagtatccttgctgtaagttgctctttaccattataaattttctgtagccctttagagttttcatttgatagcatagatataaacgatatctggacccaagtcgtgacccatcactacataaatcatataaaatgctagatttgggtgatatctcctgttgaaatcgttgcatgttcttttgttaccttcaacttctgagtactgctaacttgcaaacgttcgctgtgcaatattttcagggtctaagtttcactccagaaatg

SEQ ID NO: 31664 - DNA, 1831 bp, Unknown; identical to SEQ ID NO: 9109
  misc_feature (1)..( 1831): 2750-1469P.txt file - cDNA_ID_3044640; gDNA_ID_1971986; Annot_ID_177713

SEQ ID NO: 31665 - DNA, 3000 bp, Unknown; identical to SEQ ID NO: 9126
  misc_feature (1)..( 3000): 2750-1469P.txt file - cDNA_ID_3044666; gDNA_ID_1972003; Annot_ID_177778

SEQ ID NO: 31666 - DNA, 3000 bp, Unknown; identical to SEQ ID NO: 9132
  misc_feature (1)..( 3000): 2750-1469P.txt file - cDNA_ID_3044670; gDNA_ID_1972003; Annot_ID_177775

SEQ ID NO: 31667 - DNA, 3000 bp, Unknown; identical to SEQ ID NO: 9136
  misc_feature (1)..( 3000): 2750-1469P.txt file - cDNA_ID_3044676; gDNA_ID_1972003; Annot_ID_177766

SEQ ID NO: 31668 - DNA, 3000 bp, Unknown
  misc_feature (1)..( 3000): 2750-1469P.txt file - cDNA_ID_3044680; gDNA_ID_1972003; Annot_ID_177765
gaaatgattacacagatccctattaagcttaagacttttgttgaattaacaatggatgttacatccgcttcacctcgacgatacttctttgaggtaagaaccctttaatttcaatcattcagttctaatgcatttgaatttcaaatctatgaaagtcctttgagttttatgagacaagtatttgatggacacccttgtaatgtatgatgtatcatctctgttcagattatgagcttctatgcaacagctgaacatgagaaggaaagacttcaatactttgcctcacccgaggggcgggatgatctctacaattacaatcagaaggaaagaagaagcattcttgaggtaaaatagcaccagatctcacaggttcatgattcgtcttgaatatgcattcactctcttaaccaatcgtattgctaatgcctatgtaggtgctagaggattttccttccgtacaaatcccttttgattggctagtacagttagtcccaccgctaaaaccaagagctttttcgatatcttcgtctcctttggcccaccctgccgcagtacatttgactgtaagcatagtatcatggatcacgccttataagagaactcggaaaggtctgtgctcctcttggcttgcaagcctcgcacctgaacaaggttagaagtttgtttcttctttaccataactgtgaatggctcagttctctatttctgatatgttttctttgtcttcggttgtggttagaggtaaacataccggtttggtttcacaaaggctcccttcctgctccatctcagtcgcttccgctcatcttagtgggacccggaaccggatgtgcgccattccgtggattcatagctgagagagccgtacaagctcagtctagcccggttgcccccgtcatgttcttctttggttgcagaaacaaagacacagactttctataccgcgatttctgggagtctcacgcaagagaaggaggcatgctctctgaaggaaaaggcggtggcttttacacagcgttctctagagaccaaccaaagaaggtttacgtgcaacataagatccgcgaaatgagcaagagagtttgggatttactctgtgatggagccgctgtttacgtggcgggctcgtcgacgaaaatgccttgtgatgtgatgtcggctttcgaagatattgtgtcggaggagacaggaggaggatcaaaggaggtagcttcacggtggcttaaggctttggagaagacagggaggtacaatgttgaagcttggtcttaactctctaacttccttcatatgtaatcttattacatatatgttctctgattattttattgctggcacattaatttttatttttattttgataattcatacaaattaattaaaagtgaagatgatgtgtcgaaggttaaggttgatatagatttagttttgaaatacatatttttttgttggtttgtttgtttttcaaaatcgttaattggataacactagatattaatttctgtttaaatttaaatatcaccaattaagtaacatgtgtcatgtgattctaattaaagagtaaaactgttcatttaggatttttttaaaatcagattttataatcaatgcaaaacctcaactagtctaaatttctgaagaaagtagtttgcttttactttttgtatggaaagtagatgacactgacacgaaaaaaaaagagattaatttcagtattaaacgaaaaaataattgcagaagcacagaataatcgggcatgcgtgagtaacaaaataattattcgtcctccattaaccccataaaagcagtgagatttcgataaaaaaaaatgtgatttggaaacagaaaaaggagttttcaaacttacagaaaaacatttcttatacgtctaaaattcaaaaagttcaaaatacaaagtcatctatataataatctaagcgtaattatattatgttctttgattatcattattatatagaattttgttatttttaaaggtcaacttattttctgtttgaagctccattggcatccacaacgaagctctcctctgtctctctcacccactttcataacaacaacaatcatcattcatcttcatcttcttcagtgttcctcactttttccgcaatctttctttttatcaccgacgagaaaacaaatagtaatccttttgaagtttttcactttcctgggaaattgcacaattaatgagtttctatatttatattaaaagttgaaaatttaaagccttgtctctctttcgtcggttaatttgtttcatctgatcgaaaaggaatcagtttaggtctttgcctcctctctccggccagctcaattctcgatcaaaggtttactctttctttttaatttttcgattatttgaaaaattactagaaatatgttttcatcaataacgatcctgatcgttatttgatctcacaagtttgttttctgatcaaattttactgtttttttgtttgtcggttgatacactctgtttttctcagttctttggattaatgcaaatggggtttttcacttttcggtgtctcttatctcaattgagtttgtctgtttctctgttgaagcaaagtttttatctttttcttctttttgtgtggttatatatgtggttgtcggaaatttacctaatttagggttttttcctgtgtaagtgcttgcatttcactttaacaaaacctcaagttagagttgtgagtgttcagagttcagatcgattgaaactctcagttgctactcaacagaaattggacttttggtttgttgagatgtattgtttgaagttgctttgttccactagtgtaaaataacattctcttctctgcatctttagacttatcaaggaatcaaacccattttatcattgcaggtgacgtggatatatgaagcagatgttttggggaaccagagttctgtaaatagaaaccttcacgcgacgttgaaaggtttttgagacgaatataggaggagaagatg

SEQ ID NO: 31669 - DNA, 2862 bp, Unknown; identical to SEQ ID NO: 9139
  misc_feature (1)..( 2862): 2750-1469P.txt file - cDNA_ID_3044701; gDNA_ID_1972008; Annot_ID_177816

SEQ ID NO: 31670 - DNA, 3000 bp, Unknown; identical to SEQ ID NO: 9140
  misc_feature (1)..( 3000): 2750-1469P.txt file - cDNA_ID_3044708; gDNA_ID_1972008; Annot_ID_177808

SEQ ID NO: 31671 - DNA, 3003 bp, Unknown
  misc_feature (1)..( 3003): 2750-1469P.txt file - cDNA_ID_3044728; gDNA_ID_1972013; Annot_ID_177836
aaacaaaacatatcggttgtgtgtgacaaaagaaacatacgtgtcaaatgggcctctttcatatatgttccacataacatgataacattaatatgataattattttatttctttcaattattggtcttgtcttctatcttacaacactttaattggcttccaaatacgtccaaaccccattaatgatcttctgtactctatatatatgttttttttaatcgaaaaagtctttaatgtatgaactaaaactgaaagatacgaaccaagaatggttattgtttcatattcagaaatttttatcagaaatattttcgattctcatgtatatatggactgaaaaatcactatacaccaaaaaatagcttgtacccatgaatttcgacgtacattcaacattatttcaaattgaatcttccatcattttgaactgcatgttggaatatcaacattacgtttttttcaaaaaagaaaagaatatcaacattccgccgacaaaacaatagggcgagaggaagtggagaagtttgagaattcaaacacatacatatataacatcaaggatatttcgctataaaaaacactaaaaatatcccaagcataaatatataatatgtccagtttagtgtccacatatatgttttatgttaatatattttgacaatttgacatttctttttaatgttaacgtacaccacaccttacatgccaacaactcataatttcatgaattttctctgtgtaatttcatctgtagattaccaaactcactgcattgtgaagaaaataacaaagattcatcaattttctcttgaatttaaccttgtaccaaaaaaaaaaatattttctttcagaagattcagtttgtttttttcaaacttttggaaatgacatgttcaagataagagtgttattatcacacaatcaaaacttaaaggaaaaaaaaacagaaacaaagataataatttgagaaagcagagatgtctagcaagcagagaaaaaaaacgacagttcgaagataacgagggcattagaaagggacacgtgggttagagggtggtcctacgtaaactgattttttatcagcagtccagcttggcacttgtgagattctcttctgtgtttgcagatgagtggtgcccacttctcagaaataatagatattattcatacacgtgtctatttcaaaatgccactcaataatagttggtctactaacaacttcaaatttgagaattgagttgacactattctaacctcaacactttgtatcgttgtatatgaacatcgatcacccactcttatggatggtggttaaataaaccgaagtacaatagtatttttttttataaaaaaaatccatacaaatttaaacaaattcaataaatgtactaataattttagtttgaagttctaacaattaacaatgtagacaaagtgccaagacaaattccgtggccaatatatataacttggtttagttaaaacatttgttggaattaaaacatattttcaaaatttcatgttttggtggaagaagtcgttttcaccttttaaatttgtttcagacatggagtgatgtgtcatcttgtttaatattattgtctacagaatgttactaaaaggtgaaaaccaaatcttgataaagaagttaattataaaacaaaatcttccggttacatttttttggtttttttgaatgttatagatttggtcaactctcttaattcatccaatcacgcgtcgaaagctataataacacttggttgcttttttttttttaatacaattttgtttttaaaacgtttagaacaaaaataaaaagaagaaaaagaaagagtgaaaaacggcaggggtaaaaacgtcaaagaagaaatagagagagagagtgaagaggagtacaacagaatccacgcggaaagacagctgttcccatgttggaataactgtgcgggtcccactttcattacactcactcctctcgcacatcttctaattttcgccgccgttaccgtctttggaattttttttggtttaccacactaatgttacatttttcgttagagatgattttgttttttgattacaacctcctacgacgtttgagttattgagattacttttataaatttccttactctgtttctttgggtcaacaattcaaacaatgatggtaatggagtgatcaattgacaaaaaaaaaacacgaatcaaacaatgatcgattatataaagctgttatggtctaataactgaataataaaatcatcataagtaaggaaccaaattcgaatactcgcaataaaccaataatagtaatttagtggataaaataatagttatgggttcggtgtcttaaagatttgagtttgatcatcgtaattcgtaaacctttgaaacattttctgtttttttcacaaacttttgggaatatttgttttggcttgacaaactctccaaatagctctttcgtcgtttaaaatctcttagttacaaaacaatgtattgaggtttcgaactcccaaaaccaaacacaagggaaagatgaaaaccattaggccgatcaattactattaagttataactagctaaattaccaataacgtgtatggatttatacccaaaaaaataagtaaacgtgtatgagtctacgagacaaatcgtgtcggctgtattttgacaccttagtcgcgaggtaggtcatacgtgctgcattattaaattcttaattttggtcgaattaattagtaaatactcctaaataatgacgtggcaaattcggtgcaggccacaattctattatagtgaagcactagagtacaacaacaacacttgtgcctcttcttctctcttcctcatatttattactctctctttcacaaacacacagaaaataaataaataaaattaattaatgtgagaaaatcaattcaaaaatttggacatacgtatcatctgagagaagaagggtttggtgaataccggcgggtggaaccgacggcgatg

SEQ ID NO: 31672 - DNA, 2052 bp, Unknown; identical to SEQ ID NO: 9146
  misc_feature (1)..( 2052): 2750-1469P.txt file - cDNA_ID_3044732; gDNA_ID_1972013; Annot_ID_177862

SEQ ID NO: 31673 - DNA, 3000 bp, Unknown
  misc_feature (1)..( 3000): 2750-1469P.txt file - cDNA_ID_3044742; gDNA_ID_1972013; Annot_ID_177856
ccaatttagatcacacatttggccgctggactacatgatgacaagcttaacttgtgagctgccatgatatttggaaactaatattttgggatatagtgagatattactggtcattaaatagcaacaatgcatatgtggtgagtcaaatctatactatcagtcaaggtatgcccttgcacaagaacccaggttaattcctattttgtgcagacacaactcagattccttgatccaagacgacagaaaaaaacaactacgaagcaccagaataaaatgtagtcttaatcataaagccaagcaaaccttaccttattccagaaagaaatgaacattggagaattttcatcgctatcggtctaaaagggagaagtcctaaacctgaactaatcccatcctgcaacacatatttatcatcagatatattgaattcaaactggatcatctgatagagatggggaagagagaaagagattaaaaaacctcaagaacaagcaatgattttggatctccacgccaacgctgaagaagttggacagaagggccaagtcgcaaactccagtgagaagcaaatacgatgcatggttcctgccaactcgttctgttcgcataacttaaaaaatcagtgcatgctgtaacatacttcttgatatagaatcacatcatcccaatattcaggtttgcagattccatgtgaggtatattactgatgtctctgaaccaagcaatgatttaaggtgaacagagatgatattttcatgacatgtgtttgcaaactatgcatttacgcaaaataatccatcactaatgataaaagagataaaacttataacctcttcttacattaagttgggtgaatgaatggcaggaaacaaatggatcttcttgtttttgatgaatttaagatggccaaacgatggttctcctgaaattaactgcaacatcaatcaatatacatacttttaattcacatttcaataccataaaataaaacttatcctatttgattcatttttctaataatattgtcattgataaccaaacaattggcagaagtataccttctcctgtcgttgttcgcacagccattcgggtatggtgtttgtgtatgccaatagctcttctgccacagaagatattacaaagattggaacctaaccagagccaaactagagttacttagactcacacagctaagaatcatttcaactaaaataaacttttttctgtgcttcatatcctcaagaaagtaaaactaaagaaaaagaagaaagagacatcaaacctttagagacgaggattcaagagaatttgacaatagctctaggagctgcagaactatcccaattctagtaatcgttatcaaggttgagccaccagcatcagcagattctgcagcacatgaacaaacaaacgctagtttctccatctcttctaagctgtcttcagtgtttagtaatgaatccttgttgtcactgctaaaaatgttaaacagtaaagaaagatcccccactttaagatctaaacaaacatcctcttataaatgtaaagaggggtcttatatgatagtacctgattgttgatatataattattatctgagtcaggagaaatacaaccatcctcagtcacttctgcagattggagggatgagaaatctgagtaaatcaaaacatcggtttctttgagaccatggaaatcaaaacttcttgcatgatgtgaaacgaagatggagtctgacacataacttagacttccattaggtccgttgatcaaccaattacaagccccaatatctagacctgaacttagagccttaatgattaaggtcccattgtaacaaacttcttctgcaaactttacgccttgaaccttcttcatgcaactctctatatcatctaaactgtggaaaagattgcacaaaacttaaagaagctatcaacagtacttgaagatctagcaacatattgtttgagaagccaataatagttacctgtacagacgcatccaactgcccagatcatcaccactctcgccgaagacaacttttttaagcaaggctggtacttgttcactatctaaattctttatccacccaggaaaactggagttgtcaggtccatgaaagcatctgaattccttgtgcatcgagacaatatcttccatcatgagctgtccaatcttcgctgttacttcagtcatatatatctacatcgtagcaacaataacaactcagcacaatacacaccccaagaaaaaaaaaatcattcagaaaactcaaaactttaggtcctgaacacgtataccttggcaaaaaatccagggttttgagtaaggaatggcaatccgagcaatcccatagggttagagatgagaacaatatcaatgaaagaagcctcccacaaatgcaaggctttcacagttttgtaccacggttcttcacacaccaaatcagcacaagttagctgtctctccagtttttgcttcttttgaattggattctgagcatccaacgactcatcagatagatattcagaagcttcagaaccaacaccagatggaacaggagagaagattttgattgccgaaaggtccaaagggcagtcaattaaaatcctgaaaccacatagattcagcatatgacaaggcggatagtgaaagccatctcctttgctcagacatgtctgcaaaaaaacacaaaactttcatacttacccaacccgaggttttcaataactcacacgaaaagtattagactttcattaaccaagagaaactcaccaattccatggagacaaacaacagtataatctgtttaaaaaactgaataagcgaggtttaaattcagagcttttccaaacaacgcaacctaaaaaaacagccagaaatatgcgtatcatagaagaggttcagtataactccataaaaatttccgtcttgttttttagagagagactaacagatgcggcaaggaaagtacggaggtttatgcaaggcggcgatg

SEQ ID NO: 31674 - DNA, 3000 bp, Unknown; identical to SEQ ID NO: 9144
  misc_feature (1)..( 3000): 2750-1469P.txt file - cDNA_ID_3044745; gDNA_ID_1972013; Annot_ID_177855

SEQ ID NO: 31675 - DNA, 3003 bp, Unknown
  misc_feature (1)..( 3003): 2750-1469P.txt file - cDNA_ID_3044749; gDNA_ID_1972013; Annot_ID_177853
aattctctgacacctttcgggaatatccccgaaggtaatccgtttgccaggaggatctcgtatatagtctcagtctctgatatcgccgtggagatcgagatcccggcgacgagaacgagacatagaaacgcgatttgaacaatacgaagcatcatcggcttattcttcccgaattcacggtttgtgattttgacagatctctctctgctcgtttatcaggaaattgaattaatgggtttaagggaagacgaagaaggagaagaagaagaagacgacattctggtgacagcttgaaacagagtggatcaaaattttatcaaattattgaaggcggaatttggaatggagcagtaatcttgtgcttctcattccatagatggaacagaccaatgaacgatagccacgtcggatgtgtgtccaccaagcagtatttagttaaatgtggcttgtttcgttaagcctttggttctaacttcctaaatttcttacgcgttattggaaaaagtaggtggaccgtatcacatgggaacagagtggatctggccggacttgcggctattcgaatgtttatagatttttttctgtcttaaatgcctcataaaatacatagaagcaatgttttcttcaacccaaactaaaccaaacaaaatatttggattaatattgaccggttcgattgaacggtccagttagaaatttgggcttgtaagtatgtaacttatctttgggcttataaagaagcccatctccaaattagcgtttcaccctcactcacttttccggtttcaaccattagcacaaaaaatctgagctccgaccaaaaattggggaacgacgatggcgacgactcttcagaaactctcctctcaaatccaccgactctctccattcaccagatctctaatcgttcgcacatccgcaacgtctgctccttctccgtctctgggatcgaagaaagtctctgaccgaatcgtcaagctttctgcgatcgatcccgatggatacaagcaggacatcattggactctctggccagactctccttcgtgcgctcactcacactggtctgatagatccagcatcgcatagattggatgacatcgaggcttgctcagcggagtgcgaggttcagatcgcagaggaatggctcgagaagctcccgccgcgtacttacgatgaggagtatgtgctgaagcgtagctctagatcccgtatcttgaacaagcactcgcgtcttggttgccaagttgtgttaacgcaggagcttcaaggtatggtcgtcgctgtccctgaagctaagccttgggatattccgtaagtttttgttcttgaggatctcataaatgttgggttcgttctcaatttggctaataaaattcgctttggaaatttcggtactctgaagataactccatttgaatctgtaattttcgtttgcttacatttaaattttgtaatgtggtaaagaactctgcttgtttaaacgattccctgcttcaagtatgggtgaatgttgttttcttgatttcattttcgttgcttcttcttccattagattggttagagactatggtgttatatctagagattggtaaaagcaattggaaaatgctaggaggttattgaacacattgtgttgaattgtggttacctggtgttgatatctgttggtctcgagctcaatttgccaacagctttaagcatagagaaagagagtatatagaatgatgtgacttcttagtactggaatgagattctttttacagaccatatagtaatcttcccggtttcggtatgcttaggattaataggccatcctttatattctcgggtctaattgtctaaggaggtgtttccgttgagttagaagaattagtggagttttgatctttcattctcataaccactgcatctttggtgaggctgagataacattaaatatactctgagcattgtaatcacagtttctgcttttagggaaagggaataaggtagaatggatctggcatcttataccaatggtttagtagatttgatttgagccttgtaaacagaaactctgtttgtaggatcgattcttgttcagggtttgattcagtaacaaaacatattgagtatactgtttagatattattttcctaccagtagtttctaaacacagcttaggcatctttaaatgttgcgaatagttttctaattcttactcgtttttcaaaatccgaaaccaaagcaaactgaaaaatggatgctcatctctatctacctgaaaacgtcgatatcaaaatcaatttctgcttgtggtgcacttaacacaataatcattactctcagtcttataaggatgtgcaatacaacataatttaaacctgttaacagactatcaatctgttaagaagtgattaagaccttgactattttaaaggctatctcttttattttaattttattattgttcaagttgtctcttctattttcgaaacatcgccatgttcaaatcgacaaaaaaagaagtgtatagaacaaatccacttagaataagttacatcttatgtagataaaataaataaataagttttgtagaaaattaaccaaacatatacaaacagacgataagcatttgaattgaattatatttgtctataccataaattgagtctcaaaagatttaacctgaaataactatcctaacggaaaactgttttgaagatgacaaaatacgagataatgtgtagattccgtgtgtatctctattgatagactttagtttttgtgtattcttgaaggacataaacctattttaagaccagttcaacagaaaactggtgcagaccacgatcacagttgtaatgagttttctaaaatggtaaccactccttttcctttaagaagcagtccttcttgtctcctgccctaattctcttcttctctataaacccatattctagttttgttctcattcattctctgttcaaagctcataaataataaactccaattaagaatg

SEQ ID NO: 31676 - DNA, 3000 bp, Unknown; identical to SEQ ID NO: 9143
  misc_feature (1)..( 3000): 2750-1469P.txt file - cDNA_ID_3044753; gDNA_ID_1972013; Annot_ID_177851

SEQ ID NO: 31677 - DNA, 3000 bp, Unknown; identical to SEQ ID NO: 9148
  misc_feature (1)..( 3000): 2750-1469P.txt file - cDNA_ID_3044755; gDNA_ID_1972013; Annot_ID_177849

SEQ ID NO: 31678 - DNA, 3003 bp, Unknown
  misc_feature (1)..( 3003): 2750-1469P.txt file - cDNA_ID_3044761; gDNA_ID_1972013; Annot_ID_177842
atatattcaaagttgcccaacaactaggaaattaaagaaagaagaaaataacagaaaagaaatgaattttggctcataaccaattctcatgaaatgacctcaaggaaaattccgatattacccgccattgttccacgttattgacgctgtgtcgtttggagaaaatcaaatatctcgtccctagacacacattattcctttccaaattcgaaattgaatgtaagctgtaactaacaaaacttgtattatttggaaaattatcgatcttttttttttgttaaaggaaaattatcgatcttaatttatcgatcttaatttattttctcacattgcccacctctataaatttcacacacttcaaaactagtataatttatcaattttactttaacactggaatattttcatcttatacagacttcgataacaaaagaatatatactaattttaaacgaaagacttttccaacgaagctacaatgaaaaaagtcatgcatgtaaacaaaaaaataaatttcaacccctttgactgatgacaatatatacacaagaaacaggttgacatatatgatgagtatatgacttctatctatatatatatatatatatatttaacacatgtaaatatatttctataattcttaataaattgaaaaaaatattttcttctaaataaaactattaataaaataaaaaaacatacgatttcttacctagcgatgcagtgaaaatatgagagacgccagttgcagtcaacttccaaaagaacacgcactctccacatgctctacccaaattcctccttacctattataatcacctccgacttttaattataacaaaccaattcacatcgtgaacgtgacttttctatagctagtggtcaactcgacacgtggcatcatctcaacggtctccttgattctctcgtcatagaaacgatgcactgaatcaatctccataacttcagggcattgcccttctatataaacatcacatgtccctgtgtcttaaaatacctcttatcaaacaccaaaccacaccagaacagaactcagccatggcttcttcttcttcttctcttctaatcctagccgttgcttgtttcgtctcgctaatctcaccggcgatttcacaacaggcttgcaaatcacagaacttgaactccgccggtccgttcgatagttgcgaagaccttccggtactcaattcctacctccattacacctacaattcctcaaattcatctctctccgtcgctttcgtcgccactccatctcaagccaacggtggctgggtcgcttgggctattaaccctacggggactaagatggctggttctcaagccttcctcgcttacagatccggcggtggtgcggctccggtcgtgaagacgtacaacattagcagctacagcagtctcgtcgaaggtaaacttgcttttgatttttggaatctacgcgccgagtcgttaagcggcggtaggatcgccattttcacgacggttaaggttccggcgggagctgatagtgtgaatcaggtatggcagatcggcggcaatgttaccaacggtcgtcccggtgtacatcctttcggtcctgataatttgggctcccaccgtgtgttgagtttcacagaagatgcagcaccgggctctgctccttcgccgggatctgctccggcgccgggcaccagtggctcgactaccccaggaacagcggcgggaggtccagggaacgcggggtcattgacgaggaacgtaaattttggggtcaatttgggaattttggttttgttgggttctatttttattttctgaatggggatctctctctagtctctcttctcttcttgagtctctctctatttttttttttttttggtttgttcgaacaataatggtgccccatacttttgtactgttttagtcttagggccatttactttgtttcaccacattacttagagttattggattgtatggaccattactatcatgagattgagatcatcttatcttcttaaaatatctatttgccatccactgtactattttcattaatctaattagtcgacatgtatttgaaaaaataaataattcaattgacaaaccaaacaacacaagaaatttttattactaccgtgttccttgttaaggagacaatcaaggagttgattatgtcaatttatttcaatcaaatattctgtaattatgtctgattagggcaacattagactctctagcttgtgaatcattcggtaataaaatcacccgattctatcctgtgtttcttttatttcatttggtgatatatatatattgaagctttagaacaaaaagttattgtttgttctatttgctgttgtccacaataaacatccataagtgataaagaaatattcgttttgttattgttggttcaaaagtgtgctgacaacgttctaatttcacaacgaagttttcatccttggttagaagaaaaaactagaaaagtttactagtgtttaattttaatttagctagctaaacttgccactgaatgtatcaatgaactaaacgttcaaattttcaactcttaaaatatttggtcactagtattccaaagttttcgtcgaattatgtttgctaaatcaaaacataaataaaatcctaaaacttgttcccgcgggaccatctatacaaaataatttgggcctaaagcccaatagtaagataagtaacaagacccaagaagtatagacagtttcgaacaaggagacgcatatgcgcgttttgatgctcaaaatctctctctctctctctctcatccctctgcttcacgttcgcgacattactctcttttaaggcgcttccttaattttatcatcttctcaaatctcaccctgagtattcccattttcaaatttcgacgcggtttcaatactcaaaactcaagcgctccaaactaattccggtctttactttcgatttagaggtgggtattgaccaaaggttgtagtaatg

SEQ ID NO: 31679 - DNA, 3000 bp, Unknown
  misc_feature (1)..( 3000): 2750-1469P.txt file - cDNA_ID_3044773; gDNA_ID_1972013; Annot_ID_177830
atccttcttcttttttttttgtcaagaaaaacaagggttatccatgaacaaggaaagaaagataaagatagaatttacatgaaaagaggacacgtgacagagaggaaacacaatgggaatatatatgatttatggtgggggccaaataggtcgagagatagatgattgcgaaaggaagcgtagggccaagaaccaaccaaagagcctttcacctttgtctccctatcctgttcttttcttgatttaatccatttcttttggctcttcatgaaagggaaaggtgtagcagcgtctctgtaatttttaaaattctttttaaaattaccaataatcttgttttatgccaagcataattaatgatccgttttgtgatacaagaaaattgtggctgaaatggagaacaagtccattaaagactcggtcctaattggtggttgaacttaagatatgaatgaggtatactctccagtccaggtccacgatattatgaaacaagcaatttcgtgggagagtgagagaacaacaagtactatataataaagtcattgtcgactaagcatgcaccaaaacttacttcaaatggtattttaaccgatgacggagtttttccaattttgttagtctcaaacataaatcgtcttccattgcaattgctgttttcgaaacaaaatcaattaattggaacatcatagagctcatcagctcaagcaaacaagaaggctaacatttgtgttgtattataagacaatcatcattgatttagactaatgatcataagtttttccttacttggaaggtttcgagtttttttttccaacatcaaaagtgaagaggggataaaatacaccaactgaaactcatattcgagtgaaacagaacctgaccgaacaacttttcttaatttaatggaaggaaaagttgggatttgggaggtgtgaagagttctttagaatgaggtaacgaacaagtgacaatatctaataatcttttgtaagaacaagaacatgacaagtgggttttgttgtttggtgtctatttatgctcgtcgccccatgcagtatagtagtagtattattaataaaagacccaaatccgtttttttgtatgctattgaaattttatctgaacgcgaagagtcaatggattattcataattctaatgaatacgtgaaagttctgctcgtcttagaacaaagtacttgggataaaatgccaaaaagccggtttaaacgaaaatcaagcatctttcctaaaccatgttatatataatgtatttttttttttttgggtaaagaaaataacatatgttgtacataatgtattacaaacaggaattttggcaaacaattatgcatcacctacataattgtttgtgtaagtggtgatgtatatattttattctttcgaacaattatgcgaatattgtcaccaaaatatgaaaatatcgatgttatctattcatcattaaattacccgatccagagatttataagtatttaactatttatcaaattctaaatcgatgttataagttgtagataatttttagcaaaaaaaagttgtagataattgatattataggggagcccattccaattctctcccgaggatggatcccgtttaaattcgtaagtgggcttataagttgaaagcccatacttatgttagaagttaaaagcccagctaaataataatctctgtagtgtttatagtcgatgttgggctattgaccactattttcatcatgcgtgacgtaggcgtgggaagtattatttgtgtgatccgagatctgatccgaatttgaatgtagctgtatgggagaaaagccgaacgtgtatattatccttttgacggcgcttaaggttatcttatactagtatatgtcatatttttcttacgtaaaaagtcggtgatatgttattgaaacgtgtcaccacaaacgtaaacctatgatctgggacatgtttgaaaccaatgaacttttcaattaaactcggacatctatttgtatctttctgtaaacttaaatattagatatatctattgatgtattatgttgattttcttattcttagacgactagcaatatacgtaatatggtcaattagaaatttagaaatctcaccaagtcaagcactaatctatacagaacggcaaatccttctaagttctacttctaaccaaaccgtatgatccacatgaccatatgagagtaatttccaagagactatcatgatgcaagaacgaacataaaaccatctaactaaaaatttagctcacttacatgcatgaacaaaccaaattgcctcattgaaactgcctacttgaaacatgttataaaatcaagatttttccttgtctttttcttgattcgaacaaagaaagagttaaacatgttgacatacaaatcaacaaaagaaccggcgatggttaaggaacttcgacaagggaacccattcgtcaaaagtagtttgttattcgtttaccggtttttgatattagtaccagatttgtttttgacatcttaaagaacgttaagattgtttcgtactatttaatagtttcacacttattttatactgtatttagaagcttgtttctccaattatctcatttggtaaagacgtttcattagcgatatcgtgttaacgtcgaaagtcctcctctcgttacggtccggtccgacacagaaatttttatttaatatttactttattttttgtccatttattagaaagaaagtcattgattggtgcaatttattaatataaatttattaaacaactatataaactcctcattactgcccattaacgagcttcccttttcctctgttcttcactttaagaaaattacaaacttttatcttctattggacgaatctttgatctggttttaattaatcacacgcttactttaggatttttttacctgaattcgaatatatacttttgattttcatcttccgtagtccgtaccgtagaattgaggagcttcatg

SEQ ID NO: 31680 - DNA, 3000 bp, Unknown
  misc_feature (1)..( 3000): 2750-1469P.txt file - cDNA_ID_3044777; gDNA_ID_1972013; Annot_ID_177828
aactgttccgtttgtgcttctttgacattcttcggtcaaaggtgaaattgagaattatattgagactgttttcctcttgctcttccttgagaatattttatgtttatgaagttttcatattgatagctcggtctgatcttaatctggcatttttttttctctactacaggtgagtgctgccaagaaagcaaatatgatatttctcttcttcttgctacggaagcttatcttgccattctactcattcacgctcttctgcgtcattcttccattaacgatgttcttcccagaggctaacttaccatcttgggttgtttgctatatccctgggatcatgtccatcttaaacatcatcccagccccaagatccttccctttcatagttccgtatctccttttcgaaaacaccatgtcagttaccaaatttggagccatgatctctggtttgttcaagtttgatagttcttacgagtgggtagtcaccaaaaagctagggagatcctctgaggcggatctggttgcatacgcagagtccggctctttggttgagtccacaaccatccaacgatcatcctctgattcaggtctgaccgagcttagcaaactaggagcagcaaagaaagctggcaaaaccaaaagaaaccgtctgtacagaacggaaatcgcactcgcgtttatcctcttggcagcctcggtgagaagcttgttgtctgcgcaagggatccatttctacttcctcttgttccaaggaatcacgttcgttattgtcggtctagatttgatcggggaacaggtcagttagtttatataaccctttttctcagtttaaaactacattgaaccataccaccagaagaacgaacaagacccaaagatcaagtcaggaaggaacgaaccaactcactcgcaggtcttttcgttacagatagatacataaaaacaattcatttaaagtttctgtcttgggaacatgattttatactctacttgggttggtttagattcttcctttttttacggatagtattagagaatggcagaaacaaccgtcggagaggattccaaagacttgcctacctgtctttgttgtggtattaagccaaaccttggtttttttgttgtgcaaaaattgttgttaggttgttggttttttgtttcggatgatgtggcagaaacatattttaagctttgctctaatgccactctcaaattctttgttgttgttgtttctctcctaagggttcatttatttatatacacacttctgaattgaaatgtaccatttcttttttaaatctgttgtcttcatcttttagtatttgttatgctaattttgggcctcttctatcttaagttataaggaccagaatctgtttgacaatctcttgtatgatttaaggcccaatttccctcagctctcttagatcaagcacaaatgattcgagttttgtgattgaatttatacgaggaactttttttccataaaaagtcaaaacacagatgttaaaaattgtccgactgcaaaatgtataatgtacaaacatatgacatatgtttcgacctaacaagtctattgcatgtattcctgcctcggagggcgtaaacccagataaatcattgcaggcttgaaagaaaatcgttgataaaaaacactgttgaaaacaacttatcaaacaatttacattgaagacgatatgctaaattaaatatttcctgacagatataaacccagacctaatattaatgtactccagcagagaaaatatctaacaaagtggaaatctcagagacaaagaaaaaaggataaaaggataaaaggaagaagaaagagagagcttgtccgagaaggactaataatggcgttttttttgtttccgaataattatggaaatcttctctcagatattcatatctctatccgactcgtacatggtacacgtatctatacccgcagaaatcgaaactatcatacctataaattttagattattccggttgaatataggttggtcggtttaccggaccagaaatttatgattttttaatcattattataagaaaaatgggatctagagcataatgtcacgtcacatcattaaagcatgagaacgttactttttcgtttttctcaacgctcattaaagcttttttagtttctttattacaagacgaccgttgagatttgttcagaattaagacaccaataaacagtcttgtactacttaacttacataaccttttcatcacataaatctcttcgtgccaactcgtttagagccccgacaatcacacttttaatactttttctaagaatcaacgtttatagtactacaatgaacagtcaacgagagtttcctgagaatctgtcaatattttgttccgttcattaacaacgagagttgaactaaaaaaatccatagagaacaattcttcatttatccacctacttcatttcccacgaagcataagggtccataaataatctcaacgacatgttaattattagaccatgaaaatttctttaattattaacctttgtagacaaaatgtgagaaatgtttttagcaatagtttatatcatttaagatttaaaattatatttaacaccaaaaacagaaagaatatttttcactaaaacataatttattttaaaacaacctttaagaattggctagaaacagagtttttcaattaatataaccattcagactaaccaaaaaaaaaaaaaagagaagacgtcgtagtaatcgtacacttaaaaaattgaatataactagtaaatacaaaagttagtaatacattgtatcttttgttgatttaatactcaaaaacaggcttttgtacaggaacacgtaacactagccattaaatatctccactcttctttcttcttaccaaattactcaatccatctccctctcttcttctccttctccaaacaacaaaccaaagcttctctcttttcttgcttcagagagacctagaagagttatcaacatg

SEQ ID NO: 31681 - DNA, 3003 bp, Unknown
  misc_feature (1)..( 3003): 2750-1469P.txt file - cDNA_ID_3044781; gDNA_ID_2684211; Annot_ID_191501
gcttgctcacaggggaataatacctgtgacccgattcaacgcggaggcccatgtcagaaacctgatttgaccgttttgcacgccagttacgcctttagctcttattgggcccaatttcgtaagatcgggggaacttgctccttcaacggcttagctacacaaaccatcaaagatccaagtaagttaaattccaaaatccaaatcataattaaaccgattcgtaaattagttccggttcagtgatatcaggatgttaaaaccggtggtggattttgggtttgctaaatttttgtactctgttgtcgcttgaaaccaggttacggacgatgtgagtttccgagcgtgacattgtgaagacttacgagttacgaaaatgcatggtcgagaagagacgcacgagggaaaaccgcacgatgttacggctttcattaatggaaacagcacgtgactctctgtacgatgttacgtagcttgattatttagaaacggcacgtgattagtgtttaacttgctgtttatttattttatttttcttttcccgcgaataatgaaaactcatgaaataattaattcgttttcgggtaatgcaatcgccaatcggtctcttatgtgtgttaagctgaacaaaacaataaaattactaatgttctaatgggaaaaagtttgcaagtttcagactgtttccttgtttttattgctaaaattattagaggaacaaaaatatatgatcttcttttgttaacaaaaagaaacgtttgcaaaattgatcttacttttgaaaaagcacatgtaactattgagaatcggatgccatgattctcttctctgcatcgtgactcgtgagaataggatgtcgtcatagctttctttctcactttgcaaagaaaatgtttgaccttttgcagctaaaaagtacaaaccatgaagttgtctctactttactcttctgcatgtataaaggattcgtatgtggtcaatacattcacaactccatttcaacttcataagcggtaaaaacttgttacacaattctctcttggttgattgattgctcttctttcttgttaccaagtacaactttggatgtaattagtgatgagattgttatttatttgatcgttttgaccatgttttcaaatgtcgaaattttcattttaaccatgcgttcgtacaccttctactctctattgtatcatttcattcaatatctggtatatatatatggcgacatgtgttgtgctccatagtgccctcatatatatgttcgcttttgcttccctttttttcttctgctaattagctttaattacatctactaaaaaagtaaaaacacatttatgaaaaaaacatagtaataactagactatgacacgtaaattagtggtttaacttgtgtttgtaccattgttatatcaccatggagatttatcaaaatatatatatatttttaaaaaaagagtttagtttaacaactatatttaacaactatatcgaacatacacttagacttacatctatgccattgtctcatctattcacatttgaaatcttttagaacgatgggttaaaactctagattaggctgtggaccacccaagtgatagcaaacaatgtacacgccgctatgataggagcttccacttatcctaataattaaagtattcaataccacgattcagaagtcatccaaagtcaaaacctcgcacgagtcatgggctcatggcttacccgctccgcggttgtactttgtatatgtttcaaaagcaggaaaacattttttaaagcaattgtaaaataacaaaacaaacataaattatttgatagccggaaactatatatgtatttgttacggccagaagttgattataaccaaagtagttaaatcttgaatctgctttttcattctaacttttttttttaccacacatcaatccaaaatactgccgatgaaatttgtaattagtatcaacttctgtctaaaatacaaatttgaacttctaatttagatccaagcgatgacaactacatttcaagtatcattgtagtttgatagactagtgttacactaaacctaataaatataccaatcaacacacaatgaacccttgttcaggagtaataagggttcaaatttgcaactcttttgtcaagggaaggaaataaataatcaaattgttagccgatgcatgattgacgaaaagtaggggtgttttttacaaataagctaagatggctttagaggaccaccaatcggtccaatcctttaacactcagagcctgaggcagagaacacgatgggtcatcttatatttgtttataaaattgccaataattgagataaggtatcatgattcatcaatctagctagactgtgtgtaccatacataaactataacccatgtgtataaaatatacaaatatctgtgaacatcaaccacctaactataatgaatatgaaaatcatacgactaaactaatttacgtaaactatactactttgaaacaattattcatcaaattctcttatactattaattgtggtttactaaacttccaagttttatgttttactaatcctgtaaaattagactttagccgagtccgtttgaatctaggatttttgaaatttccaggtggctcaaagctaaagaaaatgtgaatgagaaatgatttcaacgaaaataagatttacataatagccaatgacatatatgcacttgtcaagttggagttaaacaataaccacacaccgaattgaggagcccattggaaaaaacagaagcaaatatatttttatgtaaaaatagaaacggaataatatagtaacaaaaagatactctcttcaaccttatccattcttcgccacttctcccactaatccgctaaatcattcttcttcatctctctctcattcacaattcccgaaattctctcaaatcacagatccttttagggtttttccactgtttctaggttttttttattgctcaaatctgatcaatg

SEQ ID NO: 31682 - DNA, 3000 bp, Unknown; identical to SEQ ID NO: 9153
  misc_feature (1)..( 3000): 2750-1469P.txt file - cDNA_ID_3044781; gDNA_ID_1972013; Annot_ID_177826

SEQ ID NO: 31683 - DNA, 3003 bp, Unknown; identical to SEQ ID NO: 31681
  misc_feature (1)..( 3003): 2750-1469P.txt file - cDNA_ID_3044781; gDNA_ID_2684211; Annot_ID_137329

SEQ ID NO: 31684 - DNA, 3000 bp, Unknown; identical to SEQ ID NO: 9158
  misc_feature (1)..( 3000): 2750-1469P.txt file - cDNA_ID_3044819; gDNA_ID_1972015; Annot_ID_177893

SEQ ID NO: 31685 - DNA, 3000 bp, Unknown
  misc_feature (1)..( 3000): 2750-1469P.txt file - cDNA_ID_3044827; gDNA_ID_1972015; Annot_ID_177888
tgttaccaaagactatggagataccacgaggcaaaattttccagaaatcagcttttctgataattctagaggaaagttctatgagcaatatatgcagaaaagagacgcaaagctgaaggaagactggagttgcagaaggaccgagaaggaagccaaattgaaggtgatgcaagatatacttgatcgcagtaacgctgagatgaaaaccaaattttctcagtctacagggagacgtgattcaagtgcccgacgtgcagagaagcttgtatacttcaattctaagttgagtgccaaaaaggatcaggtatagagcatttccttctgtggtagctaaaactattgagtgggtgtaatattatccttggtttcctaacagtttaacaatgtgatgacttgacagcatccaattagttcatttcagagtgaggaagatgaggatggttccaggagcacccagaataaaaagctacaacaaaataaaaataatttattgattgctcgaaccactgctacgtcagcgtcacgctcggcagccaaagtttctactctcagtgctgttaggcggagagggcaatcagaaaaacattttgcacagtcagtccctaacttctccgagatcaaaaaggagggcatgaaaccagcctcgggagttggaaaaaatggtgtccgcacccaggtgagaagctctatccgcccaaaagctgtaaatgaagaagaaaagttgcgaaggccgaaaattttcagaaaaggtgctgctgaagctgctgagttggctacagacttttctcaattgaagtcagaggatggtgtttctgtacctctgtatcttgaacaggagcaaagcgggagaaattttaatagtcatggcactggtatcagctctgataatgcgcagctaaaggcttcagaagaatctgaggcatcagatgatatggagaaagaggggatgggagaagcgcttgatgacacagaagttgaagcttttactgatgcagaaaacgaaatgccaagactaagtcaggagtctgaagaatggggtagtactggggttgcaaatggtgaatctttttctcagcttgacgctggttcaaatactgaattacctgctgctatggcttctaggcatcaaaccatgggttcaatcctggactcacccggtgaaagcactagtccatggaattcccgagtgaagcatcgatatccaaacgaggcatctgaacttgatgcttcagtggactctccagttggtagtcctgctttctggaacttctcttcccttaaccatacagagagcgatacaactcaaatgagaaagaaatggggagctgctcagaaacgcgctgctggtggtaatccatctcaaaatcagtgccaacaagatgtgacaaaagggttgaaaagacttttgaattttggaagaaaaaaccgtgcggctgagagtttggctgactggatatctgctacgacgtctgaaggggatgatgatactgatgatggaagagatcttgcaaatcgatcatcagaagacttgagaaagtcgagaatgggattcttgcagagccacccctctggtgatagcttcaacgagagcgagctattcactgaacacggtaactatttcaaataccatagtattcattcacaagaagcaactaaagatcttacaatctagccaaaactgatgaccttaactctagaatacatcagtactagagttatcaactgcttagatatatttcttgttttttttcctcttgatctgagtcatggaggatgatctaatatggtgtacctgatttcagtccaaaccactggcacaccattgagctttaaactgaaggaggatcagacgacaggagcttctgtaaaaggtaatcaataaagtgttctacttttgaaaactctccatagaatctaaacgttgaagtatgcatatcatcatagaatcgaaatatctagcatccgagttgttaagcctaatccacagtcacttatataaccaagctgtgagtttaaactcagtaagatctttgctagatgcttttttactcactcttaagcttcttgtttactgcagcaccaaggtcattcttttcactctccaattttcgtagcaaagggaaatgattcgaaaccaaagattcattacagaagtcatcaggatccaagcgaatgaaaggtaacaaattcgcaatgcaggcacaacagacacgagtatataagtgaaatgttcggagatcgcaatgtgctctttgtttcggatcaatgtatcattgagaatagtccctctcttcaatatttctttgttaactttctgaagcctacattgtaaaatgtaaattgtatcaaacctgaaacatgtcatcgatgtgattttggtagtacactacaaacaaacagaaaggatggcaatgttcatttactattttgacccttcagaggaacatagtctgttgcttaataaacgtgattatgtgactgtgaatcatgtccaaaatgaaactcggaagcttttggatagacattaaagaaacacaaagaattaggttatacgacacgaagtttactacatttaaataatcatgattttgtgatgaaaacgtcaaagtgggacggataaggtaagattctcaccttccctaataacctttctccatcttcctcggaaagtgacgtgaattcgaagttgacgtaacacagtaagaaatccccaaaaagcccctccccataacgtcacaagtctctattccgtcaatggcacattagtcattcaccccaaaaaagttaaggaaattgggacaagaaatcctcaagagcctaagtaacatgatcacttgacttcaaagccaagtgaaatgtgatgatgttacttagctgacatgcaaagatagcgaagatgctccatcatcaaggaacaaagaatccaaccaaaaaacagaaacgtttctttattctctctgttgtaaaattcaatttcacactgttcaatttccaagaatg

SEQ ID NO: 31686 - DNA, 3003 bp, Unknown
  misc_feature (1)..( 3003): 2750-1469P.txt file - cDNA_ID_3044846; gDNA_ID_1972015; Annot_ID_177883
gttgtggaacttacaactggctcatcaggttgtctttctattactgtgcaaattcttatgtttttttctccttctcctcaaatggaatttacgaacctacattgattttccctgagtaatatgaaaaactttaagttaacaaagccatattggtcgtttgattgtgcagaggatggtaaagagacattaaatgaggaaacacctgaaaataattctcagtttaccactgtttatgtgggaaaccttgctccagaggtacattatccactaggaagtgctccttgtaatactatcacaacaaaaacagtttatttgaggttctttgatgaagttttacattagtagatttcgggtacatcgttacagctatctatcttgcaggtaactcagcttgatctacaccgttacttccatgctcttggcgctggagttattgaggaggtccgtgtccaacgagacaaaggctttggtttcgtgagatataacactcatcccgaagctgctcttgctattcagatgggtaacactcagccttacctctttaacagacagataaaggtacttttaagtttggcttaccactctaaaccctctctatttgatcttactgctcccaaaagttacttcatctgaaacttagcatgcaatctgacatttgttatcatgttaattgtagtgctcatggggaaacaagccaactccaccaggtacagcctcaaacccacttcccccacctgccccagctccagttcctggtctatctgcagctgatctcctaaactatgagaggcaattggcacttagcaagatggcaagtgtgaatgcgttaatgcatcaacagggtcaacaccctctaaggcaggctcatggaataaatgccgctggagcaactgcagccatgtatgatggtggctttcagaatgtagccgccgcacagcaactcatgtactatcagtaataaacctcagttcgtggcgccgatctcaagtttcaatctctttgctttttctcttttttttttgtttgtctagaacttgtttgtgtgtgtctgtttgtctctcacttaagttatctatataaagttttatctgcagttgtatgattagttatgtattcccatggattgtaagacaagcgaattacattcaataaaagggatttggatatccattctatgtgattttacatgaacataaacagacaacaaagaaaaaaacattgcggaaggatcagtcagtctctaaccgagcaatgtacgtatcatagaactttccagctttctcgagatctcccagctcggtataacagtctgcaatagctccatatgcttcagtgattccagaatcttcactttccctctttgagatggctagaaccatggagtgatactgtatggcttccctatacttcccttggcgctgcagcgaggcgcctaggcctcttgcagccttcttttcttcggtggggtctttgagactctgggcaagttccaaagctatcttgaactctgtataagctttctctggttcttggttcctaagaaaggtttttcctgttttcaacttggaaatcaactcttgtttctttggttccacaatgatttcactatctgggattcttgctcccactggagcataactcaagcttggtgcataagactcgattttggcttgtctcctaagagctgcgttaatctgtcgtagttgttcattcaacctctgtaactcccctttcctctgccgagcaagcaaccctgatttggtacaccacaaaaaaagtgttgtcaaaaccccaatgagtacagttcatagaagcatagattgaagaaaagactagtcactacctccaacggtggctccaataagagcaacaagcaacaaaataggcatgctgaacatggagctctcaggctcacatatctcagcagccaaagcttcaagaggtgtagccatctgaagggagtttgtcaacaacactgccatcaccggtaatttgagcctcccaattccctgccacatccatatctaaaagcttactatcactaagaaaaaacttgacaacaaaaaataaaccgagtcaaacaatataatgtgttttagctggatatagctagacatcccggaattcatcaccaaactacctcaaaagctgaaaacttgtcaagagatcccacactggcaaatggcgtttgtaagattccctttccttgtcgctccttaggctgtgaagacgaatgtataattttggagaaaggaggatgatccccaggttttctgactactgagtagccaatagatgtagcaaattttccaatctctgagaaaacgttatggagaaagatgacttcagaagcgacaaagaattggctaatgttattgaaatgaaccaacaaactattgatgcctcaaacaatttcgatctagaagttctgatgcctcattaccaaaagaggatcactcatatagcaacagtgactctgaattggaaatctgattcagcgaatgagctatgagctatgagctaacctggagctcgagacttgtcacgcggcggtggttggccaccggaagtatgagagaaggaggagcaacaccggataagcgccgccatcactaaagaaagctctctgagaggataaaacaaacgctttgggaagcttaaaactcgtttccgctggtctgttttttatgaaacttgtacaagactgcccctgtttttctatttaattacagttaaacccttttttactaagcttcaaagatgaaacgcagcgtttaaggagcttttgcttaaactctggtggcgactgttctgtgtcgtcgtcgctgtctttgtctcagcggagtcttctactggagcggaggattttaaaagggttttagatttttgacgactacaaaaccctaatcgagctcaacttgagcattgccgcgctcttctgctattctaagatttgatatttctgcataccacttggggttagctttcgttggtgaagaaatg

SEQ ID NO: 31687 - DNA, 3003 bp, Unknown
  misc_feature (1)..( 3003): 2750-1469P.txt file - cDNA_ID_3044850; gDNA_ID_1972015; Annot_ID_177881
gtctctatagtgcttggatttctcttctaagttgaaatgcaagaccacaatcaaccatatcaaatgcaaatccaacggagatttactatccaactccgtgaaatccatatccggtgtgtttggatcagaaccagtagagggattcgacatgatgagatcatccaacgtttgcttataatcagagatcataacaatgtagttcatcacataccttgtcaatggatgaatcgttcctccagggacaggaactatcgaaggttcgcgaagaaccgcattctcaaactccgaaagtatacctctcgctgcttccgctaacctcgattgaatctcaacagcctgagctctaatagcatctgatgaatctgagtcaaagattgcttcaatatccggcaacatatccgttaaagcatcatgtaaatcaagaatcttgaacagcttctcaggtgatcttctactgatacttatagcttcagggaaagtgaaaagtctcagagcagaagccttcactgtctccatgaaacaagtctcatccatggcagtgcaaataccatcaaagagctgctcacatagtctcttctcactagagaaaacaactctaatgcaaactttagcagcacgaatccatttcctgatctttccttcaacaacttcccactcaagcctttgaacatcaccaatgcttatcttcacaatcccaagctgcttaaatattgcttccatggctgatttgcgaacagttccatagacttggatacattcacgagagtaaccggcggcgaccattcgttgaacaatcgatcttagatcagaaactgcttccggcgaaatcagatccatttctcgtatactgctagtggatctgtaactgcttcttctacgagttaaccggcttgaaccggaaccacctggagaatttaattcttcttcttcgggagttacggtggtatcttctccaacttcgacggttaaagacggagagactgatggttcctcgaggaaaagtgaatcaggctcgaaagtagttgtgtgggagagaagaatgttacggaactcgtcttcgagtctagccatagcgatttgaatagctgagttggctttgacctcgtgttcatcgactacggtggcggcggaggtggcggcggaggaggaagaagaagagaaagagacagaagataaggaccgttggatttcatcaacggctcgaagaaaccgatccacctcatcacgatcgctttggaaaatcatcttccctcttgctccatcagtcgctgctgagtcccaccggagtattatcctctccgctgtctctaagttcgaaccatcggaatctaaactattctccggcggttccatctaataaatcaatcagacaacaacaaaaaatcaaaaacagtataaagaaaacttcaaaattcgaaagccaatgaatgattctcacctccaccgattcaaattcttctcagatggaaattcgtgaaggagattggttgattttttggtaagaaaccacttcggtttttttttttttgcttatcggaagaagtcttagcaaaggcaaagctgtctgtttgtattgtttttagttttaatttttggaagtttctgcgagaggtgggaaatcggaaaaaataagtctttggacttttcaactcctctttgtgtgtacgttgccgataaattttaaacttttttattccgaattactcgccggcggcgtaaaatgcccggtaaaaacttttttggtttgtcgaattattgggtgagatctagtcataaatgctattatgcctaaaacaaagtcccactttctcgatataaaaaaaaagacacacatcatgtcttattatgatctttcatttccatagtgggatcacttaagccagtaattttggaaacttttttttttcagttatctaaaaatatatatatatatatatatatgacatatacattttcaaatatacaatactttcaataaactaaaataatgtagttgtttctgtgctactaattcggattttttctttacataatttttgttataaatagtttacctaaaatgttatgacgtggttggcccatgttggcatggcaaggacatcaatttgtatatgtaatcaaattacctgcggataagagagtaccaatttggacatgttttttttttttgtatatttttgaatagtcgagaaaataaatgtagattgtcaaacctcataatgagatgtggttggtggaccatacttgattttaatcgagccgattaagtaaaggagataatacaagttgtagtcatgaatatttaaggttattgaattgtttgaacaattaggttaacttaacaataaattgaaaatttgatatatctcacatacaagatcataataatacaattttctttttcagttctcaatttgtttctctttcacacaaaaaaataatcctcattttatttgagtccttaaataaattcatctaatcagtcacaaagaccggactaatccaatatacacgcttgggtccacagaacaagttagtcagaaatactggtcctcctttgatatctgcaggataaacgacgtcgtctttagatatgggcttgggcctaagactgggctgtcagtaagataaggaacggacaaggagtattattggcagtcactaaaaatggttgtcacagtgccgtgacgttagtttcacctgacttgttctctgaaaattagcaataaaataaatcgtgctataaatagttcacttgtgccgcacggtccctctcatcttctacggacagcttctttctctttcctctctgattttttttttctctttctacctttttctttttttattttctttcttttttttttgttagtttttttttttttctttcttcatctcgtgaacgatatagtacctgaaccctagcggaggaaaatcaaaaattgtctaggagaaacaaacagagatatctttctttctttttatcagtggggaaaaaaaatg

SEQ ID NO: 31688 - DNA, 3000 bp, Unknown
  misc_feature (1)..( 3000): 2750-1469P.txt file - cDNA_ID_3044854; gDNA_ID_1972015; Annot_ID_177878
attgatcacagaaccaataagtaccatgtaaattttgcaatgtgcgacgtcctctactcatttgctccatttttgttccgtttggtagtagccataggcaagctccttgtttaaaagttccaaaatagagaaagaaattgcttaacatttttttcttaaaaaggtaaatagatccaaagacaaaagtacacagatttattgtcatattcatccaaaatgaaacacaagaattgcgtcgatcccctaagtcaacacaccaaaaaggctcatcataaaacttgcgagccaaagcagagcatcaagccaataatgaatggggatacaatctggtttaatcaaagtcaagaaactccattctcttcctcattgttcctctcagctcactcgcttccctctccaccttttgtgcctgcatcaacagacagattcccgaaaaccaaatcatcagcacgcacacagcatcacaaatgaatcaaatttggctaatcaaaatgaacatgttatgcgatgtcttacccttttaatctctgcctctgagacgcgaatcatatgtggaggaagctcttctctctccgtgtcctaatacatagtttaaggtcaaactcagtgaattggaaaacacgaggtgacacagcaagaaaagacaaacaaggagaagtcttaccagctcaccaatcaaaacaacattctctccacggattacatagaggcctaaaggaatgtcacagtattgttcaccaacaattaccctctcacacgcaccttctagaaccgcattggctgtgtatttacaacgaacaaaaaaaagtcaaatctctcccgctcatcaacaatatcgtaaatctagaaacatggaaagaaaagtgaataccgaattgatcaaaggaacggagtgttcccattagctttctaccatctctaagaagcacaagtagttttcctgcatcatcaagagcagagccaacatacataagtaactgatgcacattgattcatatctaaaaaagaaaacggtacgccaaatgagattgagaactaactcatagcccaaaaacatcagcaaaagaagatcattgacttttaaactcaaagaaccaacatcaaaaagccgatagtgaattaaatttcaacaaaggttaaagtttatacttcgtaagttgaataaagagtgagccagcaacctcaatcacatctaatctctcacgcatgctaaaatttagcttgacaacaataactgatgaacagttagatttgacccaattaaaaaaaaactaaagctttgattcaataatcaatatcttaatcaatgaatgtctctttgagacaattcaacaccaaaattgacaagctttggatacagccacaaaatagtacagcctatatatcaataagaagtcaaaatcaaacgtcaaaaaaacagagaattgtttgcaaaattgagctcccaaatgcgtacagagccatcacggccaattattttaactacatgcattcatacggttcaacaaatatgtgaaacagagagaaagagagacggatttactatcgagataactagcgagtgatgttgaaagataaatttcttcaggaccagcccacgacatcgccactgactttgaaattgaagaaaactttcggtctttctatagaacactaccgatgataataatgttcgtcagattccagctgaagagataagatttggctattgaacgcgaactttgacaggaaaaaaaaaaagtgaagacggaaagagaaatctaaattagggttttgaccaaagggtttaaattgataaagtgattaaaaaagattgagactttcgacacctgatcgaagacggacacgggttcttcaaaaaaatataaaacccagatccgatcgaactttggctgagaaaatttgtttgtggaaaattcgaagagaaaactagcgagcaaatccgtccactgtcccttttttattattttcaagcaatgtccacgatttcttaactcgatagataagacgttgtactttaatactttaagcactttccaatttaatgttaaatttcctaataattattgtgactgaatgtttcttaaataaatgagactaatcttccaagctaataaaatatctgtttcgaataaattttaatttatggaccaaaaaagtcgatttaacactattattatttactgcttgatttatgttaaaacgcttttatgggtaagtcatccaataatatattcccacgtaagcatcagatctcggcggcgcgaaactacgcggcgttcgcttagcacaaaaacgtagcgcagtttatttaaagcaaaacaaaaaattctgttttcacacttttgcattgcagcatcttgtagctaacaacatcatcggagagaaagcagcttccccttcccggagatatcgtacataagctaaagcaaccttaaccttccttctccactgtaaaaccctcaaattaaggtcacgatttcgtcttatttttccaggtttgattcacaaagaacttcgtgttttaacgatgctattcttggggtaggatttagggttttgtttctatagttcaccgatcctgttcaattttaagctaaatcacattcaattttatgatttgcatcggttaaaagacgcgatagttatcaggagtagggtttgttgtggtattcgagaagtttcaggaaagtgagagttttctattaatggcttcttttttttgtatcccgaattctttggggttaattggtgaaaagaatgttctttgtacgaaattatatccaattttccagctttacatgtttttggagatttctggaataagtctgagatacttaagaacgcatctggagattgaaattgtggcatccaatgtagtttcaatcgattttgtctttaaattttgtattcttattagattgagtttcgtcttggattgagcgaatttgtttcattgatgattttagggatagattgatcatggcaactgcaactatg

SEQ ID NO: 31689 - DNA, 3003 bp, Unknown
  misc_feature (1)..( 3003): 2750-1469P.txt file - cDNA_ID_3044875; gDNA_ID_1972016; Annot_ID_177930
acactgggtttggtctctctatttaaaaactaaaacagccagcataagtcatgttgattttctttatagataaattctctcatatgtttttttttgtttcattggtttggatgtgtagtgaatctactgatgtcgctatagttacgttgtccatgacatatgaagaagtcagaaattggatgaaaggcctctatctatgtaatgattcaactaagaacgaataaaatgaaaaagtcacatgtgatatgtatcaccccgaagacaatatgcatacatctattcacacgatcaggtcaaggatacattagtaccgtgtctatatatataattatttatacagccattgacgaacgaatcattttgtactctccaacaatccacccaattaactcttggattagaaacgttcaaaatcacataaccaccgcgatttttatgtgacttccacatattttgaaatacttaagaattttggtatgcacaccaagagattatgaagaagatattcctccattattcaaatttaacatttattttattcaaaacaaatttaacatttatttggtatgaatcatatcatatgtgatgtgttatcatcgtatattcataagtttgtacatgaagagggattttcaaaaagattctcattatgttaccaataatggagtaacattaaacaaaaaataatatagatgatacgataagaaaagcttgtggctccacctcctttcgtatggtcataaccatcatatcactattatcatacttacttttctccatgcctaaatttatatcgctccataaaatcaaatcttttacttgcttttctccctcctttaatcataccctatcacaacgtggctttttattgcaattatataagttttggatagcctttcactttaccgaaattccggactagtcttagcccatgtgtagtagtcgaatttagataagtcatgtagacacatattcggggatagtttcattgttctaactatatgagaaaagaaaagaaatagtgttttgcctaataaatttgattacaaagttcggttctctaacttacatcccaaaatcacaaataaagacgaatccattagaaccaaaagatagctacaccattgcaaatgcataacttctccccaaacttcctgatttaccgatttgtttctacttacatgaatgttttggagtaaaactaaagtagctctgagctaaaccgacttgaatttaaacttcaactctacaattcccgacttcggccgtaactaccggcacatacatttttacttagatttcggtgatacaccacacacacacattttgtcggcgtatccaaaaaactccaagtattatattatgttttctctctcttaatttcaaacatcttccttgtcatttgtcaatacgatgctacacgttaataattcttctcaaagacatgcccaacatgttttcataaatcatgcatgtacttccacgtaattatattagatgttaatgcgacaccgtgtgatgtaataattgcatacataatgtatgtttgcggtgttttaacatgtatatgaatctaactacgtagccttccaatgctgctaatcaccaatcatattgctatctaatttaattggttcattatttatttataagtctcttatactaataaaacgttttgatggaagttaaacttttattattgagcaactgatggaagttaaactaagaatgtcaatttatgaaaacaaagcatcactgcaaaaattgtatgaacaaaaggaccaataaatctccacaatcatttatgattttgccctaaagagatactataataattaggtagagagagagagagagaaactcggctttctttaagacaactatatgggttccaactaatttcacattggattctacgattttatgaccgttcgctagacttccatttcccattgttcttgttcatgttcagtggccataacctgacacgtgtacggtggaagatgcaacttcacgcacgtgtgtgagctttgcctaaacacagacagattacgtgcgatctctcgtgtgcgatgctactagagtagtagttactagctgtcacatatacaaaaaagcgtggctcatccatggttggctgacgtggatttaacgacggtactcaagattttaacgcctcaccgtttaagttccccattcaaagaagacaaaaacatccttgttcccaagggggaaaataacatttttgctttcatcgagaggggtaaaacagggaaatttgggagattaatgtggaagagatccccaaggttgtcttcaaaccataaacaccacgtgacagagagaccaattatactcaaaaaggtaaagaccaatttgaaaaacattacaattttaataatgctcatagactcatagttaaagattacaagaaccaactaactaattgacattatcattatcaaaataaaaaccacctaattgcgaatttatagttttacagtgggattggtaagacgtttctaatatgctttcttttcaactttagaccttcttctctcatttctcacaaagcaaatcaaaagtaaactataaattgctaatcatgcatattagtatataattaactaactaaaaaagggaatggggtggggccattggagcgagaaagtgagcaaaaaaaagagagagcctccactatctctcaaagcagaggaagagagagagagagacagagacagagacagattgagagaaagtttggattttgatatgtgtggttggatttttgttacaaggcaaaaccagacccaccttcaaacttgtccccacgaactacattatcattgttttgttcgaacttcttcttcttctcgttagggttttctttcattggctctgagctactctttattgcttaggccttagtgtgtgtgtgtgaatcttctcagcgaaagccaagttcttttctttgttggtgtttctgggtttattgcgacaatg

SEQ ID NO: 31690 - DNA, 3003 bp, Unknown
  misc_feature (1)..( 3003): 2750-1469P.txt file - cDNA_ID_3044885; gDNA_ID_1972016; Annot_ID_177926
gttaacaaatttggaagacttgagcggctatatatatatgccagtaaagcagacaatggtgttcattagcaaaaagaagtttggaaagacatcataccgtgtagtgagaatttgagcggtagttttgattcctcgatgaaggtactgtgctagacttagaataggaggatgcaactccactaccagaaacaggtctctgcacatcagagtacttagagccatcgtgccacggcacaggagcataatacccttcataggcatacctggggtcctgataaccagcagccaaacctcctcctggagcacccataccatacaaattacttgaggtgttaagggtagcctggttagttggtttcactggagctgatccattacttccttttgtgataccagcagcagaagcaacattattgctatccgcaggtagtgtcttcacaccagcaggtttgtttgcagagagatccggctgggtaggtgtagccacagatgaagcatacggtccactgtttggaaaatagttaggatactgatactgctgagcaccgtacaactgcccttccccgccaagctgtggagcagggctagttgctggcgagtaaggatacgctgcatacccataaccctgaggatacacaacagtcccattctctccataaattccctggtaaaatattgaacctgttaagcaaagaaaatataaagacgatgaaaggcactattataactagtcagcacacacttacagaattcatgtcaacaccctcaggatttgtgtaagctgggtagtcagtccactcttgaccactcccatatactgaaaagttacaaaacgaaaaacttgttaaaccagtggtgacaatttagtgaaataatgtttctagattgtaaatgatttgaggatgaagctaccattgtaatactggtagggattgtaaggattaggaacatagcaaactgaagggtcagcagcatcactgggaagcattggtgtcaaagatcgatcataagaaggaacttgaccatgaacatcaacgcctccatactggtagacggcagtctacacaagacacaaaacaaaagcgttaaaaaaaactggaagaagcaaaagttgtgacaacagaaaaccaaaattcaatctgcaaatcaccttcttgttaggctcagggatctctgaagcttttgctggcgagtccaaggatagtttctgcaacagatctgtagcttctacaaacaaggtgagtcaaggaagcaaagaattacacaattaaccattagaatagtggaaagcaaacattctcaaatcaatcaaactcgccacaaatgaatcgatttgaatcaatatagaaacctaacaatcgagaaatatattgagaaacccgaaactgaatctaggcaatatcaaatatatctgaacaagactcaaaatcagctcactggattcaagatccaacagattcaagatcgagaaatcaaaacacagatcgagaaacataaagaaaggatacgatcagcaggaggagcaacggtagccatgagaggagattcgacaaacaaagatttggatagatccttctcggataaaaggggatgcgaccaaagagaaagaagaagaagaagaaaaaaaagaagatagagaaaccctaaatggaatcaggaaaaacccagatcaaatctagggtttaagagatagaatagaagagagaaagaagaaaaaaatggccgcagccgccaagaaggagaagggttttgcttcggggaagaggaaaaaaagggttttgtctctctacctctccctctgattcaaatagatccactaatcaaccacctcaccttctctcttttttttttctttctttttttttttttttcttccaccttaagatatttcctcttttgttttaaaagaagactatagaccgtgtggttttggttatttttcctgcaaaatctggataatatacttttccattttcttaaaattggtaatcttgtaataaaatagatataaatctcaattctgttaccaaaatataattcaaaagtaaatttggtcaaatttaaaagcaaaagagggcatgctttctattataggtgtgtttcttctataaatttaccccaatatacattgaaatatctttaaaaatatatattaaacttttttgttttgagcaactatttaaaaactaaaagcaaatcattaagataaaaccaaagaaagtaaaatctatttttcagagaaacttaccaaaactagctattcaagaaaatatactttacctttaggataaaaggaagtaaattaccttagcttaaaaaagctattattaaataaaaacattttaagatcgagagtatgtaatgggcctatttgattaaagattcataaacaggcccaaatcaccaaacaaggccaccggaaataaacccatgatccgattacccatccgacgttctagagagttctaatgagaaaacaatgaagagtacatccaacggctaagattagctcgaagtttcaagagctaaaggctcatatcgcctttatattcaaagaaaaaattatcagtagcaagtgcattcttcatttcgtcattggagaaacctacttcttcctccttatccggaataaacctcttcggcgccatctctctcctcacctccgtcgttccaccgtccggtgagtgtcacttttcccatcaattgagctcacaatgttggcgcctatgtaattgtgtgtgtcgattgattgttttgttagaattggaattaacaagtattactagtagctgagaaaaagtatgttaccttgttttcgtgttcccggagatttgtggctattggtgtagttgtggttttgagtatttggggattgagctctgattttgaaattcatctgttttttgttttttgttgccagttttaattggttagtacttttggtgaatctttcgttttatgtgaactgttggattgattttcagtgtttgagaagtgaaaatg

SEQ ID NO: 31691 - DNA, 3000 bp, Unknown; identical to SEQ ID NO: 9165
  misc_feature (1)..( 3000): 2750-1469P.txt file - cDNA_ID_3044889; gDNA_ID_1972016; Annot_ID_177924

SEQ ID NO: 31692 - DNA, 3000 bp, Unknown
  misc_feature (1)..( 3000): 2750-1469P.txt file - cDNA_ID_3044897; gDNA_ID_1972016; Annot_ID_177921
tcgaaaagtcctcgctcttagctccagtacagacctaattggagattagtcgccaaattcagaagagaattcaaaccaatgtaattaaatttcagaattatgaaaaagtattgccaaccaaaataactataccattttccctgaggcgaatattaatgctgtagtcttcggttctctgatcctcattatcaccgcagcaaaacgctggaaacataaaacacaagaggtattacataagacgagcttagctaaggcaaattagtttagcaaaagccaaaaacagataatatcttagattctaattaatcagtacacagtatatagaccaatcagatctcaggtaacaataaggtcaactcaaggagagagtactcttccaaacaacttttctaccgtttattaaaacaaaaagtcacaatataatgcaaataccttgggattatattcagcattccgagcctgcaaagctatggctttaagatctagcttgcagtctaagttcaccgtggagacaatgtttctgaaacaaaacatcaaagatgtcaacaggggtcaaacaaacacttaatcccaagagacaaaaaacaaatacgaaggcacaaaagaactcactgaagagtaggaacaatccctgaaggatgcttgctaagatcaactggattactcccttccaatccttgatcagtcattcttctatagttacacaaaaccaaaatcaacacaatcaaaataagcaatagccagaaaatataatagacactagacacgatccaagacaatatgcttaaaagtcttatcagatagacttatcattcaaaagggtttcaattatttgagaatacagagccaattttagatttcatcttccaaaacaacgagacttatcctcttaaggtgatgaaactcataagatctaatcgaaaaaactcaggaaaaggattaaaggtcagacctttggatagcgaagaaatccgaaatctagggtttcgtagctttaagacgagaaggaaagattcgagggaagagtttgggcgaaaggaagccgaagaattgagaaaaggagaagccttttatacaaagaattgagaatcgaagagggaaaaagatttataaatcggtgcttatataaggggagagtgaatttgtttctctcgcttctggtttttagatctgtgagagagaggaggtcatcgacttgcgtttcggatttgggatccttaagcccctttatacctatatatacatacccatgctacccttgaccgtccttgttacatcgagggtaattttggaaatttatgcggtaatgctacgatgacggctgtctttcggttttatgtgaaagtccactccttttcggccacgtcagctttagtgttataacgctattatatttttgcatatttagcgatttagtgaacattttttttcaagtagaaatttataatttttcattgattttttcaaatcacataatgtggaattgaaaatcaaaatttcacatcagttaaaatccactaaccaataaccccactaaatcaaatcactgttacgactacaccaccaacacaaaacatgattttcataaaaattaaaacactagagaattcttggttaaacaaagcatgcttatgagatctctagccatctttgtagtatcagcgccattgtttctccataagcgaagataaggatttcgaaaactgcgaaacaaacgatgatgatgatgtctctttgtcctggctctcctcatccttgtctctccagaactttaggataacgagattctcctcttctgttgatctctgaactacgattctcgaagcataacctttctttctcatcatcagacaaatctctgctgggaaatttgaagttaatgtcactaagtagaaccatcctttctctgatagcaaaagatcaaccacaggcaagattttatcgatgactgtccggccattttcccctcctgcccaagcagaggcaataccttccattccaacttcatattcaggtgttggcacataaggcggattcaccacaatcacgtcgactgagccagcaagtctcttctctagaccagtagctaaatctgcgcagataacatcagcattaactccatgtgcttctagagtttcttttgtcactcttgtagctatcgggttagtgtcaatggcgagataatgaacaccaggaacttcgttttgaagaagaagtataagtgaagttatgacatatccgcttccgcatccaatctccatacaaatcttagggttgtgctctataaggttggtgcgatcagcgagtaatgcatcaactagcgcaaatgaatcatcacatggttcatagacctcacgatgcgagcttacaagacggatagcagcaattcttggtggcatcttgtaaatgacttgactactaaacaaacaaacaaaaaccacaccattacaagttagaaggttttaactttgagaaggtgtattccatatttcaaatataaacaagcttgcagtctaaagttcaccatagacatcaaacaaacactaactcttaagagactaaaataaagacaaaggcacaaaagaactcactgaggagtaggaacaatccctgaaggatgtttgctaaggtccattggattactctcttctaatccttggtcagccattcgtctaaaacaacagacaatcaaactaagcaaaagaactcagagaagataattgccactagacacgatccaagaccacaagaaaacttatgcgtaaaagtctgataagatagcttcatcaaatgggtttcaactatttgggaatacagagccaattttaatttcatctgccaaaactacgacacttttcctctaagctataataccgatacgagaaatcatatctgaacgattaaacccatgaaaaggattaaaggtcagacctttcgatagcgagcaaatccaagttttgaacacgaaatcgaggttttcgtagctttaatacgattatg

SEQ ID NO: 31693 - DNA, 3000 bp, Unknown; identical to SEQ ID NO: 9177
  misc_feature (1)..( 3000): 2750-1469P.txt file - cDNA_ID_3044913; gDNA_ID_1972017; Annot_ID_177965

SEQ ID NO: 31694 - DNA, 3000 bp, Unknown
  misc_feature (1)..( 3000): 2750-1469P.txt file - cDNA_ID_3044916; gDNA_ID_1972017; Annot_ID_177959
tatataaaaaaaaaaaaaaaacttcacgtcagtctttgcgttacgaagaaaggcagtattgctaacagtgagcacaattttatgataaccattcaccatgcaatattttatttccataacaagattagaaaactaacaaggcaccaacaggtccggcccaaatgagtagggccggaggccattataaattttaatttttttctaaacttctcaaaccaaatctaataatttaggtattagtgaaagatccaaaaaaaaaaaaatacatttcctaagatcttatggtccgtggaagaaattaaacacattttgggccaggtatgaggtatgcaaattggagatttatataccaaaaacttcattatcaaaagaataagatttaagagtaattgtcgtggaatattataaagggcagtcaaaattacgaaatttcagacaaataaaattttaactactacagtatattatctagagtctagacagaagaaagacacaaatgaaaacgcaacacttttttttttccaacaaagcctattggcctttttagtttttaattactcgcaaaccctttacaaggaagtgaaacagacagaggtgaaaaacataaccgttaatatttgtggaaaaatgaagaagaaaacggacacgtccttttttatatcagagtcaacgtaactacatatatctctctggaagactttgaatagttttctagacccaatatatctttagtaataaatattccatctaaaaatgtttggttgggacaatattctattgggaaagtgaaagactatcaaacatgtccaaatactcatcagaaataattttaagataagctttttatatcacattgttcctacatatggagaggacgatcaacttggatagacccgaaaagagagaatgattagaacgtgcaaaaatcaaacacgaccactctgccaattacatatcttatattatatttctggtgtcaaattacatatcaattatatgaagcataatgcatgttgaagatgatcaaatgtaaatgggtgtctaaacttatagattagaatcgataattgtagttaagtttttacataaaaagaaagaaataatctttttaacaaaacacagtgtgaaaacgaaacttatattaccaaatacctcgggtcaagaaagactctcgcaaaagtctataaaagtcgtatgaccttttttcgttgagagaagacaaaattagcaaaatatgcgtcaaaaagtaagattttgctgacttcttagttcttaccattcattttccaaatatatttctctatgtgaccaaattaaagtcgagagtaagtagtcattgaattggtagtctctcacaaaagtacgcaaaaaaggacatgcaataaaaatatcttattgtagtaactaaataagtagtactaataaatccgctaaagtgtaaactttctcattgaccttactataatgctgaaaaatgttgcaatatccatgcggccttgtgaaatcaaatagaataagactttagtcgttggaaaaaaggaatataaagtcaaataggttgaatatttccatgaaacagaaaatgccgtccacgtccaaaactgcaatatgctaatccacaccgtccattaacttgggaaaatcaaatctaaagcgttcatcagagtaatggtttatagatgaatcacgtgtcgagatcttgacgcattaatagcgtgcacttagctctagtggaatcaaaaacaccacgaccgcacaccatgcgagatcgaaggaccagagtgttcaaagtcctcaaaagcagcccacgcgttatttggccacccacttctattttgtaattgctgccgaagtaactaatggtgtaatttagttaagtagtaatcaactatttggtcttaaagtatgttatcaaaagacccaaatcatcaactaatcatcaaatgagaagaataaaactatataaatgctttattctctctttatttgccttttagacagaataaatattttctcatagattttgttttcctaataaatggcttacaaaaagaatatttgaaaacttaagatttgtgtgatgtcatcgatcggtaaaatggttggttaagaacttaggaaattaataattttcatgttaaatagataccgttcaaacatctacatattttgcagattatgttattgttattacattgccgtgctaatatgtacaaaattataaaacattatctgcagtcggctagtactatttaataattagatcacgaatcatgatgatcatgtaatgattagttgatcattttgaaagatacttttacaactatcttcaccagaagatttgttgattaactatataccgatagatgttgtttagtccccacataaaatctaaaaaatcataaactgtgtattttgagtatttgaaaatagtactatataagatataaacaacaatatacaaaatgagaaatttaggttacatgtcagtttcatataatttagacacctacatcactactctacctctttttatttcctttagatatattgtcaaattgtgcacacaaaaaaaagatatatttcacaagtcattctgaaattgttttacgaaaaacattttgtactaaaaccttttttgaatattttaatatttgtattaaaattttatacttcataataatatttttttttttccactctctctattttttaaaaaaatatatatttatgttgatatattagtatgagagaaaagagttgatgtgggagtcaaatatatgttgtgatccgttaacttcaaagcaaattactgtttattcacagaagcttggacgcgtacggcttcgatttccttatatatatatattacacataaatctgccgtcttggagattggaaacatatctcaagcttcttcttcgtgttacgcactttcttcttcttcttctctctctctctttcttcttcgtcttcgatcacagaagacagaattcaatg

SEQ ID NO: 31695 - DNA, 3003 bp, Unknown
  misc_feature (1)..( 3003): 2750-1469P.txt file - cDNA_ID_3045000; gDNA_ID_1972020; Annot_ID_178051
tacttgtctcctctaaacagcccaggaagaagatgggaaaagagctcaactgctcacaagaagtctgcttcagcggatttcataaatcttgtgaacatcaagaaagaaactcatgcgagccaaccagaggaaaatactgatattcaggtctgcaatctaagcaaagaacctgatgattctatccaaccaatcgcaagtgaacctaatgagaaaagtgttgacattgaggatgaaactgctaacgaagataacatgttttctgcaggtaataatatttctgtctcatagtaaggctctctgttttgagtaacaataatttattttataacctttcttccaggttctgcagatgatgtgatgattcccaatgagctagatgaagttccagaggaagcaagctctacattgattggtgacttatcaaaagttgaagctcaggatgaacagagagatagtataaactcgaaacaggcaagtcattttgattgacccctagaacattaccttttttgtatggactttaaaatgaggaaatggtggaagacttaaattggttttgctgcttctttttttctacagacctctcttgaagagagccaaccaccactgtcttcctctgtggcctcaccatcccactgtttagctcaaactgaggagtgcaaatcagctattactgattttccggagtggtcaagcccaatatcagttcttgagccactcttcgtcgaagatgatataagcccagcaaaaatgcgatctcagtctggtatgtagaaaaagatcccaacatctactactagacttggattctagtacttagttcttcaatattgactcatttttacaactcaggtgaagcagaggtgcaaccgtggtgtatccacttcgatgaaaaagatcctgcacctacataccgagaaaattctgtgacaagtgacaaagaattggtgtttaagtatgtaaaagctgtcttggacgcagtagactcagacatcgaagagctctatctaaaggcgcaattctctgaccagcttcttgaaccagcacttatcagcaatataccattctgtccaaaccagctttgtcctgaccatgagctcctctttgactgcatcaatgaagctctcatggagttatgctgttgcccaccttgggcttcgtttgttacaccaagaaccagagtcttctctaccgtcaaaagcatcatccatgaggttcaagaagcggtttactggcatctcttgccattgccactccctcacgccttggatcagatagttagaaaagatatggctagagctggaaactggttagacatcagatgtgacattgactgcattggcttcgaaactagtgaactgattctcaacgagttactcgaagagctcatcctcaacaatactgagcactctctggtttcacctgagttgaagacggatgggagcatccttattctagaaaggtcttgaaagctgaaaactcttttcttaaagacaaagccattgttgatacactctgaacatagtctcactgtcaccattgctaattttttttagcacagaaccatgtagatagtttgtattactcagtcagacaaaaacctcacggagctcctgtctgatcagaaactactgagagggagaaggaggaaatcagatcctttcaaagaccagaccagaaactgttagtggtggggtcatcagagaatcactttcaaagacagtcttcttcctataggctattatatagtatatgatttattattttattttagagtgtttgtgtgaagatggagggatgtgatagtgtttgtttgaaatcggtttgtgtaacattttcagagtttgacataacaatgtattatggattaggagtatgacaaattcaaagtttttgttgttcatgaaaacaaaaagatataaattgggtatgttgattactagacatgaaactagaaagttttgttaataaaacctaggaagagtgttgtaaattgtagtctaacaatggtgggttgataacaggacaggataaatatcaatggagttttttttaagtaataggaaagaagcagtcataacacaaatctgtagagatttttactcaatggagaaatgaattttatggatcatgatatatgtatataaagttttggataatgtttttgtagttgttgcactttatgccctacttagtgaataacattttctttgatgggatatggttatgtggacacaatggacagtacacctgataaagatggattttaagaaattaacaaaactgaatgaattatatacaaactgataaataataaagggtttattctttttaatataaatatatttattttaatagttagtaaaattatttcattttgtttttgtaaaaattatgtataacacttatatataaaagatgtataatgcaaacaatcaacatgtcacttatatgttcttgttttagtattgatcctttggttacattattatgtgatatacaagcttattctatatgccattataaatgcttcttggggggatgcttgtaccatttagtgagtcaatctccgatctaatataacgaactgaacgataaaaataattattatcctttaaattatagtcgttgctatttaatatttcttaccttcattttcttattatctcacgttctttgatttgaataataaaaagcgaatgaaagtaatagataatattaaataataacggtaatttaaatacaaaaccaattttttattttatttttattttaacatgattctaaatactgatgaaaaaaacatgaatctaaaatactttcaactataaaatcaagagaatcaactctctctcaagtgctcacaagatcaacacaattaccaacctgcaaacaacacaaacacagtagcattctcaagctctggaacattaggcaaaggtctctctgctacacgagggtgtcgaccgaccctttagcaaaagagataagggctttgaaatg

SEQ ID NO: 31696 - DNA, 3000 bp, Unknown; identical to SEQ ID NO: 9196
  misc_feature (1)..( 3000): 2750-1469P.txt file - cDNA_ID_3045007; gDNA_ID_1972020; Annot_ID_178040

SEQ ID NO: 31697 - DNA, 3003 bp, Unknown
  misc_feature (1)..( 3003): 2750-1469P.txt file - cDNA_ID_3045007; gDNA_ID_1621157; Annot_ID_173563
tcaagcttttgcctctccagttcagttagtgcttcatgtttttccaattgtttggcccgagactccaagtcccgcatcttacgatccagttcatttcttagcttctctttatcatataggattctctggatatggcgaagtgacatctgctgcatcttctttgtttctgagaggagataaagtacaaaaaatagtcagataccctaaatgctatatgagtcggaaacatatcagtgtgtgagtaaataccttcagcaaaagcttggtgcaagttttttttctcatctaggaccctttgcagtgacattgccgtcctgttgtaactgtgttgggccttgttcagatcttcgtttgtcatatcaatcatatttgaaagtacgtccagaagagtgtttctatcctgcacattgttttgcaaaatatctgaaactgttcttagcgttccctccttggagaggtactcacctattggaccttgagattgaaagtcgtctgcacgtgcacaccaaccataagcctttgactctgaatctccactcctctcagtccactcttttttgcaggacccttgggtctcaaattccttttcaagctctgtggcagcagcaaacccactccagtcactgtcaaacttagcaataaccccaacaatcgaatcttgttcgacccaaaaggcattcacttcaacaggcttgaatttggaaagggtctgcagccaatatactgaatcaagtagaagctccttgtcatccgtttctttcaaagggttaacaacaatccccatccatggccagacatagacgttatgaggatttggttcagtctcgtctaacagaggaggaacaaccggagggcgtggaagaggttctgcataaccagcaagatcattctctaaaaacttagctaaagcaagatgattagacttctgtaaagcacttctggtggcagaacctttggaaacaccagtagcatgtgcatgcaactccttgtacttgtaatcttgcttcttcttgcctacacaaaaggggcatctgagccgtccattcaccttcaccttgtagtaagtctcactgcgtaaaaggtggtagggtgttttagaatactcctcaatctctgactcgctgatctcagactcttcatcagaaatgtccatcgtacctgctttacctggagaaaaagaatgttacaaaaacagagaagaagaacaaaataaggcccaaaagagactcaatttctaggcaatcccacgagcaagagaaaccctaggcaacaacttaacaaacaaaacaaaattgacactggataaagcaaaagagacgaaagtgatacagcatttacaaaattgagctaagagagtgacgcatgcatgataaggaacctagcgaaatcaaaaatatatttttaagtaacaagtgagtaaaggcgttaaatcacgaaatgcataggggaatcgaaaaaattcattaaacgagagatttcactgtgaaaacagagaatagaagaaatctggagcttacgctagagagggaaggaaaaggaacaacacggcgatgactcaacgcttgatgaagagtggagtagagagagagtgagtgaggaagatgaagagttattttattttggaaaatatatcagaaaaattagagggtgatttgcaagaataacacatttttatacaagaattaagaatatagcactattaattaacaaagtaatttaaaaatagataaaagagaaattttcacaaatagcataattttaagtttttttgacaaaacctattttatactatagttttttgacaaaattttaagtttttttttggacaaaattgatgaataaaacctatgatccaaattgtgaatgatttatactataagcaatatagtggccacaaaattggtcaagaatttttagtggctttatcaaatagccactgactggagatttttttttaaaaaatatgtgtctggtcaaagtatgtaattatatatctatgtgtaaaattgtatcataaaacattaaggtttccaggattatttttcttctcaaaatttaatatagtgactttgttttactctaagagcttatagtcaccaaagttgttatatatattaatatatgtctcattttttttttttataaaaagaatcaattatgagaaagccacttttgaaagtgacatttgttgattttgcaattttccatatagtttgtgaatttgccatttttagttaataatagataccagttaatacgtggatatagtcggttagatttgtttttaaaatttagtatttggtttaaagtacatattttgcaaaaacattttatatatacatacagttttaagtgttcaaaatgacaaatcctcaagattttagtaaaaactaatgacattgttgtacaattttagtgcttaattttagtattttagttattttatgggctgcactttagcaataaatgtctctttgttttcacttttcagcagttggaactttgaacaaatggaaacaaaaaaatgtagaagacaattttatttttaagcccatcaaaaatacaaatgagattgtaagcccaatatattaaccaacctacctttttcttttgtcagctctctctatttctctaaaggtgacgtcatcttcggcggtaacggctcagatattttccacaataacttccaataatacccctgccattaaccaatagtacccatgtttcctctttgcaacgtgggggtagattcatgaaatgagaacagaacggaggttccaacgagtagaagatgatgtgccacgtgtcactatatcgacccccctttcctcttccttccttccccaatagagagggattttcccgcttcagcgtctctcagtctctctctcggctttatccaaaggttccttcgtttactccgcttctatggaagaagcttgaatccttctctcttcttcttctccttcttcccttgacatttttgttctgagaagcaacatg

SEQ ID NO: 31698 - DNA, 3003 bp, Unknown
  misc_feature (1)..( 3003): 2750-1469P.txt file - cDNA_ID_3045012; gDNA_ID_2926128; Annot_ID_196764
aggacttagaaaggaatattcaaacctttttggcacgtttcacagcaaaggttttgccatctctgagtttgaccttgtaaacagtgccaaaaccgccttgtccgatcctaaaggacggagagaagttcttggtcgcgtcgtagatttcatcgaaggtgaatcttgtatgctctgtttcgtttgcatttccataactcctctgtacactactacttcctgttgagctacgtctactacggatattattgtctgctcacacagagaccaaataaaatcatcatcaactgtttccactaaaagtctaaaatctaagaattactgatcaaactataccggaagaggactttgaattgtcgatgtagttggaggaaacggaatcgggaggagtgaagcagttgatgaagataccggagatgcgacgagcgatggaggtggttgtgtcggtggatgtacgggcaggggttgtcgggaaggaacgatcggtgaaagtagtgttactgtaattggaagatgtggttgcaggagatccgacggtgtagctatgtctccgacgactgggcatcggaaagttcgtggagaacgtgtagcaatggtgaacacggaaggaaggaagagtcggagagactgactttacaattttttcaactttttcttctccgttgaaaaagacgactgttttgggtatttattgacgccagctgtacaacttgacgttctctgattaacaaaatttaaactcgacaagctaagataattaatgtgtataatttcctttttttttattacattttgtctaatgatttgtaataagcttttttattccttagatttaaattcgataattattaattttgaaaaaaaacgattggtttcaaattttattgaataactaaatactttgtatataatagtagttctcggcgttcagttatccattccgttatcgattttttcggttttaaagtttagtatccattcggttatttgaaagttctgttcggtttcgattttaaaatttagtatccattcggttatttcatttaaaatatttcggttattttgaatatttttaaatatttttagatatttccaaatatttttactattttatttatattttcaagtatttttagttatttagtctagaaataattaacacttttaaaaatatatttatactttagatattttacccaaaatattttggtttgtatttattcggttttatttcagatatttcggttatagaatttaatatttattcgactagtttccaatttttggttcggttcgatttaattttttttttcttcaattttggttcggtaaattcgattcaatttatttacagtagtactttaattcggtttaaacgctccaaaacagcacgtacatggaaaattgcatatgtaagattattaaataattttagtatttagaacatctactaaattctgtcattattgaatttatagaggataattagttcaatgccagacgtaatctatccgaatgatttgaaaattttcaactaatatcttgttagcgattattccgccgccaccatattaaatgccagatgggtctatctctattaatgcaataatcgaactcgcatttaatttgtatttttttttacaacaaagataccaagaaaaaggtataatatttttcttataaagttactattagatacattttatatgaaaaaggcttagattagaggaaataataaaatggtagattaaattactttgattagaagtcaatcaatattaggttacggttaacaaggaagattcataggcaggtgaaggatgatgagaattgagaccttaccagcaaaatattcaatagcctctgatagcgacagagggtttgaccttctgtagaatggaccatggtctaaaatgtttatagcccatgtttcagaaaacaaaagcccaatgattagcccgtatccttaaccgacgtcgtactatttaaaaggtatttaatgagatttgagaataattaggcaaactaaataaagtaaagtaggattacagtataattacttactatgatgaggttattcgactagagaaaaggagctctgtgtgtcgaaaccctccgtcgccagcatttattcttctcacttttcttcaccggagaatcacgacaacatcaaattctccggcgacatctcaggttatcttcgtttactgctctcatcggttaattattccatctctttttttgtttcccggagtcggctttcgtgtactttttgtttttggtcttttcggcttcttcaattttagggttcgcgtactgtttagtgttgtttagtttctgatttagatgtgcttactgtgttcatgttgtcgtctattcttatgagaagatcttatggtagagttacatatcaatgatgttaccaattttgaaggttattgtgttgtgtttgattaaaattggctcaagtgtgaaatgcttttgctcgcgtcactgttttcattgcaacttgactgaatcctagaggttgttttagaatatagattcaagtttcagctattgatgggacattacaacagagcataaggaacattcccatacctttgtgtttcttatggataactttggcatcagatcaactttttcttttgtcattttgcttattaacactgtaataatcacttgttattgggatttctcaagtctgctttgattaatcttgtttcgtaatgttcttctcactattcactcttcccatacctttgtgtttcttatggatgactttgccatcagaccaacttttcttttgtcattttgcttactaacactgtaataatcactttttttttattggggtttcttaagagtacttttgattaatcttgttgcattcaagtaatcgttgttcagttcactcttttcctgcagtggcagtgcatctgtaaaatgcttcaaggactgttgttcgctactcttgcttaattattactatagctggtgaaaatg

SEQ ID NO: 31699 - DNA, 3003 bp, Unknown; identical to SEQ ID NO: 31698
  misc_feature (1)..( 3003): 2750-1469P.txt file - cDNA_ID_3045012; gDNA_ID_1972020; Annot_ID_178034

SEQ ID NO: 31700 - DNA, 3003 bp, Unknown
  misc_feature (1)..( 3003): 2750-1469P.txt file - cDNA_ID_3045028; gDNA_ID_1971748; Annot_ID_175256
ccacggagatctgctgcctttatctctgtctacggtttgttaccgctacggaaccagtctcacgctggtttactctcagtaggagaagtggaagtgttttggttccttctgatcattctctcccatattcaaattcaaccgtaacgatgggttcgaaaatatatggtgaacatatgggtgacgcttttggtccgtcttcagctatatggatatatgactgttttactcgctcgtggggcgatgtccccaacatgaagatgaagagggaaaacgcctccgcatgtgttttggatgacaagatttatgtaatgggaggatgtgactctgggggcatcaattggttcgaaatgttcgatgtaaagactcagtgttggagacctctaccggcgaatcctgacgttaaggtgatgacggaagataatgttcgaaaaatcgatgtggtgggaggaaagatttacgtaaagactggggctgagtttatggattggatttatgatgtgaagcgaggtaagtggagtgctgcagatgagtatatgagtttactatggtcgaactcttggtgcgtgatagagaatgtgatgtattgttactcttgctctagatataggtggtatgatttagaggctagaatgtggagagaagtgaaaggtttgaaatatttgaaaagatacagtagtgctagtaatgataatcgtaatcgtatggttgaattagttaactttggtgggaaacttgctattctttgggataggttcgagcggcctggtcgtagtgagaacaagaatatttggtgtgcgatggttgcgctcaacagagactttgaaggtgaaatttgggggacggttgagtggcttaatgttgttcttacagtccccaagtcatataatttcttgcgtcctatagccgtttcggtttgatgatctcttagtcaccttgtagagtcatccttttgcttttaccaaacttaaatgctttgtcttgtgtttgttgtgagtctttttttcttttttctttctacaatttgttgtgagtctgtaaaatcctaaatgaattcatctgatttctagactttgtattgtttcaatttgcattctgcattatgaccatctcctatcgttttgttggtttaattctggttacagtaaacactaagtccttgtgaggcaaatctctttgttctttctaggtcttcatctaaataatgccagtagaagaatttgagtaccttttgatttcactttaaagtgaagtgagattctcctaaacttaatatattattttatatatgccttggtgagatttacattcaagattagatggtttaacatttcagtgttccactttaatatgcttttcctctcttcctctgtttctaagaagaaagagtcatctcgtattcggtcaagttcaaaaccctttagtggctacaaacatttgctatattgtacgtatggttaagacttaagataaaatggataatggtttgtgttgtttcgatatgtagagaatagttgttacttgtcaccggctcataaaatatttagttttccggccgactaatcccggactttccagtagactcttgatttaggtttagctaatcatattttttcatctttttgtggagagtggaaatgtgcagagcaaattcgtcagttatacacttttgtcattatgaaattcgccaaaatggtataacacaagtgagacaaattgagtaatttcgtaagcttttacgttttatgtgttctgtttaatagatcatatacgattattatatatatcactagttcgttagatatctttttttttttttttaatcaaatttttgaaagtagtttgggattcaccgttcaagaataattgaaactttggaaaattaaagatttactagattttcacccgcggtataccgcgaggacaaattatattttaaagttagtatatataaaagtttgtaatttgtaacaatctatgtaactatctataaatatttttattttatagtttagaattgttattaagtaacgtcctgtcaaacccgtcccgccaacccgtcccgtaaaaaaaactcatttattttattaatgttgatcttatttatcatatgtttatgaatcattatctaaatattttgtaattttgtagtaattaaatgctatcaaatatttctgcggtttgatgattataattgaattgtaatagtcatgtagaaaaacaataataatgataattttgtagtaattaaatgatattaaatattttgaaagttttattttaataaccaatcgtgtagttaatgtagagagattttaggaagattgttaaatgtcaaatatttaattcgaagattttttttctaattatcaaaaacaaatattaaaatccagtgacaaccattgtaaataagtcccaactacaagatttatttcacaaaatggctgcaaaaatgtatatatagacatttgtaaagaatgtgcataattacagttataaccttaaacgatgcacatcctttataaaatttacttaactttgttttattatatagttctaaattactaaataagatttcatttggaaataacttacaattttctagtaaagttcccaatttaaaaaaaataaatagaaaaagtgaaaaagaagattttttttgtttgtggaaaaaaagttcagattttttttgaaataaatacaaaagtcgtaaatctaacaaattaatatttttatacatgttaggaataataatttttgtaatgtaatgttaaactaaactaattaagaaatttgtttagaaacgtgtcgaattggggttaaactcatccaaactataaaacaattccgaggaagtccaaaacacgtatctttttcctccgtcgccggagacgattctctttatcaccggaataatcagattccatgttcgaattcagctgagtattataagttataaccccaatcgaaggacaaagaattttaatttttaaaaagtcttcgatg

SEQ ID NO: 31701 - DNA, 3003 bp, Unknown
  misc_feature (1)..( 3003): 2750-1469P.txt file - cDNA_ID_3045036; gDNA_ID_1971748; Annot_ID_175252
gcacttacctctcttgatgttcataagttataggacaataaaagccttttggtaaagaaaagagagagagatactattattgaatggattattgcaaaactttagtaccctaattgatttaaggaacgtactatttgcttcactgaaaatgattcattgccatccataatattcttttgatatcttctgctctaacttggatatatgttagccaaaaacaataaaaacatctcgatcacgtgcaaagatcttgaaatagatatgtctctctattttttaatgtctatgaaaggacgtaacaagtttctcttctatttcgcatttggtaatacattaatgttttaagaagacatttgcccaagttgctaattttttctttttttcctgatgaatattcaatgcatctatggctttgacaaaaaaagagataaaaaatgaaggaaacaaaataaccaatgcatgtaagtaataatactcttctcgcaaatgaaaacaaaacctcgaacaatcaatttactagctatgcgctagggccaagctactatactaggcactaggtccgatttattcagaatcagttttgatatggatattggtcggattcgttcaacccactgattccaatttggttttgaaaaacaatgttcggccatttgcatccagagttatttaaatcacgaaaaatatagtttgctatttatcatatacatacggaatttgcatgttaacactattgatcaactagatttttctaatgttatattttttttggtggggaagtattgaacttaccttaccactctttttcgattcaaatactaagaatcacatttatcagttgtgagtttagctaaatatgtgggtggttttaaatttgtgagtattaaatttgtcatttctatcacaaaacaatgggagaaaaaaacgaaaaactagtttcccgacattaaacatgcgaattactgaaacatggataggtccaccatttttgccatttgacaagctcggtctcttgttttccttgttcataaatgattttagtttgtttgcttttttaaacgcatctttctatcacttttttcttttggttgcaaatatgtcgttttctctcctccctccttttccgggatttaacttatcacaatgtaatgaaatttgcatgttcctctctcgccattggcaagttccattgcgatgtctctatcgataggtcaaacaatccaaaagaaccaaaaccttttttcttttcttttccactcacatttaatctagggaccctttaatcttattcattttctcaacgataatgtaaaaaagtatagttagtaaactgttaactgtgtagattatacatgttttttaatcaatcatataattagaaggggtatttagccgtccaaaagctgttttcgcgtgactatgcatgaaacccacttacgtagcctccaacgtaacgaccaataaaaagctctaacttaggaacattacaacgaactaatatttaataagttatataaggtcatgaaatgaaatcttataacgtatctaacaactcacatgatctataccatgtcacattttttatcaaacatatgttaaccacctaagcactaacactactctttgatcaaacttatatttcgcatatactccaaaagaaaccaagtggcatattggcatatctcgtaatgtggtgccaaaaatgcttatcaacttaattatagttcagatattgtctccgtatcgtatcttaatatttgtattcaacaataggtattatgttgtattagctaggtgtgatttgtaacgagaagagatatctcgttctattgtgaggtaaaaataaaataaagcagtacaagaacataacggtataaacggtttttactgttaaaaaacttgtaattgtttatgtaccaaccctattgattgtgtttaagaaattatttttaaatcttgagattcttattcaaatataaacattgaagatcgatattgctcaatatcacaataatctttctaagttatgaaaagaacgtctactactatttgtttaaaactacataggacaacatcaaatcagttttgaaattcattgtaaaattcttttaatactaaaattgtttacagttaatgagaaattacaatattatttttagcagattataattagaaaatacattattattattgatcaatttaccttgcagttccacgcaaaaccaacaaaataacaaataacaaagcattgtgtggaatgacgtaaggatgagtcagcagacaaggagtgagatcgaatcgggtcaagattatctggttgggacccgtcacatgcacatggaccctctcccgtacctaatccaggttaaataatcttgattttctgtttaattaccttaaaaacacattattattgaaactaataataaatctcggatctttggttccgaccatacttgcgaaagatcattgctttaatgctaatgtttctctaattttgatattccttgagattagattccctttgcattgtcttttcttgttaatttgttagggttcatattcttacattattttttttggcaaagaaaaaaacatttataaacatatctaattcgagcctgatctattaatgggtcaaataaaagcctctttggcccaattcaataaactggccaactggggatcatcatagagacagactactagagagtagagacgcatcagaaagaagagaaattgatcccacaagtttaaacacgattacaaattaaaacgtgccacgtattcaagacggtgaattaacacgacgtggcaaggtatgattggataacttacgcagctgcctaacaaaaacaagtgatttgagttttcagatgattagaaggaaaaaaaattctggaactttcgagcttctgttttgcggtgctctcaaagcttatatcggatctcgaatcttgaatcggactcagaacctcggatcttcgaaaatcgacgaacatg

SEQ ID NO: 31702 - DNA, 3000 bp, Unknown; identical to SEQ ID NO: 8339
  misc_feature (1)..( 3000): 2750-1469P.txt file - cDNA_ID_3045044; gDNA_ID_1971748; Annot_ID_175238

SEQ ID NO: 31703 - DNA, 3000 bp, Unknown; identical to SEQ ID NO: 8339
  misc_feature (1)..( 3000): 2750-1469P.txt file - cDNA_ID_3045044; gDNA_ID_2926195; Annot_ID_201388

SEQ ID NO: 31704 - DNA, 3003 bp, Unknown; identical to SEQ ID NO: 30007
  misc_feature (1)..( 3003): 2750-1469P.txt file - cDNA_ID_3045090; gDNA_ID_1971751; Annot_ID_175319

SEQ ID NO: 31705 - DNA, 3003 bp, Unknown; identical to SEQ ID NO: 24863
  misc_feature (1)..( 3003): 2750-1469P.txt file - cDNA_ID_3045094; gDNA_ID_2214546; Annot_ID_185440

SEQ ID NO: 31706 - DNA, 3003 bp, Unknown
  misc_feature (1)..( 3003): 2750-1469P.txt file - cDNA_ID_3045094; gDNA_ID_1971751; Annot_ID_175317
tttaattcttttaatcaaagcatgatttaatgtaaaattatactactgtatgactacttttcttaaaaatataacctaggcaacttgttcatgtgggtctactcgttaggtgcttcattttgaatgatcatgtttaattgcgtaacgagataagtaaactggttaattgcttgtgtgacaaaagatacatatcaaatttaattaatcattaactttgattaaagaagtaggcggcatccccaaagtcaacaaataaaatcaaaggtttctggtttaatccacgcgttgccccatccatattccctttatttctaaacgaaagcgaccgccatttccgtattttgtctccctagcaccaaaattacatgaccatttatttacttacgtggttctttttttctttgcagcagaattatataaatatgcaacactggttagtctaacgctatagatatggatgatattttagatatctatatatacatttttgcagccattttgtaaaataaatcctagagttagaatttatttacagtggctgccactgacatttaataattgtttttgataattaaaaagaaaatctttgaattaaatatttgacaatcttcccaaaatctctccacattaattacacgattagttactaaaataaaacttcccaaaatatttaatcttatttaattactacaaaattatcatttttgatattgtttttctacatgactataataattcgattataatcatcaaaccgcagagatatttgatagcatttaattattacaaaattaaaaaatatttagacaatgattcataaacatatcataaataaaatcagtgagttttttttacaggacggattgacgggacgagtttgacaggacgttacttaataacaatcgtaaactataaaataaaaatattttatagataaatataatttgcaaacttttatatatagtaactttaaaaaataaattgtcttcgcggtataccgcgggttaaaatctagtaagacctaatagagtaccaaggctagaacaattaatacgagtatcgcgtatgaaaaagaatatacatgtattctgataactatataaagtagtagatgaaatgattttgattcatgaatctctatgttgagtgagaaaatgaatagcctgagacaacacaagtgtaatagctttcacgcttggacttgtgtctgaattttggaactgatgatgtttgctgctctttctagaagacctgttgaaaaaagcataaatacgctctgttttcaaatttggcaattgatatttgtttttgtacgtgtctatttaatttttggtaaagaacgcacgttgtttatacttacacaccgcccttctagaagaacaggctctcacgtcatttgcatacaacttccatcttctggaaccaatggatccctgttacaaaagttgctcttaaaacataaacaaaaacaaaagaaaagaaaacatttttatatttgtcgtcaataataatggccactttctgcttacatgtatatgaatgtatatattactataatacgtagctgctcgtgtttcttgtctaagttctctgttatagttaggagacaaataaagagaattagagaacagaagaccagaaaaataaagatgaacacaaccaacaacgtgtttgatgtgtcaccgttcttgcttttagaagcatctgcagattccgaagctggccacgacagcgttgacgatgataaatgcgttaaggattacgatcttggtcatgagtcttctagtgccagttcttgcgagacgtcttgcgtgagtcagagaacgagtttgttaggttttgacctgcaggacgatacggtgaatcatgaagaaagagacgccggagatgaagaagacgaagacggagaaggagaagtgaatagctacataagatgtgggagaagccaacgtgaaaatctggctgtggattctgctgcggyggtgagtgagatggatcaaaatcgaatgttctgggaagcttgtctcgcatcttgatctgtctttattaattaatgtcatctcatcatcaacagagaaaacaaaatagtatatatctagcttagcgtagtgttcttgtctgtgtttcccctttggcttttaatgcacaactaatcgatatgatatctacccattaaccttaattagtcccctttagcgtagtgtaaatttgttttgattcgtcaagagaaaaaaagtggtctaagggactgactagttggagaagaatccgtataaaatctgttaaaaggagaaacaatatactatactagtcttttctcgtagaggaggatgttatactaacattactaatttatgctcacccagtttaaataaaataaaatcaatacttttttggtttgtactaattaacatatatatatatatatattcccaaaattaaagattccatggctaacagacctaaagaagaagaagaacaaacacaataagagattggtgtagttttacttttactatattcatctttgtctttattgaccaataaagtaatttctcccctttatctatttgatagtggtatactttaagttgctttttaattgctggtgtacaattatattggactcaccaacaagaatctgtgtgcagtcagtgtgcttgttactattgttttatctcattaattgatgatcactttttcaccttcatacatgagagctgaattcatcactttgttagttatataagttgggctattctattattaacagtttgatttttgacagtaaatttgtctgccagaataacttatacacattaccacccaaaaaaaaaaaaaagaagaaccatttttggacattacgtggttttgggtttgtctagcgaccttttatgggccaatgatatgaggcccagtaaggaaacaaagaacggcccattataatgtaaacatatttagtacaaggaaaaggggtaaaaaaggaacaaggggaaagaaatg

SEQ ID NO: 31707 - DNA, 3000 bp, Unknown; identical to SEQ ID NO: 12380
  misc_feature (1)..( 3000): 2750-1469P.txt file - cDNA_ID_3045099; gDNA_ID_1971751; Annot_ID_175310

SEQ ID NO: 31708 - DNA, 3003 bp, Unknown; identical to SEQ ID NO: 21939
  misc_feature (1)..( 3003): 2750-1469P.txt file - cDNA_ID_3045105; gDNA_ID_1971751; Annot_ID_175301

SEQ ID NO: 31709 - DNA, 3003 bp, Unknown
  misc_feature (1)..( 3003): 2750-1469P.txt file - cDNA_ID_3045113; gDNA_ID_1971751; Annot_ID_175297
aaacactaggcgtcctcgagtttttttcttccttttcaaaccagtttggtaacgtcagatttagttgacatatgaatgtagttttattacttaatttgaatttaaattgcataagggccaatcatgagattcgtcgtattcatttttgtttttaatttaaatatacgatcgattttgtctattgtgcatattatgcatctgctggagtcaaacttgactcttgatcgtcggaaagggacttctccatttatgtattataatggacgtaaacaaaaattgtgagttatcgacacaacttcagaaacacctctcatttatggtatattgtgaataaacgaataagttatccattggaaaaattaaatcagtagctagtagaaacatatatgaaaaaatatactgcgacagacagtatattaactgggaaaggagaaaaaccgagaaagaaaagaaattgtcaaaggaaatcaatcgtatttaattaagaaaaggaaatctcaactgaatctgcccttttttggttaagggggcttcagattaaaaaagagttatcgcttcataatgaatgaatgaatattcagtacaggtcacgacgtcatgttacgtacgactaaaaccgcccattttcagaatcagagccgatcggggtattgtttaataacggatttaacgatcgtgcatgtcatttcgttataattccaagctttctcatcattatcattttattatcatctttatcaacttaaacagactcttctttggcggcccattcacagcccatataatgattcttaagaaaagaaaccactcgctaccgatgtaacaacaaaattattaaaatgatcactagtattatagttttcattaaaacgacaaatccatgtccgtacttgtcaacacacaccacaaaacatatacatatatatcaatctctcaggccagaggattattcaaatcattaatttgtcgaaatccatcacttgaaagtcgggttagcacgagcaatggtggaagaggaactgagcttcatctttgccttctttatgtactcagagaactgatctgatgatctccggccactactacctacgtgagagataggcacatggtggtgaagatgatcatgacgtgtctgatctgtttcatcacttgtctcccacgcatcctccttcatcatatcaccgacattcgtcatcgcccttatcttcagcttcgctttctttatatactcggtgaacctctcgtccgttttgatcgtagtatccactcgagcgatcaccggttccacctttgtaatgggtttggctgccctaggcctagccgatgtctctgcaaatttgacgcgaacagcctctgctggtgaagatttggtggagatgcgacgaacggttcggacaggactagtcactgctctgaagatcttctcgcacactctgttttcttgcttcttcttgctactactctgtgatgatgagttctttgccatggatgtcaccttgggaagtactaaaggtgatctgtgcagagaagatagtgacattaacgagctttttataatgcaaaatctatgtgatttatctttgttaattgcagaataacgtgtttcaacatgcaacaagcgaagaaattacaacttgttgaaaagaggaaagttggaaacttttacaagtttttcaaaaaaggaagagtgatgttagaaagggatcggattctgattccactatgttttctttctttctttcttcttcgttgtttttgtttcggattgttacgttcctgtcaggatttgagaatcatgcatcagctgtcactcctctcaggagggggagattatatctacttgtaacatactaatcttccaataaataagcacttcacatattattaaaatacagtagattctcataattaggccattttccataagcttttgtttacttatttcaatccactagtatgcttttcacattattcttttcctgcaatttagcatgaatcatgtatgcaatttagcatgaatcatatatatgaaacgggggtttactaaaactctatacataaatttctaaaactctaacccactccaacccggttttttctgttcgggtatcgggtccggtttttttttcgcaggccctaattaagacattcaagaaaacaagaagaagcataagaagaggcctaaatgcccagagaattaaacaaatgggcctttaacaatattttaaacaacactgaacaatagatgagatctcaacttcgaaaagctaaagccttaatataaaaccaaacatcaatctctcgccgttaaggttacatctgtcgccgccgctgagaccgccacttaaggccgtctcctccgctctatccatatccaaaacagctataaagataaacttccagagcttggtgaaggagcagcaaccctagttttcaatccctaaaggtgaagtttttgttcttctttttctttgattctactcttttttcgtcacaatagcgcagtagcgatctgggttggcgtttttattgacggattttggtgggtttgggttcgtgttagattttactttcacagattcaggtatgtatttgatcttatttagctttggtaatactcaaaccaactagtatttgatcttaattaggtgacgttgatattttgtgtgttgtgggtcaatcatccactctaggttgatctgcgtctatgtttagtcctaattttgaagaatcattctaattgctgatgtttatttatgacaattttatgtcttacttcgaatttagctaagataataaatctagacgagtgcctttataaacagtttatgtatgaacaatgcttcgcttgtgggattgttgatttcactacatttgattaagaatgtacatactattacaaatgttatcgattaaaaacgtcattttcagatattagttctccagcgagttgacacaaaacccgattacgtttcatccggcgactcgctttgatattccatg

SEQ ID NO: 31710 - DNA, 3000 bp, Unknown; identical to SEQ ID NO: 8350
  misc_feature (1)..( 3000): 2750-1469P.txt file - cDNA_ID_3045117; gDNA_ID_1971751; Annot_ID_175292

SEQ ID NO: 31711 - DNA, 3000 bp, Unknown
  misc_feature (1)..( 3000): 2750-1469P.txt file - cDNA_ID_3045156; gDNA_ID_1971757; Annot_ID_175366
cagataaaacttggctcactttccgggaacaaagttggtggcgaaggcccatgcgttgttgttaactggatcggccaaatggtcagcaaggttctctatcggtcccttaccagtgacgatggcttgaacgaagaatccaaacatagagaacatagccaatcttccgttcttgagctccttcaccttcaactcagcgaatgcctctgggtcggtagccaaacccaatgggtcgaagctgccaccggggtaaagcaagtcctcggcctctcccaatggcccatttcctgcgactctgtagccttcaacggctcccatcaaaataacttgtgtggcccaaatggccaaaatgctctgagcgtgaaccaagctagggtttcccaagtaatcgagccctccatcgctgaagatctgtgaaccggccttgaaccaaaccgcctctccgaacttgactccgtttctagccaaaagctcagggaagacgcagcctagggctccgagcatggcccacctgctgtggataacttctagttcacggttccttgcgaatgtctcggggtcagctgaaagtccggcggtgtcccatccgtagtctccggggaactctccggtaaggtagctcggtgattcgccagagaatggacccaagtacttgacacggtcagatccgtaccatgggctgcctgatgggccctttggcttggcaacagtcttcctcattgtcacacggccgcttccaaggacttcagatgccgcgggggaaagcttgacggccttaccggcgaaggcaggggaggagagagccattgttgaggcggccattgaggttgagtagtgcagcacaaagtaaaacgtttaagatttgttgttgtaagccaagaaatgggtggtttggtattgatgcgattttcgctatatataatacagaaatctaaatactgtcttatcttgaaatatcaatctctgaggttgctattggctagtcatagattttttttggggtttagattgtttgtttgcttacgtggttaatggctcgcacttcgcagattcgcaattgatatgtgttttagatatctaggtgcgtttcatggattggcgaaacacccactcatgacgtgacacgtatacgaatagatctctctatccttatgaaatcctgagagcatcaatgtaaaccaaaacaaaaaaaatttggataattgccttgtataatacattttattaaaccttttgtatatatgcttcttttttttttcttcttctgataataataataactcttggctagagataaaacataagaacaaagtagataaaactataaaatttatgtatggaaataagattatctaaaactacggaattgaatcaaactttaccacagaaacataagaaattattaccatcttaattagcacctgtattgaccataatattttattagaagaagaagaaaacattggaatccaccagatcaaggtgatggtcagggtcataagacagctccataatcacgagtcatggtcatagactcatagccacaagtctgcttctcccttaccaataccaacggcttcaacaacggccacaactaataagccaattccaacggccaccatataactgaaccggatattcaccaaacccatttcaaccggaaattgatccacaagtaattaaaaatgttctgaccaaatgtggaataggtgggaaaatgttgaagtaaaggccaattctataatgtgagaggaaaactcttttttgagcttcaggaatattttcttagacctgaccttgaatctatattttgtagttcttcaatgatttgatttctctattcatttccttataaattaaattacttgtgaaatgaatttctgtttagaaaaaccttgaacttcctagttgaccaaaggattagaaaatctttctaagtggagtgtctcctaataatggatcaaaagtgtttggagcaaaaaagaacgcatagtgtattagtgttaacagcttttatagttcaaagtttagaatgtgctctaaagcatatgtgtgagcctgtgaggtctagtgattgtaaaaaagaaaaattgtgcttcgtggaaagtgatgcaataaacaacacttctagggctgagtaaaaccaactagacatgtaatgatagcttaaaccgttttctataggagtgtgattgaggagtaatttgttgatgaattcggaaaaagcgaataaataagtttgttcaaaaggttgttgaagtttacaataaagataacttgaatcatgataagaaaaaaagtagctatatgttctctaaagtctaaacccatgatgatgaacatgccatatgaattaatatagttctttcatgttcttagaaatggtcgataagttaaaacagtgtttcattaatcgttgtgtttcttcgataaagagtaaaacgtcaaagttttaaggtgatatcacataattcatgagattattttggttattggataaagtgacgatgaaatcgattcataattgaaattaaactggtagtgatgatgaactaattaccattgaaaatattgatatttatgtgtgggtaaatgctttttataatgttactttatattaatgtttcgatcatcagaatctatattttcaaaatgttatactttaagttttagttattgggttgtagcaaaaatcattcttgtcacgagggtgtaagtaagtgtaaccgttgaagtattcagtggctcataacttgtggtcacaaaacgcttggctgcaatgaaaaaatcaaaacaaatgctggtggactagagattgccacgtaagactactaaacgataaaacaaaaatcttaaaatccaatgaatgaacagataaagattacttcagatataacaaacgttacaatatccctatataatccaacactatcgaaccagttttaatcactctcactcacaagttagtcataaaaaaaaaaaaaacacaaaaaagtttcaatg

SEQ ID NO: 31712 - DNA, 3000 bp, Unknown
  misc_feature (1)..( 3000): 2750-1469P.txt file - cDNA_ID_3045160; gDNA_ID_1971757; Annot_ID_175365
aaaatgttatactttaagttttagttattgggttgtagcaaaaatcattcttgtcacgagggtgtaagtaagtgtaaccgttgaagtattcagtggctcataacttgtggtcacaaaacgcttggctgcaatgaaaaaatcaaaacaaatgctggtggactagagattgccacgtaagactactaaacgataaaacaaaaatcttaaaatccaatgaatgaacagataaagattacttcagatataacaaacgttacaatatccctatataatccaacactatcgaaccagttttaatcactctcactcacaagttagtcataaaaaaaaaaaaaacacaaaaaagtttcaatggccgcctcaacaatggctctctcctcccctgctttcgccggaaaggctgtgaacctttcccctgcggcatcagaagtccttggaagcggccgtgtgacaatgaggaagactgttgccaagccaaagggtccatcaggcagcccatggtacggatccgaccgagtcaagtacttgggtccattctctggcgagtcacccagctaccttaccggagagttccctggagactacggatgggacacagctggtctatccgctgaccccgagacattcgcaaggaaccgtgagctagaagttatccacagcaggtgggccatgctcggagccctaggctgcgtcttccctgagcttttggccaggaacggagtcaagtttggagaggcagtttggttcaaggctggttcacagatcttcagcgatggagggctcgattacttgggaaaccctagcttggttcacgctcagagcattttggccatttgggccacacaagttattttgatgggagccgttgaaggttacagagtcgcaggaaatgggccattgggagaggccgaggacttgctttaccccggtggcagtttcgacccattgggtttggctaccgacccagaggccttcgctgagttgaaggtaaaggagctcaagaacggaagattggctatgttctctatgtttggattcttcgttcaagccatcgtcactggtaagggaccgatagagaaccttgctgaccatttggccgatccagtcaacaacaacgcttgggcctttgccaccaactttgttcccggaaagtgagccaagttctatctgtttgtaatttacttttctttcaatcttttgaattcgagtgagagacaggaggagaaagagtaggtttgtgtttgtggtggatggtagagactttcagatgtaaatttgcaaagactttgtatgatttgtcattaatcaaataactcattgttctctaaatatgtttcgtagaactataattgaattggattttcagttcttgggttcactccgttgtagaggctatttctacaatcgagcaacgtgattgaacatattaaggcaatgggtacaaagattatgttcttttcaaatcaagagaaaatgtgattctcggatgttagcttgaacaacacgaaagagtcttttatataagttttttatattcccttgatttaacttgtatatcgtctcttcacaaaatatgatcgcattgaagaagaaattgcaatcgttttttttcttctgattgagagaattagagaatagataatgaagtagtttcttccgtgtttggttgattctgaagctcgtaacattggctcatacgatatctggataacaatatatcacattgctctgataccatattaaaatcacatccacgcattgaatggactgatcatatatcttacatattagttaaaatccattgtcgtgcgagagattgccttccgtgacatcctctgtggaccaggttcgcttgtcacactagctataattggtgaacacatgataacatatatgtttggagcatagaagagctagcgcctgtgtcattggtgtgtggtatcgaaagaacaagagaatagaacaggagaacatgaatatagctaggtttattcattttcaccccaaagcttagaaattgcgttccaaagagtgggtgaattcatgtgtgagggcaattagtgattgtaaaaataaaattgtgttttgtaaaaaacttttactgtcgaaattatttagggtgatgaaaaaatcagtaaactacgaatgatagcttaaagagtttctatcaaagtgattgaggaatagtttgttgcaaattaaacctctaacaaaatgttttctgttgtggtttttcatctctacaaattttgaattttatgatgaattagaaagatagaatgagttactttagattttaaaaggttgttcaagtttacaaaacagattactagaatcatgattaaaaatttacaagctacatattgtctaaaccaatgatgttgaacataccagatgatagtttttcagtgtttgaacaatcaattggatagtttttatgtttctgcaaaatatgcaaataatcagtgtttttgagtctttgcattttgatttaaaagcaaaaacaactgagtttcaaggttaaattaattacattattcatgagatttatcaggttagtggataaactgacaatggaatcaatgttattgtaaattggtagtgatgttggacttctaatgttactctctatgatgtttcggtcatcaatatcacactatctttacttttatttaaaggaaagatcacacaaataagttatctctattcagaactattaagctgcttccaaaagacttgcaacatgtggtctcgaaatgctttggctgcaatgaaaaaatcatagcaaaagctagtggactagagactgccacataagaatagtaaacgttaaaaccaaaatctcaaaaatccaatgagtaaagagatatagattacttcatagataacaaacgttactcgcaattttcctatataatccaaccctacctaaccattttcaatcactctcactcacaagttagtcaccaaaaaaaaaaaaaaacacaaaaagtttcaatg

SEQ ID NO: 31713 - DNA, 3003 bp, Unknown
  misc_feature (1)..( 3003): 2750-1469P.txt file - cDNA_ID_3045168; gDNA_ID_1971757; Annot_ID_175363
ttcgattattatctttaagcaagcagtgggaatgtccttttctacaaagcctttcaacttcaagctcaaggtttggatctcagagacatatcctgtcactaacggaaccactttgaagaatgtctgaacaagacgaataggctcacttctgaatcttaacatgcacggacgccttatactagcaatcgtttgaccatccacagataagaagtccacccgaaccttcaataaacacatgatcccatatcaaaatggatgagcaaaacataagtaaatgtttattggacaaaaacgaatacacatgagaaactatttcaagccagagcaaactgcaatgcttagacttagagtgtaagatatatatctcatgccaatacctgaaacatgccgagatttttattgtacgcagactcaggtaatgtcattgaaagaatgatatctaacttctggtctcgagggataactcgcaaacccctgatcttcgacatttcattactttccttgcaacttccctcacattcaacaccagcacacgaggatatgggcacatatgcttctggactattcttggtgtaatcaaaattcaaggtctccttgacctcaaatggtttatccgctatacggttaatcacataaccaccaatcataagcgacgaaaccaacaagccaaacaacacaatgcctacataaacagcccaaaacataccccaaccaaacttgcacacaatactcaacatttgttttgtatcttttaacctaaaaggattcatataaccaaagatcatatcacttattcctgctactcttgccattaaaaagcgtctgccaaacctaatcgtgctaaagggatcgaaaaagaagagaaaacagttacggagaagccatggaggaaatgtgagtaagcttgtcatgaaactgacttgaaattcgattgctttgatcactagcccaaccaaaaacccaaggagagaccactcagtggaattaggtggctcccgaaactgtggtaccgatccggcgtagtcgtcgtctccttgatcatcgctgctcacggtagtcaccgtggattcttcctgaaacgggtcaacccggttccgacccgaatcaattacatccatatcattcccagacgaactaattacatccaaatcgttctccttttctgaagatagatcaattgagtccttagttgattcaattacgtcgcttgtatcaatatcccctctaagctcagcgttcttttccacatagctggatttctcaccgacatcaaatccatcggaagaagaagatggctccgtttcaatatcggacgaaattaaatcccggcgatgtgccgactttcgccgccgtaagagagacgaaggttgatgggaattggaacgaatcggtaagcaatcgtagtaaaattcgtcaggtgcgtcgaggaatcgatcgaattcgtccgtggtgctagggtttgactcggactcggactcggagtccattgatggtgatgataacccagaagaagaagaagagattgcgtgagtttggggaatttctaaagcatcggtggcgataagcgtgatagctcacaaacggcgtgaccgagttttttttatttaattttaaatttatttatatacgtcactctttggcctttgcagtcaataaccggagcggaccatcaaaccggataattgagaaccgaagataaaaatgaaactaaccctagggaagttactatttttttttttggtcaaacaggaagttactattaatttctactaatgaatacagatacaaggtatctgaatctgagagctgagattagaaagtgattgtttggtgggttagttagatagtcttccacaaagatatgagtgttggactgaaatttatctcactaatcaacttttagtgataaaataataaaatagtttacaacgtttatataaatgtttgttctttacttattttcccattcaatcatagcaatatactttacttattattttttaattaattaattattttacttaactatttatgacaatgttactgttgatagagattgttttgtgttactttatatttaatttcttttcttaaattaaataaaataacagattttttttataggattagtcattaatcgaaacaaatctttgggggatgtattatggcctatattttgcgtgggcgagacggatacctcagttggagttagaggtggattcagagatagtggtgggttttctcaagaccgggataagcaacacacatcccttgtctttcctagtacgtttgtgttatggctttctttcgaaggactagagagtctgaattacacatgtgtatagagaagttaatcatcttgctgatgggttagctaactatgcattttcgctccctttaggtttgcatttttatgatgtatgtcctgacggtttgtcgtcttgtttatctgacgatgctcgagggtctgcgtacccgcgtaaagttcttttgtaatatttttttgttcttttcataaatttgtagggggcattgccccctcaccttaccaaaaaaaaattaatcgaaacaaatagggttggtctagcggttaagcggaaattaatcggactagatgaagattttcaaaaaggagaactatatggtttttaaactatataaaaaaatatgatttacctaaactatgtatcctttaatttatgttacacttgttgacaacaagttcaaagaggaaatatcaaagagcggatatgtatgggttaagcttacttttgctaatgtcaatttgtttttttgttttccagtgtcaatttcattttgaattgtcttttgtcatacacattttgtcttcaattaatgtaagataatctacgttttctttaaagaaatgtcgtaaatcgtaatgaataattgtctacttcaaaaaaaagtttgaaaaattgttctttgactattttgtgcaactattttggtcttcaaaattaacaaagcattcacacaatg

SEQ ID NO: 31714 - DNA, 3000 bp, Unknown
  misc_feature (1)..( 3000): 2750-1469P.txt file - cDNA_ID_3045174; gDNA_ID_1971757; Annot_ID_175361
  misc_feature (411)..(460): n is a, c, g, or t
ttggcacactcgatctgcaccacattgagaattattgttatactaacatatgttaaccataaaggcttcactaaccacattgtgaagtttctttataataacatatgcttcgatttgtagatcccactaaccttaaccagatgtgaaactgtgaaatgtaggtctcgagagttatcttgcccagccacctagagagagatcatggtcaaaaagctgtgtgcactgtgaacaagaaggtaacaataaggaattaagagattgagaatcttacgcaaagagtgtcagggaaaatctccgtagctgttgggtgcaatttcgcagacagatgtagacactgttccagatttaaaaccaaaggtcataaatcaagaaagcatattatctcaagattttgagtcaccaaactacgcnnnnnnnnnnnnnnnnnnnnnnnnnnnnnnnnnnnnnnnnnnnnnnnnnnagctgtttggtgactcacaacaaaatatgaatgattgcttcaacagtttataggatcatcaattcatcatcatcatcatcatgtgaaagaaggcctaatgaagagtttaatacaaaaatatgacaagttctttctcaaggtaactcaatggtcaaggggattcaaaccataatcaatcaaaaaatgatttaataaaccctaatggacctaatcacacccaattaacacctgcagattttggactcaaaaaacttcaattaaaaaaatgaaaaaccccaacgtcaccggaattgttgcggctaccaatcatgaaatcccatttccaacagataatgaaaacccaaaaaaggaaactttacaaataaaatgagaaaaaggagcaaactttgcatagaatctgtaaacccagaatccaaaaaggaaagagaaacgataaagttcaaatttttttacccaaaaacagaaaggaagtaacttgaaaaccaaccttcttgctgcggtaatttgatagcatttacactataaaatttgaagcaaatgatggcaaaaacagaaaatgcaaagatgttaagatcatttttcttcttcttcttcttctcggccaatatttgatacagagatatcattgcaacaaaaatatctctgtaaaacaatgtctcatcgaaaatgataaatcgttagggaagaagaagatctgaattttttttctgggttggttaggcaagtgtgatgatttagtggattcgtagaattatgacagagaatctacgaactgtgcttttttcctcccttcgtttttctggttatttctttttttaacttcctagtgaaaaaaatttctatacagcgtatattattattagtcaaattttgaatttgactgaaaaaaaaaagaatggtacaatcccacaatgagaaaaaccacaaaccctacaaaagttgaacaaataatccattagaggtaaaaagcgacgtaaatcaaaaatagtagatatctgtttagagaaattacccgctttttcattgtgtgaatgctttgttaattttgaagaccaaaatagttgcacaaaatagtcaaagaacaatttttcaaacttttttttgaagtagacaattattcattacgatttacgacatttctttaaagaaaacgtagattatcttacattaattgaagacaaaatgtgtatgacaaaagacaattcaaaatgaaattgacactggaaaacaaaaaaacaaattgacattagcaaaagtaagcttaacccatacatatccgctctttgatatttcctctttgaacttgttgtcaacaagtgtaacataaattaaaggatacatagtttaggtaaatcatatttttttatatagtttaaaaaccatatagttctcctttttgaaaatcttcatctagtccgattaatttccgcttaaccgctagaccaaccctatttgtttcgattaatttttttttggtaaggtgagggggcaatgccccctacaaatttatgaaaagaacaaaaaaatattacaaaagaactttacgcgggtacgcagaccctcgagcatcgtcagataaacaagacgacaaaccgtcaggacatacatcataaaaatgcaaacctaaagggagcgaaaatgcatagttagctaacccatcagcaagatgattaacttctctatacacatgtgtaattcagactctctagtccttcgaaagaaagccataacacaaacgtactaggaaagacaagggatgtgtgttgcttatcccggtcttgagaaaacccaccactatctctgaatccacctctaactccaactgaggtatccgtctcgcccacgcaaaatataggccataatacatcccccaaagatttgtttcgattaatgactaatcctataaaaaaaatctgttattttatttaatttaagaaaagaaattaaatataaagtaacacaaaacaatctctatcaacagtaacattgtcataaatagttaagtaaaataattaattaattaaaaaataataagtaaagtatattgctatgattgaatgggaaaataagtaaagaacaaacatttatataaacgttgtaaactattttattattttatcactaaaagttgattagtgagataaatttcagtccaacactcatatctttgtggaagactatctaactaacccaccaaacaatcactttctaatctcagctctcagattcagataccttgtatctgtattcattagtagaaattaatagtaacttcctgtttgaccaaaaaaaaaaatagtaacttccctagggttagtttcatttttatcttcggttctcaattatccggtttgatggtccgctccggttattgactgcaaaggccaaagagtgacgtatataaataaatttaaaattaaataaaaaaaactcggtcacgccgtttgtgagctatcacgcttatcgccaccgatgctttagaaattccccaaactcacgcaatctcttcttcttcttctgggttatcatcaccatcaatg

SEQ ID NO: 31715 - DNA, 3000 bp, Unknown
  misc_feature (1)..( 3000): 2750-1469P.txt file - cDNA_ID_3045205; gDNA_ID_1971757; Annot_ID_175353
  misc_feature (391)..(440): n is a, c, g, or t
caatagtcgtaggtattaacaaatcagtgaatctgaactaagaacacatacatatcaaacccagatttataattacaacctaagtatcaaaatccgtcctttgctactattcttcaccaaaatcaaaaatctaattcaaattattaccgtttgtgacgtctgtacagattattgaacaatgatgcagctggaacctaacaaaaaaaaaagagaggtaaacacacacgcaaatccctgatatacatacatgcacataaacatacacgaagagggtgattttggttaacctgtgttctagagattgagaaaagtttaggtagcaagagccgactcattggtgccgaagccgttgcggagcagaaatttccggggagagttttgtaatgagtcnnnnnnnnnnnnnnnnnnnnnnnnnnnnnnnnnnnnnnnnnnnnnnnnnntcgtggactcgtcactcaaggacgtcatagctgacactatgatgagaagacagaagagaaagagaaaaaggtctcggctgtaattctgccaatggaatccacatcaaaaagatggacggtcaattgcaattgctaacacagtaacactgatataagctttctacaccagaaagaatttcggctctagtgaactatatattgcacaagtattttttttgaaatttaacaaccgaaaaggaaattcgtcaaagaagtttgatggaggcaccttttgagactgcccgatcaagctagttcgatcacaaatataaaaatataaaagaattgctccaaactcagccctacaatagaagaaaatggtcactatggagcctaatcagtaagaattcaatattgctgagaactaaggaacctacattgctctcaaggttgctcggttttcaagcaagaaagagtcttccaaagtcagaaacctacgaataaacacaatgccaatggttaagaaaatattatggctagagaacattcctccctaagaaaaacaaatagctataacaacctaatcaaatttgttttgattggtgagctataaaactttgaagaggcagatcttggaagacctccttccattaaaactgttccttcatcctctttgttcgtcaccatttccagttcaaccaaattcttatctgaatgactgcaaatgtggataacgtgaaaccacaaaaacagtaagttccaaagaaattaaacacacataagcgagatatcagtagatgagactcaattagataataatcatccatacacatacactttagcgtgaaaagaagacctcctatactccagaaattccgagtatagccatgctatcataagaggaatgactccaagcagaaacgaaacctgcaacagaaagaagaacaaaagaagaaagattgagaacaataacagtaatccaaaaaaacccacgaaagttgtgttctttcagccgaatacaaaatgtaaatctacgcaacaaggttcaatccaaatcttccaaactaaaagaaaaagtacgttgcttcaagctgaagaaaacacagagtggctgaggtagaagcttagtaagttattagtaattgaaaacacttgactcaatgttgagacattacaatctttgtaaatgaactattatagatcattgtgccagcagatcatctggtgggataatcaatctcaccactctactttacacagccaacattaatctaaatctagcaagcaaccgatgaactgaagaatgaatcaaccacattcatataaaggagaaagatagagagtcctaatcacattaagctacaggccaattcaatcaaaatctcaaaatccgcttcgggaagttggagaagaatgtaaatcgaaacttgaatcaccgaagatcatgaaaaattgtacctgaccaggcgtaattggctgtgacacaaccatatctactggatccataaaggaatacccagagattcaaaaactagatactgcaatatacactccaattgcaattagtttcaatctaggggatgaagagagagatagacagagttaattggggcagtggcaacgaagaagaagaagaagagatctgaagtgaagaagctattgcttcaaggaagaagaaaatggcggacgcgacgtcgttttcgtcaaattcaatcgtacggttggttggtttggcgattgcctctcctctaattgttaaattattaattacttattaattactaattaagtaaattacagaggtaatctgattgtggttatacgcaatttacagctctcactgcacacaaacttttctttctaatcgcaatgcctttgcttacagaaatgcatgcatttaggtttggttttgacaacatatttgtgtatctaaagaggaaaaaaagaacacaaaaacattagtgtggatttgcctatagataaacaaacgtagtggacctttctggtaggtgagggataagttggtaccaaacatcaatgttcacatatttgtttggtgttaaagcatttggaaaattttgcatccatgttgaaacgtcaaacgtgtagatgtgatgacatttaaatgtctttactctttattgggtttagatttcatttcgtcaaccaaacccactccttgggcccaaaggtttccacattatcatcttaaaccctaagggggccactagtaagtggaaacaaacacttcgtcgaatgcgcatcttctctacattcgtctttcatcgcagacaacaaatcttcaatcttcgtcaattccaaaccaccacaatccttcgcaacccaatctccatcgctccgatccagattccgatggacgccaccgagcagtctctccgtcaatctctttccgagaaatcctcatccgtcgaagctcagggtaacgccgtccgagctctcaaggcttcccgtgcagctaaaccagaaatcgatgctgccattgagcaactcaacaaattgaagctcgagaaatctaccgtcgagaaggagcttcagtctattatcagtagctccggtaatg

SEQ ID NO: 31716 - DNA, 3000 bp, Unknown
  misc_feature (1)..( 3000): 2750-1469P.txt file - cDNA_ID_3045209; gDNA_ID_1971757; Annot_ID_175352
gtgccaagatcagggagtatgggatcactgctccagacacgaagaatccactctctgatccttacccgtttaatttgatgtttcaaacatccattggcccatctggtttgattcctgggtgagtatttttcatgttataatcatttctgagccactttctttcctgagtttgttatcaaattactcctcttttgtgtttcagttacatgcgtcctgaaactgctcaaggtatttttgtcaactttaaggacttgtactattacaatgggaagaaacttccttttgccgcggctcaaattggtcaagcctttagaaatgaggtaatgtattactttgcttgatgtatgggatgtcttcatctcaatcttctttaagaaattcttttctgcattatgtctgggttttaataagtagcatattactcgcagatatctcctcgacaagggcttcttagagttcgtgaattcacgctggcagagattgagcacttcgttgatcctgagaataagtcacatcctaagttctctgacgtagcaaaattggaattccttatgttcccaagggaagaacaaatgtctggccaatctgccaaaaaactttgccttggtgaagctgttgctaaagttagtatttgtaatcatattcgcctacttaattctactaagaactcgcacacacccatttttatatcttattgatgcctgacactgaaatcctattcgtatagggtactgtgaacaatgaaactctaggatacttcattgggagagtgtatcttttccttactcgtcttggcattgacaaggaacggctgcgcttccgtcagcatctagcaaatgaaatggcccactatgcagcagattgttgggatgctgaaattgaaagttcatatgggtggattgaatgtgttgggattgcagataggtctgcttacgacttacgtgctcactctgtaagaacctcaccttttacttctattttcatcatttcgttttacagctagataattaatgatcaaaacccgtaagtgttcctgtttaaattcactaaagtatattgttgatcaactgttgcgcgacaggacaaaagtggtactcctcttgtggctgaagagaaatttgcagaacctaaagaagtagaggtattttagtgaacagattcattcatctctgtctttattacttgtccttaacatggttatcttttatatcagaaacttgtgataactcctgtgaagaaagaactgggtcttgcattcaagggaaatcaaaagaatgtggttgaatctttggaggttgaactcttaactgttttactgaataacttttttttttaataatatggtgatggtttagaataaatatcatgcttcgtgtaatgttttgttaggcgatgaatgaggaagaagctatggagatgaaagcaaccctggaatccaaaggggaagtggagttttacgtgtgtaccctaaagaaaagcgtgaacatcaagaaaaacatggtgtctatatcaaaggagaagaagaaagagcaccagcgggttttcactccatcagtgattgaaccatcgtttgggattggtcggatcatatattgtctgtatgagcattgtttcagcacaaggccaagcaaagcaggggatgagcagttgaacttgttccgtttccctcctcttgtagctcccatcaagtgcacggttttcccgcttgttcagaaccaacaattcgaggaagtagccaaagttatttccaaggaactcgcctctgtcggtatctcccataagattgacatcactggtacgtaaaaacaagttgagaattgaagttttttgaaatattgaaatggatcaaatcaagtaaagatttgttgtgtttgtgtgtgaacaggtacatcgatagggaagagatatgcgagaaccgatgagcttggagtgccatttgcaataacagtggactcggatacatcagtgacaatcagagaaagagacagcaaagatcaagtccgagtcaccttgaaggaggcagcttccgttgtgagctcagtctcagaggggaaaatgacgtggcaagacgtctgggcaaccttccctcaccattcttctgctgctgcagacgagtagctagctccttgtttttttccgaattaaaaaccaaagtgttaaattaattgttgctgaatctactcatttttaatgttttgtttcttagtgtcacgtaaaaagttcgataccagatttggagacgaagtggctataaagtataaactctctgttatattttcgtccattctactgctaattttctaaattttggtcacaaatttcagtccatccagttatggtctgaattgtttgtgtttgcattaagaaaaaaaagtatgaaggatcattgtttttacagtttgctaaggattacaaagttacaagttagagaagcaaagagttgacgcatccttgggcagttggtagcgccatcgtgcatatatactgactattttaggttttagtttagatgcagagatggactaaaccagaggaaagcacattcaaaagtttttgatatcgaataatgggttagttaaatccaagttttatgataatgcagccatgcaggcggatagaaatctcgatcttggaggacgtaacacaattaggcaagttatgaaggaaagtaagattatcaatatttatgattttatgattgttatttatataattaaatacaaataattaatacaatagactataggcaagatatatttaaaaaaatatttaattgaaattacaattaaaatgtttaagaacgaatagagattttatatttttttttaaaaactcatcgcttgagcaccaagtttcgcattgtaataaaaatcctaaagtaacaaaaccctgctgaagtttcccatattaaaaccctagctagaccaaaattgtgagcggacaagttcacacttttcttgacgattccaaaccactttggctccgattcagatcccgatg

SEQ ID NO: 31717 - DNA, 3003 bp, Unknown
  misc_feature (1)..( 3003): 2750-1469P.txt file - cDNA_ID_3045249; gDNA_ID_1971772; Annot_ID_175395
agctaaggatgatgcatttcttagggtgtgttctcgggtgggcaagaaatcgcggtgaaaagattatcgtgtacttcaggacaaggagacagtgaattcaagaacgaaattttacttcttgcaaagctttcaacataggaacttggttaggctattaggttttttgcatagaaggacaagaacgaatccttgtctatgagttcatcaagaacgctagtcttgacaatttcatcttcggtaaattgttttccgccgttttctccatatgatgatcctaccgttctgttttttctgctctgtgttgatctttacgctgttacagatcttaaaaagcgtcaacttttggattggggagtgcgatacaaaatgataggtggagttgctagaggacttctttatcttcatgaagactctcgttaccggataattcaccgtgatcttaaagctagcaacattcttttggaccaagaaatgaatccgaaaatcgcagattttggattagctaaactctatgacacagaccaaacttcgacacatcgatttacaaagcaaaattgcaggaacttagtaagttacttcatcttactaactcattaaccaagaaacaccggtataaacccgttattcatcttgtagcgggtatatggctccagaatacgctatttacggtcaattctcggtgaaaacagacgttttcagcttcggtgtattagtcatagagatcattacgaaaacaataatggtcgatcaaatgatgacgaagaggcagaaaatctccttagttgggtaagtacacaaaaccaaccaggtaattgaggtttgagtttgattcatcatgttaactgaatttgtaattctgtttgtttctcaggtgtggagatgttggagagaagacattatactaagcgttattgatccgagtctaaccacgggatcaagaagcgagatcttgagatgcatacacattggtcttttatgtgttcaagaaagtccagcgagtagaccaactatggattcggttgctctaatgctcaatagctattcctatactctcccaacgccttcaaggcccgcctttgcgttagagagtgtcatgccttcgatgaatgtttcttcttccacaagaaccgttattaatgtccttgaatgatgtcactgtttctgagttatctcctcgttaggaagcttaatctgcatatctttttagtttctttcaatgatggattttgtttgtgtgattttttagacagcttggcttcatctagcttttgaaacgagtagaagttatagctttttcttttagttctacacattcgtcgttaatggtagatttgttttgcaaattcgattttactgtgttttaaaacatataacatgaaatttaacttaagaaaatgaaaatagtattagacttttactaagaaaagctttctactttatcctacacatgaaatgcatacacattggtcttttcaaaagcaacaaatcaatgttaaatacagttttctttatcttaactcctaataatgtagctatagaattcatgactaagcattgtggacccttggagcatttttagatggagatgggtgtttgtttctttattaggttttgttgcctagtagccacattctctcagttaaactaatacatttgtaaattttcacttgtaatcaactaatccaccaaatgaatcaataatgtaaactccagaatcgatctggcattgtatgagtatcaatatatgctttagtgccacttgctagtgcaatccacttgaggtttggctgcatcgatattagatataaatacttaagcgttcatgcaaaaaaaagattactaaataattgtagggttattatgggattttaggcgagcaaacaacatttaaactttgaaggaatacaatttgaaatatcaagatacgtaaaatatgtcacgtgcaataaaataaagagaagacccatccaaatcaagtgtgcgatactttgaccatatgagtcaatgtggcgagctcaaaggcaacaagcatatctaatctaagtattatataactaagcaaatattccactaaactagtatacaaagccaactgctccactaattgcctgacatacttatttatttttcaaatttggtaaccacaccatatagcttatacattttcttcgatggccttatacaataggaatatactattaccttctcattgttcttattatcatcaaccatttgataaatcctcatcactcttaaacattgactatgaatctaaggacgtcagaagtagtccatacaagatatgaatggttggatcgtcctaagtcattgtattaatatacgtttctaatcaatggaaactatataattgtaatataatttttactaaatcatgtaacttgaaaacctaactttctttcttaataaaaattgaaccgctaaagtatctaatccatcatgtgtcaactgacaccgtccaaaatcctcttagagatgtaagaaaaagtttcaaaacaattaggtcagccaccaatcacatatttctatgcagagttgtataatcttgaaaaagaacaaaaaaagtagatgacaaaaaagaattaaaagacaataataataataccttaaagatgataataaattcaaacagtttgacctttttatttcaattctctggtccaactttccaacctgacgagacaaaaatatagaaacttctcaacagcaataaaacagcaacctttcctttttgtatcccttctcctttgtcacctctcctcttacttttttatcaataggaagtttccgccattgtgacagacacagttcctctgtttctcttctttcatctttaagcaaacctcaaaaaccaatcctttattacgaagatcctcacttgtgtcttcttctccaacactaaaccccaagaaaatgagattcttccgcaaaacctcactttatctttctctcttcttatacttctttctttatgaatcttccatg

SEQ ID NO: 31718 - DNA, 3000 bp, Unknown; identical to SEQ ID NO: 8355
  misc_feature (1)..( 3000): 2750-1469P.txt file - cDNA_ID_3045269; gDNA_ID_1971772; Annot_ID_175388

SEQ ID NO: 31719 - DNA, 3000 bp, Unknown
  misc_feature (1)..( 3000): 2750-1469P.txt file - cDNA_ID_3045272; gDNA_ID_1971772; Annot_ID_175387
aacattgaatctgctgttcttcaatgggatgattcccgattttcctttttaaatatccttattttttacattcaagccacacaaaagtatgatcattaacaaggtgaatatgtatcgtaagtcttaattagtctattgtggtctgactaggaaaatataaaccttttgttaagtcctacaataaaacgtattcaacaattccaaatattatccatgactgaaatacataaagaaaaggtttaaattttatctagaaaccaggaaaaaagacaacagtaaacaaacaattaaaaaagaaaagactttgaaagaaaatccaaaagttgtagaagaaaagacttaaataaacacaaagagaatccaatacgctgtcgtttttgagcaaagtctctatcgacttttttccttccgttaatcaagccatcggatattaaataattacaaaattattttcagacaaaacacggacgcgaaatcaaccaattaaatccacttctctctcaccatctcacgtccgatctctcctctctgagctctcatcacgagtcaacccctttctccgtcgaaattcgcatgcttaaactctgagagaagaagatgactatgacggaggagaaaccaacttccgacggcaaaggaggttggggtttcttcaagattccatttcgtaactcaagcggtcacagaaacgccgcttcaagtgctgctacttctccgtttccatctggagcttcttcttcttctacttcttctcatctacataaccatcatcaacatcatcatcaacatcaccatcagcaccatcatcagcttggttataacggtcctcacggtgatggatcgggtcaaaatcaacatccgactccttctccttcagtttcatctgttgctaagtcttttcttcctactaaacgaagattgaagcttgatccttctgagaaactctattttccttgtgagcttttttcgaatctcattttgatcggagtagtttctctggaattacagtctttttttcattgtctagggtttgtttctgaagatttgagatccattgacactagtctaaaatttctatcttttagtagaatttgagtatttgactgatctgattatgtggattgatacataagtttgataattgactcaataggaaacataaagtttgaaactttttggaagttaagagcagaatcttgacattggattataattctaacttaccattactctaaatatggtcttcctttaagcattctgaaattaggagtcttttatagatacgaatgattttagctatcaaatgattttgcaggaaggttttggtgtatacttaggccatgtttttttttttcttcatgatttgattttggaagtttagattgttttctgttacaagtaatgctgtggagtactgaattagattattactttgattttgaagatgagcctgggaagcaagttaggagtgctattaagattaaaaatacaagcaaatcacatgtagccttcaaggtttgttttttgatctaaagcgttttggttattgggtctttggcattattgtatatgagcttactcgttgctctttcagtttcaaacaactgcgccgaagagttgctttatgcgtccacctggtgctattcttgctcctggagagactattattgctactggtatttgttttttttgttttctcgcctctgttcttattcttcttgatgaggctatcagaacaatggcttattcaatgtttctctgattgaaatgtgcagtgtttaaatttgttgagcctcctgagaataatgagaagccaatggatcaaaggagcagagtgaagtttaaaatcatgagcctgaaggtgaaaggtccaatggactatgtgcctgagctggtatgttgatcttctgatcttatctattagctgatctttgaacatgaaaacagtagtaacatatccgaatccagatagaacataagatattgacccatctctaaaacataagatatcaatgactagactaagaattgtgttttggtctgagtagaggtttccagttaccttttaaggcacaaacatataaccaagcattccactgaatgctgtttccatctaaagacatatcgattgcttttgtttttgtttttttctcagttcgatgagcaaaaggatgatgtctctaaggagcaaatattgcgtgtgattttcttggatcctgagcgctccaaccctgtgagtatccgaataattttgcttatgatgacgattctattattttacgacctccctctttaataatctatgtgataaatgacataggcattggaaaaactgaagcgtcaaattagcagaagcggatgcagcggtggaggcacgaaagaaacctccagaggaaacaggtccaaagatgattggagaagggcttgtgatcgatgaatgggtcagtctcatttgctatccagtgtctcttccattagatgattgtgaaaatctgacattgtttttgtcttacctctaataaaaaacacagaaggagcgtagagagagatatcttgcacagcaacaaggcgaaggagctgactctgtctgagagactaaaagagttttctcaggacaaaaacaagtgcgcttgtgaagatgaagaagaagggaccgctatattgaattttatatgctaacttctagatttcatgatgcaatatataaggatcatgctggtaaaaaaaaaagacaatgaaggaaacttttttcatgtaaaaaagaaatgtaaacttgggtttgatgataatgaattgttcatgttaaggactaataaaaacagagaagaaagtgtactaaaatcgaaatttgagctctccaattactaaatcggtgctaaatgaaccggtcggtcgtttctatatttgattcgttcggtttatcctttaaccggtcgaaccgaagcttcttttgttcgtatgaagaaaactaaaatccaaatctctctctggtacaccatg

SEQ ID NO: 31720 - DNA, 3000 bp, Unknown; identical to SEQ ID NO: 8352
  misc_feature (1)..( 3000): 2750-1469P.txt file - cDNA_ID_3045275; gDNA_ID_1971772; Annot_ID_175386

SEQ ID NO: 31721 - DNA, 3003 bp, Unknown
  misc_feature (1)..( 3003): 2750-1469P.txt file - cDNA_ID_3045279; gDNA_ID_1971772; Annot_ID_175385
cggttggcttgcaggaggttgaagatgcacagagaattcgtagtactgtcattgattcatttgagaaggcaagtttacctggactaaacgaacaagagagaaagagaatgctacattttgtagttgttggtggtggaccaacaggtgttgagtttgcttctgagcttcatgattttgttaacgaggatctagtcaaactatatcctaaagccaaaaacttagtgcagatcactcttctagaggctgcagaccacatcttgaccatgtgagattttcttactcttaaacttttgatctatatcgaagattagctcatgtcctatggtttgacaggtttgacaagagaatcacagagtttgctgaagaaaaatttactagagatggtattgatgtgaaattaggttctatggtggtcaaagtgaatgataaggaaatttctgcaaaaaccaaagcaggagaggtctcaactattccttatggaatgattgtttggtcaactggtattgggactcgtcctgtgatcaaagattttatgaaacaaattggtcaggtgagtagccaaaggtctaatgataatgctcatattttttcatagtgaacgagctttatcaactcggtctataagatgatttcttgtaaattccagggcaatagacgtgctttagcaaccgatgaatggcttcgtgttgaaggatgtgataatatatatgcacttggtgattgtgcaacaatcaaccagagaaaagtcatggtaaccaaattcagaacctagataaaaatgagctcgcttgtgtatagggtttctctgtttcttatactttggattgttatggcttttgtacaggaagacatagctgctatattcaagaaagcagataaggaaaaggaacactgacaatgaaagaatttcatgaagtaatgagtgacatatgtgatagataccctcaagtggagctctacttgaagagtaaaggtatgcatggcattaccgatcttctaaaacaagcacaagctgagaatggttccaacaagtctgtcgaactcgatatagaagaacttaaatcagctcttttgtcaagttgactcacaagtgaagctttctaccagcgacaggacaggtttgttctgtttttacttacttgaaagttttatcttcggtcacaaggtcacacactcacactcacacactttgtttgctttctcatcctttgtctggtggctttataaaggtcgctgctcaacaagggacttaccttgcaaaatgctttgatcgtatggaagtatgcgagaagaatcctgaaggtcccattaggattagaggagaaggtcgtcaccgcttccgtcccttcaggttggttcctagtatctgcatcttaggaggctttagtcacttttgagattgcatgttttgtgaatttctcaatactgattatatactttatagtaaggagacatgagacaatgaatatatatgttatacaggtatagacatttgggacaatttgctccattaggaggcgaacaaaccgcggcgcaacttccaggagactgggtttcgataggacacagcagtcaatggctgtggtactccgtttacgctaggtaacgttaaatgactaatgaaatacgaaatgtattcatatgatttttgtatttttttgtaactttttggttacaagtttttgtttttaataatacagtaagcaagtgagctggcgaacgagagtcctggtggtctcagactggatgagacgattcatcttcgggagggattcaagtcgcatttgaaaatctcatgtctctcttactctctcgtttgaattatcatggatagtcttattgctttttgttttttactttcaaataaaagcataacaacgggaagatgttaaacttcatttggttacttctgtttttggaattggtacgtgaaattgatatatttatattgctggagattggagtataatttcacaaagaatataatctactgcttttcttatagaataacgtttaacattacaagatatgtcgcctagctagtcagaaaaaaataaaaataatacaatgttagaacttttgttgtccttagattttgacaattaattccctttacatgatacagtatcaattatgggagaaagaaataggagaatcttctggcaacacgtaatacttaaattgttcatctttctattagtaaaactaaaaacaaaacctaacctaccaaaccactactctccttgacctcgactaaaatcgcaaacttacctataacttcttttctaggtaaaaggcaaccaaaaatattaattcaaatcaaccaccatacactcccgattcatatcgttaaattttttacacgttagcctgctagctaggatactaaaaataataagattactttatactaaggataaaaatgatctactattttttagagtgaatctaccaattaaaaagttttcaaaaataatgtatattgacttatgtgcctggattatttacccatttttgggtgggaatctaaagattttatttccaatttttctcaaatctctatgtattattttttaccacaaaaatgaattatcattttaagagaaaaaaagaagagaaacaacaattgacttcaaacattgttgtatataacatattccttcggttacatttcaagtgttgtttaagtgtcttacacatatataaagaaacaaacatagattgcgtaattttttttgtctttttttccattaaaacattcattcattatttagaaaaatatattcaaccaataacaaaacagtctgtctaatactaacagtcaacaaaaatatataaagtaataaaaattttaataggatagtttccctaaaacaacattaaaaaaatttaacaaaatggagtaacaacagttcatcaacttctcctctttttgtttatataaacacacattaacgattcataagccattgtctactaacaaaacagaaaaagactaaaatg

SEQ ID NO: 31722 - DNA, 3003 bp, Unknown
  misc_feature (1)..( 3003): 2750-1469P.txt file - cDNA_ID_3045289; gDNA_ID_1971772; Annot_ID_175382
gcaaatttgccccatcaggccacaagatggaggggattctaatggctatggagtgccagtccctgaagaaggttagcttttccatctagcatttgtatgttgtggcaaatgctgtaaaatatgtgtgaagtaattttgtgattcatggtgtgtttattggaattgtagattcgtatggtgcgagtcttctagtgaatgagggtgaatctgtctatgatttctgttggtatccatacatgtcagtttcaggtaatagataagctcatcataaggggttcaattttttggcttaatgatttcatcagttgaattactgattttggctgttcactgattgatatcagaccctttaacatgcgtcttcgctacctccactagagaccatccgatacatctttgggatagtacttctggtgaggtgctgattttttccatgaaacttaacatgtttactggagattttttctaccatccttttttgtttatttacatgtgaataacacaatgtcagcttcgatgcacataccggctctatgatgctatggatgaaataactgctgcattttcagttggattcaatcctgatggaaccaagtaagcaaaaacttcatctaagttgtatccatcttcccacacggtaaagaattgattaaaagtggtctatgttcatttgcctgtgttatgtctttaggatctttgctggttacaacagctccatcagagtgtttgatcttcatcgtcctgagaagagattttagagcagtattcaactctacagaaaaacaaagagggccaagcaggtttttttctttcttttccactcagacgctgcataacaatattattacagattatacagaaacaagaacaaccttaactggttcataatttccaggtatattatctactcttgctttctccccaactaattctggaatgttggctgtggggtcttacgggcaaactactgggatttatagagaagacaacatggagctattgtattgttttacatggtcaagaaggcggtgttacacatgtaagcattgaccactaaatgtgccttaatttttgtccattgggatatgatcaattattgatcgaatttttggtgcttttaggtccagttttcaaaggatgggaactatttatatacaggaggtcgcaagagtaacatactgttataaacattttaccctctgaatgttgagcatattatatcgcaacttgacttccattttaaggataaccctttttggaggaaagtatcgtctgtccagagatattctcgttggtgtccaatattagagtatgatatgtaataggatgatgaattgtcctaacctcaccaaaaaaatgtttctttttttgtttgctctttttcaggatccttacattctttgctgggatattcggaaatctgttgaaatagtctataagtgagtatttacttctttattttggtttgggtagtctttggtttctaagctcatacttgttttacaatataatctagaagcaagaacaagtgctgtaaacaagattaatgcttaatgagccatgagcagcttaagattaacgttacatcaatgttcaagttaatagaagtcttagcttgagaaatggtagatgttgaagctcttataatgttgacatgtgtttgaaatggatcatttatatgtgtgatcagattgtacagagcaactgagaacacaaacagcgtgtattctttgatattgagccatgtggtcgacatttaggtaccggtggtcaggtacttttgatcttcctatcctttctaatgcctgagcttttgtttttcattaactataaaactgcaagcaatcttttttcctctgttaacactcttatggttagatcatgtaaccattttctcattcctctttgtcttgtattccaggatgggcttgttcacatgtacgatttacaaaccggaaacttgggtttctggatatcaagctgctttcaggtagctaatcacttagttcttcagtagcttctgcaattgttgatgagatcctgactttggcatattactccattcgattaatgcagataccgtcaatgctttcttctttccacccttaccttccaatggctgctacatcctctggtcacagacgtttcgcaattccagatgatgacgatggtgaagataagaacgagcttcaattgaaaggtacattacactaaaacgctaattagttcctctcccatcaatgttaaagaacacaatctaatcgttcctttctctttttgctcacacagctgatgagaactgtgtatctctctggagtttctacgtagaggacaatacttatgatgaaaacaatggcgttgcaagcgagtctcatctccaaaatgtcaccgaagaaatagttttaacataaattttaatttttaaaagctacgttagaaaaaaagaatcgaaacaatattattttattagtcttatccaaagcatattcttaacaaaaacaaaaaacaaaaaaaaaacaaattcccatacttatctccagatgtttcagaatccgatgagctcaagtgggactcttctattttaaaaaccacaacccttcctctgctcattaaattcacaccgttcaagctacctaagcatacacgtcacaacaatcaatggacaaaacactcattatgaacccgcacactcatgatatttcctcccgaataaagtgggtttatcttgtactaactgactgataccgaagaagcttaactcaacttggactgatcgaaacacaaaacgccaatgacggctgatccaataacaaatcaccacgtgtcgaatcggagcttatattcttcagcaaatctctctctctctttttctctactttgctctgtttttggcgttctaaatgatccattatctccatttcatcggtgaattttgttttctccagtgctgttaaagtagttgagtggttctcggagaatctgtttctcaaaagaagcacaatg

SEQ ID NO: 31723 - DNA, 3000 bp, Unknown; identical to SEQ ID NO: 8351
  misc_feature (1)..( 3000): 2750-1469P.txt file - cDNA_ID_3045295; gDNA_ID_1971772; Annot_ID_175380

SEQ ID NO: 31724 - DNA, 3003 bp, Unknown
  misc_feature (1)..( 3003): 2750-1469P.txt file - cDNA_ID_3045299; gDNA_ID_1971781; Annot_ID_175416
atagacgtaaggtggagacttgtagacgtatggagacggtggtggactgtaggcatatggtggtggtgaactatagacgtaaggtggagacttgtagacgtatggagacggtggtggactgtaggcgtatggtggtggtgaactatatacgtaaggtggagacttgtagacatatggagatggtggtggactataggtatatggtggtggagaactatagacgtatggtggtggtgatggtggagagtatgggtattgagcacttgtatgcgcagcaacggcatacaaggccaatatcaccataagaagagatggccaattactcggattagccatgtcgattgaatgtgtttgctcttgtttctagactcaggttttgttagtatgtttcttactttaaacccgatttatttttgaatggattgtaatagaaagtaaacagtttatatagcttacattaggccaactagaatacttgtttattgaactttaaggaagcgtcttagagcaatatcttatattgtttaataagtcaacttaactagtttctgattttgtctataaatctgaagaaaaagtcgagaagaatatgtctttggtaactacctctaaccatactttaaatttaaatgtgtcaacttttgaagttgtcaatttaaattcaagacatttaagagtgtttctttctgaattatctatcaccgaatttgtacactagttctatattacatcttgtaattttaaatactaatgttatcgtacatgactcataattttgagtttttcttttgagttaatttttccaaatggtgataactttgacattttatttcgtaatgtgtataatacaactaccgattttcattttttttaaaaagaatattacttacactaaccatttgatttggtttagtcataatctcttcatatttcagccatctggtcgtcgtccgttatatggaccttttcttattctatcgttttaacattgtaattaccgattatcttttttgttgaataaattttaaatgcttaggacaaaactaatattacatgttgtggtttcggacctggagagattacaggcttcggcccaaaacttccttgtattaaaaaaaaaaaaagaataaattttaaattctaaataaaaaagatatttactaaggatttttgtgaaagcaatactaattgcattaacattcatacatgatttgtataattgtttggagttgggtaagatgctcgacttccacattagggaacaaacaaagctagattaatgcacgtctagtgaaagatccatccctttgattacttaacttcacattagggaaaaaacaaagctaggttcatgcacttctagtgaatgatccatccctttgattacttaacttcacatttagggaacaaacaaagctagattcatgcacttctaggtgaaggatatcaggatatgccacatttctatcaaagaatacggttaagaaagtctataggaggacaaaaatagatatgttttcccaaaaaagattcaaagctcaagttaaatggaacaatgagttagcaaaaaatggtttaacgggaggagaaatagtggtagtgtcaaccaagtcgccttggtccagtagtaaagagaggtaattcctgtcacatgggttcgagtagctttggccactgggattcgagtaatttaacatgggttttttcgggttccagaattagtctttggacctagaaaccctttaagatcacctgaattatcaaaaaatatatatatagtagtagtgttgtgtcctatgttgaaaagtaatatggatcagctttggaattctccaggaagcaatgggatcatgtgggatcaaaaagaataataaagagaccacgattgggcaattactaggcacttatgtcattgaggtgattagtggatcataagattatgcctactgttatcctcaatttgaccgtatactattttcttctcttttagccatccttgaatacctaaccgaggttcaagaatcagtttatgctttcatgttgggttgacctttgttaaataggttatctagtcatgaagagcgaatcaagccaaactcttttttttttttctctttaattaaaataggattgtctctaaaataaaattttacctaatccccgattttgtaattttacttttcatctcaaagaaatacaaattaatattacaaaataaaaaaaaatatgaaatataacccgtcaccattaccatcaagttttcaaagttttaacgaataatatatcaaatcaaaactttcgtgatgcagaattcaatctttagaattttaaacatctaatacatatgatcgtaataaattttagaatatacatataaaaatgcatattattttttacataataatatcgatttccgttgtttactatacacgtagcaagacctaaacagttttaatctgatatagcggaaactaattttggcaccttagacaattgattggtcaattcaaccctcaataagcccaagtggaaagacaaagaaatttagggtattttgtcgaatgagacataatcaacttgactgctccaataaactgttttcactagatgatggatagtagttctgttctaaacatggttaatagagatccaaaacccaatttctctatggactttattggtgcaactctttaagtgaaattgaaaccttacttcaacacatttcaaatgtatctacctaattaactctttatataaaattaaaaaaaaccttagtgcataagtgggtaggtgaacttgagtctcttggcaatatgtaaagaggcgaaatcaaagttgatcaacaattaaacacaaaaacccttaagttgacgtggctgtatctcttccaactcttaaaaatcaattactattatacccctcagaaaaatggcagagcgtgtgtctctcacactcaacggaaccctcctttctcctcctcccacaacaacaacaacaacaatg

SEQ ID NO: 31725 - DNA, 3000 bp, Unknown; identical to SEQ ID NO: 8371
  misc_feature (1)..( 3000): 2750-1469P.txt file - cDNA_ID_3045316; gDNA_ID_1971785; Annot_ID_175451

SEQ ID NO: 31726 - DNA, 3000 bp, Unknown
  misc_feature (1)..( 3000): 2750-1469P.txt file - cDNA_ID_3045327; gDNA_ID_1971785; Annot_ID_175453
ttacttttccttgtgttaaagctgacctttctgttttcataaattaattgtaggtgaatgattttgtgtatgttttagcggagcaacataagagacttgttgcatatatagaagacctttatgaggattctaaaggcaagaagatggttgtggtacgatggtttcacaaaactgaggaggttggttctgttttatctgatgatgataatgacagagagatatttttttctcttaatcggcaagatatcagtattgagtgcatagattacttggctactgtccttagtcctcagcattatgagaaatttcttaaggtgccgatgcatgttcagacagtagctttcttctgccagaaattatatggagatgatggtttaaagccgtatgacattacacaactagaaggttactggagacaagaaatgcttagatacttgaatgtatctattttaaaatcatttgaaggtgctcaagcccctggtactgacccaggattaaaagctccattggttggttgtgttgggattagatcaaggaaaagacgccgtcctagtcctgttggtactttgaatgtatcatacgcaggtgacatgaaaggtgactgcaaatctagtccagattctgttttggctgttacagatgcttctatattcaagggtgacgaagatggttcttcccatcacattaaaaagggttcacttattgaagttctttctgaagatagtggcatcagaggttgttggtttaaggctctggtattaaagaaacacaaagataaggttaaggtccagtaccaagatattcaggatgcagacgatgaatctaaaaagctagaggtacacattttaaaacccttgctttggtttcgtacctactgcccagtttgataacatgtttttgttgcaggaatggattttgacatctcgggttgctgctggtgatcatctgggggatcttagaatcaaaggacggaaagtagtaagaccaatgctgaagcccagcaaagaaaatgatgtatgtgtcatcggggttggtatgcctgtggatgtgtggtggtgtgatggatggtgggaagggatcgtggtgcaggaagtttctgaagagaaatttgaagtttacttgccaggtgagttaagacacctctgaatgcaaatttttattgcagttgaagatctatctatatactattttgtgtgactaattattgttgttttggctgttttctctcaggcgaaaagaaaatgtctgctttccatcgtaatgacctcagacaatctcgggaatggttggatgatgagtggctaaacataagatcaagatctgatattgtgagttctgtcctatctttgacgaagaaaaaagagatggaggtgaaacatgatgagaagtcgtctgatgttggtgtttgtaatggtaggatgtcaccaaagactgaggctaaacgcaccatctctcttccagtagctacaaccaaaaagtcactacctaagcgaccaattccagatcttctaaaagatgtcctagtcacttctgacttaaagtggaaaaaatcatcgaggaagcggaatcgagttgtcagttgctgtccacacgatcctagcttgaatgatggtttctctagtgaaagatctttggattgtgagaactgtaagttcatggaagatacttttggctcttcagatggacagcatttgacaggtctattaatgtcgagatgatcatcagcttggacctagttacttttcttcttgtgaggtacatattaccctgatgggcatctgctcaatgcgattttgggttttaagattactggtaactcgcaagctttcttgggatggattataggattagctcgtaatggcatccaaattcgtttgtgtacttatgttgtgacagtagggcatagtgctttaattcaatcagcaaaattttggatgcagtagaagtaggtaataataacattacctcgctagtgttttaggcttaatcagtgtttttctcttagaattaagttatcattttactctctttagcatagagatgattcgttttctttttggtctggtgggatctttcttttcatgtaacctatgtaacattaaataaaattatcttgttaccttgatctcaacttcattgtctatatgatacgtacctttcttacttgttgaatgttatgaatagcttctgcataatttgatactcgaagttgaggacacttgattatcttaatggcacgtaagttaagtatgtccatgtccatgtgcccatagggttttgttttgtgcagcattccaaaggggaccaacaaataaaattgatgctctttggttgttagttgtaactagctggtaacaattgatgttttctggaatcgtccaacaagttttgttatccatagtaagagcgcttgttataaaccactaacagtgatgaaagttgagtgtcttatcttacaccattttaaacttttacctattatcatctcttgttgtgctatagatgattggcttaccaaaaggtagggtaaggtgaaaaaggtaagctatttaaattcgtttaagaccaagtcagaatcctccaacttgaatgattttggtggggttgcattttggtgagtgaagcatctttttcaaacaatgtagaggaaataaagaggagccaaaagaacttgactttcttactcagattaatggacactaagtcatggatccaaagcatatattatatctctattgtgtgttaacatgtctcttgagtctctaaacttagttttctccaaagattaaagcaaaagcaaagatgggcttcctctgtcactagttttgctaactcatccttttcggatagcgacactcttcgtttcccactcttggtttggtggtttctttaggattctagatttttgttttacttatctttccttgtacaagagactgtttctataggattcttcatttcctgttttatctatcttctctgtgcaacgagagtgtcatg

SEQ ID NO: 31727 - DNA, 3000 bp, Unknown; identical to SEQ ID NO: 8369
  misc_feature (1)..( 3000): 2750-1469P.txt file - cDNA_ID_3045332; gDNA_ID_1971785; Annot_ID_57985

SEQ ID NO: 31728 - DNA, 3000 bp, Unknown; identical to SEQ ID NO: 8376
  misc_feature (1)..( 3000): 2750-1469P.txt file - cDNA_ID_3045332; gDNA_ID_1971785; Annot_ID_175442

SEQ ID NO: 31729 - DNA, 3000 bp, Unknown
  misc_feature (1)..( 3000): 2750-1469P.txt file - cDNA_ID_3045336; gDNA_ID_1971785; Annot_ID_175440
cagaccacaagtgtttgtggtggtcctgtctttgaagagtttattcctatcaagaaaattagttccttgtgtgaagaagtacaagaagaagaagaagaagatggtgaacatgaatcttctccagaacttgtgaataataagaaatcagattggcttagatctgttcagctatggaatcattcaccggatctaaatccaaaagaggtatttaaagttttgagctttttaaaggagttttagttttcgattatgaggaaataatcatgtgttaattgaattataggagcgtgtagctaagaaagcgaaagtggtggaggtgaaaccaaaaagcggtgcgtttcagccgtttcaaaagcgcgttttggagactgatttgcaaccggcggtgaaagtagctagttcgatgccagcgacgacgacgagttctacgacggaaacttgtggtggtaaaagtgatttgattaaagctggagatgaggaaagacggatagagcagcagcaatcgcagtcgcatacgcatagaaaacaaaggcggtgctggtcgccggaattacaccgtcgattcctaaacgcgcttcagcagcttggaggatctcatggtaattacgattaattttaattacctgattatcttctatctgattggttcattagtgattcataatcgggttgataaagaactgtttttaaacattaaaacgtctcaacatttacattatattagtaagtaacaaagattattatcaacattaaaaaatgatttttatttgacattttatttgccaatcttgcagttgctacaccaaagcaaatcagggatcacatgaaggttgatggattaacaaacgacgaagttaaaagccatttacaggttagtgattaatgattcttatgttataatcacaagttcgtgaaattggtaattaaatgaaatgttactcaagttcttaaccattttttgtgtaatatttcagaaatatagacttcacacaagaaggccagcagcaacatccgtggcggcacaaagtaccgggaatcagcaacaaccacaatttgtggtggttggaggcatatgggtaccatcgtcacaagattttccaccaccgtccgatgtagccaacaagggtggtgtatatgctccggttgcggtggcgcaatctccaaaacgttcgttggagagaagttgcaactcgccggcggcatcttcctctacaaatacaaatacttctactcctgtgtcataatctgatagtcatactataatcatctcctgatgttgattttggtgtaggtttgaaaatgtttatgtgaatgtaagaaatattttcgtccgtttttgtttgtaaccaagaaatgttatttcctcggttggaaattttgaataaagtagacgaatgctactatgtagtatatacacgagataagtgaagactctttgtttttctaactttggatatttactaaaatatcttcttgtttttggtgtctaatttagacagatcttcgtgatgaatctgatggcaaaggttataattcatcaccttcgtaaatagtaaaatacaaaggtagataagagaatctaagatgaattgagaataacgtgcgtgaatggtgatgtagatatttggtgtgacaattagaagtgatttatttatggtaacgcttgcttaaaacaaaggtccatgaatcgaccaactaaccattcacagaattgaataccaaatctatctttttgcatggcaatttattaaaataaatctaacgtggccgcctctgaatcttgcttaatagaatagtaaccactaaccataatcaaatcattaatttagattttttattttttgtcggccaatttagattatagtatctttttttttttccttcacatatcttacggtaattgactcgaaccggaatttctttagaaaattcaaaaccagtttaataatcgggttcatggagaataaaaaggtcatgttctgatttttataataagtccttgttgactaagtccttgttgaataagtcttcctagattataggaaagtggacgattaaatttgtattatgttttgattttatatgttatagaatttcaggtcgataaaaattgtgacatttgcattgtgtctagggtctttcgggttttttttttttttttttttaacttgatttgtagggaggataatcttgggtctatacaagcaagacgaattcttacgtaattttgtttctttgttttgaataaaactggataaatcgtgactaggggctggagatcaataaatcgtgacttccctccaactgatacggattctacaactatttgaattttataaggaatttcaataacttgttcactttttaaatatacaatagttttgtacaactagtaaaaaatattcatatttccattataatcatttatcattccattctgcttttttttttgggttctcaattctgccattccaccatgtttcttatcggaatctaaataattaatgcattaagtagttgaagatgataaatttatttgtttccaaccattttgatggttaacttaaaaaacataaaattttaggtttggtggaaaaaagaaagggacacttggccttacgacaaagcgaagggtcacatgttaatacaacaatttcaggatattcgaatctctaatattggaatccctaatacatggctcactctctttgattcaaacataaactgcactcgtttatttaatctttgtttgacagctaaaaagatttttattttcgggttgataaacctataactcctccaacggacaaaatttactagatagatctataacttttcgtgggctatatataacttctcgtgggcttcgaggcccaaaaatgtttaaaagtgttgaaaaccaagacaaaaaaaaatggagtgaaaaagatgaaatccctaaattgaatcgcaaatcgcaatttgaaaaaaaaaagatctctctctgaagaatccgtcatg

SEQ ID NO: 31730 - DNA, 3003 bp, Unknown
  misc_feature (1)..( 3003): 2750-1469P.txt file - cDNA_ID_3045343; gDNA_ID_1971785; Annot_ID_175436
ttatcttaggattttttagaagcttctctctcttttttttttcttttacgccggataccgacgaggcgacgaccaccaaagatatatgaagatattaaaatgttggagaaggtttatggaattaacgaattttaaaaacattttaatcaacaaatccacaaagagtttaaaaggcgaagaattatatggtataattagtgaaggtactttggctttgcatgggaatatatggggattattctaaggcatgtgatgtgtaattcgattgacattctaacaactaagttttgaattcttcgccaaagtgttgtttccctaattacctttttttccatgtcttgacatttattgagagtgtgacatctcgatgatgccactgcacacataaattcgtaccatataacaaattttattatatagattaacatttttgtagattgaatttgtcaaggattaccacaatcaacgtggctaataactcgaacaaatataaaatatacgatatttgatcttagagtatgtatacctgattatatatatataagaaaagaaaacagaatagtgttttttgataagcaaaactgatattgttatgtatggataaagtgacatgtgcaatgtgttatgttgtcatggtagttataataaaagaataagaaattattgtttaaaaaaaattccaagtgtagatactatgagaaaaccccaaaatttttattaggtacatgaattagatataggtttaaaatctaatcactaaaactttttataacgactcccaaaattttggataagccatgcaattaaatttatcgaatagaattatctcatattggaaaaaaaatacgagtctgacgatcaaagatttagataagtcatgttataaaactttttttggttcttagacatcaagtattcacctctactcgtttttcttcttgtttaggcataaagagttcatcaaagttcactcaaattcacaacattcatgacaaaatacattgaataattttattctgatctttagcagctgttaagtatactaacacgttttacgaacttgtcattgttgtaccggactaagaaccaaaaaaaggagaaaccctacaaagaatgttcaatttatatgtgatgcccataagcagaagttgattaatagttagattctaaaacatctagcgacttaatagttaataattaacttaatgtagaacctatatgatgtttttaatttcctactagtttttatagatcgtacatatgaaatgggaccggtaatatgttaaccactcggtacttgtgaacggggaattatatttagttgaaacttgaaagcaaaattcatgcattaaatgatgttcaccaaactatacaaagccggtgccatgttttatgcattaaaagtaaaagttcctctaataaccataccaaaatcctagaggttataaagtaattcaccaaactccattaccactgagaacaataaaatgaactaaccaagtgagtcattaaccaacccaaactcaattttgtggttagcattagacaaaactataattaaaaaaatatataacaaaaaatatgtatatatttaaacatatttgaaattatgatttaattattttaagtgaaagtattttcgttttctttttttaaaacttacatttatattataaattttatcttattatttgaaaacttgtagatatattagaagttaaaagttttttttaattaaatacattaattagaagttagtttttttatagcctaaactcatttctgaaacctaattttaggggagtgtacattgttcatagccaagatttggcgtacggatactagacgtatacaaatcacgtttttaaaaacagagattatttcacctaatttctctaatccaaaatgtgaataataatgacactcttaaatctctaaaaatatatgtacactcaacgtataaacatataagtagtaaatcaatgtcaaataataagaaaatgaaaaaggtagagaaatcatgcataatttgattgattgatgcatcatctaatttatatgtggtttgacccgcatttggtgtcttggtcaccttctccgccatgacggcgcatctaatgttcctccaatcgattcttcttcctcctctgattctctcctctccaaaccaaaactctcacttttctttctgagattatctgacagtaaaaaatcatcctagattagaaactgtcagatcaatctcagtctttgtctctctctttttccacagtcctgtttttgtttctttcttcacacacagcttataattgatgatcatcaaaattcccaaaaacaaaaacttttttttttctttgtttgtttgggaaaagagtttcagcattttgatttgatgttataatatttcccagtgaaactatgacttgtccaaatcttggcactttctctctgtttttttcttcttcgtcttcgtcttcccaatttgtttggatgagatgagaatttttcgctataaaaaaaaacagagcatatcgaaaaatttatgagatctctctctctcactcaaaactctaaaaatctcaactttcttaaagatcataactttttatagatacccttcacctctcactcactcactccgatctctgatcttttcccgagaaaattcctcattttcccgagaaaactaaaaaaatttagataaccggaaaattgcaaacaacgaggtcggaaccgaccagtcacggtcttctctctgcttttctctgttcggttggtttcacggtactgtctttttttttttttttctcttttctttttctttttttccactttataaaaaacaatttttttttctttcttggtttcttcgttttaaattgttctcgcgggtatttaaaaaaagatttgtttttatataatttcaaggtttcttgaatatctgaagaatctgaaattgttttttttttgtttcagtaaaaaataaaactttgaggttcaatg

SEQ ID NO: 31731 - DNA, 3000 bp, Unknown; identical to SEQ ID NO: 21533
  misc_feature (1)..( 3000): 2750-1469P.txt file - cDNA_ID_3045357; gDNA_ID_1971786; Annot_ID_175497

SEQ ID NO: 31732 - DNA, 3000 bp, Unknown; identical to SEQ ID NO: 24401
  misc_feature (1)..( 3000): 2750-1469P.txt file - cDNA_ID_3045370; gDNA_ID_1971786; Annot_ID_175479

SEQ ID NO: 31733 - DNA, 3000 bp, Unknown
  misc_feature (1)..( 3000): 2750-1469P.txt file - cDNA_ID_3045374; gDNA_ID_1971786; Annot_ID_58004
tctcttgacaatgaggatcctcagacagtgttgaaatgcattataattgctgaaacccgcatatccagttcctctttggattctgctcacgctgctgcatttaatcgctttacagctccatgggttaactcaaaggtggttctcttaggagtttccttttttgagaaccagaagaggcatgtaaacaatccatctcgtctttttagttattcagattatctttatctttttgcctgttgagatttgtttctttggtttcaggtacaaccgagcagtttatctactgaggcgattgctcagctgttttaattgtgatgggagacgaggatactggacagtcaggttatcaacggatttggagcacatgggacgtccaaatgagagtcttacagttgcagagcagggactattggatccttgggtgcgtgctggttcaagggtagctttgcaaaggcggattcttcgtttggcaaaacctccaagacgctggaaaactcccactttttcaaatctcgtcgacaacaagatccccgaggttatacttctattcaaagtgaaaagataaaatataaagttgttcatcttcttactttgtcctcaaatgtgcaattttgcatttcaggttactattcaagggagatcactgaactgtgaagttggcataaaaaataggttttatggagaagatggagaacaatgtggagtggagcagctcgcattgcagtattacagtggagaaggaggaggatggcaaggaattcatacagagagtagtatctggttaacgattttcgggcttctcatgtgggatattctattttccgatgtccctggcgttttccaaacccgattccaggtgaatgaaactcaatagttgtctcatatgacgcaaatgaaaactctcattctgttttctgttccccttatgcagactgctccactggacttagagactgaatccttctatctaaccaggaaggaaacaatagaatctcagctcgaaaaagtcgcaaatggaatggctgaagaaatactaatcatatcatatgaaacacaacgtggaacagcgtgcagaggagtggcttgggagcggttttcgttagaggaactgagagcagcagtggcttgtgttggaggtatgtgtatagcatcgctgtgccggcatttagctcaagactataggagctggtgcagtggaatgcctgatctactggtatggcggttcaaggagaatggttatgaaggtgaagctaagcttgtggaagtgaaatcagagaaagataggttatcagaacagcaaagagcttggcttctacttctaatggattcaggctttaatgttgagatttgcaaagtaagacctgcttctttaattaaaacttaattatccaaattaaaaggagaacacacgatttgtcggatagttactttttttctttttttctttatgcaaaagtgatttgttttttatttgttgttgattattctcgagtagaaagtaacacgtgtagatagatatctgagaatgagaatagttgatgatgttaggttttgatgaagtagacgttgtggcttgtttgttgtaccataaaaagacgactaaattttgttcttccataaacttttcaaagagatttgtaaatttggacaatgtgtgtgggtggtcctcacatgttagtagattcttatgttatgctttagtttgcttttatttttgtgagactttttagcttcattttctctagaggaatatgccatttggggatgggatccagaatcaatttgaatttttaataattaatactagatgacattctagttattatagattatgtaatatgatttgacatgtaattatttatactgaatttatgtatactattatatatagtagatacatcctaataaaaattgcaatgtaatgataccagaaaagaaaatttgcaatgtaactttttcaacataatttttttctttctttcccataagtgttaccattttataaagaagtgttacaacccaatagaaatataaaagtatccctttttaatttaaaatttatccaaaaaaatgaatttttattaatataacaattcaattgtgtatgcatgataggattttcttaattttaatattatgaagtcatttcatctttattgaataatattatttttcacttagacttagtggtatgcataaaatcaaatttaatacagtctatagtaattaaaactatatatggagaagtttaataagatttcaaataccaaaaacaaatggcaatttctgagaaatgagtcacagatagcgacgacaagagccttgagaatgggaattggtgtggtggttttgctctcaatatagggatttgttcagcgcctttagccgagctgtggggggtctactatggtttgtacatggcctcagagcggcgggcttcaagagtggtgatcgaggtggattcagagctggttgtcgggttacttacgacggggattagtgaagctaatccgctgtccttcctggtgcgtttgtgccatggcttcatattaagggactggatagttcgtattgttcatgtttatagggaggctaatcgtcttgcggacggattggcgaactatgtcttttctttacctttaggttttcattcttttgagtgtgttcccgagcatgttcgggatatccttttagaagataccggtggaacatgttttccacgtcaggtgcgtttgtactatgctttaattttggtttaataaagtaggggagacaatcccaccaaaaaaaaaaaaaaaaagagccttgagttaaaaaaagaaaaaaaaaagtgaaaagtattaaagtgttaaactatctcattgtctgatgagagagacttcagttttcgttgactctttctgaaaaaatcttctttgtaccttattacaatattacttctcttcttcttcttgttcaccatctctcttatttcgcagatctaaagagaaaaaaaccatg

SEQ ID NO: 31734 - DNA, 3000 bp, Unknown
  misc_feature (1)..( 3000): 2750-1469P.txt file - cDNA_ID_3045374; gDNA_ID_1971786; Annot_ID_175478
gtccaggtgttcagtcgcacctcaagaaagagagaccttattaattctctttgttcttgttacaatgatggaacgaggtccgtttgttttactttatagttaagatttataaagcttctttcctttcgtagaagtttctgtttcactttgaggttgatttgttttgtttaaatttagaataaatctagcaacagtaattctagaaagaacaggactatgtgctaaggtatcaagtacagcagaatctctcatatggcgcgttgaggtgaagttttggtttttccacgtacttgggttttattttgggaagaattaacttttggttttatgttgcagaggcttttcttcctcaatggggagcaagatctatcgtcttttgttctgctggatcttggtattatcaaatacccaacttacaaatgcattgactcagagcaaatattctcgaatcggaccaagcttttagcatatgaagaggtgtttacttgtctatattgaaaaaaaggaaccgggttaatttttctacaatattataaagcttcaattacaggccattgaagtggctcagttgatggatgagtctcttgacaatgaggatcctcagacagtgttgaaatgcattataattgctgaaacccgcatatccagttcctctttggattctgctcacgctgctgcatttaatcgctttacagctccatgggttaactcaaaggtggttctcttaggagtttccttttttgagaaccagaagaggcatgtaaacaatccatctcgtctttttagttattcagattatctttatctttttgcctgttgagatttgtttctttggtttcaggtacaaccgagcagtttatctactgaggcgattgctcagctgttttaattgtgatgggagacgaggatactggacagtcaggttatcaacggatttggagcacatgggacgtccaaatgagagtcttacagttgcagagcagggactattggatccttgggtgcgtgctggttcaagggtagctttgcaaaggcggattcttcgtttggcaaaacctccaagacgctggaaaactcccactttttcaaatctcgtcgacaacaagatccccgaggttatacttctattcaaagtgaaaagataaaatataaagttgttcatcttcttactttgtcctcaaatgtgcaattttgcatttcaggttactattcaagggagatcactgaactgtgaagttggcataaaaaataggttttatggagaagatggagaacaatgtggagtggagcagctcgcattgcagtattacagtggagaaggaggaggatggcaaggaattcatacagagagtagtatctggttaacgattttcgggcttctcatgtgggatattctattttccgatgtccctggcgttttccaaacccgattccaggtgaatgaaactcaatagttgtctcatatgacgcaaatgaaaactctcattctgttttctgttccccttatgcagactgctccactggacttagagactgaatccttctatctaaccaggaaggaaacaatagaatctcagctcgaaaaagtcgcaaatggaatggctgaagaaatactaatcatatcatatgaaacacaacgtggaacagcgtgcagaggagtggcttgggagcggttttcgttagaggaactgagagcagcagtggcttgtgttggaggtatgtgtatagcatcgctgtgccggcatttagctcaagactataggagctggtgcagtggaatgcctgatctactggtatggcggttcaaggagaatggttatgaaggtgaagctaagcttgtggaagtgaaatcagagaaagataggttatcagaacagcaaagagcttggcttctacttctaatggattcaggctttaatgttgagatttgcaaagtaagacctgcttctttaattaaaacttaattatccaaattaaaaggagaacacacgatttgtcggatagttactttttttctttttttctttatgcaaaagtgatttgttttttatttgttgttgattattctcgagtagaaagtaacacgtgtagatagatatctgagaatgagaatagttgatgatgttaggttttgatgaagtagacgttgtggcttgtttgttgtaccataaaaagacgactaaattttgttcttccataaacttttcaaagagatttgtaaatttggacaatgtgtgtgggtggtcctcacatgttagtagattcttatgttatgctttagtttgcttttatttttgtgagactttttagcttcattttctctagaggaatatgccatttggggatgggatccagaatcaatttgaatttttaataattaatactagatgacattctagttattatagattatgtaatatgatttgacatgtaattatttatactgaatttatgtatactattatatatagtagatacatcctaataaaaattgcaatgtaatgataccagaaaagaaaatttgcaatgtaactttttcaacataatttttttctttctttcccataagtgttaccattttataaagaagtgttacaacccaatagaaatataaaagtatccctttttaatttaaaatttatccaaaaaaatgaatttttattaatataacaattcaattgtgtatgcatgataggattttcttaattttaatattatgaagtcatttcatctttattgaataatattatttttcacttagacttagtggtatgcataaaatcaaatttaatacagtctatagtaattaaaactatatatggagaagtttaataagatttcaaataccaaaaacaaatggcaatttctgagaaatgagtcacagatagcgacgacaagagccttgagaatgggaattggtgtggtggttttgctctcaatatagggatttgttcagcgcctttagccgagctgtggggggtctactatggtttgtacatg

SEQ ID NO: 31735 - DNA, 3003 bp, Unknown
  misc_feature (1)..( 3003): 2750-1469P.txt file - cDNA_ID_3045378; gDNA_ID_1971786; Annot_ID_58003
agttcttgcgagctaatgtgctgactcttcccagagtttcagcaaagtgcaacgtccacttcatctgattttctttctttatctttctttgttatatatatagcaatagtttatggttaagagaaacgcagaatattggggaattatcaattatgcaagtttagttgtgcttgtggcagcaatcatcaaaacttgcacatcaaattgtataagtgactcttttaggtaaaaaataaacataccagaaacacttgacaaggtttgtcatctctaatttacgcgctgccgtctatgaaaatgtatcctcacagagctgttttggagtggataaaactaagaacaaaagcaaaaaaagaaagatgattgaaacaagaggtgaccatggagagaaagggatcaaagtggtgaaacaatactatcaatccgttttaccaaatgtagtattagcccatcgtcttctccgctatatcgtgctgcactctaaattcattactactctctacatttgaatttgcataggatggataagtaatatcttcttatgttctatttgccttgctagacgtagccgtgttcttaagctcttctagtatttcaagttgcttttgtaaaacttatcttttgtatatccattggataggagaatgatataaattcttcttccatatctactgaaccatcataaatgactcaagctacataatatttgcaacacaaaatctctgaactgttaataaagaagacgcaaaaacaataatgagatcgaaagaagcttcttaatgtcatggagaaagtgatataaaatctacctaattgaaccaactagcccaaaaggcaaaagcacaaaatacgttttttttcttagattctgaaattattaacctggttaggttacagtagtataaaaaagagctttgtctttctcttagattccattgtcaagcttttggtacacttcctcgtctcctctgccatcgtaagttccaaaaatctttcacttcctaaattacactctctccttcgatttaaaggatccatctttgattctgttttttttttgttcttgcttgtttagttgcaaaaacgtttcaataggataggaggaacctaatcgacagttgttttagtgtgtcgtaggtaatttttggggtatgatggattcaataaacaatttgccagatgagattcttggcaaaatcctgtctttgcttccgacaaaagtggctgcttccacatcgattctgtccaagaggtggaggaatctgctgggtcttgtagataaccttgctttgatgagtcgatggttgtttatcccaacgaagaagctgaaaatggttcacttcgcttcgtagatttcgtaaacaagacatttgctctgttaggcaattctcccatcaaaaagttctctctgcgtcatgagcctagactttactgtgtagatgcatacttacgttggattttcactgcaatggaacaagaacgtggtttactggaactacacttgtacgcggatcgatattattatcctgttggtatagagagagagctgttcacgagcaacacactggttaagctcacactatccggtagatatgattttcaagttgagactgtgtttctccctgcccttaaatcactttccctctcatcttctttcgagattggttttgacaaatattgtaacctcctcgatggcttccctgcattggaagagttatacattcgtgaagctgtatctgaactttctaatgctttactatctagcggtacgtttgtgaaatgtgcatccatcaagagacttgtggtttttaccgattgtccaaagtttaaagaggatgaggatcaccaagaaccttgttttatagcaccaagtcttgtctaccttgactattctagttatctctccgaaaattatgaccttattgatttgaattcgcttgttgaagccaggctgaatctcagactattggagtcatttaacaattatggttcgtctgataatgatggtgatgtttatggttgggattttaatgttccttttgattattatggtgatgttacaaatctagttgcgggtataaccaacattacaacccttcacttgtctcctgattcccttgaggttagtcttttgctactacttcttcgtctatctattgattgttttttggtttgtggagattgataatccattgtatatagaaaagctagtttgcaaagtctttcacttatatatggttctggatatataaatcaggtatttcatttccgctgtaaatccataccggtgttcaacaatctcctccttaatttatctattgagagtaacaagcgaaatggttggcaagtaatgccacttttgatcaggagttgtccaaatctgcacactttagtcatcaaggtcttatcattttccttgctgagattcttttgttgttgtttgtgttgcccattcatgtcaaattggtctctggtttcagggttttgtccacagagtaacaagtaaatgcggagacgcatgtgcttgcatccctaagaagcagaggaagattggaaagaaagaggagatttcagagtatggaggttcttttcaagagctggaacagatgagacatttcttgggcaagttggaacgtcttgaaactgtgaaagttggtgttcacgcagaaaacaataacaacaatgagttcttgcgagctaatctactgactctccccagactctcatcaaagtgcaacaacatccaattcatctgaccttttccttccttgtcttttttcgctttgatctcgcaatgtgaaagtaacgtgacatgaatatgattatatcactaaagttggttacaatctgtttttttgaaagatccgttgttcttcttcctttgagttcaaaaatgacatttttatttttgtgcctttttttgttgttaaattgacaaagacatttaaaagaagaattttcgaagaaaaattagagagagtagaagaagcagaagcagtaatg

SEQ ID NO: 31736 - DNA, 3003 bp, Unknown
  misc_feature (1)..( 3003): 2750-1469P.txt file - cDNA_ID_3045378; gDNA_ID_1971786; Annot_ID_175477
atcgtaagttccaaaaactttctcttcctgtagttaaaaccctaatttatggctatgatgagaacttctcctagagattcgataagcaatttgccagatgagattcttggcaaaatcttgtctttgctcccgacaaaagtggctgcttccacatcggttctgtccaagaggtggaggaatctgttgggtcttgtagacaacctctgctttgatgagtcgatggttgtttatcccaacgaagaagaagaaacaagtggttcacttcgcttctgtgatttcgtagacaagacatttgctctgttaagcaattctcacatcaagaagttctctctgtctcgtgtatataagtataacgatgatgtagacggtatggtccggcgttggattcggactgtaatggaacgcggtttattggaaatacacttgcacgccacccccatgtcttttgttgccatagaaactaagctgttaacgagcaacacactggttaagctcacactatccgctcgatgttttgttgaagtagagcgtgtgtttttccctgccctcaaatcactttctctcttctcaattctgggtgattataccaactatatacggctcatcgatggctgccctgtgttggaagaattatacatgcgtgatggtgattatccgttcttgcggcttacttgtggtaccaacgtggaaagtgcatccctcaagcgacttgtgatttttacccataatccaaatgaaatgatttggcacgaactgatttattttgaagcaccaagtcttgtctaccttgactattccagttatgtctcggctaagtatgatgttgttgatttcgatttgcttgtcgaagccaggctgagtctcaggttatgggtgtcaactaacgattatgattattctgatgatgatgatgatgatgatgatgatgatgatgatgatgatgatgatgatgatgatgatgatgatgatgatgatgatgatgatgatgatgatgatgatgatgatgatgatgatgatgatgatggtgattattatattgtagaaccaaaggcgcctatatttggtgatgttacagaactacttgcggctatacgcaacattacgacccttcacttgtctcctgattcccttgaggttagtttttgcttcgtcttagtgtttgttaccggagctagcaaggtctcttacttatttatggtttttggttgtgttcgtttataacttaggtgtttcatttctgctgtaaatccatgcccgtgttcaacaacctccttaatttatctattgagagtaacaaggataaaggttggcaagtaatgccacttctcctcaagagttgtccaaatctacacaccttagtcatcaaggtatgatataaaccttgctgagattcttttctgttgttagtgttgccccattaatttattcatgtcaaattggtctctggtttcagggtcttgtccacagagtaactagtagatgtggagatgcatgcgcttgcatacctaagaagcagaggaagattgtacagaaagaagaggcattatgttgtctgcggacatgtcaagtgaaggtgctacagatttcagagtatggaggttattttcaagagctgaaacagatgagacatttcttgggcaagttggaatgtcttgaaaccgtgaaagttggtgttcacgcagaaaacaacaacaacagtgagttcttgcgagctaatgtgctgactcttcccagagtttcagcaaagtgcaacgtccacttcatctgattttctttctttatctttctttgttatatatatagcaatagtttatggttaagagaaacgcagaatattggggaattatcaattatgcaagtttagttgtgcttgtggcagcaatcatcaaaacttgcacatcaaattgtataagtgactcttttaggtaaaaaataaacataccagaaacacttgacaaggtttgtcatctctaatttacgcgctgccgtctatgaaaatgtatcctcacagagctgttttggagtggataaaactaagaacaaaagcaaaaaaagaaagatgattgaaacaagaggtgaccatggagagaaagggatcaaagtggtgaaacaatactatcaatccgttttaccaaatgtagtattagcccatcgtcttctccgctatatcgtgctgcactctaaattcattactactctctacatttgaatttgcataggatggataagtaatatcttcttatgttctatttgccttgctagacgtagccgtgttcttaagctcttctagtatttcaagttgcttttgtaaaacttatcttttgtatatccattggataggagaatgatataaattcttcttccatatctactgaaccatcataaatgactcaagctacataatatttgcaacacaaaatctctgaactgttaataaagaagacgcaaaaacaataatgagatcgaaagaagcttcttaatgtcatggagaaagtgatataaaatctacctaattgaaccaactagcccaaaaggcaaaagcacaaaatacgttttttttcttagattctgaaattattaacctggttaggttacagtagtataaaaaagagctttgtctttctcttagattccattgtcaagcttttggtacacttcctcgtctcctctgccatcgtaagttccaaaaatctttcacttcctaaattacactctctccttcgatttaaaggatccatctttgattctgttttttttttgttcttgcttgtttagttgcaaaaacgtttcaataggataggaggaacctaatcgacagttgttttagtgtgtcgtaggtaatttttggggtatgatggattcaataaacaatttgccagatgagattcttggcaaaatcctgtctttgcttccgacaaaagtggctgcttccacatcgattctgtccaagaggtggaggaatctgctgggtcttgtagataaccttgctttgatgagtcgatg

SEQ ID NO: 31737 - DNA, 3000 bp, Unknown
  misc_feature (1)..( 3000): 2750-1469P.txt file - cDNA_ID_3045393; gDNA_ID_1971789; Annot_ID_175530
ccataggattccacaatcgaagtatgtcgatggagttagatggcttccacaagcttctgctttgaatcgtttcttcgcaacagcgtcctatgacgcggattgtgattcttcatcaatcgagatccaatcgctcgacccaaaccctagagggaatcacaacacgaacccgttaatcgagtcgttatcttcatggacttcaccttctcgcgtttcgtctctagaagtcgcgggaaacggcggtggtggcggttcattcaaaccaatggtttcagcagctacgtcttctggttctcttcacgttctgatgattgatttggtggaaggagctgcgattgaagagttttacgcggcggaaggggagaggtttcatgtgggacgcgtggaaggtgtggattggagagagggaggagaatgtgttactgttggtgaagatgggagagtgaatgtagtgaagattgtgaatggtgaaggtttaaggtatagaaaggtctttgatgggaatggattggtggcttatagagctgtgaaatgggcttctccgactgagtttgttactggaggatatggttttggtttgcaattgtgggatcagaggaagtctggtgaagctgtttcacaactcaaagggaactggtgagttcttaactctgtttaatgattgaataaatgctagttcaatctggttttgaattcctggcatgtttgctcttcgatgatatggaacttgaaagtttgtgcgtttggctttagaacacactcgtaatatttgatttggtgagctgtttagcaagtagaactaagaatgggaacggtagatcctttgagttaatagtctatataagaagcatgcctatcctactgtgtctattctgattataacattgcaggtttcaaggcaaaacttctgcaattgtccactccattgacattcatccatctcggaagcacacttgcattgtaagtgttttttcttcttcgcatgtgttagatgtcttttaaagttcttatctgtttgaagtttgaaaaacgtctttcccatcaactgatgaacatgataattcctagtgtgatcctcaatctttaccaagtttttgggtatatagcctttggtaatattccttcatatttcttaggagatgaaagtgaatcattttgtttctgtgtttagaatattaaaccaccttgtcactattttcctttacattttacttgtcgctcacatatacgcacacaaaacttcagtgtagctttaagtatccccacaacttacaagcatgatttaataactttatatcttgatactgttgtgtgtttaggcaggaggttcttcaggtactgtatttgcttgggatcttcggtggccacagcaacccattgttctttctggggttggagcaagtgagaatataaacaatcctctgtctgaaagtgaggtatgggaagttcagtatgactcatacacaaaatccaacgtctcatcctcaaggattctccctgttatgacctgctctgaagatggaatccttggtatcatagaacaaggtatttacgcctttctaccacatttgttcttctttcatgtatgagttaccaaattgatgtttcctctatttatttttgtcctggctattttgctcaggggaagaaccaatcgagcttctggctgaaccttgtgccattaacagttttgacatcgacaggcaaaatccacaggtgaaaacatcacctaagtctgtttcaacaaactagttacttacattatgtgttttctcaagctggtacatacaaatgtgcaggatgtgatatgtagcttggagtgggaatcaatagcagttttctcaaggccttagtataatatggaactgtgcacggtatgctatgttttcttctgcgagctacaacgaagaaattgaggaaggtagtgatagatgatgagagacaagtttaaggaagagggtgtggaatgtgtttataagtttcattataacaagatcttaaaatacagtctgcacaaacagagttttgtattcatcttaaagttagtgtgatcttgaagatttgcaatcctggcttgaattgtacttctgaatctctgtcgctgtataagtagtgtgtgtataccgacaccaagttaaacctcaaacccaactatgacacgtggcgaaaaagaagtcggccacggtaggtcccaccggagctaatacttggccctctaatgagccgttgaaaagcttgaatctctctttttgttttctttttcaattctttaagaggttagaatttggtaacaagaacttgtcaaaccacaaaacaaaaaagaagacatgtcccacgcaaaaaacttaagctcttattaagttctttaatcgttcaaagattattatttcaccaatacgttccagctcttttcttaagatagtccagaatatcatcattattttacttgattttttactctttttgataacagaccctttcttttttcgtttttgttctcctgtaggagtttttgttaatgagaatttctgatacgaactctcaaattgattccatattatgctgagaaaaggtgaacaactttgtcctgtttatgatctgatatattttgtagttttgtccactttgattttggcataatcataatggttttggtctggcgtgccttttgtgattgattatattccctttttggatagtttcctctttgattgtctaaatattgttttgttaattcaccagaaatgttcatcatgtcttctacgtgaagcatttcctctgttcaagagattagattagtcatctactctcatcccaaaatctgcaagttcatcaatcattcttctgcaactttcctggtacaatgagattctttcttcttttattaagattctgctcatcttttggtgaagaaaactttactgtttacgatttttttcttgttttatatgaagtaacagttactgacattatgtatctataaatctgttcaagagaaacatg

SEQ ID NO: 31738 - DNA, 3003 bp, Unknown
  misc_feature (1)..( 3003): 2750-1469P.txt file - cDNA_ID_3045393; gDNA_ID_1621091; Annot_ID_170735
agtccataggattccacaatcgaagtatgtcgatggagttagatggcttccacaagcttctgctttgaatcgtttcttcgcaacagcgtcctatgacgcggattgtgattcttcatcaatcgagatccaatcgctcgacccaaaccctagagggaatcacaacacgaacccgttaatcgagtcgttatcttcatggacttcaccttctcgcgtttcgtctctagaagtcgcgggaaacggcggtggtggcggttcattcaaaccaatggtttcagcagctacgtcttctggttctcttcacgttctgatgattgatttggtggaaggagctgcgattgaagagttttacgcggcggaaggggagaggtttcatgtgggacgcgtggaaggtgtggattggagagagggaggagaatgtgttactgttggtgaagatgggagagtgaatgtagtgaagattgtgaatggtgaaggtttaaggtatagaaaggtctttgatgggaatggattggtggcttatagagctgtgaaatgggcttctccgactgagtttgttactggaggatatggttttggtttgcaattgtgggatcagaggaagtctggtgaagctgtttcacaactcaaagggaactggtgagttcttaactctgtttaatgattgaataaatgctagttcaatctggttttgaattcctggcatgtttgctcttcgatgatatggaacttgaaagtttgtgcgtttggctttagaacacactcgtaatatttgatttggtgagctgtttagcaagtagaactaagaatgggaacggtagatcctttgagttaatagtctatataagaagcatgcctatcctactgtgtctattctgattataacattgcaggtttcaaggcaaaacttctgcaattgtccactccattgacattcatccatctcggaagcacacttgcattgtaagtgttttttcttcttcgcatgtgttagatgtcttttaaagttcttatctgtttgaagtttgaaaaacgtctttcccatcaactgatgaacatgataattcctagtgtgatcctcaatctttaccaagtttttgggtatatagcctttggtaatattccttcatatttcttaggagatgaaagtgaatcattttgtttctgtgtttagaatattaaaccaccttgtcactattttcctttacattttacttgtcgctcacatatacgcacacaaaacttcagtgtagctttaagtatccccacaacttacaagcatgatttaataactttatatcttgatactgttgtgtgtttaggcaggaggttcttcaggtactgtatttgcttgggatcttcggtggccacagcaacccattgttctttctggggttggagcaagtgagaatataaacaatcctctgtctgaaagtgaggtatgggaagttcagtatgactcatacacaaaatccaacgtctcatcctcaaggattctccctgttatgacctgctctgaagatggaatccttggtatcatagaacaaggtatttacgcctttctaccacatttgttcttctttcatgtatgagttaccaaattgatgtttcctctatttatttttgtcctggctattttgctcaggggaagaaccaatcgagcttctggctgaaccttgtgccattaacagttttgacatcgacaggcaaaatccacaggtgaaaacatcacctaagtctgtttcaacaaactagttacttacattatgtgttttctcaagctggtacatacaaatgtgcaggatgtgatatgtagcttggagtgggaatcaatagcagttttctcaaggccttagtataatatggaactgtgcacggtatgctatgttttcttctgcgagctacaacgaagaaattgaggaaggtagtgatagatgatgagagacaagtttaaggaagagggtgtggaatgtgtttataagtttcattataacaagatcttaaaatacagtctgcacaaacagagttttgtattcatcttaaagttagtgtgatcttgaagatttgcaatcctggcttgaattgtacttctgaatctctgtcgctgtataagtagtgtgtgtataccgacaccaagttaaacctcaaacccaactatgacacgtggcgaaaaagaagtcggccacggtaggtcccaccggagctaatacttggccctctaatgagccgttgaaaagcttgaatctctctttttgttttctttttcaattctttaagaggttagaatttggtaacaagaacttgtcaaaccacaaaacaaaaaagaagacatgtcccacgcaaaaaacttaagctcttattaagttctttaatcgttcaaagattattatttcaccaatacgttccagctcttttcttaagatagtccagaatatcatcattattttacttgattttttactctttttgataacagaccctttcttttttcgtttttgttctcctgtaggagtttttgttaatgagaatttctgatacgaactctcaaattgattccatattatgctgagaaaaggtgaacaactttgtcctgtttatgatctgatatattttgtagttttgtccactttgattttggcataatcataatggttttggtctggcgtgccttttgtgattgattatattccctttttggatagtttcctctttgattgtctaaatattgttttgttaattcaccagaaatgttcatcatgtcttctacgtgaagcatttcctctgttcaagagattagattagtcatctactctcatcccaaaatctgcaagttcatcaatcattcttctgcaactttcctggtacaatgagattctttcttcttttattaagattctgctcatcttttggtgaagaaaactttactgtttacgatttttttcttgttttatatgaagtaacagttactgacattatgtatctataaatctgttcaagagaaacatg

SEQ ID NO: 31739 - DNA, 3000 bp, Unknown; identical to SEQ ID NO: 31737
  misc_feature (1)..( 3000): 2750-1469P.txt file - cDNA_ID_3045393; gDNA_ID_2926198; Annot_ID_201639

SEQ ID NO: 31740 - DNA, 3003 bp, Unknown
  misc_feature (1)..( 3003): 2750-1469P.txt file - cDNA_ID_3045397; gDNA_ID_1971789; Annot_ID_175529
ctacgacgttttgaatgaggattcggacggttgggtgtttcaggtttgggctcagtgtcttctctcgcgcgtccctcttcaccttcttatttctacctgtgagtctcacttttcttctctccggtctttagcattctattgaatagaagaattggcatatagctattagctattttcctcagatcgtgttttaggcgactttctgttctcgcttgcttaacattgtacttcagtgtcgaattcatatcctacacatgagtctacataaacattgtgctttatgcttgcttccttagttcctcagaaatccttggaaaatccgcagatttatcttcttcgctatctggaattgttttcttcgtaggtttcttctcgttcatgtgtttttccctattgggataatggttttcagctctaaagattctatagccgaaagtaaaaataagacttgtgtaatatttgctgcagctttatttgcgaaatcacgtctaaaaccttgtaggtagaggaaaggacaagaatcccaggcagaagcaaccatggtgatggtgtctaattctacccatcaaaataaggaaatacatgtcagaaggagaatctctgagatgtattcttcgttctgatctttttctctcgttgcatatcatgcttgcctgtgcaaatggtgtgatatttaaaccccttgatcaatctactgcgtattgatcagtatagactcttagcatgtatagcgctaaatttcacatctgatcatttttatagaaaatactttgttcactgcatacacttaatgaagcaattctcccatctatggacccagtgagatgctccattgtttcctagcataccttagcataaaatggagatctttagtcacagtttctaacagatgagatatagatttatattaaggtatcaattttttcattctgtagaagcagagtattttcagcctcttgagtatcatgtttttttttctttctttctggtgatgcagatacaatagacgggaagaggagtttccatcacttaaagactacaatgactacttggaagaagtggagtgcatgggttagtttcacttgtgctccttattttctctattcatgcaagacaagaccaatgtatatattaccttctattccaccagtattcgacttgatagatggaatcaatgtcgaggcgattgagcagaagattaagagatattctaaggagaatgctgaacagataatgattaatagagctcgtaaggtagggcctacgttagccttactttttcttatcttggttagatgaatgagtagaggaaaagaaagaagattaaaagcatgtttggttatatgatatcactgtgcaaattgcttttggtgtatttacaatttgctccaacaggcagaagaattgactgcagccttggcagcttgcaaggccaaacccccacagacagatgctgacacggtaaattgggttttaattttcatatcaacaagcagatgaagtttcctgacgaagctgaaatctctttacttgtttacgcattttgtagtcgtcgaaccatggggtcacggctggaactacatatggtcaggcttcacgaccaacgggaatgggcccacaacctgtacctatagtaggtggagcagagcgtcaacattacgctatggaagacgaagcgacgaggaggatgaaagcagagagagctggaggattttctttagagataagcaagaggagggctttggaagaagcatttgcaagcatttgggtttgatttctcaagcgatattagttttgtcccttatgatagtgactaggaggtcttgatagcttccattgttgtctcagtttactgtcttttactcttgtggctggtttgttttgtatagttgacaagactctattacgggcatcaaggaaaacaaaatttacgaaagaaaaatcgcaaaaaatacatgtacttgttcaattgtagagagacggaaacagatggtagaacagaagcaaaaaataaggaggatggacatagttattgaatttaaagggattttgatgtccatatcaaagacatagtttcatctttagcagttacaccgttcccagttgccataacattttcctctgtttccatacccatcagtatatcaagaaatgattcggcaccgtctaaacaagacatagaacaaaaattcaacttaggaaacttgaggtatatgtaacctcggcaacacaggccacataatttgcaaattaatcgactctggctactgttacgaacaacttccccttttaggtcatcgcaactgaatgtggaaccacactttatgtaagcagaggagtcaaaacacgcatagatggtggatagtggtgcaacatatgttgcaagtgtagaaccatgttgtcgtatctattttttcttcacatatttcgcaccagtagatttcatctgtgctagtgctatcttcatagcaaagagagagaggatgctcatcatatttccagcataactgatatgggatggttgcacatttataacacattgtaaactcacattgagtacattctagtagattagccgacaaacacattctattggaactaatacgtgttccgccactgctgcttctcttcatctcgaacacgatcatatttctctgagtcttagatgatgttcatggcaattttgcgattatttttctccaaatagtattacttttaaaatttcactcccttttttttagtctcaaaataaaagttggtcaaaaaaataaaattaataaacaaaataaaagttggtccgaccgaattgaaccagcaaagccgatatgatctccggtttactgaatatagcaaagcaatcccagtaagaaaataagctctatctcttgctgcagcgattaggctcttcctatatcctctcgttccgcttaatcgtcaacaccagagaagctggaaccttttgttatccggtttaagcaaatgttttggtagctcgctttgatg

SEQ ID NO: 31741 - DNA, 3003 bp, Unknown
  misc_feature (1)..( 3003): 2750-1469P.txt file - cDNA_ID_3045401; gDNA_ID_1971789; Annot_ID_175527
tgtttgtgacaaccgaaatagtgtcaagaacttcatatcactcggtggattactttatttgattgaatcttagttgataacgaaatcctttctttttctatgtatttcgattattaatgtaatcagaaaattttaagtattttttcacgttatccaactttgagagtactgtccttgtgttggccaataagtggttgaatatatggtaaaagtataaaagctcccatcatgttggacctactagctttgctatatataaaatgtcctgtcattgcataacgtaccactttctgaatctgttttacgtgcctatcaatgatttgtctttaacacttaccgtaatattctacaattaagttcaagtgcctagattttctaaatgtgtataaagacattatatatggcaaatgatcctttagataaccatttcatttaaatcaagcattcgattcgcattcatagataaaatactattcaccggtccagttctaactagccatccagtctggttagaaagcaaaattgtttattttattttaggttcagttttcagatcggttttctaacactgttttggtttggttctcgtatcggttcaaccggattggatagtcataaagaatttgaagtccttaattaagcccaaaacaagtagagcccatatatatactaacaaagccgtgattagggtttttggttttcgtcagaagatttcaaggtttagggtttctgcaattcaaccatggcagagcaggtttggatctacattacattgtctttatgttataattggggattgctagttgttggattctcgttttctgggttctttgattttggcttttaatgatggattggtgtgtttgcagacggagaaggcgtttcttaagcaaccaaaagttttcttaaggtaattgtcacacctcaaaaattcaactgctttgtattttggctatggtctctttatgcttatgattcaaatgttctatcagctcgaagaaatctggtaagggaaagaggcctggtaaaggaggtaatcgtttctggaagaacattggccttggtttcaaaactccaagagaggctattgaaggtactgtttttatgtctcagctctcaattttgctttaccatgtctagaagaagcttcatttgttaaaaaagttggattctttagagaacttagaggattttggtttagtgtctctaatttggttgttgagacattttctgagtaatctgattttagagtaatgccgctttgttagtattctcattgatctaagacttgggtagtagattggtggtatttgcccaattttaggagctttggggaaattgtttgacatagctatgttttttcttgattttatttgcaggaacatacattgaccagaaatgtccctttactggtacggtttcaatcaggggtcgcatcttgtctggaacttgtcacagtgcaaagatgcagaggacgatcattgttcgtagggactatcttcattttgtgaagaagtatcgaaggtaaaaggatcggttttgttattgtgttcaaattctctcagcttatttgaaaccctccagctaaatgcttaatcctaccagatatgagaaaagacactcaaacattcctgctcatgtttccccgtgcttccgtgtcaaagaaggagatcgtgttaccattgggcaatgcaggttaggagcactaatatctatatacttggtttttcgttcaaaggaattcatgctattgtataatactgcctgaactttgataccatctttatttatcacgcaagtttctaaacttatcaagttaacgattcaggccattgtcaaagacggtgaggttcaatgtcctgaaggtcattccggctggaagctcttctatcgggaaaaaagcattcactggaatgtaaaagagattcagatttgttgaaaaggtgcgaactagtattctaagagtttagaatttttctagcagagttattggattcgtttcttaagatctatgatcaaaggaaaccagattttctgtttcatttagtgattcaagtatcaagatatgtctatggttatagttttactccaatatatctagtcatgagttgctatctactagtcatgatttcgatgaaaagtggaattatgcttttgctatcttgatatttatctttgtctaatcgatatttcttgcttccattacattaatttctgaaaatgatatttaagagaaaacaatacagaagttgcataactccagggaatgctatgaacgtgcagcctcattctatgccatacatttatataaaagctccgattgcaccccttaagcttattaagtcatcttcaaaattagaaaaagaggtgcctaagtcatggcgaaaattagtcgaatgaaaacgacacaaaagattcttcatgtataatatacaaaaatatgaccccgtatttcacatggtatagttttttattacatcacttttccaaacgtaaagttaattaaacgttgagaaatgtgatgttgcttggtaacagctcaattctcgaaaacacgtgaaacctggcgcacttgcttctgtttcacatttgcatacaatttcaaccactaacacgcaaccatctccaaacgcagggccacgtttatctgcgtttgcgttaccaaagtcaatgattgacaaacaaacaaactaacactccaaccaatgacgagttttagataaggtattcgtgattttatacaatgcatcaaacagaaatcgaaccaaacacctccttaagttgtttcacggttcgaccaaccgcatcgaacgccaaattaacgagaagaggttgttgttagttgaggaccacgcacgatgggtgaaataaaaaagtccgaatcttttgggttcgttgagtagcttctgacgtcatttcgcacattctaattctaatattcagtctttaaagtcttaaaggatcttcattgtactttgaagtatagtttctgtaacaacaatg

SEQ ID NO: 31742 - DNA, 3000 bp, Unknown; identical to SEQ ID NO: 8395
  misc_feature (1)..( 3000): 2750-1469P.txt file - cDNA_ID_3045405; gDNA_ID_1971789; Annot_ID_175524

SEQ ID NO: 31743 - DNA, 3000 bp, Unknown; identical to SEQ ID NO: 8395
  misc_feature (1)..( 3000): 2750-1469P.txt file - cDNA_ID_3045405; gDNA_ID_2926198; Annot_ID_201633

SEQ ID NO: 31744 - DNA, 3003 bp, Unknown; identical to SEQ ID NO: 21540
  misc_feature (1)..( 3003): 2750-1469P.txt file - cDNA_ID_3045409; gDNA_ID_1971789; Annot_ID_175523

SEQ ID NO: 31745 - DNA, 3000 bp, Unknown
  misc_feature (1)..( 3000): 2750-1469P.txt file - cDNA_ID_3045417; gDNA_ID_1971791; Annot_ID_175571
agtacttaatactttcttataatgcccaaatgaaagttgcgtaaaggccaaggatcatcattttcatcatgtttgaatgaataacaaaaaaaaatgaagaagagaatagattgtcttgttaatagtgaagtgaatgattctttttcaatttttgaaaaactgaaatagaaaatgccaaagagagtcagtttcagaaggtaccatcattacaaaccctaatagtataaaatgccaattgtgtacttgaggaggcttttgtaacataacataataatatagccttacaacttttgacatttaatattggttatttattgttggcccttttgggtttagctcggaaccagaggatacaaaactccaagacaagaatcaccaacggatctctgcacagaatctttggtccaaaattttcccccacaatatcaaccaatggtcttgtaaatacctaattattttcaaatcctacataattttcaattttgtttcatttttgtgcatcaatatataaaccaattttagttaattcaacttagcataccttaagcttgaatctacacacagtaatacattaaaggttttgggtgttgggagattctacagttctgcaaaagtgactctagtaacttgggccttatctactgtcgttgtcattatgtgtcatctccttttacatatctcaccaatttccccctatttaaaacatctgaaaaacgtcaaataattatttattttgtcggcaaaatgaaacatcgaattattctcttatttgttttccattctcatcatacgatcgactatatgtgtgaaattagccctttctcaaataataataataataataatatgtatgagataatttggctcaacttataagatacagtatatgattgagaattagagactagttagatcaaaggctcatcttagacgagcaagtttcatattggcaaggtcttccaaataccatctatcaattctcaaaaagaaatgttatatgaaaacaattcaagctttatagtttatacccattgatctcggagttcaacagatatatctattatctttaaaagtgttttaaactaatttggggttgtgatgaggtttattaatgttggaattagatggagatgtgaaagaaagttgagagagttttgagtattatggtgatagatgttgatatgcaaatgtagacaaacaatggtgtcccacttaaattcgagtgtccttaagaataaaatcacaaagtctcaacaaaacaacacaaacccaactgtaagtcacattcacaaaccctaatctagaccctcatgttcccttttgctttaatattttacttatcaatctaaagagactactactacgttacaaatttacactgatcattatcctttgcactaatcttaaataagaaaaaccttcttctaaattctatccgggcgagttccaataataccgtggatgaccgaaccataatttaaaatttggcatcattacttaaagatcattacgcttagtaatagtatttttctttgtagctgaggttaggatttttacatgttaaatgtaaaattttgcgtttagccattaaaataatttgggtttaataagaaaaatactctacttgtttcatcaaatattattcgtaaattgtaaaaccaaatacaaaacacaaaacaaaatgttgcataagattaaaaaaaaaatcaatttgatgctatttttcggttaaaaaatgaatacttgtaacaacgacaaaaagtaagaggtattaagaaaaaacataatagcaaaataactcgttctttagaccatccttattgatgggttcttagatcaaatcttcacatttttgatctaccaaataataatttaaaattagagggttcttagtaagatgagagaaagtataaaaaaaactcttaattaagagccaattttactttctaagaactttttttaatatttttattcttattttgttttatataattttttaagagattttataaactttttaagaaaccattgataatgatgcttttactgatcaagttttctgtagtaaccaatagaaaccacaagtatacacaaaggaatttttagagccccctttgaacactagaaccaatcaataaaacaaaacctcttactacattgaaccaatccagctaatgatctgttattggctgtctcgtaagaacttaccctcttttggtatgtaattttttaattttaactatttcttgtcgtttgtggtgtttttcttattgtacttgtttgtccgattcaattagcgtaagagtaaaaacctatccatttctttggtaccgtcctttatattctcttttcatcattcttcaccattcaagtttcaaccttttgctcacaaaaaatttaaaagtaatttcatattttcatctttatcattttgttggacaaaagaaaaagtcgaatagtatccgatgtgagatttacatgtcacataaccattacctcttggcagtcccattcaatcgataacttgtaatttgttttttgtaagcctagaaaccatagacctatgaaataattgagtactagttgctcatataatttgtacaatacacaatacacaacaaaataaatggtcatatccgcaaatatcaaaacaatattttctttagtaaaataacaaagtaaaatgtctcctcgactcctccaattgcttataaattgaggtgatcccttatttcattatttcaataaattccaccaacgtcactctttctcttctcccaaaagcctcaaccaaacattttccctcccaaatctctagaataataacttcaaaaaatcacactcttatctccataattacactaaacctactcttctctcctcatttaaccacaaacccacttctcaatttctctaattctctacccaatttttttttttattcaaagggaaaagaaacagagtaagaaaatgaaaatgagtgattattggacaacaatg

SEQ ID NO: 31746 - DNA, 3003 bp, Unknown
  misc_feature (1)..( 3003): 2750-1469P.txt file - cDNA_ID_3045463; gDNA_ID_1971795; Annot_ID_175634
aacacaaacccaatgttttatcttggtcacgtagagctcctttatcttccctgagcgaatacgtcttctacgttttgtgaaatccgtagattttcttttcgccgaggttaggatatttagtaacattaataattaagccatggcagtatgaaagagtgggattcatatcttagcacacttttgaaagatgtgagccaaattttgatgtagagagacaacaaatgaaattaacgaatttgcatttgaaacatatatagatcgatccattgataagctttaatgatatgtagaacacattctctaattctatgagatttgtaatgaagtgataacccatctttacgcaaaacacattgccgtaacgtcgacaacaaatgaagaatggctttgttaaggtgagttaaaaataatgttggcgcatcatatgtttctttaacattaatagacaaaaataagtaactcaagttacgttttgatgaaaggaaataaagtcgtaagcatgcatctctttgacgatagatgttgtgttgcatgataccaaactcaaacatattgcgaccacaactctgaaaaaaaacattaactcactcaaaattaaagcagaataatttttttgtttcttctcttttttagataaagagagacattttaatttttatgttagtcggaagattccgattcaaggaaatttatatttacttttttcgacctattttgaaaacaatttgtacaatcaaaaagatgttagaaaagtatgcgtaacattttttgttttttttggtaaaaaatcagggccggctcaaactttttgaagaccttgtgctgatttataaaaactggctttagttaatattggtttttaatttctaaaatttttggaccctaaaaccttaaagaaaattgaaattttttttgaggaccctgtgcttttgctcctgtagcactcccctagagccggcactgtaaaaaatatacgtaagattttgtgcaatattcgcagtttttaatcactgaattaccataaatttgttagacatttttacatgtttcttacagtatattagatagactttgattctcattctacatctcaataatatataatatatgatatgaaagttggacagtaatgaaatagtaatcatgaaagtgagactagctatttaaatgcaggtcacatgcaaacctcgtccctgatcccatcaacagaaacatggccagtgtactgtgcaaatccacaaactcccaaacaacgacactgtttctaaatctataatgcgttattcttttttatcatggccaaaaagtttgtgcaattagttagctgtcttgtacgtatataataatagaaattaatgaggaagtatatatgttgtgtgttttgtcaagtctctacgggccacgtccttatccataaaaaagctttgtgcatgacaagctgtgtaccattttcctttattcttttgtctttctacttattttctttcaatagaatataaaggtcaaaacatttgaagtcttttatagtcaaagatcaaacattgaaagtctttcagagtcaaagatcaaacattttaagccttaattaaggttaaacattacatcgacttgttaaggatttgatgatttacgagcattattaaaccgagtcgagaaacctcactagttaaagagtttattttgtgttagacgtgacgtacatgctgcatgcatatatgtaatttaagttgtttgcggcgagaagctgattttttaaaaattttgagacataatgttttaacttttaagctttctcaaacacattatgttcttgatgtatgaacgatagttttttaaatctaatttaacattaggttatcagacacactaatatacatgtaaaactttgcattatataggagccgtgactaccctatggcaaaaaggcaaatgcctaaagccaaaaaaaaagtttaaattaaaggccaaatttttataaaataataagcttatcaattttgttattttgataacaaataattgttaaaatgaaacttttttcgtgaaaattatattcttaactatacctttatctatagaccattttcttatcttgaaaacacatcatttagtaatatattttttttggtaagaatcatttagtaatacatcataattagtaaatataaatatttaaaacaaataacattattagaaaaacatataaaaacaaaaagaataacgtattattgatttttttacattgtaagtttttgatactaatattttttccgattcagtattatgattatttttaaaaactatgatgatagccacattttataaacttgtcctagccctgcacacatctaagcaagacactgcattatatatagagttgcttgtgtgtgttttgtcaatatttttacatgataaaatgatgatgcactctgaatacgatcccataaatatagaagtttaaatctaaatacgatcaccatatttacgtataaaataccaaagagtgtagaagataattattttagttttatagaataactataaaaaggtgatataatccacaatattatcatgtcaatatcttaagaacaatttgaaaagctaaattattggaagaatatgggattatggagcagtgagagacgtcaacttacaaattgagagagaaaagagtttcaacaacttttttttggcagtgaacttagaccgaactaaattccttcttcaaaagtaatccacaaataaattaatattttatagcctcgttttcaaattaaaaacagagagaaatttggaaattccagtacgacgggagataaaacctaacatacgccatggtgaccgttatctaaactacgccaaaatatttgaagtgtcgtcgtttcataataaaacgcaaacaaaaacccactcccactttctcctttccaaaaaaagaactctcgccactttctctgctctttttctttctctctctctttcttgttttcgccggcgatcatg

SEQ ID NO: 31747 - DNA, 3000 bp, Unknown
  misc_feature (1)..( 3000): 2750-1469P.txt file - cDNA_ID_3045467; gDNA_ID_1971795; Annot_ID_175629
atacgttactatacccaaaataaaaggtttgattagtgagtggcccgcaaaaagtggaatgattccacaatactacacgttattaccaattacaagttacacatccattctattttgtgattatatgaaactgatttaagaaaaaatatccattaaatcattaaccatcattccagaaactcattccaaagattttgtttcactttcgacggtgatgtgattctgctatgtttaaaaattagatcaaactaagaaactacggctggtggcgcgagactgaccggagatcggagggctgacgatgggggtaaggaacggctgagatgagagtcatgaatgcaggggtgtagccagaccaggctcacatggacgaacgtgcccatttttatgatttggaccaaaaaccataatcggtttccgattattggatctgaaaccggttctgatgtgtcctacgaagtagtacttttgtcagaaactaattaatttatgaatagtgttaatttcgtgagtcaataataattggtggggaaataggtgggtccattaatccattgccctaattaactcctaatcattcaatgtattgtctatttagaaagggaaatttcagaaaacataattcgagatttttctatagaccgacaaatgtaaacgattctgattttgtattttgaaagctatagtataatgttttggtgtcattaattttaactcgatgatgcttcgaaaataaaagaaactaaagatggtagacgacacgtgatcaatagctaagtaaacatgtattgcagatctgcagacaatatacacgtaccaaagtttttgttcagttaacatttaacagattattattgcattgtttcatgtaacataactcattcactatattgcgaatatacggtactttctgtcatatcgtggtagtttaaacattttgtgtgtttatcaatgtgtatcatgaattaactcttatcgtacgttaaattcctgaatcattaaagaaacaaaattttgagatcatcttgtatatgtttaacgatgacgcatctgtatcttcaatcaatgacttcgttatatttttggtaactttgaggaagaacccaatgtaaaatttaattgatttgaatttatgttatgtcagattttgcaaatactccaatttattatagatatagataaggtattatatgacatactattattatcaattctgcaaataatccaatttattagggattagacatagtccttgaattgttaattaggatgattaaccttaaaatgaattaattatatcttaccattttttaatggtatgaatatctttataaagagttgcataaaattttaatggtgtaactgtatgtatccattctcttcaactgagtgaccttttcgtttgcgcccattgcaacaattataagtttcgtttaaactgaaattctctatcacgtccttaattttagccaaaattttgcagcaaattcggcattattattttattacactatgatccttatattaagagacatcacctttgtttatcgaagtttaattcttcaagtatgcatcttatattatccacttgacatatgtatatatgtgcttaaaatatcaaaaacatttgaccaaaaattttctaacttaaagctcgattctttttcaagtcaatgttcatctataatgttgctaaatatcagttttataattggtgaaataatgctataataaaacactaattttaaaagctcacaagaattctcataaataattatataatgaatcaagttaattattcaatatgtatgtattttaaaacattttcgtctttttagttaagccatgttcgtttctccatttgacagatccatccaactgattcattcaacatgtccatctagatgattcattcgactcttgttcgtttcatttttagtaggttcatttaactagaccatccgaatgagatgttgttcgtttgcttatctctatctccatccaaatgatttgtaataatacaaatacctaaaataccaatgctttcatctaattatatttttattattacttgtaaacatattaattttaattcttaatttaaaatatatttaaaagtaaataaattttaaataatagttttttacatttatgaatttattttacggttttggcgggaaaacgtgattttacagttttgacgggaaaactcgattttacggtttggcggaaaacataattttacgtttttgacggaaaaacgtaattttacgtttttggcgagaaaacgtgattttacgattttggcggggaaaaatgattttacggtttcggtgagaaaacgtgatttttgcggttttggctggaaacgaaaatttacagttttggtgggaaaaaacgatttgcggttttggcggaaaaacgtatttttacggttttagcgggaaaacggaattttacggttttatcggaaaattttgattttgcggttttagcggaaaatttaatttttattttttaaaaaaataattggaaaataagatttaagtctatttgtttttatctaaaaatacatctaaataatcaattaaaataattaggatatttttgtcatttgttaattctgactgaaccatctccatccaaatgatccaattaaattcagccaaatgagtttcaaaatttagcctaaattttcaaactcatccaaatgattcatttggatggatcatctgaatgaaccgttttttgcactaaacgaacatcaaaactcatctccatccagatgatccatctgaatgatgaaacgaacagagccttaatagaatctgaaaagagtgggtcctcaataattaaaaaccaagaattcaaggggatgggacttttcctataaagaagccaaagcctttctcaccattttctctcatcaccaaacaaacaaacacattcaaatctcataaacacattgataagtaaaaatcctctcgagagacaagaatg

SEQ ID NO: 31748 - DNA, 3003 bp, Unknown
  misc_feature (1)..( 3003): 2750-1469P.txt file - cDNA_ID_3045528; gDNA_ID_1971801; Annot_ID_175722
cagcctaacatcatcgatcaccggaccacatagcgagccagagtgatcgcttttcatgtggtaaaacgtgctcaagaaagtgacacgtgtcctggccgacactgccttgaacacaagcctcccacgtctaaacccgccttttcctttagaagcgtagtccaccatgaccttgccctgtccagcgaacgcttccacaatcattggtccctcacaaccgtctctggcgtctcccacgttgaacgtgagggcgtagaatttgttcagtgacgtcctcactatctgagaaatggcgctctctttgcctccaacaagctcgatggctcggtgtccttcggggacagcgaagtgtgctttgtctacgtacttaacggctttgagagactcgatcatccaaccgggcaatgggctgttatcgtcctcgatgaacggtgggatcagtactccccattttgccgtgggaaacacgtaaggtccttcttcgaaattcccattctttatcagattatctgcaaacagaggtcaccacttaatcaccgaatccggtttactctaaaagattaaaagatatgaatatggtcggttccggtttacttacatccagagaatctgggagggaacaaagccttgatagccacggcgtcgatcaaaggtccgcaagccgggtgctcttcaacaccagggttatggaaccggatctcgatttcgggaccaccagctttaaaagcccatgagtatgagtcccaaccatcgctgccgtacatcgtctggatagggatcacacctgactcatgcgtcacggatatattgagcctctcgtcttgagcgcaggttcgagcggcgctgaacgttattgagtacagacggccaggtaggacggatattttctgggagattgaggcttcgttgcctagtctaacggcggaggaaccctgcggtacgaccaagaccatgtcatcttgtttctgaccggatttaatgaactccacaaagccgattatgttccagtttggtacggcggttcgttccttaaccacggatcctttcatttgggagggtttaggacccaactcgaagttgccgtttggtaataaacctgaaacaaaaaatattaagaaatgttaatttataatctcggatttgagttgaaatgagctttaactagagttactaccatcgcggactggggccgataagacgacattcgaagagatgaagaggagagctaagaggagtgctgcttcttggtacatcatgacttccttgggtgatagatgaagatcagatggtgagtactatccaaagggtgaagaaaggctgggtttttatgagtttgagaatagaagacgagcactggttttgaagaaaacaacgggaatgccactggaagcatcctgggttctattgtcaggtgccacgcagacacagacagctagctcaggaaacatttgacttcatgattagcatttccatttcttcaatgtattgtttaaggggctgccttaacaaccattatattaaactatatattcaaacgtaatttgcgtttgcctatctaaattattcacataaattttcaaagtattaaaatattttttggctttttcagaaaaacatttttgaagatcagtacatccatgcgtaaacgccaaaaaagttctttttgaaaaaaggtttacgggtaagtattccttaaaaagtgattaatctggaaaaaacatacacactaattaatataaatatatagggtacgtaacaactaatgcaaacaaacaacggaaaactaaaatatgtagagaaaaaaacatatatatcatcaccactcaactataatgccatggttttggaaaatgaaagaaatataatgtatatttgagatgtctctaagattagtcatttaacgccatgcaactcatcccaactctaatcaataaaaaataattatgattttcgtatagaatgcgacaaccaaaagttaatgacgggggaaaatatgtgctgttttggaataaatcaactcaacttaaaaatgaagtcaaaaatggtattgattgatgttagatattgatcacattgggatgaacacgtgcaggggtaggttgttttctggtgcagggcacgactgccgactttaccgcattagaagtttcgatcaatattcctaatgtccttattaacatgtcaaccattatcataatccaaactcttcccaacatctttgattaaattatgtatacattagttttaagtttcaatttgttaggcaaagtagagagggacattatggtgaaaaaaaagacaagggacattaagaaactttagttatacgtcaacatatatataaaagacaatggttgggagagagatcacgtgcgacaaggctggaaagattgatttgccgtaatttcaaagcgaaggatttaaaaaaagatgagtcagaaaaaaaagatgaggatatagttcgggggtttgaacccgacgtgaatcgaacacgcaaccttctgatctggagtcagacgcgctaccattgcgccacggatcctcaggtaattacatctatacgtttacttatttatactaacaattagtgaatgataaaaaattaaaaaccccttccgattctaatttcctggcggagcaaatttagggtttatcgtttgcatcggtctcgcgtctcgtttcccacagacacatctctcgaatcttttgaaggccttcattgcaatagattgctcgtaagggataggtaggcctttatgttctgccgcttaatttcttcgccggattctgtttgattcattttaaggtgagtgaccccatcgcttttagattacagacaagtatgtatttatggtttgaatgatgcttattgtcttgttgttagcttagattttacattcagccattaatttagtattaataagcttcggttctacttgttttaagcagttaaatgctttaatctctgaatctttgaaacttgctcctctcttaggaattaggatg

SEQ ID NO: 31749 - DNA, 3003 bp, Unknown
  misc_feature (1)..( 3003): 2750-1469P.txt file - cDNA_ID_3045538; gDNA_ID_1971801; Annot_ID_175715
agaaagaggaatattttggttctgagaaaagacataaaaaaaacaatagagaaaccttgtaaaatcccgccaaaattttcacagaacccctaaaaaagtttgagtgttgccgccatccatagatttattccaccatcttcatctctggaaatccttcgccgccgcgagaattgacattgttttgattgcatataaatctccgcaacagtatggtacgttttgtttagatctacggttttgttatcatccgttaattcggcgacatcagcaacgatttgcttcatccacaaaccgaataggttcggtttaaacataagcctgggatttgagtcaattatttgcatttgcctacttttttcaattttctgggcacgccagatgtttgatgaattgctcgaatagatagatgtcaaagtgaagcgaggagacccgccgattcgacatgtacgggagaaaagggtatcagcttatcaaagattttgccaccggagagaagggtcagctcaaacctttcaacgtaagacttcaagctcccacctttatgacactaaatctctcaatttatacaggctattgaaatttttgagtatctgtaatctaacgtatatcaatcttgcaagtttggccagtaggttttgattataggtgacggaatgttagcaaatttccagtcctgggttgataatatccaattctgtaattagaaagtattatcttggttagctatgaggtagattagttctttaacctcttgtatttctaacagagcaaactctttgatgaaacaatcgaagagtgtgaccagaatcaccatcttatccagtccttgataaggtattgatccccttttttacactgttgcattttttcaatccatcacaaaagacttacttctgattcattgaggttgatgtttccatttacaggaaaatgcaacaagaaggtttggatgttcagaacaacagaaacgctgaccactatggagcactaattcaccaccttgctttgatccggaacaagcgctgcctcatggcttatgtgtgagaaccacgtttcctatcagtaacactatatctggacactcaatttcttaaaaatagctgcaattggtgtcgctatgcaggtacaaccgagcagaaattgtgcgtgatttggcatggagagtagggcttgaacttctcgaccttccctctgaaatccaagagaagctcactacactagagaaggaatacttcaaaaaccattcggttgctctaaaatcatacatgggaaaagtaggaatcgagttgaatgtcgtaagtcctctttccaccaccctggcttttattaattaattggatttttcttgtttggtggacttgtaactagtaatctcctcttgatccatttcttgaaggatatggtccctcctaaagatccttatatcaaggtcagaattttggatgatattgatgaaggaatcgtgctgagtgacaaaacaacaaattttgcccgtcattctatgcatttcctcaaacgtactgatgcggaaccatacattgctcgggtcagtctttttcgttattccttccctaaaactagaatgatctaaagcccataaacttccacgaactgagaaattcaaagaatgagccttgctcaaattcgcagagatgtagatagaaccttgattacagccttccctagcaggtttaataggaaaaaagaagactgcttaagatagattataactgaaaaaacgaaactatagaattcctgaaagatctgaatagtgatgcaaatagaagttttaggtttagaatatgcgtgaagtgtaatctgaagaattgacttttgtcacatttcttggtaccgtcaagattacataaggtcgaaacatttcataaactgtgagtgtattggattctttggttttccatgtgatgtttgtcatagtatgccaaaggagttgctaagcaaatgcagtctgattctactgcctagcttaaaaggggtctcgtgtcccatcatttggataaagagtttctaattgttgagatgtgaatgggataacagggccaaatggaggagctgacaggatgattgatctaatcagaagctgtggtgggctcagatgaatcacggtcgggtctgtgatcaaagaatgtaagcttacttagccttgtataattgtaagacaggaacatgaaaccagaaacctcatactcaaactcatgtaacaattatttatcttacaaagttacttctgtagtgcataacattcactagcaataatgcagttttgacaagctcaaaattaccttttttccaatggacaatctttcaaggcttcaatactcagtctttttgttacttgctggcttttcactatagaagtgaacctgcagctaaaaagataagaatctgccacaaatgctgcagaaaaatgagaatatgtcatctacaaaacatacctcaagattagcttgtaagatctgaatagtgatgaggcatttactcgaacgatgatcattgtcacatctctgattaatgtaaacgataaacggatttttgatgtttccatatagtttgatattgtctctttccttaggcgttttcaaaaccataaacataggtgaatgttatttacaatgtctctatagttatgattaatttgagttgctactcatcttgtttctgaaaggaggaattcttgcatcttttgaggattagttttttgacttgcatacagaaaatgtgttcttagtctcttgccttcttagttgttaccaccactgcttcgtcaatattttattattggattcacaacaaaaaaattcctctttattttttatgagaaaaggggaaaaaacacttaaaaccttttgtgttgaccagaaaaaaaaagagggataaaacgtgggggtattaatgggaatggggatgttccacatatttctgaaatttttttccctctgctacgaaacctttgaaatttgtgtcatcgaaatcgaaaccaaaatg

SEQ ID NO: 31750 - DNA, 3000 bp, Unknown; identical to SEQ ID NO: 8450
  misc_feature (1)..( 3000): 2750-1469P.txt file - cDNA_ID_3045544; gDNA_ID_1971801; Annot_ID_175711

SEQ ID NO: 31751 - DNA, 3000 bp, Unknown; identical to SEQ ID NO: 8430
  misc_feature (1)..( 3000): 2750-1469P.txt file - cDNA_ID_3045555; gDNA_ID_1971801; Annot_ID_175694

SEQ ID NO: 31752 - DNA, 3000 bp, Unknown; identical to SEQ ID NO: 8429
  misc_feature (1)..( 3000): 2750-1469P.txt file - cDNA_ID_3045559; gDNA_ID_1971801; Annot_ID_175692

SEQ ID NO: 31753 - DNA, 3003 bp, Unknown; identical to SEQ ID NO: 21580
  misc_feature (1)..( 3003): 2750-1469P.txt file - cDNA_ID_3045563; gDNA_ID_1971801; Annot_ID_175688

SEQ ID NO: 31754 - DNA, 3003 bp, Unknown; identical to SEQ ID NO: 21581
  misc_feature (1)..( 3003): 2750-1469P.txt file - cDNA_ID_3045577; gDNA_ID_1971801; Annot_ID_175682

SEQ ID NO: 31755 - DNA, 3000 bp, Unknown; identical to SEQ ID NO: 8424
  misc_feature (1)..( 3000): 2750-1469P.txt file - cDNA_ID_3045581; gDNA_ID_1971801; Annot_ID_175681

SEQ ID NO: 31756 - DNA, 3003 bp, Unknown; identical to SEQ ID NO: 19046
  misc_feature (1)..( 3003): 2750-1469P.txt file - cDNA_ID_3045591; gDNA_ID_1971811; Annot_ID_175742

SEQ ID NO: 31757 - DNA, 3003 bp, Unknown; identical to SEQ ID NO: 19046
  misc_feature (1)..( 3003): 2750-1469P.txt file - cDNA_ID_3045591; gDNA_ID_2926175; Annot_ID_199767

SEQ ID NO: 31758 - DNA, 3000 bp, Unknown
  misc_feature (1)..( 3000): 2750-1469P.txt file - cDNA_ID_3045606; gDNA_ID_1971812; Annot_ID_175791
ttgtaacccaatacggaaacaaaaattctttctgagcccaaaatgtaattttagccttagtattttatttacataaaagtccttttaatcgttggctattgcatttatcgcccaatacttgtctttgagctcaagaaatatagtttactaaaaggctgggtttttctggatttcttactcccaaaccgatacaagatcgaagctttgccttctgtttcttcgaaaatctaccatggctgctctacaataccttgaatcgcagaaaaatgcgcacccagagcttggtgagtggtacaattcgctcgcagatctgtaccagaagaagctctggcatcagctcactcttaagctcgagcagttcatcgctctctctgtctttcaggtcaatctcttgaattttcatcgtttcgtagttcttctgtgtgattagggttcatagatctcgagaaagttaataggagtcgtcatgttagacttgggtttatagagagatctgaaggattcgttccgactcttaggtgatttttcagattcattgaaaagctttgtattggtgaattatcgcacttctgtgaccaaagctttcgaatattttagctcagagatacccaaaaactcagctttacaaggtttacagatttgttaatgacgtgtttccccctgtttatgttcataatctttgcaggctggagatgctttaatacagctttacaacaatttcatcactgactttgagacgaggatcaatcttctgaagcttgcgcatttcgctgttgtagtctcccgacagtatcctgagaaagaagctgcagttagttatcttgaaggagtgattgagaagcttaaagctactaaagagtcaaggataaatgaaccaattagctatatagaaacacaaatagctttgttcaagcttgagcaaggtgaccagaaggagtgcaagaaaatcttggacgatggaaaaagcctgcttgatagtatgactgacattgatccatcagtttatgccaacttcttttgggtctcttctcagtaccataaagtccgtcaagagttctctgagttctataaaaatgctcttctttacctcgcttatacgtctgtggactcactctcggaatcatttaagctggtacgtccctctgaatgttctaatcattcatatatgatatatgtagtcgttacgttaccaaatggtcttttagcaattttggataagtattagcactctatgaaaggaaacttacagtgaaaaatgctttatctctgtaaattgctttgtgttccaatcaaaatgttaatatcatatactttcgtttctttcaggatttggcttttgatttgtcgctttcagctctacttggggagaatatctataactttggggaactgttagcccatccaattgtaagtttcccttcatcctccaaattagcaaaccacagatttattcaccattatagataaaagaacactgacatgttatatatgttatggcagttgaaaagtctgcttggaacaaatgtggaatggctttaccacattctacaagcattcaaccacggagatttagttcagtaccaagaactctgtcgtgtgcacaatgcatcgttgagtgctcaaccagcactggttgagaatgagaagaaactattagagaagatcaacattctctgccttattgagatcattttcaggtattcattctctgtaggagtcatcttatacccatatacagatgaaaacaaacttagtacttaacttgtatataacatctttgccacagccgacctgctgaagataggaccatacctttgagtgtcattgccgagcgtactaaactttcaatcgaagatgttgagcaccttctcatgaagagcttatcggtgagtacctttttctttcctctctctttctctctatctcattctatcagtaacattaaaaatctaaagaagattggcaagacgcagactcgaaatcttcttgaatgtgtgattctgtattggttgattgtgaaaactgaggagaatgagttattgcaggtgcacttgatagagggaatactagatcaggtgaatggaacagtttacgtctcatgggcgcaaccgagggtgttaggaataccgcagatcaagtcattgagggatcagctagacagctgggtcgataaggttcacaccacattgttatctgttgaggccgagacacctgatcttgttgcagcttaaactcttctttcctcttttttccttcactgttcgtttaagctacagattgtaacattctctgaggattaaatgcaacttccttttaagtttttaggtattacagttatacttttgaactttgttctccacagacacatgaatctatcctattaagttgagtttcatcgttagtgttgcctttaaggcttaagcctatttgcataacaaatggtccaacttttgttattagacgtgtgaaaaactcataaatctcaaatagtggaatgaatccaaattgtcaacttctgaaatgaaaagtgtaagggtaaaatagtcaaaacatattaaaccccaattatcaccatcgtttcgtttcaatcaaaattttccgattttgagattttgaaacagagcagtcaagtctcaaagactccagctcatctgtctgcttcgtaagctgctcgctctctaaatgttttgtcttctggggaatagattttagggatcatcggtagatgctgttggattgacataatccagatctgatttcttctacaaaaacatagctttcttctctgggaacaatagattttgattgttgtttctgggttttagatttctaatgttggggttttggtgattcgatttctcaataatgcttcaaaatcgaaaattgaatcggttagagctattttgggaatctctttgcgttaattcgaattagcatatttgcagaataatccaatgagctctgtttttatttgtgaatagatattgaggtccaaagatg

SEQ ID NO: 31759 - DNA, 3000 bp, Unknown; identical to SEQ ID NO: 31758
  misc_feature (1)..( 3000): 2750-1469P.txt file - cDNA_ID_3045606; gDNA_ID_2926171; Annot_ID_199535

SEQ ID NO: 31760 - DNA, 3003 bp, Unknown
  misc_feature (1)..( 3003): 2750-1469P.txt file - cDNA_ID_3045608; gDNA_ID_1971812; Annot_ID_175783
cttatatagtcacatcaacattgagacgagtcttgcgagaagggacaatgacggaagaaaacgcaacgccactgcaaccgccacaaacgcaggaggatgatgaagaggaaaaggcaatgtatgctatctgggcagtaccggaggatgacgtggaggatcggcttcagaggttaatggaagggctcaggtcagagtttggcggtccagcatttgatcctcacttaaccctcgttggacctttcccttacaaacttacggccagcgaggctaaacggatgttcaagtcggcgtgtgaaggttttaaggtgtatcctgctaccgttgaccaagtctccgccggaacttcttactttcagtgtctctacgtatctctccggcacaccgtagaggtatattttacatgcataaactgaaacaaatctttaaccgaaattgaaacttataagctaccggacattgtttttgcgtttgtcttatgtttacaggtaatgaatgctgccggacatttcatggcccacttcaaacccttcaccggaaaatgtatgatctaatctcgattaatcggattttaatatttggttgggaagtaattaaaacgttattattgtgaaaaacactaaaaatcatattattaccaagaaacgtgtttttttgtttctttctctttctgtgtacgtgtatttgaaacgttggattgttgcagtttacgtgccacacatgagcatactctacggcgatttaacggagagggagaagaagaaagcgttagagaaagcttacacgcttgattcgagtctcgacggattgaattttaagataaatcgagttgcattatggataaccgatgcagacgttggatcgtgggtgaaagttgacgaacatactctaatttcttaaatgaaataaagtaaataaatattatggttttgggcctagtctccaatcttcctcttgtgctttgtgtgttgtgtgcaatttgtctccccttattcggttttcatctgctgcattggtttagtaaggtatgatgttccatggttcggctcaaatttgttatcggtttggtctaaatgtatctttgcctctggcttaattctatgttaatatgaacatagtttatggatcttgtgggaatattcctccttctgtttcttgttaagtgttttggtttatatcttgaagaagaatgacctagtcaaggatttgaatcattggactcttatcaaactgataatatcataataagatgattcaagatataatatttaaaagcacacaatcatgaatcaatttggagtctagttgacatttgttactaaattactaacaaaaggttcaaaaagtttgaattgacattaaagataagaatcattgataagggtgcaggaggaggaaaaagctataagtaaacaacttgtcattcgtcgaaactaaaatatgatagctatgtgcatatgttttaacatagatttaaaatttaatgtaaagttttttcatcataatttagtacgagtataggacaaaacttggtaagattttgctcgaatttcgtaaaatataatactttcttgaaactttttatttaagtaacgttgacattcatgtgacgtgtatgtatccaattttggttaataagatgctatgaaatctaattattatactttcattcaaccactattcgtatctaattaattagaatattcttttaattttagtaaaccaaatgagctatagaaaaacatctctataagagtagctaggaaccaatttggaatgtatagttgacatttgttactaaatcacttagagaaactccataaagttggattgaaatcaaaggagaagtaatattaaaatgttttcagcaggaacatatgagctataattagacaacttgtcatttaagacaacaaattgattatcatcatgtcttaagatacgaatgtcaaaatcttgaccttgcatgttagttgttatacataactggttgaaaagatagttaagtctaaaggttgacaaatgatgaaataaaaattagaaaaaatgttaaagccatacaaatccacatgttgtgaagttgaataagtaagttaaacgagttttggttctaaactgaaatttgacccccaaaaaaaagatgaggatgcagatgtcaatctttacctattcaatgtacaccacaataaattgaatcacattcttagcatgaaaccttatccaatttgtttgtatattttttccttggccaactaaagtggctattatcaagaaacaactaaagtaccctgtaaattgataaagaaaacaagtggaaaatatgtaaatatatcattttagaattcaaaccaaaatagaactcatgtaatcttataattcttatcccctttttaaaaagtctttaattttagacatgactttaaaaattcacgagccaggttggttacaaacttacaaaaactcgtcggcgcatgtaaaacgcagtcgtttaaccgaatcgaatccaaacacgtgcgggttcatccacaccgttaagtttcatctgacgctgtttacatcaacggctaagatttgttattctctcttttcgtcaacgcattgttaccgtggcgccagatatgacgtctatatacgcgcataaaatcacgtgacaaacacgcgctcaacaaaagctggttcttctccttttcctctccgatgactttcttaccgaccagcttagtcttctccattacggcatcattcacctataaatttcgccgctgggtttaattctctattcattcagaaccaaaaaagaagaaacctttttgattctctttgcgatttctttgttcaatctcttctcagattgtgtgaatcgggtttaaatcggggttttagggtctctgttttcaaaagggtaccaaaaagtttggagctttactgtagaaagatttgatttttcgttgacccactccgagattttcggatacaaatcagggttttagggtttttgttggaatg

SEQ ID NO: 31761 - DNA, 3003 bp, Unknown; identical to SEQ ID NO: 31760
  misc_feature (1)..( 3003): 2750-1469P.txt file - cDNA_ID_3045608; gDNA_ID_2926171; Annot_ID_199527

SEQ ID NO: 31762 - DNA, 3003 bp, Unknown; identical to SEQ ID NO: 19349
  misc_feature (1)..( 3003): 2750-1469P.txt file - cDNA_ID_3045638; gDNA_ID_1971813; Annot_ID_175846

SEQ ID NO: 31763 - DNA, 3000 bp, Unknown
  misc_feature (1)..( 3000): 2750-1469P.txt file - cDNA_ID_3045649; gDNA_ID_1971814; Annot_ID_175896
attttgacaggcacttttagttttcattcaaccataaaatgtgaaaaaggagtatttagccgatataatacctctaaaagatagtattactctcatgttcatgtacctaactttctttgaacaaacattaacattgagcattagtatttgtttacgccgagttctacattcatgcatcatctgatcatataattaagaaacataattacaagagacaaataaaatattttcttaggccaagaagacaagaaccatgattaggatctccattgatatcgtaattatatatcatcatatttagtcttccaccagattgcgtttgccatgattatgttttcccgatcacatttttctgaagtcaaactaaaacatatatatcaatcccacaaaaagaaatagagtaaaaaattggcccgacgcgtataaagacctaaatgttgcactattttaaccaagtaaaaacttaagacatgagtggctacatatttacataagttaattatgtaaaaaccactttacaattttaaagttactgtgaaaacataattttttcaaagcacatatagcttaaatttaccagggtaatcaaatcgcgacacctaaacatgacatcatcatatttgaagaggccaatcaaattggtctaacctcccaaacccttcacgccttgaaacgtggtaagctaccacgcgagaagagttatggaggccataatatcagtttgactcctccagaaagctttagtgaacatatatccaagtcccatgaacatgagtctagctcatgaactctttcaattctcaacgtcaacgatgtccataacatatgttgcttacttttcatgaattttattttcttcaatccaataattcaaaatttaatataaaaattgtctaaaagtgaatagaagaaatatatattttacaatctaaaaatgattaagaaacaaggcaacaccgcacgtgtatcaaagacaaacaactcgccgtcacgaccagctaccgagtccgacccgaacccgattacatcatcaacccgacccgctatcactctacaaatcatcatcgccttccttcctccgccacctccactactcacgtacgcttcaccactacccgaaaacgtacacacagcctgacctttcccaccggcaaaaacacacgcgccaccgttaaacccatcaagaaccggataaaacctcatcatctcattaccatcagccaaacaccgtgcatcctcttcttcacacgtgcctccgttaaaacccgcacgtgacttcacaacctctctatactcctcgaaccgggttacagtccttgacccgtgttccactttgaaaatcatctcgatccgacccggaaactcgtcggagctccagcttgaatgaaatataatctccactacgtttcttgacgggtgaccatcgggcagctcggtcagtgcgtctgatgttcgggcagatttgcttcgtcgggtccggtttggcgggttaagtaactctgtttcggttcgacaagacttgaaacgccttagattcgggtcgggtttctggtttttcttgcttaaccgggtatcgatcacgtctttgacgcaatgtgagctctttcgactacaattgtaactcgacgacgacattagtgatttactgttgaaattgtagacatcatcgaacgcttttgatttgcattgcaatgatttgatccacccatttggcatgttcgggttcttggatccggatctttattgttcttgtctctctttctctcttcaacaagttatgtatatgtatgttatgaacaaaaaaaatacccgcgagcgttttatcatatgatcattcatattacgattttaccctctaatttttctcctgggcctggcccatatggtttacataatcaatacctagaaaaatatgatacttatttggtttgatgtggtgactcaaattgtataatagattgattataagtttctaaacaaatattttatgaaatccaaacttattattcgtatctgatttttttttttgtgtgtgtgtgtattcaagcgactgattttgttgataaggatttttatttattctttcttgaaactaaagttattgaagaatgaatttatgattaaaacaggcagagtgataagagagaagttaggtgaagaaagcaagaattttctttacatttaatgaggaaagcaaattgacgcagtgtttccttttaacatatcaagaattgaatgatttaagtgttgtgtcgggttttatttattgagatattgacaatcataaataggaatccgagtaactttactgtagtgtaacaataaggtaagggaatcagtaggaccgattcttaagttttatttgaacatacaaactaaaaaaacacccccattattgtcaaaagaaaaggtagagaaaaaggaaaaaaacttgtattaagatgtcatattgtacacttttacaagtatgaaaaacatcggaatgaagcatatagtaacaaattagggatattgattgcaacaactagagtaaccaacgattaagttatgtttgttttgcagttgctagcgacaatgatcaataattatattgtgttggttggttttgtggtcgctaacgaatagtaatattatattgatgatgaaaatttaaaacgttaaaacatgtatttgttggcaaagtggtataaatgaactaacaagaacaaaaataacaagatttagtcgcttttactggtcactaataactacgaaacgaagtggaccttaaaaatctaaggtggttatgttagcgaggaaagtgactgatcttttctctttatgggcttaataaaaaaggcccaagatgcacatatttttctaatggattagtgttcttctcttagaaagcgacgtcgttttgttagactcaacttcacaattaatttttttttctttgactaccgtccctttaaacgacgacggttttgtttttgacagagatctgttacgacagttatg

SEQ ID NO: 31764 - DNA, 3000 bp, Unknown; identical to SEQ ID NO: 8515
  misc_feature (1)..( 3000): 2750-1469P.txt file - cDNA_ID_3045656; gDNA_ID_1971814; Annot_ID_175890

SEQ ID NO: 31765 - DNA, 3000 bp, Unknown; identical to SEQ ID NO: 8515
  misc_feature (1)..( 3000): 2750-1469P.txt file - cDNA_ID_3045656; gDNA_ID_2926180; Annot_ID_200181

SEQ ID NO: 31766 - DNA, 426 bp, Unknown; identical to SEQ ID NO: 8542
  misc_feature (1)..( 426): 2750-1469P.txt file - cDNA_ID_3045665; gDNA_ID_1971815; Annot_ID_58223

SEQ ID NO: 31767 - DNA, 3000 bp, Unknown; identical to SEQ ID NO: 9887
  misc_feature (1)..( 3000): 2750-1469P.txt file - cDNA_ID_3045665; gDNA_ID_2096290; Annot_ID_195331

SEQ ID NO: 31768 - DNA, 3000 bp, Unknown
  misc_feature (1)..( 3000): 2750-1469P.txt file - cDNA_ID_3045665; gDNA_ID_2926169; Annot_ID_140050
tgtaattaaaacgacgtcgtatcatagttaaccctacgagaggaagtacattagtttggagaagagtaatagacagagagatagagagaaagagaagcagttcggagaaacaatggcggtagaagacactcccaaatctgttgtaacggaagaagctaagcctaattcaatagagaatccgattgatcgataccatgaggaaggtgatgatgccgaagaaggagagatcgccggaggagaaggagacggaaacgttgacgaatcgagcaaatccggtgttcctgaatcgcatcctctggaacattcatggactttctggttcgataatcctgctgtgaaatcgaaacaaacctcttggggaagttccttgcgacccgtgtttacgttttcaactgttgaggaattttggaggttaggtttttgattttattttatttccgactcaatatctggtttgttcaattattctgcatctgggttttgttataggtttcgatttgttgaggaaagttatgttctttattgggggattagaagatcccattgaagtcattatatgtttttgatgaattgctatgtttggtgtttgaattcgtagctaaagcttatgttagggtttagctttgatattctgttcacttgtttgtgaagtaaagtagaagagcaaagtttgtgagagaaagagaccaactttgaaatctttcttagtggttttctaggtatcagaatttgagcaaacactttcgtgatgactgagggttgatgttgtatagttcttgctcttcccaatgagattcataggtttgtgtattgttctttcgacttcttattttaaaagacattttggtttgcagtttgtacaacaacatgaagcatccgagcaagttagctcacggagctgacttctactgtttcaaacacatcattgaacctaagtgggaggatcctatttgtgctaatggaggaaaatggactatgactttccctaaggagaagtctgataagagctggctctacactgtacggtttctattcttcttttattttgactcgtaactcctgcgtcatcatccaattgaatctcaccggtttttctttttacatgcttggtttagttgcttgcattgattggagagcagtttgatcatggagatgaaatatgtggagcagttgtcaacattagaggaaagcaagaaaggatatctatttggactaaaaatgcttcaaacgaagctgctcaggtaaatagaaaagacctttctcatcaaaactcatcaaacagtctctctgtgtaaaaataagactttaattctcgtctgcatcaaatgttgcaggtgagcattggaaaacaatggaaggagtttctcgattacaacaacagcataggtttcatcatccatgtaagaagaaagcttctcataattctaattcaaaagtcttcattttcttcagatctctcattgtttggtttggtttctttttttttcaggaggatgcgaagaagctcgacaggaatgcaaagaacgcttacaccgcttgaaacctctcaaatctttgcattgtttcaattacagttttgtatgtgagagatctctatttatctaaacatgacttgacagtctgtctttgctagtgttgattgttcacgaagctctaacatttcatttagtaatatattagtatggttcttcataatatttacgttggtgcccttgtataaaaccaccggagtgagcgcaagctttacagacaaacagtgcttctgtctacccaaggcgggccttaaaagcctgaatagtgtatatgtttacttgacaagagcccatgtacactcatgagcgattgactttaaccggttttagagaaaagtacttttacattgtcacatttacatcctttataattaaccttttaatttaggttttaaagatccacctcagcatttattttaatggaatgattatttagcagtgtgaaccgattaactcggtttttgacggtgaccggtttagaggaaatgggagtgtcggtaggagatctaagtagcgagtatgtaaattgtccaactgtctgaaaaggaccacttgggacgacaagattcttcggctaataataatacatcactcgtttcaacaaataaaattttcctttctattattatgcaatcttatagcatatggatttgatcttttttaatatataaacaaaaggttttccaattatgctaaaccataatctgaaattgattttaaatagctacaatcaactacccaaaagcttcaaatatgcaaaataataaagtataggtttatatatataaacgcacacaaaagaggttgaataaaaataaacataaggatgcatgtgcagtccagattagatctaaatctattgagtattgtaataatattgttatgaagatcttgctgcgaaactacacacatttaattccaacatgttttgtttatagaaattgaataaaatcaaacgcgccttcatcttcaagttaaaaatcaaatcttaattagtgaagacaaagaagaagaagacattattttaagtgagttctctctctgtcacactcacaaagctttatactttctggctactgcaagctcatcactgaaaagagcttaaaccagagagatctgataagagaaattttagagtctctctgcttcaacaagatctacatcgaccaggttcaatatttttctctactgttagttcgtgttctagctctgtttcaacgagatccgattctgtgttttcgatttcagtgctaaagttacggtctttgaatctttctatgttaggattagtcttttgaatccataaactctagatttcaattgttaaaggctaggttttgattagtttgaattagctagatccttttttaacagatcttgatgtttaagctcaaagttgtgtcgttatactgagaatcaagtttgtgatttgttgggaatggtttcaggagattagaaagaatcaatg

SEQ ID NO: 31769 - DNA, 3000 bp, Unknown; identical to SEQ ID NO: 31768
  misc_feature (1)..( 3000): 2750-1469P.txt file - cDNA_ID_3045665; gDNA_ID_2926169; Annot_ID_199384

SEQ ID NO: 31770 - DNA, 3003 bp, Unknown
  misc_feature (1)..( 3003): 2750-1469P.txt file - cDNA_ID_3045678; gDNA_ID_1971815; Annot_ID_175942
taaatttatcatatgttggaatatttagtgttttattcaggatgaatcatgtgttggaataacagtaaatatttcttctttttttgaagaacaaggataacagtaaatagttcagaattactttttaccatagaattggttcatctctttcaaatctagtttttgttctgcaaataaatttgatttgaacgcaaggaaagactcacaactcacaaggcttccttttgtagggttaatcactcacaaatctggtttagcattacaaaataaattgtccgttcttattattaaactccggaaataaaagaaataaattcactaatatttctaattagcatcttcacaaaattcactacctacaacatctataaccaatacaacaacaagaaaaaaaaaatctaattgccaaaaaaaagtgtataattatttcttcttcaatttttagattgcgtttgaccagagacttcaccaaaccggcgatgatcatatcctctgtttctaataagttcagcgaacgtaacacaactctctgtctggctatgtcctctcgtgaccttaatctttacatgttctggtaatctcaatgtatacttatcttcttcctccggtttatttctcactatcgagtgtcccgtagaatgcgatctagagaatttctccggcaagttttgttcctttttgatgctactggtctgtcctgaagatggccaagtatcaatctgtgttgttgtctgctgacgatgatgatcgtcttcttcgtcgtcgcttgtttcttgaatcacatctatgatcatctcatcgacagtaggcttggtgttttccggtggcggaggaggatcaagatcccgacgacaaacagggcaagttctgtgagattcgaaccagagatcgatgcattcttggtggaacacgtggtagcatgttgtcaagagacgtagcacgtgatctccgtcgaattcgagaagacaaatggcgcattcgaggccgtatttctcttcccggagatctttaacggaggagtaaggaaaagtgggaaatgagttaatgattcgaagttcaaggccgggatttaccggtggagcttccggttgctggaggggattgtcggatacggtgtctccgccgtggtggagacgccaagcttgcaccattgtgtcgaggaaacacttgcaaaaatagagagtgaagaaaccgatgaagaagaaaacgaggaggattacggtgaggatcaccgtgagaggcggtgtaacgtaatgttgttgcggaggttgcggtgccagaggtgaaggaattattgtcgacattacggtggccggagactgaatatctccgccgtgagacttctcatataccaaaaaaaaacaagaaagcgagagacaagagaaattcacttatttcaaaggttattttaattattagagttcagttttatttggtatagtgtgtggaaaatgtgtgtttggtgtgagagaaagagtgttaggaagttttggttactaaaaataaaaagtgtgttttgggtttggttatgtttgtttggtttgtttgcttaatgctatagcattgaacgagtcgtctgtgacatttgtttaacgttaagccacttcgtccttaaaaatagttaagttttttttctttttctttggttttaatagtatataagtctcgtttctaacaagcaataattaggatttaggttcatgacacatttcggctaatggcttttctttccttatatatacacaattcatcaaggtataaggatgttttgaatatacttgtttggtatgatcggtatacttcataaatcaactgatcatcaaaaactctcgatgaacgaccatattcttcgaaatcaatggtcattgagctatctttgtatttggtatacttttgaatcaacgaacatcggatcaactagttttgcacaagctcattccacaaaggtgtccacacggacctcaattgatgttttgcacgaagagacatgcatatatcggggatgtgaatttgcaaaacaaggacatcagtcctttagagctttggttgcttaatcatttccattttttctatttgaaaattttaatattatgaagaggagacaaaaatatagacccgtcggtaatcacttatctttgttttgacaataatattataagtcaagtactagtttccatcttccacagttagtaaacaaaactgttactgtattttataagatcatctttaccattaatagtgtgaaacaaattaaaagacaaagtcacaactagataacaaccatattatatgcatttgggaaaaccttatcttatcttatcaaaaacagcaaaatatccccaattgaatcagtatagtgaatccagatcttcccaatttcatagttaaagacaagaaaatgaaatgtcattttgtgtgattgtgatattaatcattcacatattaacatcattctcatcccatcgttaatccattacattttattgtatagatttgacacacaaaacaaaacaaaatgcatgcaaagacaattagtaaaacaacttctttttttgatctaacatcatgaataacatttggcatgacaacagaaattttatagtttcgataataatacagtaatactcatagttttatgattctgactgaatcgccaattgtttttcattaaagagaaaaatactatggtaaggaactaaggatccatgtggtaatcgaagagtcgtcgatcacgtgcaatcctccacacgtgttaagtcagctcgtagttgattcttcccccttgacggtcatctcatcggacggttgagatcagccaactttaagtgtatcacacggaaaagggaaatgtagcgcgagaaagtcaaaagatccaacggtcgatatgaaacaaaagtcagataatcgtacggtagaaacgaagctatatatagcaacaattggattattcttatcatcatcactctctgagatcgaagagaaagcaaaatcaaagttgtgatg

SEQ ID NO: 31771 - DNA, 3003 bp, Unknown; identical to SEQ ID NO: 31770
  misc_feature (1)..( 3003): 2750-1469P.txt file - cDNA_ID_3045678; gDNA_ID_2926169; Annot_ID_199373

SEQ ID NO: 31772 - DNA, 3000 bp, Unknown; identical to SEQ ID NO: 8533
  misc_feature (1)..( 3000): 2750-1469P.txt file - cDNA_ID_3045682; gDNA_ID_1971815; Annot_ID_175937

SEQ ID NO: 31773 - DNA, 3003 bp, Unknown; identical to SEQ ID NO: 20373
  misc_feature (1)..( 3003): 2750-1469P.txt file - cDNA_ID_3045686; gDNA_ID_1971815; Annot_ID_175934

SEQ ID NO: 31774 - DNA, 3003 bp, Unknown; identical to SEQ ID NO: 21326
  misc_feature (1)..( 3003): 2750-1469P.txt file - cDNA_ID_3045692; gDNA_ID_1971815; Annot_ID_175931

SEQ ID NO: 31775 - DNA, 3003 bp, Unknown; identical to SEQ ID NO: 21326
  misc_feature (1)..( 3003): 2750-1469P.txt file - cDNA_ID_3045692; gDNA_ID_2926169; Annot_ID_199363

SEQ ID NO: 31776 - DNA, 3000 bp, Unknown
  misc_feature (1)..( 3000): 2750-1469P.txt file - cDNA_ID_3045698; gDNA_ID_1971815; Annot_ID_175923
tgcaaaatcattatttgatataccatcatatatcgataacatgcataagctaatatccgctaaattaattaaaataaaatcattatatacttctcgctcaatatgagacagttcattgttatcattgagtatagcctctgcaacttctgcatttttaacactatcgccatcaccatcatgctgcacatacgatgtcatttgctcctcattctaaaaacgtaaatacgtaattaactaattatattcatttttccatggaaatcaaagatatattcttccatcatgatgaacagaaatggataatatatatctacttctgagaaagatgttctgtaatatcagattcgtttaagtcatatgtgttcttagaggaaaataatggtgtcacctctttagatacaacaatatgatcatagtcatgattgttcaaaatcatagttgatattctatattatttcttgacaaatctattagagtccaaatccctgaatctttaagaaaaaaaaaactaaaacattaatgaatctcaaacatcaatagtaatgaaccacgatttaaaacctgattcataagaagaactaactaatagaattgatgattgtgattttctaacgataaaagaacagagcaaacaaaatcaacacaattgaaggagagaaaagggaaaaaatcttcataaataaaactagagaagtgatcaatcttaataaatttatatttcactccttgatatcatcaaattttaagataaaaatgaaaaatcttggaatccttgatccaatttgatttttgattcataatcaggatacaagttataaacaaatgatcatcttgaatcataattagacttcacaaataaaatttccaaatcattcataactttgaaaaaaatataaaccatatataatatcctaaatttatagaataacaataaaattattttagccaaaataatcaaaacaaaaaccataattcttcgaaatttaatacgtttttcacttgatgcaaagaaaaatccaaatcaaagtgaagataaatagatgaattttgaaaaatacttacataaaagtccaaacaacataaaaagtgatgagcaaagagggagaagatcacaaatatttaaagaccaaatttagagccagtacatcaattcattaacttattatgttaatatatcttgtcttattttattttctttgtaactaaagcaatttaatgatgaattgtatttcgattatctattttaggaattatattcagttagtatttgctcttattatctcttgattattattttaatttaatttaattaattttagaccatatatgcttgttaacttttaaatagaaatagatttatggctctatttttgttatttttgttatgacatgtgtttgaattaagaatacatataaattgagatgacttttgtatttgcatgtgtaacctaagttatgaaaacaaaatgtaatatcgtcgtaatgtagtttttatatattgaaccgcccacaagtatattcatgatttaactcaacgatttagtcctaaaactggtgggcctactctacaaatggctacattaggatttgggaaatattatattaactcttataatcaaaaactttaggttacatatagttacatagtaaaagagtttcctattgtatacgatcaagtagtatatattgttttgtcttttaatcgtgatagagaagtacatatatgtctcgtcacaattatatgtattttttaaaaactagtcgttatatgtgttaagtatgaaatagatgacataaaatgaattagtatcctttggaatcatgaagtttctatattaagtatattgatggacgtcaacaattaccagatcctaataagtgcacatcatgtatatctaacatttcatccctatgttaagattagagatatgcacctcgtatccattgataattaatgattgtttgtgatgtcaatttttagtaaatgtgtgtacgtctattaccagatgcatgtaggtcgaattgcaacatagagtagcacatttttttcttgcattgttccttaaataaaataagcaaaatacctttgaaataaaatcattttgcaggcttaataggtggctacatgattagcagtatatgaactcgttggatgatacaatgtttatgtttttgaaataaaagcattcaaaccaatctcatacaataatagatagttccatatccagcataccatctccctgaggtgttcgtggtgctccctcccaagacacttgtttttagagtttttttttttttctctttcagaaaaccaagacatattctttatgagaatttccctagctcatacactccatcaaagtcattcttctctttcaaacatacttaagatccctctaggcacaactcttgtgtatcctttttcgtaggataaacttcacataattaacaaaacccaacattttcttgtgtaaaaaaaaatacgaagaatgttacatatgttgtaatagtaacgcctcccaaaagaaacaccttatgggaaacccacatgatacatatgttatacatgctcagtctcattcatatatgttaagatgtcaagcaatggatatgagtctcattctgacgaaagcccattaactaaaactatggcccattttatgtgctgcacaaaaacgaatgggtaacgtgtagacatgcaaagtggtacaaatcaaaatcaatgatcaaggtaacgtagtcaagttcaattactctttgtcaaatttaagtggtctctattactaaactatacacaaccgttagatcaaataattctctaccatccaacggtccaaagtctccacttctatttattacaataaaatgagaaaataaaaacgcgcggtcaccgattctctctcgctctctctgttactaaatgaagaagagaatctctccggcgagatcaccggcgttattccgataatttcgcctgagagttgtcgcatgttataaatg

SEQ ID NO: 31777 - DNA, 3000 bp, Unknown; identical to SEQ ID NO: 31776
  misc_feature (1)..( 3000): 2750-1469P.txt file - cDNA_ID_3045698; gDNA_ID_2926169; Annot_ID_199357

SEQ ID NO: 31778 - DNA, 3 bp, Unknown
  misc_feature (1)..( 3): 2750-1469P.txt file - cDNA_ID_3045702; gDNA_ID_1971815; Annot_ID_175922
gag

SEQ ID NO: 31779 - DNA, 3003 bp, Unknown; identical to SEQ ID NO: 27958
  misc_feature (1)..( 3003): 2750-1469P.txt file - cDNA_ID_3045702; gDNA_ID_2926169; Annot_ID_199356

SEQ ID NO: 31780 - DNA, 3000 bp, Unknown; identical to SEQ ID NO: 19836
  misc_feature (1)..( 3000): 2750-1469P.txt file - cDNA_ID_3045710; gDNA_ID_1971816; Annot_ID_175978

SEQ ID NO: 31781 - DNA, 3000 bp, Unknown; identical to SEQ ID NO: 8543
  misc_feature (1)..( 3000): 2750-1469P.txt file - cDNA_ID_3045717; gDNA_ID_1971816; Annot_ID_58224

SEQ ID NO: 31782 - DNA, 3000 bp, Unknown; identical to SEQ ID NO: 8543
  misc_feature (1)..( 3000): 2750-1469P.txt file - cDNA_ID_3045717; gDNA_ID_1971816; Annot_ID_175965

SEQ ID NO: 31783 - DNA, 3000 bp, Unknown; identical to SEQ ID NO: 8543
  misc_feature (1)..( 3000): 2750-1469P.txt file - cDNA_ID_3045717; gDNA_ID_2926175; Annot_ID_140311

SEQ ID NO: 31784 - DNA, 3000 bp, Unknown; identical to SEQ ID NO: 8543
  misc_feature (1)..( 3000): 2750-1469P.txt file - cDNA_ID_3045717; gDNA_ID_2926175; Annot_ID_199814

SEQ ID NO: 31785 - DNA, 3003 bp, Unknown; identical to SEQ ID NO: 19751
  misc_feature (1)..( 3003): 2750-1469P.txt file - cDNA_ID_3045752; gDNA_ID_1971819; Annot_ID_176090

SEQ ID NO: 31786 - DNA, 3003 bp, Unknown; identical to SEQ ID NO: 19751
  misc_feature (1)..( 3003): 2750-1469P.txt file - cDNA_ID_3045752; gDNA_ID_2926199; Annot_ID_201740

SEQ ID NO: 31787 - DNA, 3003 bp, Unknown
  misc_feature (1)..( 3003): 2750-1469P.txt file - cDNA_ID_3045756; gDNA_ID_1971819; Annot_ID_176084
ttcggttacttagtgatcatgctttacaagaatgtcaacgaatcaaactttagagaattttctaacaagcgtttcaaagcacttcgtgctgtcgctcatgatatttcagatggacatatctcagtgttcaatgatgtggaagatgctatctgctatcgaaactcgtatggtcagaaccatcagatccgtaaagctgttctgagtgctgtcctcggtagcaaaaagaatgaccactgttatttctctagtgttagtcttaatgttgctaaattcctttcttggacagacatggcaggatattatgttgtcgaagaaaatcttgtttatcctgattcccctgttctcaaagctcctgagttagcaactgaagtaagcaattggaaaaaagcagatcaagcaatcaaggaaactgactcgcctgagtattacaggatcttgcatgaggatcctgcgagctgctctatacttagaagagcaaactttccgacgctcattgctgtcgcagagaagttgaagaatagagtgcttggtggcagcaacaaggtagtgaatgcagagatatctgacaaagtagactactattttgatatgcatgtcaagtagtacgcttctggccgagtgtgcgaagccaccgagcgtattgtcgactactttgaggaaaattctgagtcattagcgaagcttttctgtagttagggtctgattctacatggcgtcctgttttttttttgtttttttttttcttgtgcaccacatgtgtttaatcagatattttagtatgttgctttgatttttatttgctgtcttaaacttcattaaaaaagaattcaaggaagagattcaaaaacagaaatacaaagcatgacagttcaaaacagagcacaattgctccgaatatgtaaaacatagttgagactaagtaacagttagcccaaagaatttcttcactacacgtattgtttatgaattctaagatttcttaaacctaaacaaacctttcttgggggaaaaatagtatattcttccatgtctgtccaagaaagaatattggccacatatgaacaaatatcaccaaaagaatctccatccttggtatgattgagaaaacctttcaggacagcttttccgatctcagggttctataccataggtggaccgtaagtaggtcgagtgatcctcatcattgaacactgacacatcttctcctttgatcggaacataaccagctgcatcaaaaagtattctcatatgttgatcagagctgacttcagtgtcattcttgtaaagcatgatcactaagtaaccgaagagggccactgacttttttggttctaccaccttttgtgggacgattaaaccgtttcttgcggcagctgacgggaaacttatcgttcgcaccgtacgacccattgcacgaacagcttgttgcagagcatcagttacttccggcagtaataggtcgctctctggtccctatcggtcaggtattcattctttgcacactcaagactcaactgaaacgccgcataactgcgattcgcctccgttgcagcagacgcatcaccaagaatcatatctacttacatgctcatacagtcatacttcaaataaaaagattgaaatcgaaagagaactacttttgtttgttggctttagaattaaaagatctctataaatttagggtttcagtggagacgttttataaatacggagtagaagttggaacgttgatttgagagacgtggctcttgggctaggtacatgcatggactcgatcgggtccatgctgacttgtctttgcagtttccttctagtgaaaacgtcttgccgtttatacattcggcggggttaatgaaaacggagtgttgtgtcttgtgtgcgtgcgtagttcccaaaatacgacatcgattctactttctactagtttttaaaagcttttgcagtgcacatttgttaatacataaaggtaaagaaaactaaattttcatatatactcataagcatttaattaaattggacatccacaacaatctaatttgttgtcttttatagtgtatagttttctgattttacaaatctatctcatcaaagtcaattcttattgcaagaatctctcttgctttatttctcattaattttctctttatttatttttccttggaagttggaaccaagtaattattagttgttcaagcctctctaaaaaaagataaaaaaaatatgagttgtacaaaggttttttgccaaataatatagttggtgggattaattaccaaaagaaacaaaaaattaatatgggattatgagttaaaaaaaaaatacttgttgaaaattgaaaaaagagaagtccgttcgttcctcatttggagctacagtgaccgtttctagtgctcacagagagagagagagagagagagagagagaggcgctgtggatttgtgggagagtagggacatcagaggattcttcgatcttcagattcttactcgacgaatccttaatcgctcacctgcagttgttcttatcctccgcttattccgtcgagtgccgtggcggccaatttcggcaactctgcgccactgatgattttgatggttagatcttttaatgttcgtcctcctccttactctccgaatccattttctgtgttctttcctttctgtttcgtataaaatcatgtttcattgagctcgattatgattatatcttgtctacggtcattttgacgacgacgacagtgatgatctttgccacgcgcatcgaaaattgaattttgttttccccattttaggaattgagtcatttggatgtggttcaaatgatatttggtggttctgtttttgaatctcgtattctcttggaatatctgtatacaaggtctcactggttaatgtttcttctcttacttctgttcagtgattctaaagagtgagatgttaaagcagactataagatggatttgatacttcatccagtagtagcttaagaaatattgcggttatg

SEQ ID NO: 31788 - DNA, 3003 bp, Unknown
  misc_feature (1)..( 3003): 2750-1469P.txt file - cDNA_ID_3045760; gDNA_ID_1971819; Annot_ID_176080
aaagacaaacatcttatgctactatatatgattaatcatagacatgtgctataattaacccttgtgttctaaatatgtgtctctttataaaaaaaaaatatatatatatatatacttgtatatatcacatatgtgaaattgtctataataagatttatttttttttggtaaaattttaagtaataagtttatatttgcgattttttcttaccgcttttaactattccagtattgtttatcacttttttatacatccttcaaaaatattatatcgtttgtgtcaccgatcgtatatatgtcatgataatagtttttcttgttcattatgtgatgcataaaattcacgtcacacaatttgacaggatatgatgaaacagttttagtgaaaacaatcacaaacattgatatgaaaaaactacgtccaaataataacaagaacgcagccaacttgcctattcaagaaactatagtgctctataaataatacattttgaaattattaaagaacccaatatatatattcctcgatgattgatctagcttttgaagtttcctttagttctaactaatgaggatataaagaaggagcactatcaagtttgaattacaaaggactcaaattaggaaccaagccgcacttcccgtccaagaacgtcacaacaaaattaagcttgacactcttaaacaattattgcatctctatttttactttattctcattttgattcgtcaaatatagcaatgacagattcaaaaaatcagtccatttctacagctaaaatactttcaagataattagaatcatgtaagtataaccacaagcatggataaaacagaaccaaagttaaaccaattcatcaaaatgactaaacaaactggccccttttcatttaaaccggaacaattcttgttattcatttaagaattaactggtagtttttgtaaaaaaatgcaatttattagatgaataatgtcattcgttttaatagaatgttcattgcaatgctgtcataaatgaaataaatatgcccattcattttttctgcgtttggaaagtggaagaatttttcaagaggatcggtcattcatgcatgtaatgatgcaacggaataagaataaccaaacattcgatcgaaagtacttaaatacctaaatgtgcttgtcttaaaatatatctaagatataggattcaagatatctgaatatcatatataaaaaatgaacatacagatacagtgaatatttgaatttatgaaatatgggattgctcgattggaaaagtaccatagtccattagtccgagtaaaggttttaaaagcttatccgaatctaaagaaatgtacgaattttggcttagaatctcttaattacaacaaaaaaaagttattaggtattaaatttttcacctgatattggtgatttgctatatacatctgatttagatagaaaacaaaagttatactttgagataaatccaaaaccctatattctggggctctataaatgttattaattaccgtctctttgtagcgcttactccacacaaaattgtaatatttaaaagatttaaaaacaccaaaaagagataagttagtgtgaattgtggaagtaacagctagaattccaacgtgaaggacgatagtgaatgaaacacccaaaaccaattaaacttagtcatgatgagagggatgcatgaaactaatcggcgatggttaaaggtcagcctcatctcatgtctgtgtcttatctcatatatgataatcacccacaatatctgtatatggtcctcgtcagatttcactcattttgtatcctcgagaaattatgcagtactactagttacttattggcagattttttattgctccatttccatagtatatataatatcatttaatttgtaagatatattagtgtttttgacaaaaaaaaaaaaaaaaaaaaaaaaaaaaaaaaagaagaagaagatatattagtgttgtctatcaacatttatctgtcggattcaccaggtattaggaaagaagcccgactatttgtttcgaaattttattgtatgtcacatgaatacgtttcaacgtgatgcatatgttattaatgtatacatagatacatacatcatgttgatatcctttcaagaatatctagatcataaattcataatagatatgttcatagctagaattagaagaatactttactagaaaatgaaatgaaaatgattagctatctgataaaatgattaaaaaaaaaaagtctactgaaggaggatgataaagtttaagtgttgagattttattcaagttatgtagtatacaaaaaaggggatagttttagacttttagtagtacgaatagctaatcttctaaattaattgctatctattacactacactatcaataactaaaaatgaataaatctagtgcagtttattcaataaaaatgtcacgaattttacataagttgtaaacatccatctattaaaacataatcacacaacatctattttgttggaataccataaacttttacttgacggctacataaacatgatacatgattaacataggccttttaaaaaagcaaatatatatgactagaagaagaaagcaaaagaaatggtagaagacagaaatcaaaagcgtgcaagaattatatatactatgatatgggctccaactagagatcacttgttgacaaagaagaagaaaaaaagagagagagatcactttggaaataacaatggcgaacaaaaggacaaatatatgccacgtcatccctctccatccacctttatgtcatttctcaaaaaaacaaattttttttatccgattcattatcaaaaaataaaattaaaaaaaaacaattattttaaattatttggttagtgtttcattataatttttcttataaatagggtctttaaaccttccaagaagtcatatagaaaacggcttcataaaaagaagatagaacttggataagtttagaagatagaaatg

SEQ ID NO: 31789 - DNA, 3003 bp, Unknown; identical to SEQ ID NO: 31788
  misc_feature (1)..( 3003): 2750-1469P.txt file - cDNA_ID_3045760; gDNA_ID_2926199; Annot_ID_201731

SEQ ID NO: 31790 - DNA, 3003 bp, Unknown
  misc_feature (1)..( 3003): 2750-1469P.txt file - cDNA_ID_3045764; gDNA_ID_1971820; Annot_ID_176142
gatgatgaatgacgatgatggtgctgacttgaaaggtggaacacatctctatccaaaaataaaaaaacattcttgtaatgtattgtgtgctttcatgtgtttgcagtgtctgtttttgtctcctttcaagggtttgtttccaggtctgctttgatttgattcccgtgtatgatgacttaataaagacgtttccttatcctttatcaaatctttacatctgtattcaaagttagaatcaacgatctaagaagaagagcttaccatgaacccactagtttctggacggttaaagggaccagaactagatacaatattcacaagaattgcatctacttgactagattaggtgtatcatatcatttgatgctaactcttggggttataggctaacctttaagcttcctccttcacgttatgagccactgacagcatcaggaaggtccttaagaacctaagcaaatgtaataatgttctccattagcttcttactcaccgaagataacctccaggttttcgacaagtaacagtattataattagaacgatgtgagatttttgcttcaaggtcgttgagtgtgagaagatggtttttcgttgttgttaccttgtaaagatgccatgaagcataagcatccgttgctgcgtattgtaactgctgctttgacagaggataaaactcccagttcccaagcctgattctgtttggcttcaggagctgcaaagtaacagtcagattttcaaagcgaaatagatcaatattctcacttttgatacagcagaacagaagagagttgtactgctatttctaggaagactggaaatatgataaatccagttctcactactgttatcaaaacttaaatcaagcttttgaaatcaaccagacaaggtgaataacagatacctctttgcaaacaagtgtctcagttagtgaggcaaggccccattttttatctccaccaattttttggttggctaaatctgaaagatcctcaacatctttgatactaactccatagtcatggaaaagcttcacagagtcaccatcaattccaatacctacctatatatatgtatcagaactacgttaattgagcatccatggcaaacaacaagaacttcgaccacttcaaaaaaaaaaataacaaacctttacaagtgttgaatcttcaataagatgttggagactttgagggataccagaatgaaaaatatgcataacatcacaataattactatctacacatatctggacagtcgcaaccttccccgggagaacacctgaaaataacacaaagtttcacaaaatattattagttaagatcacaaaaacctcacaaaggttcatgaatgtgtcaaaaagcattatcaagcaactatcattacaacacatatgagtagactagtctaagagatattattagtagaacaaagcttgcagcaatgagattctagactacacaaaactgcaatagtaggcatctacactttcctccgaacattcagaaaggaaacaacgaccataaagctctattcgatataaagcaagagcatcatcattctatcatcaagatatataaagagaaattagaaaagacaacatatgatccatagagataaaatacagttcgagatgcatatcacattgcatactttaagaaatgcaatcgaaaaagacaaaacttgcaatcagacacaaaacggaaaacagaagggttaacaaaagcaccttttctaaaacttggtctccactcaatatccaagccaacaaaagctattccagattcatctctcttggtatcaagaactttaataagctgcattgctcgcttatcaacctcagtagcagtcttgctatacaaaatcctaccaccaaacctcattgctggaaaattcctagctgcaacaaagtatacacattattaagttgctccgcccacataattcaaacaacacactattacgaaaaaaatcttaatcctataaattacggcatgaacagattaatacattgtaaagaacttggaattcgaatcaaatggtgagacaactaatgaattgacattttcaaagcaaaaagaagttgaaattggaaaatagaacagaaagatctctgggatttgaagaagtttcatacctcggcaacgggagagaggaaatcgtttataagatgtagaagaagtgatggaacgaggcaattggcgacggatattattggggatttgatttggatcctcctcgtggccatggacggaggttgtagcttgtacggtcggagcagcagaggaagaagaagaagaagaacgggagaaattgtaggaagcttcgatggcgtcgatagcgagaagctcttcctctgtaaaagcgtcgtcgatccaatttgacgatgacatttcttttactgaaacaaaaaaataaaaattaatgctttggacgagtctcgtcggcccctttaaatgtttgtattgtttgtttttaattttaaacgttcccacactgtacaatatagttgtgtgttttaaattgcccgagacacgctttatacaatttttgtatgattttgattattcatcacgtaaccataacctttgcttcacattagaattgtcccatgttagggatattggcataacgatgtatcagatcatgtcgatgagaaaccaaattcaatctttcagaaacttaaacccatcccatacaaacaaccacacttttgttgacaaatggagcaaccaattcctcttattttcattcaacagtagacactctttcattttcaacaaaaaaacactcctttgactaagtagaaactgtcgatggccacacgcgaaaaatgatgatgaattcttataacactcctccacagatgtagtaagtgtcatccaaggatctagcaattaagagtcagatattcaattttctgtggaagcaattatccttcccaggagacttgtcaagtcaagcaacgatcaattcgtttcacagaagaaataaaacaaggatg

SEQ ID NO: 31791 - DNA, 3003 bp, Unknown; identical to SEQ ID NO: 31790
  misc_feature (1)..( 3003): 2750-1469P.txt file - cDNA_ID_3045764; gDNA_ID_2926158; Annot_ID_198568

SEQ ID NO: 31792 - DNA, 3000 bp, Unknown; identical to SEQ ID NO: 19001
  misc_feature (1)..( 3000): 2750-1469P.txt file - cDNA_ID_3045776; gDNA_ID_1971820; Annot_ID_176133

SEQ ID NO: 31793 - DNA, 3000 bp, Unknown; identical to SEQ ID NO: 19001
  misc_feature (1)..( 3000): 2750-1469P.txt file - cDNA_ID_3045776; gDNA_ID_2926158; Annot_ID_198560

SEQ ID NO: 31794 - DNA, 3000 bp, Unknown; identical to SEQ ID NO: 8588
  misc_feature (1)..( 3000): 2750-1469P.txt file - cDNA_ID_3045782; gDNA_ID_1971820; Annot_ID_176113

SEQ ID NO: 31795 - DNA, 3000 bp, Unknown; identical to SEQ ID NO: 8588
  misc_feature (1)..( 3000): 2750-1469P.txt file - cDNA_ID_3045782; gDNA_ID_2926158; Annot_ID_198544

SEQ ID NO: 31796 - DNA, 3000 bp, Unknown; identical to SEQ ID NO: 8624
  misc_feature (1)..( 3000): 2750-1469P.txt file - cDNA_ID_3045794; gDNA_ID_1971821; Annot_ID_176172

SEQ ID NO: 31797 - DNA, 3000 bp, Unknown; identical to SEQ ID NO: 8624
  misc_feature (1)..( 3000): 2750-1469P.txt file - cDNA_ID_3045794; gDNA_ID_2926195; Annot_ID_201354

SEQ ID NO: 31798 - DNA, 3003 bp, Unknown; identical to SEQ ID NO: 19422
  misc_feature (1)..( 3003): 2750-1469P.txt file - cDNA_ID_3045802; gDNA_ID_1971821; Annot_ID_176164

SEQ ID NO: 31799 - DNA, 3003 bp, Unknown
  misc_feature (1)..( 3003): 2750-1469P.txt file - cDNA_ID_3045806; gDNA_ID_1971821; Annot_ID_176161
taccttttatttggttgtattcagggaaaacaagaatttaacaggaactgcacgatatgcaagttgcaatacacatcttggtattggtaaggaatgctgccacttttttctcccctttgtgaagtaaagtttttgctcacatatttcgatttctctttcgcagagcaaggtagacgggatgacctagagtctcttggatatgtgcttctgtacttcttaagaggaaggtgtgttgactttttgacttgaaagaacctagttaacattgtgtttttggcagggtattgtttttccttgtttgagatttacttaaccgttttcttgctttacattttgttcctattttaatgaacctccttttctagccttccatggcagggtcttaaggctgttgacaagaagcaaaagtatgacaaaatttgtgagaagaagatatcaactcctattgaggtctatttccctctactgtgtgagtgaattgttttttgttaatcctcattcaactgaataatatcccatcctttgtaggttctatgcaaaagccaccccgtggagtttgcttcatattttcattattgccacacactgacatttgatcaacgccctgattatggattcttgaagcggctttttcgtgatttattctcacgggaaggtactttgagaaagacatccctccatcatttttataatcctctctgctagcatcagttatctacctagctcacttaaacgttttcttctttgcaggatatgagtttgactatatatatgactggactattataaagtatcagcaatcacagaaaactagaagtcagtctcaggtatagtttatcaataccatttgttatttttttttctccaggtgtatgcatattttgtcttgttcatagagaagatttcctggggagaagttttacttggttttgctattttttagttttggtgctaaatatagatatgcctgtcttcctaacaataaactgtcatgctgcaggccgttcctgggtctagtaatgctcgtgcaataccaatggacacaagcaatcatcgaggtcagctcgagttataaattttaattgtgtcactttctgattaattttgtaatagtatatgatgtgttttttgttttctctcgactttcacactggactcaactggcatagagtgtttggctgatttagtttcccgttgcaactgtttatttcaatatcttgatgctaactctccgtttggcaggaggaactaagatttcacatgaagcccaagtctctgaccgtgtcagaccggctaatgccagtggtccaagcccacagattaataccgctgtagggaggagtctgggttttgatcaagtccacaagaatgtacgtgcttattcatttgcctcttccaaataaatgttgtatcctgcaaccctcccccttgtgttagcatctcatgcctgcatctgtgttgcttcagagttctgcatggttctctgcttaaagcttttacctgttttgcatggtcaattgtcatcaacgagctctatattgtgatatgaactacatatagcataaatgattaaaacacgatactgatcatcacgaaatatgctcttgaccattattttactgaaaacccattgcagatgaacatgccatcatccacttcattatctcctgcgggtacctcaaaaagaaatgtcagacccgaaacctcaaattctgggtttgggagcgggaataaaaccggcggttggacttcaccattcatgtcaccggggaaatgatgcaaaaaaagttggagtatatcattcatctgatctgctgagcaagattatgtgtgcctttgggtctaaactgtgatttctgcagtgaaaagctctagactgaggttgaagatctgaatggagtttttccatgaacagcttactgtttgacaaaaggcatgaagattatgtttgctttccttcaagattctcacaaatgactgacttcaacctttgtataaaatcttgcaaccgggcgtgtaatttggttcttgtgattcattctcccaagttttcttctataaaactttgttcgtatttctgtacgtagttccctgtgttggggcataacctgggtttgctgtgtcatcaacattgtttgcagaaaatcaagagcaaagcatgagcagcttcagcagagatgccttcaaaggcttgagtcaagagttgcttgtggcagggacatgtcaccatcaagctaatgtgcagctgacgagaacgtaaaaggataagctatggctagcttctggaatgctccgagaaacacttccccctttttttttctctgaatttcctattcagtttaatggtattctgtgtttgatttttcttactcgattttgtgcattgaaaaaaattatatcaaaaagcttgacttgatccaaacatgcattttcaattgctattattaaaaaaaaaaaacgtataaaattgtagtctcaatattgaaatacaaacacctagaattgatcgatttggtagagaactagttagtggattaaatttgggttggctgattttcgagccataaactatttcgattctcagctttcacacccggacttttgggcctttaaatttccaccatcaactttcatattcccaaaattacatcatctatttttggattcatgcttaaacatacatttccaattgaaccattcatttaaccgggattaaccacaaatccgcgtttactgtaccgcgattgcgattaacccaactaatacccagacccgttaagaaaacgacgtcgttttcatttcgtttaactcatcaaaaagagaaagaaaacgacgtcgttttcattcttcttctttaactctcaaatcgatttagtcgttcttctttaatctcgacactgtgaaattagggttcttgagagagaaagacaaaaggggatttggggttttcttcttcggttcgaatttttgggtctcgatttgggtttcgaatagggagaaatg

SEQ ID NO: 31800 - DNA, 3003 bp, Unknown
  misc_feature (1)..( 3003): 2750-1469P.txt file - cDNA_ID_3045814; gDNA_ID_1971822; Annot_ID_176220
agattgtgagagaacataatgagctttttttcatctttgagtgcatggtaaaggcgatctccgcttttttatcttctgtaggattttttagtctgatgttagagaatatattctcattgttcttggataatgatttgactaggatcacaatctgtaccatataatgaaagaaagggaacgacctttttctgaaggagaaataagaagttttatgtctcagatgctgcaagggctcgcacacatgcataaaaacggttatttccatcgagacctgaaacctggtatgttttggtactttgtattgtattaattgaaatggttttcgctctttgaatgtcttataaacaagttttgttctgtttctgaagagaatttgctggtgaccaacaatatcctgaaaattgctgactttgggttggctagagaagttgcatctatgcctccttacactgaatatgtgtccacacgttggtaagtgatttctctttgatattgccttcgcattcatgcatgaaagtatgtggtataaggtgatatcgacgtataccttattattggctctgactgcaacaggtatcgagctccagaagttttgctacagtcttcattatacactcctgcagttggtatgtttgcgaaatccttttgtgcctcatcacatttcattagtatcatgtgatcatgtcaaaagtctagctaaaccatggctaatacttcgtggctttgaatagtttaagacattttttctttctgttttgtcatctattggatcgctttgcaaatctttatagactaacatttaaaagaactgcagacatgtgggcagttggagcgatactagctgagctttacgctttaactccgttatttcctggtgaaaggtgaattcatttccctttcaaacgatactagctgagcttaatctgtgtgcacacttaagatagaccatttagtgaaaactgatataatgatttctttatgagtagtgagatagatcaattatacaaaatctgctgtgttcttggcaagccggactggaccacgttccctgaagcgaaaagcatatctcgaattatgagtattagtcacacagaggtaagagttcttaatgaaaagataagaggcttattatattaactgcacttcaatattgactttgttctttgaatatcttgtgacagtttccgcagacacgaattgctgatttacttcccaatgctgctcctgaagctattgatttgatcaatgtgagttcttgtgttcactctttttgcggatatttcttaccattcttaagaatgttgtgatctttcaatatctttatttcgtatatcatctgtttctttttttgaatcaacagcgactttgctcatgggatccattgaaacgaccaactgctgatgaggcactaaatcatccatttttcagtgtaatttgaatattcccttgcttcttttgattttatcacacactcctctctttgtaataatcgaaaatgtaatgatatattcggaacagatggctacgcaggcttcatatcctatccatgaccttgagctgaggcttgataatatgggtgaggctttatttttctttgttaatctgcttcgtatagtatgctttcatgaccataagattaagttcaattatatttgtggtattctgcagcggcgttgcctaatcttgagctaaatctctgggactttaacagagaacctgaagaatgttttcttggcttgacactagctgtgaaaccaagtgctcccaaactaggtaagtatcattccctcgtgtagagttggtcactagatctgacacaaattgacattgacattgagcatggtttcaaatattgtttgcagaaatgctccgcaatgtatctcaggacatgagcgaggtaagctcatacgcaatgaacgtcacttatatagcattgttaaacttttcatgagttgtaataaatctgttgtttacaaaagcagaattttctcttttgccccggggtcaacaatgatcgagaaccatcaggtgatgaaaacttgagcatatgttgataaaactgcagatttctgttatatttctctgtgaaaggttgttgaatatctctctttgaacatttacagttttctggtctctgctctctcctgatgaaaacggcctccacgcgccagttgaatcatctcctttatctttgtctttcaggtgagattacaagttgtctctatggatccattaatgtgtaaacagatttgcctaatgagaaacatttactgtgagcagtccaatgcagcaacacacagttggacctccacagtcgagtggcttcacaatgacatcatcaatgcaaccgaatatgttggaccgcccgtggatggccgtgtctgcgccgtttcaacaaagtcattacctctgatctaataaacccataccctagtaaaaaaagtaaataacacagaggtttgtcagaaagatttgagtttaaagaacaagatagcaaaacaaaacagaggaaaggtgttagaattttcattttttttgtcaccaatttgttcttaatttgtaaaaatttggtttggctgatgcattttcctctcagagcttgagctctatcaatatcgaacaaataatttccttattcttgtctctgtataatatatgataaaaaaagacattgaaatcttgatgtggcattaccataaagaattacgtttcattaatgttggttctgtcgtcttttaatataaaagtctttaacttgtgaatctgtcttatctacaagaaaatttaagactatatttattatgttaattacgatacttattttaatctatatttagtaaagcgaacaagtcctacaaacaaaccaaagatattgaaaaaaagtcactttggagatagaacagaatataaaaaagattctttaaatgatcttttatcaaaacaagattctaacaagtcttagaaatctcaaaacgaagaacaagtaagaagcttgtagccatg

SEQ ID NO: 31801 - DNA, 3000 bp, Unknown; identical to SEQ ID NO: 21597
  misc_feature (1)..( 3000): 2750-1469P.txt file - cDNA_ID_3045822; gDNA_ID_1971822; Annot_ID_176203

SEQ ID NO: 31802 - DNA, 3000 bp, Unknown
  misc_feature (1)..( 3000): 2750-1469P.txt file - cDNA_ID_3045865; gDNA_ID_1971826; Annot_ID_176295
acatttcctgccaaaaccgtaaaatcatttcttcattaaaattatatttggtaatgatgttaaatatttgtcatttgttaaaattatatcatgggtattttagtcattttattagaatgaaaatgtagatgaattacaaaatgatcaaacaaataaatattcagttaaatgcatcatttatataaaatattaaattatcaaacaaacatcattcaaatgcattatctaaatggatcatgtaaatggatcatttggatgtaaatgtcaaatgatcaaacaaacggggcctaggtctcataaacaccacaatgaaattaattgatcatttttcaggcaagaaggcaaaaagaatttgatcacaatcttccaaacactcaatttttttttatggttaaagaatagaaattgtagccgcagaaaagaatatgatgatatctcttattataattactccacctgctgtgtaatttcttcaccctccaagaaaagcattgtctgtaaaaatcaaaaacataaatcaaacccaatttaccttccgaaacttcaaaagtcatagaaatggatataaataaggcgagcaagacgggaatagacacaaccgtagatatgtgttagatatataaaaaccttggaacaaaagggacaaacttcacttctctccatccattcatagatgcatgcaaggtgaaagatatgtccacattgcaaaactatcttcgggttttcatcaatatactctgtctccaatccaaataggaattgaattattaaacacacacaatcttaatcagtcataagtttttcaatctcattgcaaagtttttttttttgttttaccatagaaacatgtcggacaaacgtcttcttcgtcggcgacagtggaaatttcctctctttctaagctttgaaatatttgctcgagctggatcaaaaatataagtgttatgtagctcttgttcttggtagaagaaaaaaaaaggagaaattagggtttataatgtggaagataccttgggggaaaagttattagttattgggttagtgaaggctctgattcttggtacgtttagagattcatcattgtactccggaatttgaaaacaacaaagtagaatacccatttatctgaattaataaatcaacgtaagattttagttcatcaagtaagtgattacggtaaataatcacagtttattaaaagacaggacatggaagaaatcagagaaacgtaagaacattgattttaatgttaaactgttctcataccttggacttggatcaatctgttgaaatccagagaaagagaaagagaagaagaaggacaaacgaatcaatcaagcatgagaaaaagcaacaaactctagttttggcccgtaatcgggagctagggaagattctttggagagcaacacaaggaaacgtggagattttgttgggatattttatgacgtggcataccaaaagagcttaggaagtttcgagtttttggaatgttgacttgtttaaacaattactggtttacaaattcgacaaccgtcgtttattgtatatcattttattacttaatcctaatgcaagaaaagttacataaaaaaactttactaattcaagaattttttggggggcgtgaaagaaaaaaaaaaaagtgattaaggagctggattttttaatttattttctttttaaaaaaaaaatcataaatgtgtaaccaatgtaaaaaataatgtttcttggcacacgaaaaaggatatatattaactggtttagaaagaaaaaaaggaaagataattatggtggttgcatttacttgatatcatgccaaatccatttaattagcaaaaccatgttggagatttgttttttcttaaaacaacaaacccactttttattggttaattaaatatgtgatgtactgtatatgactatatccaattaaaccacacaccgaacaagacatttctatgataagctttacaaaaagaatcattggttaactcaagatcagttatgacaattgttactactttttataattatgttatactatcacatggcccgtaacaattatcggttggcaggaattagtgttgggacctatggcttgatgatgagcatgatgaaagaaaaagggccaacactcgatgtctaataataaaacaaaagagttgagacatcattatccatcatactcaaggcaatacaaaagtatcaagtaaatagacatctttattcacctacaaaggatttcaataattagatcggggaaaaacataagagcatctccattggagtatctcattgagatacccaaaaaaaaaaaaaaaaaaaaaagtaggagagagagagctgagtttctcttctgagaaattttgagaaactattctcattaaatttggacatgtgtcacaacataattagttcaattattaaataataattaatatatattttcagattaaaatactaatatttttttttctttgagaaactttccttccatttgccgatggagatggtctaattacaaaacaactcacgtaaatgattaatctacggacttaaaattcgataacataaaataaaaagaaaaggaacaatatatagtattaattatgcattggtgcacataattagtgattgcaaaattcacaacgattctaaatcccattagattgtgaatttggaatgtggatgtcggtgctatacacaaaatgcacacgattagcaaacttagatgcaagtgcaacgcgtcaaatttggggagctaccaaagaaggatagtaattactcattaaataaaaatgtgactactaagtttggggagaaactgaggattacgtatataaaagtgtggggagctaccaaaagcgagatcataattactcattattctatagctcttaatctcatttactttctacaccatcttatatcatcttcttgttcttccattgggaaagagtcaaagagagatcgagagagagagagaaagaaagtatg

SEQ ID NO: 31803 - DNA, 3003 bp, Unknown
  misc_feature (1)..( 3003): 2750-1469P.txt file - cDNA_ID_3045877; gDNA_ID_1972137; Annot_ID_179169
ggccgctacttgtttctttgtttttttttcctaaccatggttagtttgtaacactggttagtggttactcacacacttgttactacttccaaccttttttttcttttttttttgttgtcttcaaaatgtaagaaactttaatacttcttaatatgttgattggttttgtcactttgtagacccctgatttttaactatttcggtaaacttttgtaaaacaatttgggtttaaatctctcatgttttattagttgtacatctcagctaatgacaatagctcaagttaacgtatcatacaaaacagcaaaatagattcgaatttgatttttttcttttttctttcaggtagttatatatataactaatgtattgcaaatatttgaaaaacataaagttcaatgaatctaaatttgataattagattaacaaaatcgacatcacatgtatgaaatcgaattcctgaatattcaaaatattgtgtttttttcataagttcttgcatgcatttgcaaacgaaaaaaatcgatttcatatgttatatatatatatagtcgtagatatgtcgtaagtacatttgggtatgaatatttggataattcatcatgggtactagatttcgctgtcgttccatttgtaaaatatcaggattttttaagaaaaagttttatacaaacctgtattacatgtttgaatgaatgatcatacatatatatatttgttaaaatactactatttaacacattaaaaatgacatcctggaaaaaattatattaaatttgaaatctctacatatttttgtgaaatattttgaaaatcatgccaatatatatatgattatattcattcagtcatggtggatcatcattttgtacaccaaaacacattccccattttcttaaaagaaaacttctatatatatatatatatatatatacaaatactactattagatgtgaatatgtagaaatatttgagtcccatgcgaactttacgtaaatatgttgggaaacgattatatatatataactcacttttcttatagaaatagatagaacacaaatagtgtgtgtaaaactcacacataattaaattccatagtgttttcggttgttgaaaaacatggaaaatgccgaggaggtctcgaatctgatgtatttatttatcaataatttggtaatgtgaaataataaaccaaaaaaaataaaaacaaatctttaatgttgggaaagagatgtgaatgaaggtacggtcaatatatagacaatggtacgtaaagcgaagagtacattgccaccctgtaaactctgtatgctctatgttttcacgctattgattttcgcttttcctctgtctctcaacatttatgtgttccatcggttaattcttgaatctcgattgtatttaattccgacagaatcttaaaaacaaaactatttgatcgtaacaccatttacgtttttcttcttctttctttattaacaacatgtaatataacgaggatttaaaatcaatgttagtgtgtgactcaacaaatatcttggtccatcagttacgtttttttaattactcgatttaattggatcatttaaagtaatcatcaacgtttaacaaaaacacaaaatatggtccatttaatactattgtatatttttggcttcttttctcggtctcttgtaaattctaatataaggaaaacaaacgttggacaataattttgatacggtacaattattccatatggtcgctctttaaaaacacccatttgcagttatcttttttcctgatttgaaatggaaatagacatatataatatatatatatatattccttttggagcaaaagttaggaaataaatatatattcttcagagattttatggcacattgtatatatcttaataatattccatagaatcaatacgggtcatgaatctctcttcacgatggaatatatatgatttattaagatggaatcatggaatcatatcatttctttttcacactaataaggaaattatcatatatatcagaatctctacattacacgatccaatctcaaaagaataatatataatcggcttaaaattcgaaacagtaattaaaaaattttcacatcttctactccgagaaatttgggttacagattagaagagaccttgtcataattactacccagtaattttatttaattaccatcacgtggttaaacaaagatatgtagcatgctaacttatccgcgcattttagctattttccacttaaaacatactactgtttactaacatacgctgagagttacagttcacacatcttttctcttccttcttcttcactgtatattaagaacaataagcaatatcagttttttttttcctctgatcgaagccgcgggaaagttataataatataaagatatttttcgtgagagttgctcgtttatgggagaatcgtgtcagattaatttctatttttgttggtttaattttccatttttaatttaataattttaaggaaatattattagagtgaaaggaaaaaaaaaaagatcttgtgggtcgccattatatatgcaggtctttctccaaccttttgctccttctctctcaagtgtcaagaatcaaacagtggcttaaacccaaaaaaggaacatgggtatgtctcttttttctttctttcttttttctcattgttgattcttcttcatacgatttttgggtaagatatttcattattggttatggggttttcagtatttggtagttgcaggttaaagtttttgtttttcttcttcttcttgtggtttttttctctgttaagctcttttagaaatttacctaggatttgatgtcagtggtatctctctgtttattggtatttacaagaatacagagagaaagaagagattattattcatgggttttgttctgatttttgaaagtttctgtctttgaaactcactgatttttttatatttgggaattttttgattgcagatgttagtatg

SEQ ID NO: 31804 - DNA, 3003 bp, Unknown
  misc_feature (1)..( 3003): 2750-1469P.txt file - cDNA_ID_3045877; gDNA_ID_1971826; Annot_ID_176289
aatgtgttgtcccaaaaaatgtaaataaccagtttcttttttcctaaatcatagtattacaaattatctcgaagacattttgacctccaacactaaaacttaagaataaaagatgtactagtattttgagataaatgacaaatatcttcttgaattaggtcttagcttgaagatgaacaagtgggagagtagacaaaacgtgggatagattacgagaaattcagaggtgaaggaacatagtaagagaaaggtaggttcggccacagcagattcctagaccggctctcatgcagcacgatgctttattttgtatgcctaaccatgtgactgcagtctctccatttaattcagttggccgctacttgtttctttgtttttttttcctaaccatggttagtttgtaacactggttagtggttactcacacacttgttactacttccaaccttttttttcttttttttttgttgtcttcaaaatgtaagaaactttaatacttcttaatatgttgattggttttgtcactttgtagacccctgatttttaactatttcggtaaacttttgtaaaacaatttgggtttaaatctctcatgttttattagttgtacatctcagctaatgacaatagctcaagttaacgtatcatacaaaacagcaaaatagattcgaatttgatttttttcttttttctttcaggtagttatatatataactaatgtattgcaaatatttgaaaaacataaagttcaatgaatctaaatttgataattagattaacaaaatcgacatcacatgtatgaaatcgaattcctgaatattcaaaatattgtgtttttttcataagttcttgcatgcatttgcaaacgaaaaaaatcgatttcatatgttatatatatatatagtcgtagatatgtcgtaagtacatttgggtatgaatatttggataattcatcatgggtactagatttcgctgtcgttccatttgtaaaatatcaggattttttaagaaaaagttttatacaaaactgtattacatgtttgaatgaatgatcatacatatatatatttgttaaaatactactatttaacacattaaaaatgacatcctggaaaaaattatattaaatttgaaatctctacatatttttgtgaaatattttgaaaatcatgccaatatatatatgattatattcattcagtcatggtggatcatcattttgtacaccaaaacacattccccattttcttaaaagaaaacttctatatatatatatatatatatatacaaatactactattagatgtgaatatgtagaaatatttgagtcccatgcgaactttacgtaaatatgttgggaaacgattatatatatataactcacttttcttatagaaatagatagaacacaaatagtgtgtgtaaaactcacacataattaaattccatagtgttttcggttgttgaaaaacatggaaaatgccgaggaggtctcgaatctgatgtatttatttatcaataatttggtaatgtgaaataataaaccaaaaaaaataaaaacaaatctttaatgttgggaaagagatgtgaatgaaggtacggtcaatatatagacaatggtacgtaaagcgaagagtacattgccaccctgtaaactctgtatgctctatgttttcacgctattgattttcgcttttcctctgtctctcaacatttatgtgttccatcggttaattcttgaatctcgattgtatttaattccgacagaatcttaaaaacaaaactatttgatcgtaacaccatttacgtttttcttcttctttctttattaacaacatgtaatataacgaggatttaaaatcaatgttagtgtgtgactcaacaaatatcttggtccatcagttacgtttttttaattactcgatttaattggatcatttaaagtaatcatcaacgtttaacaaaaacacaaaatatggtccatttaatactattgtatatttttggcttcttttctcggtctcttgtaaattctaatataaggaaaacaaacgttggacaataattttgatacggtacaattattccatatggtcgctctttaaaaacacccatttgcagttatcttttttcctgatttgaaatggaaatagacatatataatatatatatatatattccttttggagcaaaagttaggaaataaatatatattcttcagagattttatggcacattgtatatatcttaataatattccatagaatcaatacgggtcatgaatctctcttcacgatggaatatatatgatttattaagatggaatcatggaatcatatcatttctttttcacactaataaggaaattatcatatatatcagaatctctacattacacgatccaatctcaaaagaataatatataatcggcttaaaattcgaaacagtaattaaaaaattttcacatcttctactccgagaaatttgggttacagattagaagagaccttgtcataattactacccagtaattttatttaattaccatcacgtggttaaacaaagatatgtagcatgctaacttatccgcgcattttagctattttccacttaaaacatactactgtttactaacatacgctgagagttacagttcacacatcttttctcttccttcttcttcactgtatattaagaacaataagcaatatcagttttttttttcctctgatcgaagccgcgggaaagttataataatataaagatatttttcgtgagagttgctcgtttatgggagaatcgtgtcagattaatttctatttttgttggtttaattttccatttttaatttaataattttaaggaaatattattagagtgaaaggaaaaaaaaaaagatcttgtgggtcgccattatatatgcaggtctttctccaaccttttgctccttctctctcaagtgtcaagaatcaaacagtggcttaaacccaaaaaaggaacatg

SEQ ID NO: 31805 - DNA, 3003 bp, Unknown
  misc_feature (1)..( 3003): 2750-1469P.txt file - cDNA_ID_3045887; gDNA_ID_1971833; Annot_ID_176344
gatgtgcacgatatatatttttctaatactcgaatctcacacgtgacaacgaccttacgtgtatgtacgtgttgaatagaattaagatacgttttataaacttctcttatctcacatattcaacatgtggatgaagatcttcgtattttttattttaatttttatgatacacccataaactgaattattactagctagtagaggctataaatacgaagaagatatctatatatatactatctatcagtgccaaaaaaaagtttttcaatatatgcaaatatacaatcctatttctccggtgaaaaccatggtgaagatttatcctcacctggcgtttccggtggatatggacgtcgtacaagacaagattttgccctacttaacgacggagcaagagaggttcacgatttggatgaaatctttggtgttcaatagcaaaggctgcacagtttttgattccaaaggaaacttaatctatcgagtggataattatgattccaagagttggagtaatgaagtttactttatggatttaaacggcaaaattttgtttactttacgtcaaaaggtaatactaaacatttcatcaatgttttctaagaatttataagttcctataattattattttattttaccttgcaagttcatttttgttgtgtgcatgtatatatatagaaactgggattcttcaaatcttgggaaggatataactcaaccgggaccagatttcgactaagaaagattttcaagattttgccaagagaatcatcttcgtcttacaaagttgtaatgggatcacgcatagttgatggtgatcaacaatcttgttataagattgtaaatcgtggatcagttttcgcaatcaaggatggatcgggaagattaatggcagaagttaaaaacaaactatcggatattagtggtttggatcttggagatgatgttttgacaatgatggtggagccacaactagatcattctttaataatgggtattgttatagcttataaacttaccaaatgtaaattgtgataatcaggtggtaatcttgaaggtaagcatgttttaaagctaattaaacgttggcataaaccccaaatatctggcttgaaattggatattgaaaagattgcaccagaatgcggagaagctcggcatcgttcatcctcataaaagtcaaaacaaccaatcagttctctctttttttatattttggtatggaaacctaattctcttacttaatattcaatccattcttttcctccaacttcttcgtaaatggcggatgaaactataaccctgtttcagcttattgccaaacccgaaccgcgcaccatggaatagtactgatccaacgagtatgtttgaacaagctcaagctgccattcaatcatcgctatcatgaccgtgattactcgttttcccggtcgtgagaagaccctttaagcgtgatttttatacggatgtatgttttactaatactagtaccaattccacaacataaaccaaaagtgttttgaaattagggtcatgtttctgttaacaatatctttaactagctgagttaaccataattgaattactaaaatatttatcaaactgaattaaatagatttggatggtaatttagtcagcagaaagaattggaattggtgaagaagataatagactaatagtaaaggggtcatggaagttatacgaatgcatgaaaagataatagagatatcaatcatacgattttattaaactaaaggaccatgtgatcagattgtaatttgtaatagcagaatgagccatctcatattccatacatggttttaaataggcttgtccatttcggtactgttcatatactgtatgttccaatttttatcccatatttgtgtgtttaaaaaaaataaaaatagctacttgaaattgtttatagaatgagatatatatatgtattattcgtttggttattcagcttttataaaattaatgaaaatcatctaaatatgtaagtttttcagaaatacccgtatcgaaagtgacctttaatttaaccgtcccgacatcaagccttacccaaattagtaagaatttgaataataaattttgctacttaaatttcttgaactcgttccgcgacccaaaattctcgtccctatcttatcgaaaattgtcatgaatgttttttgttatgtgaattacttgctctcgatttatgtgttattttactgtcctgatatcaagatgtacacgcctagttttaagtggcaacaacatataatttcttacgcatgtttcaattttcaaacacaaaaaaaacgtaacctgtgacactttgacattattttttgggtatgcgaatgaattgaaattaatttatagtgttctagagaataaaagaaagtgccctaaaagaaatgatatcaaatttatttgcaaatacaaagaaaaaaaaaaacacaatttttgcaaatataaacaatagcttttacagttaatcttcctgtcaaaacattcttttgtgcagtatcattccgataaactgtcagcattggacaacggatagaacacaaatggaatggaccacaactgaagaccgattctaagcctagcaactaataatttgaagttatcttattatattgtatgaacagttttttcaatattttttgctctattaatcgaatctcacaatcacattagtcacgttacaacgaccagacatgtagtaacaaacaaaaaggaccatacatttttttttgtttaacaaaaacgaccatacatgttatcgctacatgattttctctgttatttttattttgtatctcacattgaacatgtggacgaagaccttcgtatatatatattttctaatgacacaccaaaaactgaattactactactagtagaaagtatatataaatgcgaagaagacatataactatcattcagagccaaacataaaaaaaaatcaatacatatgcaaatatatagcaacaaccgaacgatg

SEQ ID NO: 31806 - DNA, 3003 bp, Unknown
  misc_feature (1)..( 3003): 2750-1469P.txt file - cDNA_ID_3045887; gDNA_ID_1971833; Annot_ID_176348
gtcagattgtacatttgagtcctgctcaaatcgtagctttcagtttttaatgaacatgctattagtttgcaacttagcattgattattttgacaaaaaatcaggtttagtttgtgtcaaaatggtagatgtgattatggcattgcattgacttgtagagttctgaattgtacttggcatttctgcgagtttcttgatcgctaagactctctggtggctctaaagggaaagataggttgaaagttttatctttcctggatgatgtgtttatggttttaatttacatcttctatgatgctatacttctttgaaatattatgtctctatggaaattggtagctgatggatttcgttagtcctgagtgtcagatggtattatttgagtagctttcagtgttttcgaggtagaactctaaaaatgtaagattgtcttcatgtttcagtcatgggacacaacgtcgatatccttaacagcgggatgtgatctattcatgcgctatgtgactcgaacatctgctttagaatttgaggacttcaactctgcgaaatcccgtgtgcttgaacgtgctgagaaatttggggaaatatcttgcaaggtcagtgttctcttcgaacgggaattgtttacataaatagttagtagaagaagagtttgaacagtaactggaaattttgcaggcccgaacgataattgcaatgcttagtcaagatttcatatttgatgggtgtactattctggtccatggtttctccagagttgtgtttgaaatactaaagacatcagcgcaaaacaagaaactctttcgagtgttgtgcacaggtacttttcttaagacttagagatcaattggatatgacatcttccagttatctcattctgattttcctaactgacaatcacatttccgttgcatccgtggaaacaaaatacagagggaaggccagataaaacaggtgtactgctagctaacgagcttgcaaaacttgatattcctgtgaagcttctgatcgattcagccgtggcctatagcatggatgaagtagacatggtgtttgttggagctgatggagtagttgaaagtggcgggataattaacatgatgggaacttaccaaatcgccctagtcgcacagagtatgaataaaccagtctatgtagctgcagagagttacaaggtaacctcccaaaactttaaaagttttaaaaacttgattgcaaaaacatcaatgatccatcatcttctttcttgttttcttgcaagcgaagtttgcacggctctacccgttggatcaaaaggacttagaaccagccttgcgacctattgatttcagtgttcctgttcctcctaaggttgaggtagaaagatctgcaagggactacactcctcctcagtacttgactctactcttcactgatcttggtgttctcactccatctgtagtaagtgacgagcttattcagctttacttgtaagtgaagctgtctaattcctatagctggtctgaaatctctcattttttgtataaaaataaaaacaaaaacaccatatttttggctatacacagacatagtttgtctctgattcttactgctaatgcacattttttttggtagtagcgagatctttgtgacttgtcatctttactcaaaatttatcacccaagtttcaatatatagttactagtatatattatagtatgatcatttctggtttttgatttcttgattagagatatgtattgctatattgttttattattgttagaatcatttgtgtttttttgcaaaagtatatatatccttttaacactttaaaatgtttgcacaaaaaaaaaaatggtatggtatgcgctggatattgaaaagttgcaattattgcagtgtagtgataaatgacctataatgtaacatggaatatcatatgatttgatgttttgaaaatgagagcatgagaaacgtgatagaattaaagatggtaaattcttagtattattttaatgcttggtctaagtaactactccctctgtttcataatataagttgttttggaacaatttttttgttttactatataagttgttttcaagtttctatacaaattatatattattttaatattttatgattatttatgttatgtagtctcttttgtgattagtagaattttttaaaagtaaatatttttaatttgcgtgtttttatttaaaacaatttatattgtaaaacagatggaatattattataggctataggcctatagctaatgtttggatctaactgctaacgttgtaagattcataaaacaccggccacttacaatcccacgttttttttaaaaatattacgttctttcctggaattacccatatacacgttttttttgttatcttcgtgctcaactgtttacaaaagtatactgtattcgggaaggtgaaaaaagataaaattatttcggaacatctaatatactaacacaataaatgaaattaaaaatatatttgtaaagacattaaagatggcaaatatatctgtccacaccacattttaattcttttttatatcattagtctataacatttgattaagtttcacgttttagaaaagtgattatgtataaactaaaaatataaatagattactttacaacaaacttttttttagcattttacatttgttcatttaacaacaactataacatattgaattcgagtttttttttccttttcccaatcattccattgaatgtatgagtttaggtcttagggttattttctgatgaatagcaaaagtagtaattcccgacaagaaattggccaatgtcgaaaaagtcaaattccacattttaattgagacataaaagacacatcactcaatacagtaaaatatctacttttatatattcccaaaaaccattcggcttctgcttccacttcatctctctctctctctcccttctcacatttctctccactcagatttccaattcctaaagatagagagaatg

SEQ ID NO: 31807 - DNA, 3003 bp, Unknown
  misc_feature (1)..( 3003): 2750-1469P.txt file - cDNA_ID_3045909; gDNA_ID_1971833; Annot_ID_176349
aaatatctacttttatatattcccaaaaaccattcggcttctgcttccacttcatctctctctctctctcccttctcacatttctctccactcagatttccaattcctaaagatagagagaatgactaaaatctctgttggattgcaacttgtgacaagagattcgagggaaaaactaaacaatatagtgatcaaatcttcactgagactaaaccgatccaatccaaacatctcggagctttgtttccttaaaacatgtcatctctgcaataaacaactccatcaagacaaagatgtttacatgtacaggtacgatatttttttttttttattactatattatatactctttgtaaacgaaagatgttctgttcttgattctcaattttttttttttgttgaaaacagaggagatttgggattttgtagtagagagtgcagagaaagtcagatgttgattgatgatagaaaagaactagaggcttcgacgaagatgatgttggcttcgtacagacgatgtaataacggcgccggaaaaagcgagtctcggaatttgtttgatgatctccggcgacgacgtcaattatttatagttccttgaggcttctttaagcaatatctaattatagtttttttggttacacatcttatgaaagttattagtaaaagaaagagaattaaattgtatctccggttgtcatttttcaaaatcttaaatgttaattggacagtttatgtggtgatctcattctcaggtggtttaattactgatttagtaaaaatgctcattaattagttaggttaattgtagctgttgaccaaaaataaagattacttgtagtcacacgttaattagtgagataattaaatgatacaaagtgtcatatgagatatgactcatatttcataactaaatctgattaattcgaagaacattttaatattcagattggatcgtgacatgatggatatgaactggataaagaattattttaaagaagaaaatctctctgataaataaattattcgatttgcttcttttttttttatgtatgggagatattttaaatgtatgtgacagggacatagacactctttggttgagaagatatgaacaactcatttagtcacgtgttgaatatgtacaggccaaaatactgtattttaaacaattggaattattgttttacttgtcaagtgatcactttgttcaacccaattccccaactaatttattgttttatagtgtcacactgtcacgagtaactaagcaggttcgtggtctcggcccaattaaaaggccaatcaattaaactaaatgcaagtgcctataactcgacctatgaagcccactatcttagcgattcggcccaaaaagacaacttgccttgtgtaaaatgatttcactttgtatccatccaatgattccaattaatgagaagttatgttcagatttaagaattccagttagtgaacaaaaaatcaactactggaatttgttttgcttcttataaatttggttagaaaaacaaaacataaggtttatatctataaacacaaagaaattgtactaatgtacagttccgaaacgagtatagtcaattattaaaagttaaaatagtgaaacaaataattgctccatgaatgacatattgacatcattatctgtttctttgagataagctaatttaggaacttgtctcaatcctgtaaaatgatttggaccctacctattttattcatctgtctttctttgcgttcacaatttgatcttaatatataaatatatagtacatgattgcactaatatatatatatatatatatatatatatatattatatgtagtataactatacacgtatgaagttgaattttataaaataaaattttcttttaactgaatttccaatagttgtttatacataatttagaaagttgcaaccataaaatatatttcaccataaaacaacaaaatatggtttccacgtacacatacacataacacatacctactgaatattccgtaatttacgatgcctgataatttggacctaataaagttagttaagagtaaacagaattacaaggaaattttaaattgagtttaagaaaactagtaattgatttggaatgctagttatcaaacaaaaggacaaatatatttttcggattatttttaataacttttttgtttgtcacgaaacgacaaaagctttgtcataaaaaccaaatcctatcaacttgctcaaaaagcttcaataatatcgtacgtgtcctgcacacgcagattcataaatgtgtttctatgcttttacaattttagccttatgcataacagcataaggtcttaatggtcctctctcctaatcaaaattacattcaaaagttgttgtatagtttttcattatattttcaataattcatttattttgtgcctatgttaaaacattttcataattcatttataatattatttaaatttaaatgttaaatatctgttctgcgttggctactcctgaatgcaaacaacattgcaaaagtatttagttgtgtttttaatgcctaatcacattaatagatactagatctaagggaaatagactttatgaaaaaatcaattgacgttaggtaaaaatttgtttagactatttttgtctaccagcagacaactctgactaaatttttaatcttatttactgcaactaactattaataaactaataaaatcctaatttacaatatagatctacagtaaatgaatataaaagtctggtagtaccgtaaatagtacatcaagataagggtataatagtaaacaaccatcgtactcgcttcatcttttattttactctaaaatctctttctgaagaaaacaacaaagcaaagcgttgaagagagaagaagaagcaaagatataacccccaaaagtatcaattagtttccattttcgccgctaagattctgttttcgaacatttacaccctcaagaatcgccgccatg

SEQ ID NO: 31808 - DNA, 3003 bp, Unknown; identical to SEQ ID NO: 31805
  misc_feature (1)..( 3003): 2750-1469P.txt file - cDNA_ID_3045911; gDNA_ID_1971833; Annot_ID_176347

SEQ ID NO: 31809 - DNA, 3003 bp, Unknown
  misc_feature (1)..( 3003): 2750-1469P.txt file - cDNA_ID_3045915; gDNA_ID_1971833; Annot_ID_176346
tgtctttctttgcgttcacaatttgatcttaatatataaatatatagtacatgattgcactaatatatatatatatatatatatatatatatattatatgtagtataactatacacgtatgaagttgaattttataaaataaaattttcttttaactgaatttccaatagttgtttatacataatttagaaagttgcaaccataaaatatatttcaccataaaacaacaaaatatggtttccacgtacacatacacataacacatacctactgaatattccgtaatttacgatgcctgataatttggacctaataaagttagttaagagtaaacagaattacaaggaaattttaaattgagtttaagaaaactagtaattgatttggaatgctagttatcaaacaaaaggacaaatatatttttcggattatttttaataacttttttgtttgtcacgaaacgacaaaagctttgtcataaaaaccaaatcctatcaacttgctcaaaaagcttcaataatatcgtacgtgtcctgcacacgcagattcataaatgtgtttctatgcttttacaattttagccttatgcataacagcataaggtcttaatggtcctctctcctaatcaaaattacattcaaaagttgttgtatagtttttcattatattttcaataattcatttattttgtgcctatgttaaaacattttcataattcatttataatattatttaaatttaaatgttaaatatctgttctgcgttggctactcctgaatgcaaacaacattgcaaaagtatttagttgtgtttttaatgcctaatcacattaatagatactagatctaagggaaatagactttatgaaaaaatcaattgacgttaggtaaaaatttgtttagactatttttgtctaccagcagacaactctgactaaatttttaatcttatttactgcaactaactattaataaactaataaaatcctaatttacaatatagatctacagtaaatgaatataaaagtctggtagtaccgtaaatagtacatcaagataagggtataatagtaaacaaccatcgtactcgcttcatcttttattttactctaaaatctctttctgaagaaaacaacaaagcaaagcgttgaagagagaagaagaagcaaagatataacccccaaaagtatcaattagtttccattttcgccgctaagattctgttttcgaacatttacaccctcaagaatcgccgccatgtgtggaggagctataatatccgatttcattccaccgccgaggtctcgccgtagaattggaataggtaagccttttaacaaaaaagagaagaaagaattggaataggtgaagaagataacagtagagtaattagagtagtagtatatagagtggtcatggacgcttcactcttgggagaagtacgaatgcatcaaaagatgtggcccctgtctctatattcgtaaaatgattatcatcacaatatcatataaaggcccatgggttaataaagactataaagggcccgtagagtgatctcagaaacagcttttcttattatttgagaagtttttttttgttgtctgctaaacttgtaaataacattgaaaatgaagtggaagtattacaaaagcattacttaaactagagtaaccttggccaaaaagaaaataaaaaacaaggttacaatacttagaattgatgatagaaatttatctgatccaaagtaacattagagatctctaacgcttccgaaagcgccttcccgtaatggtgttgcgaatctcgatcaattatttgagaatatccacaccaaaatccatatatttatttcataaataaaaatgtagattgttttggtattcaagaccagatctgatttctccaaaaactttaaaacttcgggttcaactggttgagctattccatctcaggtaacaccgtaaaaaaacaagatatttttttgcacatgtttcaatcatattaaaaaaaaatgcaagatcttttttagttaaaattttgtatgtgaacaaatgaatattaattgctaagtttagttgacaaaaaagcgttgacgaaagaaaaatgctaagtttctgtgaatgaaaatgaaaaaataaaaatatctaaatttatttgcaaagatagattttagagagaaaaatctacaccacaattttcaaaatatgattaaacaacaacttataacatctaatattatgaattataacgtatggacctgatcctgaaatgatatggacgtaacttgaatctgtttctagctttagctagtttgtctgctactcgattattacacccatcaagtttgacatatttctgtcttttcttcaacataaatcacaagctgttgctagccaccttcaatgatgatcaaacggattccctgacatcaaagacattggtaatgcgtgaaggaaactgaaatctttagcttcaataggatttacgctctttgatatgtccaatagatgaacttcttgcaaacatgaagacatctaagtcgtctcgagctatccaacccaaacccattggagcattatttgcttctttaaaactgcaatcgtggttgcattttctccatccgttagatgggtggtgccaagttcaagttgtatttgcctgattcgttgtaagggaatgttatagatcgttttggtacttatctcctgggatattcacattcgtccactcttttacaccgtctcgtacctttctcacatccgctaggagatttttatatatcctgaaaaattcaagtaattttcttaatttccaaagtatctccaaataggccaaaatgtgaaagcaacgactcaacattgtcttctaggttgcaacaagtatagtttaattaattgatgatatagcgggacgttggaaatccttcaagcagccaaaatatgtgaccaattgaagaggacgtgatgaattgtctccctaacttggcaccatcgttagcaacatg

SEQ ID NO: 31810 - DNA, 3003 bp, Unknown
  misc_feature (1)..( 3003): 2750-1469P.txt file - cDNA_ID_3045927; gDNA_ID_1971833; Annot_ID_176335
agaaactcggggagctacgtcgatctcctctagtcatttctaaactgcgatgaagcaggtgagagccgccgccgccaccttctacatcctccgacgatcggggaggtgaggaaacaaaaatcaaactgacttacgaaccaatgtaaatgattattattgggcctttttgggcccatatgttttgtcttacataaagtataaggttgtttttacataaagtagcttaatgactgttattacataagatgtttcttgttggcgtggccaaagtcgaaacgaagacaagtattcctaaacaatttaaaatacaagagaattgaaaatgaaaagcagactagtatgaccaacaaaggaataaaattatccaattaaccaagttaaaatgatgaacaatttccaattacaatccttggatttgcctaggaatattttcagagtggagacaaagcctatcgaagatctttagcgtggtggaggtagaactgtttgttgtggtcgcttctgtgaaaggataaaatctgcccatctattcagttgtggaattgtctgtgaaactgctagccatgaaaagctgcataaataatttacaagtcgtaaatgttaagtacttaagttgatcctttgtaactaataagaaagttaccttgctagcttcagtggcagactcgacttaaaatagcctcccttgaggagaaaatgtgttgaatcctctgtcatagtcagtccttggaacaaaagaatgtaagatagacacttatcaactgaaagaataaactagaccaagtattaaaacaatagttgaacacttacataagtttaaaattctcaacatagcctagagaggtgtaaactctcgtacgtttgaacatttcaacatcttgtatttgaactcttgtgagactcttgctctcaaggttgaagtaataaatgtaaaatgcgtatattagacagtactgtgacaacacaacttcacctccatcagtcattccaacaatggctaactccgtatgctgaactaagttgttccacaaaggaggcaatgcatagatacatttggtccatatatttttctcagcatttactagaacccagaacctaagacgttttggagacaaacatgtaaactgaagtgcacctagtttacccttgtagttgattagagtacaagagtcattcatcaacatgaatacatgtatgttgataaagctaaacttttcagacctcacatcaaagcacactaccatagaaacccttgcccgcatatcgaacccagctgtataatacaaaataccatctatgcatattccatcagatttaggataatggggtttgcattggattgttctccataaatggtttccattctccaatgtcaaaacttgatgctcatcacacgtatttgggatatcatcagacttgatgcacaatacctttagctgtttgcggaccggatcatatcctaaataaggtcttgtctcagtattaatactcttcagttccactttgggtaaggatacggactctcccgtgactgggttacaaattaccatagtatctagatttctcttacctcggcgacagatgaatccacaaagaggagaaccaatttcagaaaaagaatctgtggtatgttgaacatgataacgggtgggtacaagagacgtattctcgttacatggaatctgagggtgaggtgaagagaagaagaacaaattgccatcatcatcttggaaggtgaaaagaagcaacggtggacgaatcgaagacatagtcatgaacaactccttgaaatcaggacgacaaagtatggattcccagagtttggatacgcaacgaaacctagctatagactttgcaggaactctcgaaaagatatccatgaggagatcgatcgggatatatctaaaacaggaaacataacccacctggagaggttgcccctcttgcatcatttgcttactgagaggagctaaaccagtatcagactccttgatacctgcaagttacccgtatatgcaatttaatcattcggtaaatagaagtcactaatgaaagtaacaccactatctcagtgtgcacaaaccacatagatcgttgatcttctcggtgagttccttaatttctttctccactttcttgataggtgcagagtaaggcactaacccctgcgaaggattgagattttaacaaggtcagcaaaaaaacatatggagacgcaacatatcaaaccaagtataactatgaacgtttttttttcacttggatgacttattcaaacagtgaggcagagtcacccaaagctagttagtcatataagcacaaaaatgatctaaataggatcataaaatagcaattagctcgaaattactcatgagaaaacatcaaactggttcgcaaagaaacaaaatacagcaaaatttagggttctaaaagggtacacttacataagtcttgacgagagcgatatcatcttcgtcaagcggatcgtctacaatatctctcaccattttttttttttttttcggattttgatcggagatttgagatgtgagaagaagaaatcgaattacaccaacaagagtaccaactttgtccgagttattaaggtctagtaagtaagggccacgttaggtgccttgttggagaggccagagaaaataataccacgtgtgaattgggctatgaaacgcggcccattagcccaatatgcagtgatccgggtcgggtcattagagcgagccgggtctcgttatccatcgcctccctggttgctgcgtcaaagccagacacaagtatcttcgttgaaatttgctttttgtgtggcttatccttgtctgtcaaattcctgcaaaaactctcgcctctctcagacagtaagaggaacatatttccttaatgtattgttccgtataatcttacaagacatcctggttggtgttgcagagaagagtgtttcaaagtttcttcctttttcgttttcctggtctgaatgagctcccaatg

SEQ ID NO: 31811 - DNA, 3000 bp, Unknown
  misc_feature (1)..( 3000): 2750-1469P.txt file - cDNA_ID_3045931; gDNA_ID_1971833; Annot_ID_176334
ccaatatataagccaaaattttgaattactaattgaaaaatatgacttttctctgctaaattgctacgacattaggctgcttctgtgacttcgacgagccttccacgaacccacttcttcgttacgtttcctgattccaaagatgcagccttttcgtcaatcccgtggtaaccatttggaagaggatgattctcagcaagactgatagctccattagactctgctggtggatggactctcgttccgtttggttgcccaactatcccgagtttgatatcttctctacctccttgggatgtgttggattccatatcagaaacaaactggtttgtagtaccttctataacgaaagtcggtaaatcgttagatctcatgttcatgtgaagactctctccgttgatctgcaatgtgtgtgttccattaatctctcctggtcgttcttgatcgtttgtatctttggtttcagattcactgtcattaggctgaggtgaaagaagaaatgggtaagtcccatcttcatctgaagctatctgcctcatctctaaagatttaatcagttgtgttgcttctgctatgagctttttactctctaacaacgatgcttgagcaaccgggcttttcaaagcagcaatctcgaggactttcgcagctttctcagcttccgagatcaaaagcctgaggcgagaaaaggttaattcttgttaacttctgctcacagttgcaaacagagaaatattaacaattctgttttaagtgtactgaccttgctcgttccacagcatccatcttctttgattcttccgccactcgttttgctctgatgcttttgatcatttccagttttgaacttgccaaaggatctttatacgcaggtgttttgcgcttccttactttcaccacttgaacttggctttgacgttcaaactctgaatcccttgtacttttctttgtaggagtcttctttctaggttctgcatcgctccttggtcttctacgacgcctctcgacaccaacaggtataccgtgatattttgccaagccggagcaaactctttcacggtaagactgataagagaaagcaaactgagttaaatatgaccaagaacaaaacatcaaacaagtttgatttgatcaagtgactagacaacttactggatcagcccatttagcagctattgcttctgcaattctccttctttgttcaggagattttggcgctcttctgttacttttagctcctttaatggctttcctctgctcaacactttccagccattccagttgattctgttgatccaagatgttgtaagaatcccactgaagctcttcttcgtctgtatatccttgtttagcagcctccgctaacaagttttgccactcgaaatgacatgtctcctgcacttttctcctctccttcctccttgcccatcgcatccgcactccctctccaatcttcatccgtgtctccttgctgtaaaaatcatgcaaatttgggaagatagtattatgataacaaaaaccaaaagctccaacaggtttaaaagcaaacgaaaaaccggtactgacttttgtgcgtgcccaagattcgctaatttcatcttgatctgcacaaggacaaagacacaaaggttctatgaggggttgaaaattctgatgcatagagcaaacatatagaaccattcttacatgacatcacctttgggtcttgcattgcaatctttgtcctttctctaatcttctgtagggtctctgcataaacgcaaaagaaaaaagattatgaaatgtttccaattagaagcaactgaagatagattgctgaagatacgaataagcaaaaactactcacctggactatgcttcctgcctttgttccaaggagtgttccctctatttgccttagaaatcctcatccttctcaacttttctctgtcatccacttgttcttcgccatcatcagcacttccatttgaggatttcgaagaagcagaagacaaagaagagctccgttcgttttctttttgagccggatacttggtttcaagagtggccactgcagtaataagaacttttcctcttcggacatgactatgacccgtgtaaaatttcaaattcttggagaaacaagactgtctccatggattaggtagacttttagcatggataatactctgagcccccaatggaacaagatgagcttgaaatgaaggttggatagtagcaatatctgcaaagattaaaccaaagagtcatctccattagctagtaaacattctctagatactgtgcgaatcactagtcttttcttatacgcatttagaccaagattgcaaatgcaaataattgatactcaagaatgatgaaatccaatagaaaagaaacaaaattgagaagaaagagagtctcaatactgaagtagaattctaaacagtaaccaaacacaaacccagaaaattaagaggtaaatatctggaaactttaccagaaaaggtacctaaagaaggcattgggagctcattcagaccaggaaaacgaaaaaggaagaaactttgaaacactcttctctgcaacaccaaccaggatgtcttgtaagattatacggaacaatacattaaggaaatatgttcctcttactgtctgagagaggcgagagtttttgcaggaatttgacagacaaggataagccacacaaaaagcaaatttcaacgaagatacttgtgtctggctttgacgcagcaaccagggaggcgatggataacgagacccggctcgctctaatgacccgacccggatcactgcatattgggctaatgggccgcgtttcatagcccaattcacacgtggtattattttctctggcctctccaacaaggcacctaacgtggcccttacttactagaccttaataactcggacaaagttggtactcttgttggtgtaattcgatttcttcttctcacatctcaaatctccgatcaaaatccgaaaaaaaaaaaaaaaatg

SEQ ID NO: 31812 - DNA, 3000 bp, Unknown; identical to SEQ ID NO: 8513
  misc_feature (1)..( 3000): 2750-1469P.txt file - cDNA_ID_3045962; gDNA_ID_1971814; Annot_ID_58173

SEQ ID NO: 31813 - DNA, 3000 bp, Unknown; identical to SEQ ID NO: 8513
  misc_feature (1)..( 3000): 2750-1469P.txt file - cDNA_ID_3045962; gDNA_ID_1971814; Annot_ID_175876

SEQ ID NO: 31814 - DNA, 3000 bp, Unknown; identical to SEQ ID NO: 8513
  misc_feature (1)..( 3000): 2750-1469P.txt file - cDNA_ID_3045962; gDNA_ID_2926180; Annot_ID_200165

SEQ ID NO: 31815 - DNA, 3003 bp, Unknown; identical to SEQ ID NO: 19922
  misc_feature (1)..( 3003): 2750-1469P.txt file - cDNA_ID_3045966; gDNA_ID_1971851; Annot_ID_176409

SEQ ID NO: 31816 - DNA, 3003 bp, Unknown; identical to SEQ ID NO: 19922
  misc_feature (1)..( 3003): 2750-1469P.txt file - cDNA_ID_3045966; gDNA_ID_2926180; Annot_ID_200163

SEQ ID NO: 31817 - DNA, 3000 bp, Unknown; identical to SEQ ID NO: 8692
  misc_feature (1)..( 3000): 2750-1469P.txt file - cDNA_ID_3045974; gDNA_ID_1971851; Annot_ID_176399

SEQ ID NO: 31818 - DNA, 3003 bp, Unknown
  misc_feature (1)..( 3003): 2750-1469P.txt file - cDNA_ID_3046005; gDNA_ID_1971862; Annot_ID_176451
catatcatgcgtcaagaagcataacaaaagaaaatgataccatgtttcgcaaataccaccttcaccttagcctagttgaagatgacaacacacttctccttctctttccccttagacaatctttattgtaaccatataatcataagctctaacttggttctccataaaccaggacctgaatccatgagtcatgaaagctcctacaaagcttcagctcaagccgagttcattttcccaatcaaacaataaaaatcgttaggattttctctatataaatctgtctcgaaaacatacgcataagtcaggaactaaccattacaaatgctatcccaccgttgaatatgtagccagtagtatcatgaataatcccacgaagtttcatcccgatcagatttcacaatatcccacgttcttctgaagatgatgcatcagaactgatatttaggtttctgcaacttgagatgattctggacaaacttccaagatcaattccggatggagcttaaatctgatggacaagctgtcagctactatgagttccttgaatcaagatctttccatagacatcttaatcgtgatctaattccttctggtccatcgggaaaacgcatcataaaaccagtagtcacacactgttcttgatttatacttaacacagatttggacaacttctgcagttacttgcccagaaagaaacactcataacttctcgaatataaacccgattgaaactctgtcagttgctatggcttcatacaacgtgatctttgcagatatgtcttatttagaaactgattctctctggtttgacgggaaacatccttgtataacctcaacttgaagctaccattctctcttcatcttcttccttatatgcttctagttttacctagcccccttctctgatttactaggatctgcttcatctcacttctccttactgtcacaacgaaatctccatctcttaatgcctttcctttgcagtggtgatgatctcttttcctctgccacgtatcgtccttcgtctccgcttcctctcatcttcctcacggttatccttcatctcttccctttctcttctcctcttcaagcgttccacaatgactaacatactcaacaacaacggtagtggctgacctttaattagggttaagattaagacgacgcggtgacgctcggtttaggaacggttgcatgaatcgctttggtttccttcacttgtgaactctcttctctctcggatatggtaacgaccccactatagaactcatgtgttgatgctttggatttgctttctcaagattcttatttggtttccgttagtggctcagagaaaagggagatagattcacctatatatatgtgcaaccaacaacacacgtaacaaaaccctttaacattagggagttgcttcacttgggtttaaatgggctccatgggttccatgggctttgctttttgacaaaacgaatagggtgggctattgatgttgggtttggagtgttacagaataagtcgttctttatctttttggttttagttaggtgtttcaactctttcttctgctaatcaaggttcagtgttaagatagtgagaaaaaatactcataatgcaagcatataatggaagccataagatcagtgtaaacttttaagtttcatgtttgatcttattgtgatttattatgagtctgctattaacaagctactattttactcctttctctttagtaataaacaatgttgtacttctttagtttgtttggtttgtaaatttacttgttgtatgttgtgtcttcaactcgggttcttcaatgatggacgatgctgttgatatatatatatatatatatatatatatatatatatatatatatataaaggattcttttgaaacaaaaaagtatgcatttgcggatttgcctttagttacttttgtacgtgtttttcaattccagtcacctacctctctataatctttattattctttttttctttttttgggcaaacctctctatagtctatatgatgtataaaaggaataaagaaaactacggtattcatttttcgaaatcggtttttattttatttgatttgatttgtttcatgtgacctttatatatgaaatgaaattataaacaaaaaactatggtattcaagaaaaaaatgtaaaaaggcccagaaaatccaaaatagatgggcccaacattgggttgtaatgcattgacaactactcgtggacaagtacacgtgaataccatttccttccatacgtataaaaccaaattattttcccaaatagtatcctcttattattctattggtcaaatcaaaaataatgaccaatagaattatgtattctactttcatttttcaaatttaatagattttgatctatcaatagagaaaaatgcatggcgatgaaaatacatattccggatccaaccaaacaacatagcttttttattagactataaacaagaaaataaaatagaaagagactagatttagagagagaaataatgatgatagtgaagctgacactttctgcaagtttcataagtattttattcttttctatattttttctgtaaaaattaaaaaattgcaattgctcgaaattttcataatttttcgagttatgatggattcttgtagttgaaggcttgaagcatgacatttggttaaacaaaagcatagcatttttggaccatcatgatctctagattactattgaggataagattgtatcttatgcgataagtttgaatcctagttgtatatgtttaggaatcgacatttaagggtttggtgtttatcttgtgttgattccctcttgtataaatagcaatgttgagttcactaataaagcaagtcagttcgatatctaattctacatggtacagagctaaagatctagcaaaaaaaaaaaaacatctaaattttttcttttttttatcgattgtttcgatctttgtttttcttgcgtgacaagaaaacatg

SEQ ID NO: 31819 - DNA, 1675 bp, Unknown
  misc_feature (1)..( 1675): 2750-1469P.txt file - cDNA_ID_3046032; gDNA_ID_207; Annot_ID_143997
  misc_feature (1020)..(1022): n is a, c, g, or t
  misc_feature (1025)..(1026): n is a, c, g, or t
  misc_feature (1028)..(1029): n is a, c, g, or t
  misc_feature (1031)..(1031): n is a, c, g, or t
  misc_feature (1047)..(1047): n is a, c, g, or t
  misc_feature (1054)..(1054): n is a, c, g, or t
  misc_feature (1188)..(1188): n is a, c, g, or t
  misc_feature (1214)..(1215): n is a, c, g, or t
  misc_feature (1562)..(1562): n is a, c, g, or t
  misc_feature (1564)..(1564): n is a, c, g, or t
aatttcatcgaacatgttataggcaatgatgagtttgtggtgaataatgtgtgtgtaggtatacgctaaatatatgggatgttggtgggcaaaagactataagatcgtattggaggaattactttgagcagactgatggtttggtttgggtggttgatagttctgatcttaggaggttagatgattgcaagatggaacttgacaatctcttgaaagaagaggtatattcataaaagtatcaatatctattcaatcaaaagcttttgtaagctgaagcttgggttgctgtttttggtgaagatgattcatattcaaatcttggttttaatggcagaggctagctggttcatctttgctgatactagcaaataagcaggatattcaaggtgcactaacacctgatgaaattggcaaggtaagggttttgaaactcataagtcgatttggacataggggttatcgggttgaatcattttgtctctcggtcgggtttctcaacttcagtgaagattagtgggttaagtaagatatgttttgagttgtatattgtgtgttaaactgagtttcatcttcttgcttatgaaggtgctaaacttagagtccatggataaaagccggcactggaagatagtgggttgcagcgcatacacgggtgaaggtttgttggaaggattcgattggttggttcaagacattgcctccaggatttacatgcttgactaatcgactactgcattgcacaatcaatggcttgttatactcaactatatgcagtgactttgtattggctctaagtttttccttcagttctattgtaacgatgattagacaaaacataaatatttccaagacgaactcttctcattttgtttcattgaaagagacttaacaacaaaatgatgtctcatacaaccaaataaaacttattgataaaaatccaaccataatctaccacagatagatgaaagttgtctctgcagagtaagaaggaagaagaagcatacaaagagagatcatttnnnacnncnntnccttgtttcttcttgncgacttncatcagtgtacattatgcctttgcccttataaggttcagggggtttgcaactccttaccgttgcagcaaactgatgcactctttgcttgtcgattccagtgcagcaaaccacattgttcttgaaacaaaagacncgaaccgctggaggaaccgcaagttnnacttcgtgactgtaacccaatttgaggtataagaaacgccctgcttcctcagctctagctttgtatccaactccaacaatcttcaagaaccggaaaaacttggcttccatgtctctctatcctacagagaattaccctgccaaagaggaaaatttctcagcttcttcaaattaagaacttggaaaccaatagagttcaccattatcataaaacgatgctcaatcaaaatctgaaggcagtagattttgtctctctagccactcaaatcacacaagtaaatatgaaaattgaccaaccatgctacgaaaaattgccatttttttcattactttgtatctcagagacgnanaaacgagcgatgagctaacacagtaaatacgtcgaacactttccgtgcactatttcaagaacaatataaacggaaataaaaactccagataacctcatttacaagaacatg

SEQ ID NO: 31820 - DNA, 573 bp, Unknown
  misc_feature (1)..( 573): 2750-1469P.txt file - cDNA_ID_3046068; gDNA_ID_686; Annot_ID_144174
tcctaagtggtgtttgttttgttgtggtctaagaaagaatcgtaagtcaaagacaacggataagaaaaagaagaacagggaagcctcaaagcagatacacgcgctagaaaatatcgaagagggcaccaaaggtaaccagaataaatcctctgtatcatttggtttcaacatttagtttcagttcattgctgaacacttttttgtttctttctttttcttaggcactaatgatgcggcgaaatcaccagaggcggcacaattgaagttggagaagaagtttggacagtctcctgtttttgttgcgtctgctggtatggagaatggtgggcttgctaggaatgcgagtccagcttctctgcttagagaagccatccaagtcattagttgaggatacgaagataaaaccgaatggggaaaagaggtaatgtagagctctttaaaacactttttagcactttatctttcattttgcgatatggtttttgatttctttcatggtgtttgtgaaatttattcaagattgggtggatctacggatctgtcaccgaggatatccttacgggtttcaagatg

SEQ ID NO: 31821 - DNA, 823 bp, Unknown; identical to SEQ ID NO: 22
  misc_feature (1)..( 823): 2750-1469P.txt file - cDNA_ID_3046082; gDNA_ID_884; Annot_ID_144617

SEQ ID NO: 31822 - DNA, 3003 bp, Unknown
  misc_feature (1)..( 3003): 2750-1469P.txt file - cDNA_ID_3046100; gDNA_ID_1971666; Annot_ID_175059
catatgtactatcttctattctttctattctattggattattggatttctatcttctatttcatttcaacattccttctaattattgttattggatttcagcaatctaagcagaaaagcatgaagttaaggaaagcacggaagaagaaaaggccaatgcgaagtagtttgccaacctttgactagtcccattctatcggttaaggaggccaggaaagatcctcaggtagaactcagtttgggaacaaaaacttttccgagcccagcaaaataatcgcaaggagcccagcttcaaactaatagcccagctccataacaggcgagcagccaacaaactatgacccgaggcaaggaacattccccatccagctcagcccggcaagtgaaacataaaacacaatttgcactcttccagccgacttctcagcatagcaggaccaaccaatcagcacatttggcacttacgccagcaaagcatatatgcaagtcaggctcaagattcacacccaaactaggctcagcagcataaagatgcccgtggtatagactactcgacttagactaagaaggaaccgagaaagtaagccaagcggcgtagaccaataatcaatgtagactttgacacctaacaattgcactagattcaaggaaacctaccaaggaacaatcacatcgggattagcaagtcaggctccgcattcgtactaccaagctaagcagaaagattaccggtaaatggattcctttacttagaagtccactcacccgagcaaggaagaaaagcaatgcaaggaccaatccaactaaggacaatcaaacaataccagcatgggagaaaaaggagactcatcacattccatcagtcactcgagtcaaagcataaagcagagcaatcgtactccactcaagaataatcccatcaaacaaaaatgggcgattcacatttcccttccctcgacctggctctcttcaacttgtttcgaccggcttctatattctgaatgtttcaaccaatttaactttcacccttatcgttctaaatgatctttctctttgacttcgagtttcagtattcgtgtgacttatgctccacttgattagcgtagctgccttagcttgccccgacttgactgattggctgggttcgcttcacctcgctcggcttagttggaggactacagaaagagaagcatgacaagcatgacgttccttaattatatctatatatagttaactatccgtatatcatagtaaggaaccgaaaagtagttacccattcacgtacatcggttgtgtcgaatatttgtaatcaatcggtcaaccagacatcacgtaactattcagatccaacttctagaaataggtttcagtcagctcgatgaaatagactaatattgaccatttatgtcagatccaatagcttgcctcgaatgccagcatgaaacctaattacgatagcggtggcgaagacttgaagtaatcactttttcctggacaatcggccagctaaaggtcagacccaataatagcataatttcacccatcagtggttggtaccagtccgtaaaagtccagcacttaggtagcagccccatcaactgtacaataccgacctaacaggaccagtatccaccataaaaaccgtagcataacaagctaggttcccatagcatataaaggtagggcctagtctaatagactgaagcactaatcacaaggaatcacaaatagcatcccatggacaagtatttcaccaacatacagaggagcggaccaatttcaacgagtagacaaatccatttgaaaagacaactaaagatttattaaatttccggttaacttatgatcccggcctagctcgtcttttcttctataatagcttttggtcaccgctaatcatcaggtgacgctggtcaagatcagtactcttattaactttctgattggcattagtatagaatgggcgactaatataatagaagcatcaatctaaaatcaacaatcacaagtatctacatgtttactcaatgcctggaccaccttaactactatgtctagtcttcaaaatgcctggctacgctataataaaggcttgcaatgattgtgatctcttattgtatttgatcctattaaagtatcatgagaaagctacgaatgttactatgcacgcataaaaagaagtgagtcgaatatcttgagtgagaaatatggtagctttacgtgctagaatggaccaatacattataaaaaaggatctctctttgaaacctttatagaccccaggcttcaaaccggaccttagaaccctccaagctcaagagtacttatctagacatcgcaagtcaggctcaacagtcgtactacaagctcagcagcaatatgaccatggaatggagtcattgagaagaaagggagatcctacctccaatacgagagggaatcgtacgaaaggaacaaactcaacttcaagctcttagcccagcagcaacaaactatgggattggtccgagacaaagaagacagaaacagcccggcccagtaccaatatcatctaacgaattgtacgagaaagctaccaatccagcccggctcagcaaggcgtggaaaatgaagcacatcgggtccacatgggacagcgcaagttagactcaagattcgtaccatccacgactgagtgaagtaggacgaaagcaaccaatctaactaaactagatagaataatgtttcaactaattaaactataaaccttgttcgttctgaactatctcctttcttcgacgttcactgggttggcgtgactggcttaaactctctgaaacctgctattatatcaaccgatgaactaactatctcttacatatctctatatagaatagattatctataatgtttgattcttagtctactgcccgtttaattcccttgacttggccttacttcttttcctttcttcgcttgggcgttcctatcaaaagaatctgtcatgccaaagacccaatccatg

SEQ ID NO: 31823 - DNA, 3003 bp, Unknown
  misc_feature (1)..( 3003): 2750-1469P.txt file - cDNA_ID_3046102; gDNA_ID_1971666; Annot_ID_175057
cccaggatgcgaagggaatgagctcggctgcttctcctccacactgatttttctccgtgcctgctccgcatgcgcttccccattgggctttgctctcctcttattcttcattggacggttcggttcggatggacttcgccgttctttcccaactaaaaaagaaaaggctgtatcacatcgagatgtcgattcgttttccgcccccaatgagatggggaatttgtaaccccctatttctactttggggcccttcatctttctgaatccaggcccgtcccggctcgtgtcgttccaacaaccggcggggagcatctcagtatacgatcgcgcgcagtaactgggagtcctattacacctaaggcgaacttcaattcaccaaaccaaggttcatctcgtgtagtgattgtggactctactaaggatattgagtagacggttgatgtatcagactcgaccctatctttcgtagcatgcattcccatcggtgtcgcaactgattcggtaagctacgtgtccggtgcacggagaactgccttcggtcctccaaacttacttattcgtggcaaccttccggccgcccaacgacctataacgctagtcactactcccactggggctagaaagtaagccccacaacccaaagcggcgaagaacaaatagaatttgctacaaaagccggctaacgggggtattcctgcgtatgagaacatagtaatggagaaggtaatagccgaaataggattcgttttggctagagcgcccaaatccgctatatatttgacacgggtttgccgtaatgctgaaactatggcgaatgcatccatcgtcattaatgcataaataaagataccaattagtagtgattgaattccttctatggttccacatgagaaaccagtacgaatataacctacatgtccaattgaactatgagctagaggtcttttgactttcgtttgggccatggcggccagtgctcctaagatcatagaagcaatgctgcagaaaaagaagatttgttgcaatgtagctccataggaaccataaatagaaacacgtaaaatattagcagaaatagagattttaggcgcaatagaaaggaatgctgtaaccggggtgggtgaaccctcatagatatctggtgcccacatatatagagtcaaagggaatatggagtccgagggggagggggttttcttcggggctcgagagattgaatagacccacaagtttgaaattcgccactggggaattcacacgaaagggaacgaggaattctcaacgaaaaaagtgctctctgaaccgaacgtgaaagtttttttccatcagacggctgttcctgtaactccactctcgacttggattatatatccaaaaaggtccgctctcggccattccacacgctgcctagccgaggtgtggtttctgaagtggattctctcttttctagtagatgccgaacctgctgccccattgactaagaagaggggcgggcgcagcagctacatggaccccttcctttctgttgttgccagcgctttcccgggccgagccggaatttttgattattattctaatgggcaggcaaagccgcaggctgctatcccaataggccagcgggcggttcgaggagaggctccggcaatcatagcaccgcggtcgaaaaagcgtgctcccttcagataacacgcaccgtagctatcctcggccttcttcgttttcgatgcaaaagaaaggaaatctctcgatctccgaaagccttttccttaccccgccgcatctccctcccttcgtcgagcctttccggggttgttccttccttatcagaacttggcgggcattctttccagccgggggatgggttttgtttgaacataggctcaaacataattttaaggtcctagctacgccatgcgttcaataccaaatctggaaagctgcagaaatgacaaaaagagggccgctttcctatgttgcactgaaaaaagaaggacctaagagcgtcttctcttaggttttttcctcccgcgcccgccgccgcctggcccccgttagagggaaggggaagattagcaaagcgaaaaaagacagaggaagggggagcagcatcttattctcttcgcgagaacttccggattgaagaagcattcggaacgggctccagcgttcatttcattggcgggaaacgatccaatccattcggggcttcggccaaaaacgaattcgacttgattcatagatagaatcaatgataaataaacaaaagatagatgttcgagatatcttttctttctataaaaaaagaggaatagaatagacatccctttctttagatgtctatctatccttccgattttatatcgttatatctgctctctcaatttttttttagagagagcagatagatcctatcccctatatcgaacactaattcctatctattgataggaagatcttcgtctaatagcggactttgcctttttttaggaatttctcatatccaaggcagcttaccacaagaaccccaccccatacaactagttgggggggctgttcgccttttgaatcaaacaaagattgaagtaggtaggggcttcatagctactttcattctaaaggaaagcgaagaaccaatctttagtcaataggagccctacttccctcgacctcatcacttcaattgttgcgcaaacctctttcttagtcaccgggggagcgcacctttgtcacagtatttcgagctgtttgatagtgacttcttgcgtttggtagggcgacgaaagggctacttccttcaatctaggaaacagccggaaactcgagaaggtcgcctttggaacggttcgccagtaaccaaagcctcactccttccttttgattatgtcgtgacgctgactgaatccaatctataaaaaaacccggaaactcaacaaagtgcgttcccttcgtcaagtaggtaaagtaggcatacgaaccacttttgctttgcggaataaaacaatg

SEQ ID NO: 31824 - DNA, 3000 bp, Unknown
  misc_feature (1)..( 3000): 2750-1469P.txt file - cDNA_ID_3046116; gDNA_ID_1971666; Annot_ID_175045
acctttgtttaactgtacgagcgagaataccagctaatcatgtaactgccaagaataaggattctaaaggaaagagttaggtgtgccagagatcctgggattacctttggagaggaaagctcctactattactattaaggagcactcaaagcttcttcgctaggacaggacagcacagaagagtagatagcttgcttcgctaggagtgtgctaacttattctcataggcgtacccgcgtagaagaagctaccttcctcaaactcctctgcgcaacccagccataccagagagtgctatcacaaggaaattgtctggtctcagaagatgagagcttcttttttagcagaggtactgatgtcaggagagtgtcgacgcgctcttccccagtcgtgttgaagaagtttgagggaaagatggattctgaaggaaatcggctgacctatcggatgaagcagactgctgcgaaagtggtgccacgagtcgagaactcttagaattgtgctcgttcaggccctttagtgcacctaagtgcgaagctggtgctgcaagggaggatgtgggcgggagagcggtcagtcctctacctctcgctatcgatcccttttgcgtcctttctagctatcgactctatccctttttctttctagctatctcttcttccgtaaggacctttttgttcccccccacgctgatcaacaaccattgagataggatagagccaatgcaggaggtgaccgaagtagctcaataaaagaatgaagaaattgggaatggtaattcgagcaatgaaaagaaagaaagagttcgcccaatcgtatagctttttccttcaaatgcttctatctcacttgtttgctagcttgcaactgctgggcactgaaactcagtcggccgacatcgataagggagattttcttccaaccccttggaagagaggaagagaaaggagtggtgatggcttaaagaaccacgttgcataagccggaagcacagaatgttactcggaaacaagcctgagaacgactcttcaccgttagccattatgtttacctggtcaaatgccgtcgtttatgataggtcggtctagtgagagcaaatgatcaagcaagaacgtgcctacatccgttgatgcacttcgttgactagtgaagggtttttccttggggcccacgttgccactggggtcgctcatcttactctagggtagcactctctatggaaagaagagtggttgtgcttcactactagccaagtccatgcagatggggataagggggttcactgctgtctgatatcatcatatctattttgacctaaaagcttacttgggatatctaagagctaattaaatcttttctcttaaaaaaacgggtaataagaaaacacttattatctttttatttgcaagcaacatctgctcaaaaagaaaaggaagttgacttcactccggtgaccggcttcgcgggatcgccttacgtataaggacctgatccactctaggcgaagcttttttgggcgaaagctacttactatgttatcttccaattgagttgagagagttttcaatcgaattccaatttttcgttatataagctatttataattgaatgatttaaagattgagtttcaaaaagaaaataccggagaaaaggtgatgcaaacaggaaacctgcttcgcccgttgatggtccaagcccaagtattcattccttaaggagctggacgtattgttcagcttcctatgaagctaggctggcacttaggaagattggacgagggtggaaggggcacatctggtggtatcgtatataagagagagcttcttttaagaatgatctgaaactatcaatttcataagagaagaaagaaagtagcctagttcagatgaaaaggtatgccacaatgctatccgagttcacaggtgtcgttccgtctacttttctttccaaactttttctaaagtgcgaaataaacctatcaattggtagagtacaagatcgaaaagaaccctataggcaggctaaaagcgctgtccgtcttcatggcctcaataatactcagtattgtactggccgaatccgtttcgcagcacggagtatacctcaatctccgttagttccgtttcggctttttccccaatttcccactccttctgtgaggcaaaacctcaccacactacacttcgacacaagagaagaggaccgggcgcttgtatcttcgggataggagttatcggtcttcttttaagaaaactcaaatcaaatactccttatctcatggatcaacttattgctgatttcgtttctaggatgggtttggctctgcctgtacttttattcttgtagccgttaggtctggccaaatgatccatcaaataaatagtattaatatggaaataatcctgactgatgtagcgcgagatgcgcttcaagaaaaaatcgtgtcccaactctcaattctgttgagagtatatagggatactaatactagtgagagtgtgaccttacctttatccggagtaaatctccaagaagtcgccgctcgtagtttttttaacaacgagagcattccatggttttttcatctatttagaccttgtcaatcagggcacgaaaaaaaaccactttgcccacaagctctggagttagtgctttcgttcagttcataaggtagactttttttttctaaagcggtattcctccttgcctctaatcctcaaatctaatatgattactcggctgttcgcccaactggtatcgttatcaattgtaacttattggaatgacgctattgttgcgacaaacttttcctggctcttcataactttctttgttatgactttcacctttcgtaccttctcgcgctacttcaaaaaaccgatcatttggactttatatttttttttatgtttaatagcctttctccttctttgggcagcccgaatccatataaatatccttttctcatttgcttttggagatgtttatagcttcttcatg

SEQ ID NO: 31825 - DNA, 3000 bp, Unknown
  misc_feature (1)..( 3000): 2750-1469P.txt file - cDNA_ID_3046120; gDNA_ID_1971666; Annot_ID_175044
aatcagaatccgcaagataagcagccaaacgagcagagcagtagaaggacaggtcatctagaatcctattcttccgatgctttgatcggttccttctgatatggaagagttgactacccagcacatctttgtttgctcgactcggtaagtacagccgcttcctttattcttttctttgaaccattaccctcaagggactactccgtggcccagtgacccttggtcttttgttgctgttccccgttccctttatcagctctttaccagctatccaattaccaatgaacaatagctatgaccgtataaccaaggttcgtagaaactctataaggagaggcatagaccggtggtccccttcccaagtgcctctttgttttgtacgagctgtttccaagtgttttgattagtcgagtcttcttctgagtccagcacttttcctttgtccgatcgtccgtctcttcctctcctcttggtcgagttgctaaagcacctatctttctttgttgcctccggtgtgctaccgagcctttcccaggtatttacttactgccggtttactccacagcattgccatcttctttgttttgttggtatgagctgatcggccctctcaagcgtaaagtagtcctctgattgtgttgtattggctccttaagcaacatttgtttacttatgaccgggtgctgcttatgcctagacatcttccccaggacttattctcgaaagacgttgacctatggtaggtgctgagtccagcacagttgttcctttgttactgtgccatttcgagaccttcgtccgatcattgttcctttgaagacctgtcttttattccttctctttccttgcagtaattaactcacatttatggtaatgctgatgcttggcagcttcactgttccttcttgttgtgcgtaggcttggcgttgtttactccaccgtgctatctttgtgctgctaatcagtatagtatattctttgcatactgctatctttgtgctaatccatttcagtaaacgggaaagtggaggagtaatgattggttccatcaatcttattatttcctttgttttggcttgggtttctttcatacgagtaatgctatttatcaatctttgtgttcatcagtagactcttcagctcctggctcctgatcaatcttccactctgcgcctgctgctgatccatgtcattcagatgttcctcgtcctgttgataaagcacctttgcaccttttcctcgaggttggggtttcggtatgcttacaggggttttagggcggagtatgagcgtgttgtttattcatcggcaccttgaccttgactaatcgacgtaaagcgtcttggcttctcgtacggcttggtgctgtaatctttctttccttggtcagtggattatggttcagtacagatagtgataatgctccaatggttactgcacctgtgtagggaatcttatttctttttctttctttcgtaattaagtccattttatcagtcggggaagggagggagagtcctgcttcggacctgtgacctgcttcggggcataagtgtattagtgcttctgtgtacgattgtgctgatcagtcgttcgtgcttttgcgataatgtgataactaaaataaagaagaatgtgaaagtatgagttttgtacttgagtgatgtgctactgatcagttgtgtgagggcttttgtttccatagagcgtgtgcgaagtgtggagtttcgtacttgactccatcccgtgatcaatgtgctaatcatttcaatattgagactccatcctgcttctgctcctgatcctttgtgctgctaatcagttttgtatgccaaactgctcctttgtgctaatcatcagtagaaagtggaggagtaatgcttggtcaaagtgctgtagatttgtttcggtacgagcactgcctttgtgctaatcatcatttcagtatattctttctttcgtgttccatcctgattaatctgtaatctatgttttgtacagctggcttgggaatcatcagtagagtctttcagctcctgatctgtcaactttctttcgacggctgcttggcgtgctgtcatctttgctactcagcttcgtacggttttgggtgaaggttcaatcttttgtttcgtacgagtcggatatgtttgtgcgagaagaaggacagctttcgtagagagtccgatcaatcttccactcttgcacttgcattcattcggttctcctctcagttccgtctaaatcccctcgtcctgactaaagcacctctccgtgttccgtcgatcacctagataaattaagtatagtaataagaatgaaaagtatggcttggcgtgttggatcaatcattcattgctttcatcttgaattaagtatatagaaaagaagtgttgtctgtgccaagtctagaagtggtagtattagcgatcctattgaggtgtttatcgggttcgctgctcgaatttcaataaagtcaagtttcctcaatcccgtttctgttgagttgccaagatttctcaatccttgtattagttgatccttttgtttattcgaaagatcggcgggatgctacttcaggtagggtacgggcgctctatcattgtctgattttaggtttctgatcgctagcctgccgggccccccatcaaactatcaatctcataagagaagaaatctctatgccccctgttcttggttttctaccatgtttttgttggtcaacaaccaaccacaactttttatagttgttactcctagaggcttgacgtaagctgtctggagggaatcattttgttgaaatcaattaatctaatcatgcctcaaaagccaaatctacttttttgcagttccacgaattccggaactaacgacgttctgccaggagtgcctattctggacatgtttcctaatatataagtagacaccataattaaccaccccttctagtgttcgggtacagtagctctcgcagaagaattggtggatcctattattatg

SEQ ID NO: 31826 - DNA, 3000 bp, Unknown; identical to SEQ ID NO: 8285
  misc_feature (1)..( 3000): 2750-1469P.txt file - cDNA_ID_3046124; gDNA_ID_1971666; Annot_ID_175037

SEQ ID NO: 31827 - DNA, 3000 bp, Unknown
  misc_feature (1)..( 3000): 2750-1469P.txt file - cDNA_ID_3046143; gDNA_ID_1971666; Annot_ID_175023
cctgaattaattctttttctataggaaggaactcaagcaatccggcatccccggcagctatgcaattacttaattcagtctacaataatttggtgtccgattttcggctagtggacagctataccaataatcctgtatacagctgtataatattttttctaaaggattatcggtgagcaagaattaaaatgtagttttgagtttcgttagttaacctacctttttcttttggtggtgagtttccttttagggggttacgagcctttagcattcagattgggcaatgcgagatagattgatttacatttacctcgaggatagtctttcttttccaagcgcgctttcccaacctgccatatgtccgatacatagtcgagggctctatacgagcgcctttctttcaactctatctattcttgcttttcaaacattgtattccttatagaatatcatctcatgtctatctatagtataacgtttctcatagtggcatagcggctccgaggtgattctttctggtatccgtcctctctcatactgctttaaggttggaggatttagttcaagctagtctcctatggtgaagatctctatatttgttaagactgtatgaaagaaatcacatatagtaatcatctaagaatatatctatactataatggttgcatctaacatttctcatagtgtagataaggcagtccccggagctaagaaaactacgctattcaaagcaatccgcccaaggaaggctagctagtcgagtctaatgctaggctaggtgattcctctctatcaatgaccgaagcttaatccagagagagagctcactataccaccaggttgccacatttgcttatgaaacaagaacagcttatcccgaggctctgaaagactgagggtagtcactcaaaaagtaatccgtcacttcgcccgaaaagcactataggggattccggccaagcgagcataaaaatacaatacccaactttctgtttcagcccactccacttcattgaccgagactttctattccgaaccggttcggttaaagacctagccacgagaccaactccgggctgtctcgtaaaagatcaattcccagatgctcttactcgacgcccacaggcaagcttgtttagagaaggagagttctcttcatcagggaaactgctcaacctccactatttccataagcatgattatgcactagcagacataaagtgccaagaagagaaaacgcataactcataagccaaagatgtattcgatcctgaattgaacgtaattttttccgattggttggaaggtaaggatagcatgattgactggttgcgggtcccttggatcatgggccacagctatttggatagattcagatcctttcatgtagtagagtctttgatgggctcggatccttttcatgatttcatgtgaggacacctttggcgggcttttttgatagatccaggatttctgtgcgatatcgatcttctctttatggctttggttaatctatcgtctagctgtcttggtcttccgaaaaggcgaagacaaacgcatggatttactttattctatgactaaaccagaatcaccccggagtgagctgttccataaggggctcatattatccgacagagcagagctatcatgccgaagaagcctttttctttctacgccccggtggcatcttgactttcctaggtctctaatagttccccataaaagagtcaatgggctgagctgatcgagtcccattttctggctgcaaggcccggcccgagtagtcaatggttgctaccgctcactgcgcttctctgtaccatttcatttctagtcaaaatggatgctgggcatatctactgacccgacaagctgacgtaattctatccatccgtagctgtctgtgccgctacctctatccagcagatccagtgccaaccgatctatatctagctttggccggccgggccaacccacctatacagagttgatgccatgcccgcctaaccacgaaagaaagcatccaatatttcaagactttctccacagagctctaaaatcctttctccgaagatccaggctcactttttcaggcaatggaatgacccgagcaaaggaaagggatcaaggcaataactacgcgcatcaaggtgatacctagaccgagcgaatctgaccgtagcctatcatactgagtgaaagcgtgccgaaccaagggaacttgcctttaatcttaggctcgcagctactaggtgcgtacccttgaacctagcccgccctagggtacaggcattgaaagacggctttcagaataggcttttttgtacgaagagaaggttacactactatataagataagtaattcattataagataagtaattcattgtgctaaaagaaccactttgaggatcaatcccttactgaatgaatgtccttttgatcagtgatcacagaaggagaaggcactgtgaatgagaacctctttcctttctggctaccaaacgtgctaataaaagagcttattctgagttttaattcctcgaattctgtaagctagcttggtctacctgctttgttctgatttcattgtattcctccgtattcagcattcgcgccggtgtcacaaaaagcaaaagcatatcaattcgttgaggcaactagtcttggtaaggttttttccactgaatgagaagtttgtatgatccagatgttttgaaggcgtgtttgcccctgtgatacgcgtacgaggagtcgacggggaagagccgtgctggggttggaagaggttccagctttagaggagcctccctatcttatcccttgttggtcttatttgacagctcagctttgtctcgggcagattttggtccatgatggactctttttatttattttgacgattggatttctatatgaatggaaaaggggtgcttcggatcgggagtaaagtgatagggcacaaaatgggggggaaaagaaaggaaagagaataatg

SEQ ID NO: 31828 - DNA, 3000 bp, Unknown; identical to SEQ ID NO: 4636
  misc_feature (1)..( 3000): 2750-1469P.txt file - cDNA_ID_3046178; gDNA_ID_1971690; Annot_ID_175071

SEQ ID NO: 31829 - DNA, 2585 bp, Unknown
  misc_feature (1)..( 2585): 2750-1469P.txt file - cDNA_ID_3046188; gDNA_ID_1971693; Annot_ID_175104
tggactgtttagggttcttcttaaagaaggaaactttgtggctcttctttgtgctcttcttgcttacttcgtcttctttaactcttactcttcatcttcttgattcgtttttttgaattcttgtcattaacgaaaacattcacagctagtatattgaaatctttcctcattattatttgtactttagtttaacaagatttgatttcttgaatctgaaaatatcgatcttctttgttggattgatgtgttttctgatgatgtcagagagaatgcttccacgtcacaataccgacacgtgaagtaatttacattacttttgtttatttatttgagagaacacagattcttcttttggtctctttgtttgtcggtcattctctgtctctgtccatggaagagcttctgaaacctgaactataatatgggttagaaggcccattggggcttacgggttaccattaatggcccattttatcgtatatagtggagaactgttttagtgacaacgtattaaatacagtatctactaggccagacgataaattgtgtttgaaggaggaagtgcatgtgattaggtatggtccaagctgaagttggttagtaaaaagcttaaaagatgataagttgcaccaatttttcataatgtagcaataataacaagtgtaagaagatgctcaatccaagtcaatgcatagttcatacgataattctttttttgataaaagttcatacgataattcaaagatataattatgaatatttgacaaaatatgtacatacattcaatgctctggatccttcatgagtaaatcgatcctcaatgctcttgaatctttatccacaatgagtaattctcaaaaatctgttagtattgttactttgatttggtttgctttgtcttcaaatattatcgaatgccattggttggtggtagtaaatcatgacatggccttcaaaagaataattggtctgtttgaatgtttctcctttagatatactaatactatataataattaaatgattatggtccaaaattagcagtaaggctgcttttatctctctttttttttcctttacactaatttgattgcaaaactagatggctaatacataactttacactttgcattacaaaaaatagctagcaaaatatccaaaaaaatttaatactgtacattgttccttagtattattaaaatgactctttgggtgttaactgttaataaaagcagtcaccgacagcattcaaagtattttacttctgtcttctatttatttattattgtatttaccacacacacgcatcaagttttctaatgtcgacagagaaaatagatagtactgttaccctatattctaagaacttaacaaaacattagaaaaatacaaaagcggagacgactgtgatgaacaggttcacataatttagcattgtaatttatacaattttgactaaacaacaaggataaaaagaatcttaccacaaatgtaattgtcaagcctatctatgctcttttatcatcataaacaacgtggagaacacctcaaaagtgattttcaagagaacaaagaaataaatatgctactgaatatgttgaatttatgcagaagctaaatattttctatgtaaatgtaattatttgatttgttttgtcttctcagaattaacctttgtatgttctaaatgagttgggctcacaattcacatcacatgattgaacaatgaacattttttctcaaatatctgaagttgatgacactccaacgcatgtggccctgtttattttttttcctaagagattcaaatgtattttttttcctgtgatactcatcaaaattaaattccttcttttaaagtttccaacaacatattagtctcttttagttctaaatctaaataccaggttaattcctgtgctttttcctcttctttggtgggtcaagttctgttctttccccttcaaccatttttttatttataaatatccaatttttatgaagatattttataagtaatttcaacttacgaaatagagtgtaaaatcataccttgtgtaatttttttttttttaaaacatcacattatgccttgtcccttttgcaaggtaaaatacaaaagggctatttcaagctattttcttctttcacaaaagaaaattagaattaatagaaaaatattatttttttgtaaaaaaattaatagaaaaatatagtaatttgggtcctttaagtttcagatacagtgaaactaaataactaataaacaactaatataaatacaaagatacatagatctgtgtctgtgattattcaatttcttctgcttgttcgtatctcccttgtttgcttaaagcgttattgagcgagctattttttcaaatctttgctaattttctacaaacgattgatttttccgtctgggttttataaaaggtttgggtttcagagaaattcacggaacaaggcacagactttttcttctgggtgggcaccgactaaaaaaggagctctttctccaattctgggtttgaaatttctgtgtgtgtgtgtgtgaagcagtgaagcaggaggtggcagaagcatg

SEQ ID NO: 31830 - DNA, 3000 bp, Unknown; identical to SEQ ID NO: 29050
  misc_feature (1)..( 3000): 2750-1469P.txt file - cDNA_ID_3046188; gDNA_ID_2926192; Annot_ID_201156

SEQ ID NO: 31831 - DNA, 3003 bp, Unknown; identical to SEQ ID NO: 29049
  misc_feature (1)..( 3003): 2750-1469P.txt file - cDNA_ID_3046192; gDNA_ID_1971693; Annot_ID_175102

SEQ ID NO: 31832 - DNA, 3003 bp, Unknown; identical to SEQ ID NO: 29049
  misc_feature (1)..( 3003): 2750-1469P.txt file - cDNA_ID_3046192; gDNA_ID_2926192; Annot_ID_201154

SEQ ID NO: 31833 - DNA, 3003 bp, Unknown
  misc_feature (1)..( 3003): 2750-1469P.txt file - cDNA_ID_3046196; gDNA_ID_1971693; Annot_ID_175100
cacacccatcaccggatcaggcattctatacatgtaacgttgactctccccttctcctaaacgttgaccaactcctcttaagtcataaaccggaccagttggtctgctcggtacatttgaaccggactggggagctttctgtcctcgtccgtagatcgggacaagcgtagcctcggagacatcagatttgcataccggacattttggtggttccctcttatgatcgtattgatcgactcgttgtcttgaattgttggacgcataagtccacttgtgaatgcagggccaacaaaacaggtggccacataaagtcacgaccgggtctcgaacctgatccaaacatatgttgcagtcgaagtctcctccagaatcaaccaatgttgtgtcgtcctcatccttctcaatctccattttactaaaacatacaagacaaacaaccattcacttgaccagtcgttgtttatttaatgagatttcacctaaataagtaaatagtaaatactaaagtctaattccaattagagatttataaaatcaatgatacttcatagaaacaagaaatatcatcaaaatatgaagatcaatatagattataacagaattgttgtgtatatacttagcatgatcgatcttgaatttaaaacttacactaaccaaaaaaaaaaaagaagaagattagacgcaaaaaagtaaggatcatattctttaacaagttgaagttacgaagacttgacctaatcactttctgtttccgacgctttgctctgttttcacttaatcccaaagcacgttattgtttaagaaaaaaagctaaataattaaagacaaaggagtggttgattaaacaaacaagtgatattatgatcctttaaaaaatgacatggtatatcgaaaacaatcatcttcttgcgtagcaactcaaaaacggtgcagatctactactaattcgatgcctttagatagacacacgcaacaatatataataagagtgatgattccagaaaaaagaaacgtactctttggaaagattgtaagtaccgatggatctcttctgtctttaagcctttggaaacttgagagagcttgtacaggttcatgcgacaatggcagaagaacagagaaaatgatttatttgggttaagagaatggggtaagaatgtttagatcgagggtggtgcagaagcaggagaccttattatacacacatacacaattatttttattcttattttcttaaggtgtgcaaaattaaaatccggacaagttatgattttaaagaggaagaaacgtctacctaattaaaaataagtagataaagtaacgaaacgccattcatcttttttttcttacatgtctgtctttatttcatgaaaaggtcagcaacggatagcatcgttttaaaaaaaagtaaacaagataatataattatttatacacaactaaatatatatttatagaaaaatatttattttagtttgaataaaattgtatgttgaaaaaaaagtatgaattggaaatatgccctaatgagtccatgagaccatgacttttgtaggggaaatatacacagaaattgcaaaattcccccataactttatcccaatatcatattcataagataagaatttggctctgaaaaaaacaaaagataagaatttggcagtttctgtttctggcaacacaatagtagatactgaaccaagctcgatgacgtggcactccatggctgcaccgttactccatcaaattcacttgaaaaaaaaaacaaaaaaaaaatgctagtaattttgaaaattctgcttattttggtactttacttttttttttatggaaattgtaactattaggtgttgagtgaataacaatggcaatttggtaagttgtttattcaaagttggaactggagaatactaagtttgcgactaaagccttaatcaaaggccttatcaaccaatagttgaattagtttatagaccacaaagataattaggttacacgtcacggaagcaaggagctattggtgtcaccagaccatagtatttaatttcaagtctattaattgtagaaggcaacccaaaatccactccttgaaataataaaacactgtcttaaattcgtatttgttgagtccttcaccaccattatgtctgattctgcttatatacaaatttaagtaaggttgttagacggttcatgtctccgaatctttgatcaattgtaaagtgtaatgtaaaatagttttttttttttttaattttaaatttgcgactactatatctaaaagtctactatcaactacaacttcacttgtaaattgtaatactctcgaatagatcatttttgatgaaacaagttagacaatcatccaaaattaatcaccaatttgagtgcctccgaatttattcacaatattcattattgaaaagcatttttggatatggccaaccaataaaatgaaaattgaactttaaaaaaaaaaaactactataccaacaatgtaaaaacaatgtgtgtgttcaccatcattagaacaagatctactcaatgttttaaatgtatatataatatgttttgcgcaaaaaaacgtatatgtaatattatatatatcacgttcatgataatgttttcaaattctcatatgaaattattggagcaagttgcatttacgatccggagaactgagccaagaaatgggcggttctcaatttattatgggtattattaaccagtggtggttgaaccaaaattaatctattcattttctctatcaaactttttgttactttgatggtttgtctcaatcgattaaaatagtaactagttattttgttttggcatgtcactgaattgatgttgtttcttctaatttatgatccgctatatccgcagcatttttctctcctcctataactctaatggaaacaggaaaaagaaaaaacaagaaacgattagaaactcaaatgtgacaaaaagtcaaaaaatagaggaggaaacaaaaacatg

SEQ ID NO: 31834 - DNA, 3003 bp, Unknown; identical to SEQ ID NO: 31833
  misc_feature (1)..( 3003): 2750-1469P.txt file - cDNA_ID_3046196; gDNA_ID_2926192; Annot_ID_141107

SEQ ID NO: 31835 - DNA, 3003 bp, Unknown; identical to SEQ ID NO: 31833
  misc_feature (1)..( 3003): 2750-1469P.txt file - cDNA_ID_3046196; gDNA_ID_2926192; Annot_ID_201152

SEQ ID NO: 31836 - DNA, 3003 bp, Unknown; identical to SEQ ID NO: 29048
  misc_feature (1)..( 3003): 2750-1469P.txt file - cDNA_ID_3046200; gDNA_ID_1971693; Annot_ID_175098

SEQ ID NO: 31837 - DNA, 3003 bp, Unknown; identical to SEQ ID NO: 29048
  misc_feature (1)..( 3003): 2750-1469P.txt file - cDNA_ID_3046200; gDNA_ID_2926192; Annot_ID_201150

SEQ ID NO: 31838 - DNA, 3000 bp, Unknown; identical to SEQ ID NO: 29047
  misc_feature (1)..( 3000): 2750-1469P.txt file - cDNA_ID_3046202; gDNA_ID_1971693; Annot_ID_175097

SEQ ID NO: 31839 - DNA, 3000 bp, Unknown; identical to SEQ ID NO: 29047
  misc_feature (1)..( 3000): 2750-1469P.txt file - cDNA_ID_3046202; gDNA_ID_2926192; Annot_ID_201149

SEQ ID NO: 31840 - DNA, 3000 bp, Unknown; identical to SEQ ID NO: 28983
  misc_feature (1)..( 3000): 2750-1469P.txt file - cDNA_ID_3046225; gDNA_ID_1971712; Annot_ID_175121

SEQ ID NO: 31841 - DNA, 3000 bp, Unknown; identical to SEQ ID NO: 28983
  misc_feature (1)..( 3000): 2750-1469P.txt file - cDNA_ID_3046225; gDNA_ID_2926199; Annot_ID_201712

SEQ ID NO: 31842 - DNA, 3000 bp, Unknown; identical to SEQ ID NO: 8311
  misc_feature (1)..( 3000): 2750-1469P.txt file - cDNA_ID_3046255; gDNA_ID_1971714; Annot_ID_175151

SEQ ID NO: 31843 - DNA, 3000 bp, Unknown; identical to SEQ ID NO: 8554
  misc_feature (1)..( 3000): 2750-1469P.txt file - cDNA_ID_3046280; gDNA_ID_1971715; Annot_ID_175163

SEQ ID NO: 31844 - DNA, 3003 bp, Unknown
  misc_feature (1)..( 3003): 2750-1469P.txt file - cDNA_ID_3046286; gDNA_ID_1971724; Annot_ID_175195
taggtggagtcgttaacaagccggtctgctatttccggtgggatggttataaatattatggtgccttcggtgatgaagcgccatctcaaccccccacgccgcttcctcttcctcctcctcctcctcgtgatccagatggaaaaaagatctctacaggagttattgtggctattgttgtttccgcagttatcttcgtggtgctagtcgctttaggattagttatttggaagcgaagacaatcatacaaaacactgaaatatcatagtgagttactttttttgtttttgtttttttatcactctcacattacttattggaatgcatattagtaaccatgcatatgttatatatttgcagctgatgatgatatgacaagtccacagtctctgcaatttgattttacaacaattgaagtggcaacagataatttttcgaggaacaacaagctaggtcaaggcggattcggtgaagtttacaaggtatatttgagctgagctctacatatatctatgactgcttgatttgctgtgaaaactaagaacttataagtttttcatatgtagggaatgttacctaatgaaacagaaattgcggtaaagcgtctatcgagtaattcaggacaaggcacacaagagttcaagaacgaggttgtgattgtggccaaacttcaacacaagaatcttgttaggcttcttgggttttgcatagaaagagatgaacagatacttgtctacgagtttgtttccaacaagagccttgattatttcctctttggtaataaacaataacacttggtttaatttatgttcattcatcaaattttcttataattatagtgtaatttagatccaaaaatgaaaagtcaactagattggaaaagacggtacaacatcataggaggggttacgcgaggacttctctatcttcatcaagactcaaggctaacaatcatacaccgtgacatcaaagcaagtaacatacttttagatgctgatatgaaccctaaaatagctgattttggaatggcaaggaattttagagtggaccaaactgaagaccagacaggaagagttgttggaaccttgttagtactccgataatctctttaaaattgataaacctttttctatttgtttgtttctgattaacataaacctttttatgttgtatatttgcagcggttacatgcctccagagtatgtgacacatggccaattctctaccaaatctgatgtatatagctttggtgtattgatcttggagattgtttgtggcaagaagaacagcagcttctttcagatggatgattctgggggaaatttagtgacacatgtgagcagaaaacaatttaaaattttactttgtttagattgtgaccatcaaggatttggattctgaatatgagtttaatttcttggcaggtttggaggctttggaacaatgattcacccttagatctcatcgaccctgcgattaaggaaagctacgataatgatgaagtcattagatgtatccatatcggaattttatgtgttcaagaaactccggcagatcgtccagagatgtctacaatctttcaaatgcttaccaatagctccattactctgcctgtgcctcgaccacctggatttttcttcaggaacagacccaatttagaccccttaacctatggatccgagcaggggcaatccagcagcatgtctgttcctttttctatagatagtgcgtcaatcactagagccactcctcggtgagatgattgcttttgcactagtcagtagcattttacttgtaacacaagcaactccagttttcaaaggtccagttaatttttatggtaatatgggtacatataaaaccaaacttatgtgtagccgtgtaggtagagtattcctttcttgttttttcccatggcaagatgagaatttgtcaaacctcaaatatgatacattaacctctaagaacaaccacttacgaacccatttttttacttcttcagtcatctatgatagtcaccagcttgcttattcagctttttgctcccccagattttctataaagtggcaacaaattttattatttcccctgaaatatccatgcaactacacttatattatgatgatgttccaatgattttgatcaccaacatttgtagatctctaaggtttttatgtttcatcaaactctatctagcagcttcacatgtgctagtatatttgtaacgtctctcatccaagtcctctctttcaaagactggttttcgctatttcaagaggctataaagacttccggaagcacacttaattaactgtgacaggatgtttcaccgaaaagataagtggactttggtgacatagattgcctctccgaagcactatatacaccactatattcctttaatagaggtgttacaatatcatcttgataaatattaccaacaacatgctattgcttgaacactaaacgtattaactcataatcgctaacgaatttgaacatacgtcttgaaataagaccaagaatcgacacaagctaacgagttctcctatatcacgcgtggtgtgatctttagcgtacatgtcaatggaattaaacacactatctccagtataccaccagaacagagttttaacagtactgcaagtaacaaaccctttatatagtactgtttgtattataatactttaacagaaaaagtccgcaacactaacagaaaaagattttatatttatcgcattgacttgactatgtttgtctcaacaactacttaacgaaaattcctaccacccatactttttgactaatcaacatccaaaatgttctagtaaaaccattaccgagctgacttgaatatgctttcctcaattacttaacaaaatttctaaccaaccatgctttttgacaaaatcaacgaccctaagtgctacagtaaaataaaatgtgtacattatttacaatctgtaacacatacctgaccaaagtaaaatatccaaaaaagatatg

SEQ ID NO: 31845 - DNA, 3003 bp, Unknown
  misc_feature (1)..( 3003): 2750-1469P.txt file - cDNA_ID_3046290; gDNA_ID_1971724; Annot_ID_175194
aaaacacaaactacacatgcaaaagtaatgatcttttgattcatacacaatgtagatctcatataaggttgatagagcaaacaaaaaacccaattagtagtaaagagtgtatcaaaacaaccctagaaaatcagaaagaacccaaaatagcagtcaaagaagaacaacaaaccaaaagaatcagatagcattaagcaaagaatcaatttttattttttaaagatttagagaaaaaaagagatctaataagagacacagatagagacataagagaaaaaaacaaaacatacccgagttacagtgagaaacagagtgtgtaaatctcaaacatttcttcatcgacatggagaagaagaagaagcaatagagattacaaaacactgaaggtggtaataagagaaaccgatcatgttctttgtaatgtaaacaaaaagatagagaagaaaaaaaagcaatcaattagttttctccatcaaggcatcattttgtttctttatttccctcttcgagtgtgcaaaaatctatctctctctctctctctctctcgcagtcactatctctcacacactgtacttttgctttagcttttttgttgtctgtttctttttcacttgttctatcaaacaaaggtttttttcacttcaatgaagtgttgtgtgtgacctaagacaatcttaccctttgtcagaaattgtcgctaaaatatatagaagggtagtttcgtcatttaagtaaacaaatctggtgagacactgagagagattaattaaaattttggatcggttcgtgaaccacaaaaaatattatttacttgtttctcgggaagttcatgtgggattcctatccccaattaaaatctttcgactctatgttaattttaattttatttcgaaaagagtttatgaaattaatacttgtgtgatttattggaagtggtatacttaatttttttaagattactattaaacaatatactctgatagctagttttctatccataatgggccgcatcgtaattgggaagacccacttttgaccaaactttcaactttaaaacattttggtccaaattggtaaaagacaaaaattagtttatagggatttgggattgaatgactcgtcactcgtataaattaatttggtgactccatttagtattttggagaagaaagtttaaagtttgtgtttgtgtttgtgtttgtgtatgtttgccctttgattatgaacggtgaaatctagactaattttgacagtatgtacaagattaatctagattattgcctgcataggctgcattaaaaaaattggtgtgtttaattgaacgacgccgtgctaaaatatcgaacggcgagatttatagcttcagtttttttatttgaaacactgtcgttttgcataaataaaacgacagcgtttaggtcgataaatgactgcgtattggtaagttgagacgacaacgtttaaagccggcgtttttaaattataaacggcagagttttggttaagggaacgacggcgacgatgaatatggtgtttccgaagtagtttcaggcgatgatggtgaataatattacgaaacgacagtgtttagatagattggcgtttggatttgcattactcgaaaacattgttgaaggcgatggtgtttccgacgttgcgcgatacccatgtctcttgaacttttcgggtatggccatgtctgggaatctcacagatgaagtttctagtgaggaaagaagtcagagcaaatgatataacttgtcataaagaagaacaaaagggttttcagattggtgggattaagccaaagggttttgctcatggaagtgtttgagaaagactgcttcttgtgaagatgcttcttgcgacatagctaatgagggtgaggtttctttggatctgatattgattcggagtatctggttttagaaatgtttgtgatagagactaaaggagccattgttggccaaattaagaattgaatcgtatatagaagacatgagacatgacttatataaagagtgtttcagtttccgaatcatcttctgcttcaaagtaaactgttattaatcactttgagtaggtggctctttttcttttctcttcaggttaagattgatgtcttttgtgttttgtgttgtttctttctgatttttggaattcttttggtcagctgcactgtttaatctgaagcaagcaaccactcgctttctgtcaattcggtggaagtgtatgctgaaacttccgggaagacttgaagttgcagagacattttaaagcagtcaatgtatctaacagctgttctccgcttctcaaatcactactttgctcggtaaggccgatataccaaacaaaaacacaaatgttcttctgttttggcctttgatgatgaaacattatgttattagattacttggatgctacggttctgtacttctgttcatgtttactagaacctctctagttatccgtgttgagtcggtatattgtgctatagttaatgcgtttctttctggttcaagcgagcatgttttggaccaaaaaccttttggtaaaaagaaactttgcaaagtgcaatgaagtttgcattttgtttgttttctataatttacaaaataactcaagaaaatgtagtcctcagatttatcacagtgatcatccatttcaatcaattgcttcttcaagtactcagagagtcgcgttgatttagaaaatgttattcatgatactccaaaaagctattgattgtcctgcaacaacatgttcagagtcttgttatggcttgaagtagtagttgagagtcacagtgacttgttggaataactctgagtggtccagttcataatttctttctaacaagttgccattgttttatttatattctctatccatataataaaataatgtttacaacttgctcttatgaaaggcatggttgtgtaagttagtctatattcagcttgagacactaaagaaactcatctattccttttttggaaaatg

SEQ ID NO: 31846 - DNA, 2755 bp, Unknown
  misc_feature (1)..( 2755): 2750-1469P.txt file - cDNA_ID_3046377; gDNA_ID_29952; Annot_ID_146795
aaaagaacaccatttttttgtctttataggcataaatttttgaattcgtaacagaatttagtgaataatattgtaattaccaggcaaggactctccaaacggatagctcgaatatcgttattaaagagtaaatgatccaatatgtaagccattgttgatcatctaacattgttggactctctattgctcgaaatgatgcatacctaatcatttattcagttaactatcaagttgcatttgtaaaaaccaaacatttaaattcagatttgatatcacttacagaggatagagaagcatgactccaggcctgcatgcaacaagaaaaaggaagaaaataatgttaaaaatttgacaaatatagtgtttatttttattatatgagacagaatttgaataaaatcctacccaactagagcatcaaaacgttttgcaatcgcaataatgaaacccattttctttttgagtttttactcttctttcaacagaaactttctcaaacgtctttagcactgtgacgttggatatatacacaaaagcttgaaatttcttcaagcaaaagaatctttgtgggagttaaggcaacaagccaggtaaagaatctccaacgcattgttacgttttcatgaacctatttattatatgttctaagaaaaaaaaaatatctcaaagtaaactttggaaaatttctgatgaagggaaatccaaagtcttgggtttagtatccctatgaatggtatttggaatatgttttcgtcaaaacaaaagattcttttctttttcacaagagttagtgatcaataacttatgcactaattaatgagattggacgtatacacaatttgattatgatacttgagtaaaaatcacctgtcctttaatttggaaatctctctttcttacccatttatatactacttcttttcattaaaattaaatttcaattatcaatcatcgttcaatttgataaagatttaacattttttgtcacagggctagtaaaagcaatctttacataattcatctytcttacatatatatattacctttttcttcattagtattctatttgattatgattattttgtcataaagctagtaaattaaacactcgatatgagaattatattacttcacgctaattaactcttaacacaacaagaactagtgcatattcaactttcaaagcatatactatatattgagaatatagaccacgaaagtcaatcaaaagacctaccagctctcatcaagttctttcttgaaatgattttgcagaatttccaacttaattaattcgacatgaatgtgaaaatgtgtgttgctcgttaagaaaattgaatagaagtacaatgaaaatgatgaggaatgggcaaaacacaaaagagtttcctttcgtaactacaattaattaatgcaaatctgagaaagggttcatggataatgactacacacatgattagtcattccccgtgggctctctgctttcatttactttattagtttcatcttctctaattatattgtcgcatatatgatgtagttcttttgtctaaattacgtaatatgatgtaattaattatcaaaataaatattcagattgccgttggactaacctaatgtccaagattaagacttgaacataagaatttggaaaaactaaaccagttataatatatactcttaaattgccatttctgaacacaaccaaataataatatatactatttacagtttttttttaattggcaagaacactgaaatcttattcattgtctcgcttggtagttgacaagttataacactcatattcatataaccccattctaacgttgacgacgaacactcatataaaccacccaaattcttagcatattagctaaatattggtttaattggaaatattttttttatatataaaatgccaggtaaatattaacgacatgcaatgtatataggagtagggcaataaaaagaaaaggagaataaaaagggattaccaaaaaaggaaagtttccaaaaggtgattctgatgagaaacagagcccatacctctcttttttcctctaaacatgaaagaaaaattggatggtcctccttcaatgctctctccccacccaatccaaacccaactgtcttctttctttctytttttcttctttctaatttgatattttctaccacttaattccaatcaatttcaaatttcaatctaaatgtatgcatatagaatttaattaaaagaattaggtgtgtgatatttgagaaaatgttagaagtaatggtccatgttctttctttctttttccttctataacacttcagtttgaaaaaaaactaccaaaccttctgttttctgcaaatgggtttttaaatacttccaaagaaatattcctctaaaagaaattataaaccaaaacagaaaccaaaaacaaaaaataaagttgaagcagcagttaagtggtactgagataataagaatagtatctttaggccaatgaacaaattaactctctcataattcatcttcccatcctcacttctctttctttctgatcataattaatcttgctaagccaggtatggttattgatgatttacacttttttaaaaaagtttcttccttttctccaatcaaattattagggttcttcagttaatccttataaaccatttcttttaatccaaggtgtttgagtgcaaaaggatttgatctatttctcttgtgtttatacttcagctagggcttatagaaatg

SEQ ID NO: 31847 - DNA, 74 bp, Unknown; identical to SEQ ID NO: 183
  misc_feature (1)..( 74): 2750-1469P.txt file - cDNA_ID_3046401; gDNA_ID_25024; Annot_ID_146486

SEQ ID NO: 31848 - DNA, 115 bp, Unknown; identical to SEQ ID NO: 7
  misc_feature (1)..( 115): 2750-1469P.txt file - cDNA_ID_3046422; gDNA_ID_268; Annot_ID_144055

SEQ ID NO: 31849 - DNA, 9 bp, Unknown
  misc_feature (1)..( 9): 2750-1469P.txt file - cDNA_ID_3046512; gDNA_ID_147; Annot_ID_143949
agtttcatg

SEQ ID NO: 31850 - DNA, 3000 bp, Unknown; identical to SEQ ID NO: 7788
  misc_feature (1)..( 3000): 2750-1469P.txt file - cDNA_ID_3046534; gDNA_ID_1621163; Annot_ID_173762

SEQ ID NO: 31851 - DNA, 3003 bp, Unknown
  misc_feature (1)..( 3003): 2750-1469P.txt file - cDNA_ID_3046534; gDNA_ID_2926161; Annot_ID_139729
tttactcgacttgcagaaaataatatatatatgtatatatatatatacatatatatttaaacatagttattatttgtgttttggatataactgaacgcatccaaagcacttcggagcttgtgaatcgttataacatgcaaactattttgcagaatatgatttattattatattgtattgcaaatgatcttaattttttttttgtgcaaacaaatgatctatactagttttttttaaacgacattagcatctacaaaataactatcgtcattagccactgattgtaatattgttacaatataatttgtatagctgtaaactatttatgttgtcagttctagttttgatatatttactgtcgctaattctaacatgtttgcattcaaaaccgctgattaattgacattgttactatatagagcataaaacggtgcttcattggatgactattgactaatataccaaatgtgactatgtgagtttatgatttagttacataaatatacagatatgtttatctatttatttatagaaagtctttcaagaaatctacaaaaattaaagaaataaagagagtatgcctatctgtacgtcggtggctgtatattgtgaaaataattaatgtcgtatattattgcaagtacttagggatcagggctgagtctacgacaagatacgtatcaatgcacacgtccaaattttttttttttttgtgtacaaatggtcatggtctccagacggtgacattttaaaaaacattatttgattggtctttgtaatttttattttccaacctgtcttgtcatttcgactacgaaacgtacgattttttcaatcacgtttactaatatcatacaccgaaaataaacagttcacaaacgcatcttaattattcaaattcatgaatgttttatataatcgagtatcatatcaacatttatttgatattttgatgtcgtatgtatatcaatgttgttagctgtaaactgtccaatgaaaatccatttaatatttggacaaattattattagggaaattaatgtaatgtggagtattttatatgaaatgtgtattaatgacgacgaccttacttgatcccggaagtgtgtattaatttaatcgcggtgcatcgctgtccacacggttgggttcatgcgtacgtggtatttgctggcaagtggcagtgaagtttcttgtttgatactgtatgttccattcatgtctttccctagatgcatgtttcttctatttttatatattaatatttttttgtttttcttattatgttttctttccctttgtgaggagaataattgcgatacgattatttgttttaacagaaaaaagtgaagcgaaaaagatgattcgaagtttgaagtacgattaaaatttttctttttccggatccgagtttgatcttctttagaaacaaaaattatatttgtttagaaagtctgtcagttgggttttggcccaattgatttacctggtagtcagaaatgtaagtgacctgactacccttgacattagtcagaaaacattctaaactcgagataaacactgtggtagttctttagaaagaagtcgactctaaagtactttggcgtaaaacaaaaaaatttcccttgaaattatactttatttgtttgacataaatgtttcaaatataatcttcttttaatcaatgtagttaaatttttttgatagaagcacgtcagaatttcacactagtaatgtataagtggtaatcatcattgcctaaaacaatgattaattaaaattttagaattcgtcgtcgacaaagaatttttcttatgatgaaggttttgtgcataattatgaacggatccatttatttcactctaactaggaatagatgtttgatgggatacaagtgaacacgacacaaagtaacaaaaattcatttaacgtcacaaattattctcaatcgaatttcgaagtatcaagaaaaagggcaattaaaaacgtaatctcattatgtctttgaaatctaaattaaaagttgagtttattttaattattaatttcctttttgatgatgtaggggatgacaattgacaaccaatttgatttgaaagattaacataaatcattttgagcatacatatattgcttaaatcacacccgtttatctctaaaaacctccataatttatatcaggaaaataaatctagttattgatatcgccatcaaatatttttttcttaaattgtttttttttgttgttgttgaaaatttaattagaaagataagtggacaacgacgcgagacaaagacacaatctttagggccttgagtaaattagggacagcataaacacatgcactagtcctgtctttatttaattatgtggtgtttactctaatgacgtcgctttgattaaccaagtggtcataattaatatatcgatcgaattatataattatcataaatttgaataagcatgttgccttttattaaagaggtttaataaagtttggtaataatggactttgacttcaaactcgattctcatgtaattaattaatatttacatcaaaatttggtcactaatattaccaaattaatatactaaaatgttaattcgcaaataaaacactaattccaaataaagggtcattatgataaacacgtattgaacttgataaagcaaagcaaaaataatgggtttcaaggtttggttatatatgacaaaaaaaaaaaaaggtttggttatatatctattgggcctataaccatgttataacaaatttgggcctaactaaaataataaaataaacgtaatggtcctttttatatttgggtcaaacccaactctaaacccaaaccaaagaaaaagtatacggtacggtacacagacttatggtgtgtgtgattgcaggtgaatatttctcgtcgtcttctcctttcttctgaagaagattacccaatctgaaaaaaaccaagaagctgacaaaattccgaattctctgcgatttccatg

SEQ ID NO: 31852 - DNA, 3003 bp, Unknown; identical to SEQ ID NO: 31851
  misc_feature (1)..( 3003): 2750-1469P.txt file - cDNA_ID_3046534; gDNA_ID_2926161; Annot_ID_198785

SEQ ID NO: 31853 - DNA, 3003 bp, Unknown
  misc_feature (1)..( 3003): 2750-1469P.txt file - cDNA_ID_3046544; gDNA_ID_1620806; Annot_ID_50533
attacatggaaacaaacagatgcaaaatgacaacatgtcaagcactacttaaataatagtttactcgaataagcacatgactcccaactaattagaccttttatttatttaatggtttatgatttagattttagagaacataagataaaaaaaatcataagctaacactaatttaatgtatcgtatgttcacatagactaaaattaacgtactaatatagacatgttgtcaatactataaccatcatattttagtataccattcgtcagaatccagtaaaaccaaacgttaaacccggagttgaccaaaaaaattcaaaaatatttaataaaattaattgtgataaaaatataatattaaagaaaattacatcaaaacctgctctgtttgattctcggttttgtttccggtttaatctggttatggcgttgatttgaatttgatgggaggcactaggcagttagccttagtttggtttattggtattcgaattcaaattggaattgagtactaaaatgctctgttactcatttctgcatctcgagttgttatggattaggttacgaaatgttcaatttcgtttggtctagttcggttcgtttcgtttggtctagttcggaaaccctattcaagattgtgatcatcacgagaagcttgtgcatccttggaaaggtacacacacttttaacttttaaggttcttacttttcttcttaagattgaattgcaatgtgtgtttagtgattgtgtatacgtggctgaaacaggcattgttgttaatattccaactacaaaggcacaagatggtcgacccgcgggtgagagtggatcgaagctaagggatgagtatattctcagaggattaaacaatggtcttttgtttgacaaggcttatagagtagatggtcatggaaagaaggactggatgaaaaaagacggtcccaagttaggtctttacgggtggatagctggtgctgatgattataacggtaataatatcatcggagaaaacttgaggaagaccgtgaactcaaaactatagctgagcttacgaaagaagaggcgaggaaacagcaaatgcttgtgaagaatctgagacaagttgtagaagagaagataaaagacgtgaaggagattgaggagctttgttcagtgaagtcagaggaacttaatcagttgatggaagagaaggagaagaatcagcaaagctgaatgctatacaagagagaacaatgaggcatattcaaaagatagttgatgaccatgagagattgacgaagctgttggagtcagagaagaagaaactcgaaatcaaaggtaatgagttggcaaagccccaagtgcacaatggaaccgagagaatgaaattgtctgaagatcttgaacaggtaaaacatttactctctgtatctctcttttttgttaagatataagtccatgtgttgatgtgtacttaacagaggcaaaaggaggagcttcatgagaaaatcataagactagaaagacagatagatcaggtacaagcgattgagctagaggttgagcagttgaaaggacagctcaatgtgatgaagcacatggcatcagatggcgatgctcaagttgtgaaagaggtggacatcatcttcaaagacttagttgagaaggaagcagaactcgcagacctcaataaatttaaccaaactcttatccttagagagcgcaggaccaatgatgagcttcaagaagctcgtaaagaattggtaaatgtatgtatcaaagtgttgttcttttcaattatatcagaaaacctctgagaaagcttgacattttggtttgtttgtttcatgtgccttatgtagattatgagagaatagaaaacaagtatcggtgttaagtgtatgggagagctcgtaaggaaaccattcgtggatgcaatgcagcagaagtattgtcaggaagatgtggaggaccgagcagttgaagttctccaactttgggaacactatatcaacgatccagattggcatccatacaagcgggtcaagctcgaaaatcaagatagagaagtggtaagaccgccttcttgacacggtttgttatgtcgaatctctctgaaagattaaaaagctgtttttgtgttgttgttgttatttgtgtttaggaagtgatagatgatagagacgaaaagctgagggagctaaaggcagatttgggagatggtccttacaatgcggtcacgaaagctttgttggagataaacgagtataacccgagtggaaggtacattacaacagagctatggaacttcaaagaagataagagggctacacttgaagaaggtgtcacttgtttacttgatcaatgggaaaaagcgaaacgtaagcgcggaatggcgtaaaggtttaaaccttttcttgataaccgaacaaaaatatgttttcatgtgcaaaatataattttgctcatactggatttttgattgatgatttgcagctgcaagagggactgaagaaaaagcttagttgcagagaaatgtgtttggtttttggtttattctttttgtttttcttctcagaacttagtgaatagttgacacaactttgatgtcttgcatcgttttgatgtttcattgtgaaatatttctaggagtatgccgcctctttggacaatgagtagtaaaatgtatcataatgccattttgtaatatatttaacatgtaaaacaactagatgtggcctctctcttgtctcatatcttaagcatgtcatttagaaccttttattgtaaaaaacaaactttgtcacgagttactttcttttcttctagtcaaaaaattgaatattgaccctttcattgttatgttaacgtttcatcttataacctataaatttacattcgttttgggccttttggctaattacgagatagacccttgtcaatgtggaaaaaaaaaaaaaaaacttcgaactgggtagttttgtcgaacagttggtgtccatcactagaacaccgatcaccgatg

SEQ ID NO: 31854 - DNA, 3000 bp, Unknown; identical to SEQ ID NO: 20782
  misc_feature (1)..( 3000): 2750-1469P.txt file - cDNA_ID_3046544; gDNA_ID_1621163; Annot_ID_173753

SEQ ID NO: 31855 - DNA, 3003 bp, Unknown; identical to SEQ ID NO: 31853
  misc_feature (1)..( 3003): 2750-1469P.txt file - cDNA_ID_3046544; gDNA_ID_2926161; Annot_ID_139739

SEQ ID NO: 31856 - DNA, 3000 bp, Unknown; identical to SEQ ID NO: 28507
  misc_feature (1)..( 3000): 2750-1469P.txt file - cDNA_ID_3046549; gDNA_ID_2926143; Annot_ID_197586

SEQ ID NO: 31857 - DNA, 3003 bp, Unknown; identical to SEQ ID NO: 17479
  misc_feature (1)..( 3003): 2750-1469P.txt file - cDNA_ID_3046549; gDNA_ID_1621164; Annot_ID_173806

SEQ ID NO: 31858 - DNA, 3003 bp, Unknown; identical to SEQ ID NO: 29216
  misc_feature (1)..( 3003): 2750-1469P.txt file - cDNA_ID_3046557; gDNA_ID_1621164; Annot_ID_173801

SEQ ID NO: 31859 - DNA, 3003 bp, Unknown
  misc_feature (1)..( 3003): 2750-1469P.txt file - cDNA_ID_3046565; gDNA_ID_2926143; Annot_ID_197594
gctttagaccatcgccaatggtgctttcaatttcacatttctttcatcttgaagatgaaaataaaaagattttttccaatggtactttattttcatcttaaaaatgaaagacttaagtatcttcaaattttgaagataattttttttatttacaaaatgatctttacaatttaacaattgcatcataaatttgattttttttattcatgttatgcaatgtggtttgatttaaaataatgtttactctagagaaaatttgttgaactatttgcttgctataaaataaatgtgtaaaatatataaatttagaaagtaaaggatattattaccaattaataataaaatatagatagtatacaatgttctttttgaagtagaaaaatgaaagaaactattgaaaaagtcttgcatcattttttcatttattttgaagaaacttcaatttttttttttttttgaagcaaacaattggagttactcttaattgagaactttggttcattctaataggatcacattattttgatattcggttttccgtctttaaacatctttgtaggcggcagatccacatacaaagtaaaatggagtgatcaactaactccatctaataaagtttacaaatcttttagtagtaggttaagaacaaaaatttaaacgaccctagttaattttcttcttctagtttcacttaaaaactataaattttatagttgaacaaaaaaaaataaaaaaaatttaatggcgattcatagatatataaggaatgccataaaaggagatctctccctaacaaactaagaagaacatatctacatatacatttttgcaacacctttataaaataaatcctcaagttgggatttatttacaacccaatgtcattggcatttaatgttttaacaaatttattctcaaatctaaatataaatcaattttgtttctaaaatttaggaaactaaaagaaaaaatcacaaaaattatttaaatcttttcaaatctacactaaaatatataacacttacattcctttttaaggggatcacttaaaactataaattttatacttgaacaaaaaatattatataaattataatggcgattcatagatatctaaggaatgtcattaaagaagatctctccctaacaaactaagaagaacatatggttatggtattattaaggaaataaattatattttttaataaaaaaacttcaggggcaaatatgaaattaagaagaagaaaacatatgagaacctaggtaaaaactgaaagatataaaaactcattccacgcgacttctcaatttaaggatttttatctcttaacgattgatttgttgtgctttttctctgaaatggcggtagaacataattagaaggtaaggatttactacgattttgagagttactgattatgggtattgatgcttagattcgtttatggtttgagttaaaaaagaaattttgtatataattagattaaatatctctaatctaatttaatatttcttgtgcaaattatatttatgtcatatttgcacttcaagacataaacgaatcttagattataatatcagaaacgcgaagttatcaaggtagattcaaagctttttatttatcgtaaactatcataaaatttctgtatacttattcttgattcatgtgtttctttttcaaggctacaagaatgacagtgataatatgtcaattgacataacattgttgttaactgaagagcagatgaagctttttctgaataatgatgaaaaaatcgaagaggatgtcttggaattttgagactatccacaaccattaggaccaacaacatgcgtttgttgaacaaaactaatgtccacacaaaatatgaatctcccgagcagagtaagaatagcccatttttcattgttttgtttcctctctataaataattagttatcacttaattaatattaatatcagttttttggtccttcaagattttaaggaagagaggctaaaatggtgtggtgaaaggaaggtatgtaaatcagacactatgggtcttgttttagttattaaggcaatggtcttgttttagtaactaatcttactcctaatacacatgattatatggtggatattttaacttttgagcggaataagttagagtccaaattagcaattgtccaaagagttctcaatggagaaataaacatcagtcccgatcttgatgtggtcttggaaaagaatggtttttaaaaatatggcaagacagtgaactcatcaagaagctatgactacgtcccagaggatcttatctcgatgattagagatccttcaaaatagatgcattaaaggcataattagattacgtgaataaaagactgggtactatcaactctgaaagccagaagcactctggatcaataagctagatgattttgataaagcacttgaggtatgaatgaattagttttatgattctccacaacaaattatgtgtctgttatttgaactgaactttcttaatattgcaaggactctggtcaagactctcaagttaatggcgattataatatttagtgcatagatggcacaaatataatttccattcttatctataaatgattatggtataactgtctaccaaaggttccaaaattagtatttaacaaaaaaaatatttcaaaagtgaaataaaatgtatacctcccatctcttagatctaattttaattttattacatattttaaggatatgccaatttttcgattttttgttagagacaagttatcatatttcaacatttttaggtatctttatataaagatttattctatatttggaaaattattctttcctaaattattattaaaatctgaaacttaaaaaatatataaaaaattaaatatatgaactaaaatttatacaatctttttcatataaattgtgctttttgtacctcggaccatagtagttctctttgcatctgaagtgttgttgtaaccgatccgaagatg

SEQ ID NO: 31860 - DNA, 3000 bp, Unknown
  misc_feature (1)..( 3000): 2750-1469P.txt file - cDNA_ID_3046565; gDNA_ID_1621164; Annot_ID_173797
ttagaccatcgccaatggtgctttcaatttcacatttctttcatcttgaagatgaaaataaaaagattttttccaatggtactttattttcatcttaaaaatgaaagacttaagtatcttcaaattttgaagataattttttttatttacaaaatgatctttacaatttaacaattgcatcataaatttgattttttttattcatgttatgcaatgtggtttgatttaaaataatgtttactctagagaaaatttgttgaactatttgcttgctataaaataaatgtgtaaaatatataaatttagaaagtaaaggatattattaccaattaataataaaatatagatagtatacaatgttctttttgaagtagaaaaatgaaagaaactattgaaaaagtcttgcatcattttttcatttattttgaagaaacttcaatttttttttttttttgaagcaaacaattggagttactcttaattgagaactttggttcattctaataggatcacattattttgatattcggttttccgtctttaaacatctttgtaggcggcagatccacatacaaagtaaaatggagtgatcaactaactccatctaataaagtttacaaatcttttagtagtaggttaagaacaaaaatttaaacgaccctagttaattttcttcttctagtttcacttaaaaactataaattttatagttgaacaaaaaaaaataaaaaaaatttaatggcgattcatagatatataaggaatgccataaaaggagatctctccctaacaaactaagaagaacatatctacatatacatttttgcaacacctttataaaataaatcctcaagttgggatttatttacaacccaatgtcattggcatttaatgttttaacaaatttattctcaaatctaaatataaatcaattttgtttctaaaatttaggaaactaaaagaaaaaatcacaaaaattatttaaatcttttcaaatctacactaaaatatataacacttacattcctttttaaggggatcacttaaaactataaattttatacttgaacaaaaaatattatataaattataatggcgattcatagatatctaaggaatgtcattaaagaagatctctccctaacaaactaagaagaacatatggttatggtattattaaggaaataaattatattttttaataaaaaaacttcaggggcaaatatgaaattaagaagaagaaaacatatgagaacctaggtaaaaactgaaagatataaaaactcattccacgcgacttctcaatttaaggatttttatctcttaacgattgatttgttgtgctttttctctgaaatggcggtagaacataattagaaggtaaggatttactacgattttgagagttactgattatgggtattgatgcttagattcgtttatggtttgagttaaaaaagaaattttgtatataattagattaaatatctctaatctaatttaatatttcttgtgcaaattatatttatgtcatatttgcacttcaagacataaacgaatcttagattataatatcagaaacgcgaagttatcaaggtagattcaaagctttttatttatcgtaaactatcataaaatttctgtatacttattcttgattcatgtgtttctttttcaaggctacaagaatgacagtgataatatgtcaattgacataacattgttgttaactgaagagcagatgaagctttttctgaataatgatgaaaaaatcgaagaggatgtcttggaattttgagactatccacaaccattaggaccaacaacatgcgtttgttgaacaaaactaatgtccacacaaaatatgaatctcccgagcagagtaagaatagcccatttttcattgttttgtttcctctctataaataattagttatcacttaattaatattaatatcagttttttggtccttcaagattttaaggaagagaggctaaaatggtgtggtgaaaggaaggtatgtaaatcagacactatgggtcttgttttagttattaaggcaatggtcttgttttagtaactaatcttactcctaatacacatgattatatggtggatattttaacttttgagcggaataagttagagtccaaattagcaattgtccaaagagttctcaatggagaaataaacatcagtcccgatcttgatgtggtcttggaaaagaatggtttttaaaaatatggcaagacagtgaactcatcaagaagctatgactacgtcccagaggatcttatctcgatgattagagatccttcaaaatagatgcattaaaggcataattagattacgtgaataaaagactgggtactatcaactctgaaagccagaagcactctggatcaataagctagatgattttgataaagcacttgaggtatgaatgaattagttttatgattctccacaacaaattatgtgtctgttatttgaactgaactttcttaatattgcaaggactctggtcaagactctcaagttaatggcgattataatatttagtgcatagatggcacaaatataatttccattcttatctataaatgattatggtataactgtctaccaaaggttccaaaattagtatttaacaaaaaaaatatttcaaaagtgaaataaaatgtatacctcccatctcttagatctaattttaattttattacatattttaaggatatgccaatttttcgattttttgttagagacaagttatcatatttcaacatttttaggtatctttatataaagatttattctatatttggaaaattattctttcctaaattattattaaaatctgaaacttaaaaaatatataaaaaattaaatatatgaactaaaatttatacaatctttttcatataaattgtgctttttgtacctcggaccatagtagttctctttgcatctgaagtgttgttgtaaccgatccgaagatg

SEQ ID NO: 31861 - DNA, 3000 bp, Unknown; identical to SEQ ID NO: 7808
  misc_feature (1)..( 3000): 2750-1469P.txt file - cDNA_ID_3046577; gDNA_ID_1621164; Annot_ID_173791

SEQ ID NO: 31862 - DNA, 3003 bp, Unknown
  misc_feature (1)..( 3003): 2750-1469P.txt file - cDNA_ID_3046615; gDNA_ID_1621165; Annot_ID_57198
attgtagatttacatactgagaaaagtatttttcaagattacgaaacaaattcatttccatatgagggaaaaatattcattcctttataaaaatcaataaataaatgaaaaaaacaaatatgcaatcttttctgggatgaaaatgataattagaattgatcttaaaagatgataataagaattaactaattttatatgctgattttttacactgataaattttatattaactataccaatatgcacctattcattttagcttctttggtttcttaaaaataattttaatcaaggtcgtacattgccaggtagtgtagtcaggttatatagagcgttcttacattgagtaaaacattataaagttgtaaatttcatagcagtacattaattttcaaaaagtttaaaactttaaaggaggacaacggggattggattcacattctttttgggttttcgaacacatactttgatctctaaaacaacaccaacaatcccgtttgaaaaaactaactgaacattgggcagggacacactttccaatagagatcttgttcgagccctctatttctccaacatccatctgcatgcctacacattttgaaactacacgatcactaaccaaacatcaacaataacgaaaacaaagggagagcagtttttatatatataaatatgtgaaaaaaactctttacatacactgatgtagagcaaagaaagagaagatgaatatggagatgagaactgtttgtgatttcatcttttgtttgtcgtaggcaattttattgtttatttcaaccaacagtatgtgacttttaatgtcatagtgaaatctatatatagactgtaatattgaaataaaaggtatatatagtagtatatattagttatcattattatttaaattagtcagcagatattactttaccaaaatggtgtatatatatcctctatataccatatataattaattaaggaaacaaaaatatgacttttatattggtaaaattttacaaatttggaagatgcaactaccaaatagtaaaaaatggtaggaatggtggtaatcaatctggtagattatgaaagagtcaacagtaataacttttcaaagtaaatactcttgttccttgccaattagagtagtcaacgtctctggattttccaaattgtgaaactttcttttgaccatactttaaggttaatatttattaaatacccttaaatgattgtggccagtagctaaaatattaaaaacgttatttatttagacccattagttttattatttcggtcttggaatcggagataaaagtccataagctggcattagatctttcatgcacttgacaggtgttgcaatatctcaagatttatctatacgatagattaaaacttgggttgtccgaaaaaaagaagaagatgaaaatacaaatgattttccgaatattatatcaagaacaatactccacggctctgctgcctgcatcacattactgtattctgaatctcataattttcttgcacgccaattgtttcttgcctaaaatggaaattattattttttggatctgttaccgatacctttaccaactagccatatttggtaatttaaatttggaagttccagttagcaactactatattataaatttataaaaaaaaacctcggaaatattaagcagtccatgtgcacgagttcccccactaattaattccacaatacacaaaaccttctccagcgccaatagagtccaaattatctttaacctccacatgaggctgcatttcttttctcttttggtctgcatatctttcacgcaactatgataatattaccttttaaagttaaaatatgaataactttgttgccagaatttgccaattgacgattcctcatgtatgaaaagaatcataaatcttaatttatttgtagttcattttgaacatctcaaaattccgtattaactattagcagcacaagatggttgtcattaagagtgtttgacaaccatggacgaacgtaactgatctacctttatctcgaaattatgccaaatataactaaattatatacttcgaaatcacaagttttactaatacgtggtcttatagtaaaacctgtgattttgaagtacatttgattaacttggttatatcaaacatatacgattatgttatgtgattaagcatatgaatttaaaaaagtttatgctaacaaacatgtgtcaaccccaaagtcttaccattcataaacagaaatccacttacttatccatattccacataatttgcctaccgataatgtactaattagcaacaagtggaaacgaaaataagtgtgattaaacattacaactatgattaaaatggataaggttacagaagacagttagggaattggtcggattctatgaacgaaccttccagcgccgatccagcccacttcaccgtttctctcaaccaatcacacagtttccctcaattattttaataataatcatctctaaggtattcattattttattaacaaaatattcccccaaaaatttagtggagacattacaatattattattattgcggaaactcggagttttgagggagaggtcaccaccgttacacatggcatgattcagcttcaaagattgtcaatttttgaaaactcattttgttttctagttttggtgagaggtgggcagatacaagtggataacaaagttttttgttggatgataaaagagacagagagagacgacgcattttcctttattttctcggggaaattcaaagttttcgaattttcttcctttctgggttttcgtcaaaggagcatcttctttatgttcttttgaaagaaggctctcttctctatttctctcccctcttccggggagtttttgattttttaggataaaggagattcctttacctcgattttttgcttttcatttttattaaatctccgatttttgatttttgggggaagaagtagaagaagaagatg

SEQ ID NO: 31863 - DNA, 3000 bp, Unknown
  misc_feature (1)..( 3000): 2750-1469P.txt file - cDNA_ID_3046615; gDNA_ID_1972120; Annot_ID_178942
gtagatttacatactgagaaaagtatttttcaagattacgaaacaaattcatttccatatgagggaaaaatattcattcctttataaaaatcaataaataaatgaaaaaaacaaatatgcaatcttttctgggatgaaaatgataattagaattgatcttaaaagatgataataagaattaactaattttatatgctgattttttacactgataaattttatattaactataccaatatgcacctattcattttagcttctttggtttcttaaaaataattttaatcaaggtcgtacattgccaggtagtgtagtcaggttatatagagcgttcttacattgagtaaaacattataaagttgtaaatttcatagcagtacattaattttcaaaaagtttaaaactttaaaggaggacaacggggattggattcacattctttttgggttttcgaacacatactttgatctctaaaacaacaccaacaatcccgtttgaaaaaactaactgaacattgggcagggacacactttccaatagagatcttgttcgagccctctatttctccaacatccatctgcatgcctacacattttgaaactacacgatcactaaccaaacatcaacaataacgaaaacaaagggagagcagtttttatatatataaatatgtgaaaaaaactctttacatacactgatgtagagcaaagaaagagaagatgaatatggagatgagaactgtttgtgatttcatcttttgtttgtcgtaggcaattttattgtttatttcaaccaacagtatgtgacttttaatgtcatagtgaaatctatatatagactgtaatattgaaataaaaggtatatatagtagtatatattagttatcattattatttaaattagtcagcagatattactttaccaaaatggtgtatatatatcctctatataccatatataattaattaaggaaacaaaaatatgacttttatattggtaaaattttacaaatttggaagatgcaactaccaaatagtaaaaaatggtaggaatggtggtaatcaatctggtagattatgaaagagtcaacagtaataacttttcaaagtaaatactcttgttccttgccaattagagtagtcaacgtctctggattttccaaattgtgaaactttcttttgaccatactttaaggttaatatttattaaatacccttaaatgattgtggccagtagctaaaatattaaaaacgttatttatttagacccattagttttattatttcggtcttggaatcggagataaaagtccataagctggcattagatctttcatgcacttgacaggtgttgcaatatctcaagatttatctatacgatagattaaaacttgggttgtccgaaaaaaagaagaagatgaaaatacaaatgattttccgaatattatatcaagaacaatactccacggctctgctgcctgcatcacattactgtattctgaatctcataattttcttgcacgccaattgtttcttgcctaaaatggaaattattattttttggatctgttaccgatacctttaccaactagccatatttggtaatttaaatttggaagttccagttagcaactactatattataaatttataaaaaaaaacctcggaaatattaagcagtccatgtgcacgagttcccccactaattaattccacaatacacaaaaccttctccagcgccaatagagtccaaattatctttaacctccacatgaggctgcatttcttttctcttttggtctgcatatctttcacgcaactatgataatattaccttttaaagttaaaatatgaataactttgttgccagaatttgccaattgacgattcctcatgtatgaaaagaatcataaatcttaatttatttgtagttcattttgaacatctcaaaattccgtattaactattagcagcacaagatggttgtcattaagagtgtttgacaaccatggacgaacgtaactgatctacctttatctcgaaattatgccaaatataactaaattatatacttcgaaatcacaagttttactaatacgtggtcttatagtaaaacctgtgattttgaagtacatttgattaacttggttatatcaaacatatacgattatgttatgtgattaagcatatgaatttaaaaaagtttatgctaacaaacatgtgtcaaccccaaagtcttaccattcataaacagaaatccacttacttatccatattccacataatttgcctaccgataatgtactaattagcaacaagtggaaacgaaaataagtgtgattaaacattacaactatgattaaaatggataaggttacagaagacagttagggaattggtcggattctatgaacgaaccttccagcgccgatccagcccacttcaccgtttctctcaaccaatcacacagtttccctcaattattttaataataatcatctctaaggtattcattattttattaacaaaatattcccccaaaaatttagtggagacattacaatattattattattgcggaaactcggagttttgagggagaggtcaccaccgttacacatggcatgattcagcttcaaagattgtcaatttttgaaaactcattttgttttctagttttggtgagaggtgggcagatacaagtggataacaaagttttttgttggatgataaaagagacagagagagacgacgcattttcctttattttctcggggaaattcaaagttttcgaattttcttcctttctgggttttcgtcaaaggagcatcttctttatgttcttttgaaagaaggctctcttctctatttctctcccctcttccggggagtttttgattttttaggataaaggagattcctttacctcgattttttgcttttcatttttattaaatctccgatttttgatttttgggggaagaagtagaagaagaagatg

SEQ ID NO: 31864 - DNA, 3003 bp, Unknown; identical to SEQ ID NO: 31862
  misc_feature (1)..( 3003): 2750-1469P.txt file - cDNA_ID_3046615; gDNA_ID_1621165; Annot_ID_173829

SEQ ID NO: 31865 - DNA, 3003 bp, Unknown
  misc_feature (1)..( 3003): 2750-1469P.txt file - cDNA_ID_3046641; gDNA_ID_2926141; Annot_ID_197477
attgaccaaaaaacatttgttaattttccttttggttagtaaaattaaaatttaattttttagatttacacatagtatatgtaaattttttcttttgtgagtttttctatttttttaagagagaacaaaaagtttactcttttccaagacatgtcaacatctgatcgacagacttgacatatggcataatcgtatgagttactaactttaaaatccatactttatataataagatttctttcttgttttagttttatttatttctttaagagaaaaactggtcaacttttttccaacacatgtaaacatctgattgatagacttgacatgtgacacaatcctatgattcatattttatataataaggttaatgatgtcttattggcttagcccaataatacgatgatggatacccgaatcaaaacaaatcgagctttgacgaaatacaactttgtgttctccgccgaaaaagacttcgaattgtatccctcacccaactctcatgtgtcaacaacatctttgattcctttttggatcatcgcctatgtgcctccatttttgggtttatctcaattttgatcaactttttaaggtaagcttcaagcttcttttctcaatttaatttcaaattgaattatagatgtttactccaattgtttcatggcatcaaattttactccgttttggttattatgattacatcaatttccattttcgattatcatttgttatttgattgaatcaatcttttggtacaacatctccgcgaggctcttctcgattagagaaaccaatgcattttagaatttatcatttgttttggtcatagaaaacccaatctctatattattgcttcatttgtttttttttctgtgccacttaattttgggtaactataattgtttttttcgttttggtcggttcatatgccactatcgagttaaattttgttttatgaacttctcatttctcttaggagctattagtgggggtgtttgtaacatcctagtttcaagaatacggtaatgcatgctttaaaaaaattgatttgatgtcaacaaagtacacttatattttcggtcaaatatccggaaagaactccacaattaaaatgtgctaatgttggagcaatttcagaataggtgattttcgaagaagtgattttccaaaccgtgtaagagaggaaacaatatggagaaagatcacatagttatttgtagtttcattacacaagcctttaaagccttatggtagtggaccggacgtcggatacggatgagcccacaaaccaagagagaatgtggggcccaccaaggatgatggtcggggtgttacaatcctaatgaaaatgttcgcataagaagctgttaagacaagtatattgtctaaacgatggaggagtgtggaagtcccttagtccaatggttaaccaagggttcattaatacttctacactatgtctagggctcgagtttcagagaacacgatttcttgcagattaatggtacaaagcttatcggaggtccggaattccacatgcagagtcgttcgtagtggtctaaagtgcggggagagcatgttcatcacaaggatgtcgtacatctagaaccgaattatgaattagaggaagccaagtgtttaaaaaaggttttaaaatatttacaagggattttaaaagagttttaaaacatttacaaggtattttaaaagggttttaaaatatttacaagggattttcaagggctttaaaatatttacaaaggttttttatagatttttatagggtttaaaagtattttgaaaaatttacaagagattttaaaagggttttaaaagatttataagagatttttaaagggtttaaaagggttctaaaagatgtacaagggtttttaaaagatttataatgaatttacaagaagatcttttaaaaactcttgtaaatctttttaaaaccttttaaaatcccttgtaaatcttttaaaacccttgtaaaatctcttgtaaatctatttcccgccaaaacaaatttacaaggatttttaaatgcattttttggctgagaaaaaatttgttaaggaaaaaattttggcgggaatttttttttcggctggaattttttttttgcgggaaaaaggtattgcggaatttgttttttgcggaaaaaataacttttttggtgtcaaaaatttagcggaaaaatttcagttttcaattacatgtttctattagatgaaggtaatttggtcattctgttcaaaggaagaggtatttttaaaaatggacaacataaaagggtattgcttcaaaagggtagtaaaaaaaagatagttttgcaaatcttccaaataaaactgtttatatgtcatattaaacaaatttactgtttatattaaataattatctttcaagagtcaagacatatttgttatatcataaaattgtaaaggtgtttatgtttctactatagttaattgtctactgcaacatgagatcataaagttttgttagaaatgatgataaaagggaagatagtgatatgatataaaaagatgatttgtgaatatgtatatataaatatatcaaactacttcgttataaacataatggctaattcttctaatacaatttaataatactttcaattaatattttcaaatttgtgagatatgttacaaaccaaatttcaattgaagaaaaataaagtaatttgcattcaagataaaattaaataggaaatttgtgatatgttaaaaaacaattgtgttatggtatcattaaaatacaatgacatttattttttgctttcaattttttggtttacctttaggcccgagcataatagccgaatccgaagaaccgacccgaccccgacccaaaaaaccttatccgaacccataattttcaaaatacccgaacgggtctatacttcaaaactcgaaaaaactgaacccaaactcgaatatgtacccaaacatatctcaaatataagtatataccatg

SEQ ID NO: 31866 - DNA, 3003 bp, Unknown; identical to SEQ ID NO: 31865
  misc_feature (1)..( 3003): 2750-1469P.txt file - cDNA_ID_3046641; gDNA_ID_1621166; Annot_ID_173862

SEQ ID NO: 31867 - DNA, 3003 bp, Unknown; identical to SEQ ID NO: 17496
  misc_feature (1)..( 3003): 2750-1469P.txt file - cDNA_ID_3046670; gDNA_ID_1621167; Annot_ID_173876

SEQ ID NO: 31868 - DNA, 3000 bp, Unknown; identical to SEQ ID NO: 7842
  misc_feature (1)..( 3000): 2750-1469P.txt file - cDNA_ID_3046680; gDNA_ID_1621167; Annot_ID_173870

SEQ ID NO: 31869 - DNA, 3003 bp, Unknown
  misc_feature (1)..( 3003): 2750-1469P.txt file - cDNA_ID_3046694; gDNA_ID_1621162; Annot_ID_173724
cgaagaaaggggaaggttctttatcagtccatgatgtaactcaccttgacaagacacctagcaaaggtttgcctcagttaaatgtgactgagaaagttactgatgcaagtaaagacttgagcagccgctctagctttgcccagtcaactttgaatacttttgttaccatgggaaaaagaaaacatgaaaacataagcaccatcctctctgaaacacctgtcctcagaaaccaaacttctagttatcgtgtggagaaaagcaaatttgaagttcgtgccttagcttcaaggtgtctcgtggaaggcgatcaacttgatgatatggtcatctcaaaggaagatatgacaccaagcgaaagagattctgaactaggcaatcggatttctcctggaacacaagctgataatgttgaaagacatgagagagtaagtaggctattgtagttaaaaaaatgtcttagtaggatgctaattgtttgtggctatttcttttgttagtttatctcctaaaattactgttattcaaccactatatcatctacaggaacatgaaaagcctataaggtttgaagaaccaacatcagataacacactcaccaagggggatgtggaaagggtttcagaggacaatccacggtgcagtcagccactgcgatctgtggccacagtgctggattccccagctcagtcaaccggtcctaaaatgttttccacattagaatttagtttccaaaacctcaggacaaggaggttagagaggctgtcgagattgcagtccacaggttatgtatctaaatgtatgaatacgccacagcctaaaaagtaagatttctttccttcttcttttgtgtagtgtgtttctatttgcatttagagaaatgggattctttaaaatgacaactacgtctacaggtgctttgccgctgcaacattagagttatctcaaccggatgatgaagagcgaaaagcaagggctttagctgcagctacttctgagctggaaaggctttttcgaaaagaggatttcaggagaatgcaggttgctatctttttgactaagcgagcaccgaaagattgatagattaaaaaaatttcattctactctatcctggctcggtcgagaaatatatttatctgttttttctgtgtgataggtactcgggcaattcaatcttgggttcatcattgcaaaattggagcgagatctgttcattgtggatcaggtgagtcttcatatatgcatgcttccagagcccttttttcctccttcgatttgtttagttattggttgagttgtggaaaatggaagtttctatcatttcagagttcttccctagtctgatttttgaagaaatggtatagactagtgattgaattttatggccagcatgcagctgatgagaaattcaacttcgaacatttagcaaggtcaactgtcctgaaccagcaacccttactccagtgagtttctttgtgagatcaatctagattcttgatttcattacactgctttcactttttcacatcaaattccccggcggcattcttttatgtcccatgttactttagctatacttgaaccagtagtaatacctcttttccactactctatatgttacccatatttatctatttttttcctaaactcaggcctttgaacttggaactctctccagaagaagaagtaactgtgttaatgcacatggatattatcaggtgaaggatcaccattacttcttttgtaacattttcttattcttgctatcggtttggagattcaataatgtaacaactttccagggaaaatggctttcttctagaggagaatccaagtgctcctcccggaaaacactttagactacgagccattccttatagcaagaatatcacctttggagtcgaaggtagtttttctgtacctctgctgcatcaaatgtcttttgcattacatgttaatatttactttattgttttgggcagatcttaaagacctgatctcaactctaggagataaccatggggaatgttcggttgctagtagctacaaaaccagcaaaacagattcgatttgtccatcacgagtccgtgcaatgctagcatcccgagcatgcagatcatctgtgatgatcggagatccactcagaaaaaacgaaatgcagaaggtaaccaatgcttaccctaagataaacaacaatgtcccttgatagctaacgatggaatccatctctattaaattcaacttgaattgtaaaacacattcttctgcatatgttaacgcttttgtcatttgggttttggtcagatagtagaacacttggcagatctcgaatctccttggaattgcccacacggacgaccaacaatgcgtcatcttgtggacttgacaactttactcacattacctgatgacgacaatgtcaatgatgatgatgatgatgatgcaaccatctcattggcatgaacactcaaaagtcttaacgtatttagatgtgagaatccttaagattaacattgaggaacactcggttataactacaatcgtaaatgtaaattgtcttagtctatatgatctttttggtcacaacaggtaatttcattttcctttgattacttctcgtgaaaaaacaaattaacagttgtggttttccattgatttcaaaaattatctcaaattttggctaaaaaaagaaaaagaaaagagagatgcttcagaatcagaagagaacagtccacttaaaagtcttaaaccctaaaatgaaatccttccatctaaaacgcagtaaacgtcaccgtttgattcttcgtgacccacctaactacgatacactagcttgtagaggataaatgctccgagccctataaacacaaactatgtggagctactaaaggagaagtctttctctctcgatcaagccaagtaaaaaaaaaatcctaatctttgcgtcaccgttcgtgtttcctcttctctctagggttctccttcaacagttttccagtaaacatg

SEQ ID NO: 31870 - DNA, 3000 bp, Unknown; identical to SEQ ID NO: 7781
  misc_feature (1)..( 3000): 2750-1469P.txt file - cDNA_ID_3046702; gDNA_ID_1621162; Annot_ID_173718

SEQ ID NO: 31871 - DNA, 3003 bp, Unknown
  misc_feature (1)..( 3003): 2750-1469P.txt file - cDNA_ID_3046702; gDNA_ID_2926183; Annot_ID_200425
aataccacaagcacgtatacaagagataaggaggtaagattcttcatctacttgctttttctggagtaattgactcccaactagtagtcaaatcttttttactttaccacattcattttcactcacaatgacgcaaacactatggtcaaactctgttttatcactcctatttttttttttttaagtgtttttttctaacaccccaaaaaagaagcaaatgaagtaaagaaaaagtcacccatttgtattttgatcaaaggtatataataaaatcctcaagaataggtttatcgaaaccaaatcaataatgtttgaccaagaacatgaataaaacaaaacaaaaaacatgaaatcgttgagaatatttttgaaagaagaaaaaaaaataccgaaccgggtagttcgctactactacacaacaacaacaagagcaacatacgtttcgttcgatgaacagaaacactttgggagtatccgttcgtctaaccgtttgttttgtattgggcacgtgttcgcatgaattcagtctcttaatcagtctttttgactatatacatccatgcatgccacatcacgtgaccttttcgtaatttaatttaagtcggttacaatgtgtatgttcatttccttcaaaaggaaacttaaatacataaaacttatatatatatataatattcattgtgttaaaaaaaaactttatataaattcataatatataactctatagaaatgtattaactacaaaatctaggaaataatgtcattttttaaatattgaatatctactaagttatgactttctttgtctaaaaaatgcttcagcttttgaacaaaataataataaagattatactttataacaaagaaaatttgagtcaaattaacagcataatattttgtttttatgattcagcgttttgaatgcaaagaccaaattaccacaagatctctaaacttcaccgactaaaaactaagggtaattaagtcattttacaaaaaagaagaaaaaaagacggagatatataaaaatgtgacacgtttaggcacttttagataatcttattcttttttatgcacttatgagggtgaggacactttttccattatttgactttttttaagacatttttacccctaacttaaacaactacttttattttgaattttaacacaaattaaatattttttctctcttccacgatccttacgcaaaatagaaaaaaagatctctctctctctctctttctctctctcacatttgtagtgcctttctctctccacgtctccataacttctaggtttgattcctcttatcgattatgacggcggctcactaaaaattggtgataacgattctgcaaataaatgggagaagtttcttaaacaattcgatctcgattatctcaggaatttggtaaaaaattttggtatccataataacaagtccatttaaatatatccattcagaaacctttttactgatccatatccaatctatataccatgtcaataataacaagaaattcgattaaccgtggttcgtatagaaaccaaagttccatgtccataagatcttgaaggtggaggtctctccaaactgaaagaaaaatcaacaaataattttttggtatctataataacaagtccatttaaatatatccattcagaaacctttctactgatccgtatccattctatataccatgtcaataataataggagattcgattaaccgtgttttgtaaagaaaccaaagttccatgtccataaggttttgaaggtggaggtctctgcaaactgaaagaaaaatcaacaaacaattttttggtgtccataataacgaatccatttaaatatatccattcggaaacctttttactgatctatatccattttatataacatgtccatgataacaggagattcgattaactgaaatctcgatgctacgtagatgaaacgagtttgacacatgagagagaacaaaaatcaaatcaagccgccattgttgaagatgaagaagtttcttctcattttttacaaagatgaaaagagagagaggtgaagagagagagagatgaagagagagagagatgaagagagagagaaagagagaaaacgtgggttaagagaatattttagttaagagggtattttagtaaaaaaacatagagaaaatgcctaatcttttgaaagtgcctaaaaacggaaataattttaataaaatgtttaagagtgtaatattctctatataaaatcgtaaattttgtatttttaatcatcaattcataaatcttccaaattagaatggggacaatggttctaccatggcagggcttcatatccagggaagtgagcaacttatgtaactcaagaaggaacgagctgactcttggagggttagtgacattctttggtgagaaaattcccagtggtctcaaactcgagaaacagatcgcactcggaaaatgagtcgtcctcgtgggaaatgtaggcaccacacggtcagaagaagactcatcttatgaaggaaacctcgagctcaggcttagggaagctgatttcccaataggccaaaaccaaccgcatatgggagtgtctctaaaaaattcgaaagatgatttaacagtcacagccaatctacgacatcaagtctctgtgggaagacagacaaaggtaacaacttttgtaagtcttgacagcaagaggaccgggtgtttcactgtccgaacaaacagctcagatcagttgcagattgctgtcatggctctgcttctccttgccatgtgatgtcaacctacatgaagatttttcgatcagaggaaagaactgatattaatctttaggattaggttgttttaattacgttcttgccaaatttgatttgattttatggaattaattgtaaaagacttggggctatttatatgaaagtttcgtgattttcattgataagtaggtcgtcaaagaaatagagaagaagcccaaaaaaataaaataatg

SEQ ID NO: 31872 - DNA, 3000 bp, Unknown
  misc_feature (1)..( 3000): 2750-1469P.txt file - cDNA_ID_3046706; gDNA_ID_1621162; Annot_ID_173714
gacaattaagtgaaatcagacaatcttaactgtcgtgtccaaaaacacaaaaactctcctcgcttctcttctcttgttgtagtaagtaactttggtaattaacagtgttattatcaaattcgaatctcttacattaatggaaactcagatcttctcttaaaaacacataaagcacagatcttttacagagaatcttgtaagaagaaagaagatgattgagaggtgtttaggagcttaccggtgccggagaatccaaagagctttacgccaattaaaggtaacgattctctgtcttcttcttaccgttgttgtcctacgtagcacaatcggcgccggtaaattcggaactccggagcaagatcttgacgagatccgtcaacatttccacgcacgcaaacgaggtgagcctcaccgtgtcctcgaagaaattcagaccggaggagattcttcttccggtgacggtggaggtaattccggtgggagtaataactacgagacgtttgacatcaacaagattttcgttgacgaaggtgaagaagagaaacccgacccgaataaaccttacactctcggacccaagatatcagattgggatgagcagagatctgattggttagctaagaaccctagcttccctaatttcatcggacctaacaagccacgtgttcttttggtgactggttcggcgccaaaaccatgtgagaatcctgtcggtgatcattacctcttgaaatcgatcaagaacaagatcgattactgtaggttacatgggatcgagatcttctacaacatggctcttctcgatgcagagatggctggtttttgggcaaagcttccattgattaggaagcttttgttgtcacatcctgagattgagtttctttggtggatggatagtgatgctatgtttacagatatggcttttgagcttccatgggagaggtataaagattacaatctggtgatgcatggatggaatgagatggtttatgatcagaagaattggattgggttgaatacagggagtttcttgcttaggaacaatcaatgggcacttgatttgcttgatacttgggctcccatgggtcctaaagggaagatccgtgaagaagcgggtaaggttttgacccgtgagctcaaggatagaccggtgttcgaagctgatgatcagtctgctatggtttatctgttggctactcagcgagacgcttggggcaataaggtacaaactgattttgactggtatataactatgaacttgattccatttcagcattggtttgatgtggaaaaaaaaaaaaactaaatttggaaacttgtggtttgcttgttgtggtttatcatgtctcttgaacatcaaaaataacaatgtgagttgctttttgtggtttatcatgtctcttgatcatcaaaaatgacaatgtgagttgcatcttgtggtttctgacatctgtgtaagggtctattattgaagtaaactcaaatctttgcttggtttggattttgttgagctactcatttgagccactgcattgttgttataggtgtacctagaaagtggatactatcttcacggttactgggggattcttgtggacagatatgaagaaatgatagaaaactaccacccgggtctaggagatcacagatggccattggtgactcactttgtcggttgcaaaccgtgtgggaaatttggtgattacccggtggaacggtgtctaaaacaaatggacagagcctttaactttggagataaccagattctgcaaatctatggtttcactcacaaatctttggctagtcgtaaagtcaagagagtgcggaacgagactagcaatccgttggagatgaaagacgagctcgggttgcttcatccggcgtttaaggcggttaaggtacaaaccaatcaagtttgaatcggttttgcgtttaggatttgtgttatgtttctcgctatatttatgtcttgtgtctttgcttgttgttgtactaagatggatgataaagtattgtgcagagacatcagttaattctttggttttactttgtctctacgtctagagttctattacgaaatcaaaatgttgtttttcttcctttttgttctttgtaatccattagaacttgagattttgtagcttcatggatcaataatctgtgttaattcaagaacttttttttaacctgatttcacattcaactaattatttacttttagtatgcaaaatgtgaaaaaatcacattgagttagtatagttctgagatcatattcacaagttttgtgtagtttaggagtttaattcgaaaaacaaaatttggcatgtggtcagattcttttgcagtatgggttgttgtatctgaaatctgaatgtctttaattgataataaaatcatgtatacgggctattattagggggaggccttataaaagcccatctgaaaactaaaatcacggcctaatatatggaatccgtgttatacaaaaatccaagataattcgtagataatggtgagaaaatcgtttgtggccaagcaatttcgggtagggaggatcaacaaagatacaaaaaagatttctttcttctttataaaacccaaatctcaaaatgttatctcgttttttattttaaatgttttattttattttgttgttgtgtggtttttttggtttttagtaaagagaagatataacaaaaccctaattctcatgagttcaaaaaccctagatttagtgagcccatcaaaacattttccattggggaagattttaacatttggagaattgtgcataataaaaacaaaatattaaacagtaaatactttccaaaaagtgactaaaatattctaaatttactcaacaaaaattgaaaattcttgacaaaaaaattactgttttttaaaatgatacaatgtttttcaaattttaaccacaaatgattattgtacttcttcctcaaataaaaaaagaaactctatatattttggcttgagccaatg

SEQ ID NO: 31873 - DNA, 3000 bp, Unknown
  misc_feature (1)..( 3000): 2750-1469P.txt file - cDNA_ID_3046732; gDNA_ID_1972148; Annot_ID_179371
gtggtcgtagcacacttgagaaggctatttcattcgtcaatgccaatgataattggaacgctagagttgtatatggtgacactgataggtaaacattaaccaccatctttcatggcactattttaacttcctacaatataaagtatagccagggtttcatgcttgcataagttaatatatattcgtattacttccgagtgtttattatggtcatttcagcagccttgacaagtatgtatcacagtttctttatttacttcttcctcgtggcctcatgcattttaattacttctgtagtatgtttgtcctcctaaaaggacgaactgtaaaagaagcttttgtagtcggacaagagattgcatctgcaataactgaaatgaacccacacccagtcactttaaagatggagaaagtctatcacccttgtttccttcttacgaagaagcgttatgttgggtacagttatgaaagtcccaatcagagagagcctatatttgatgcaaaaggtattgaaactgttcgaagagacacttgtgaagctgttgcgaaaactatggagcaatcgttgagactcttttttgaacagaagaacatctctaaggtacaaatttgatttcttgcactctttcgaattatcagctgaaactgcagtgtcgtacatctgcttttctctattcattgtgcaggttaagtcgtacttgtatagacagtggaagcggatactatcagggagagtgtctcttcaagattttatctttgcaaaagaagttcggttgggtacttacagcacaagagactcttcactccttcctccagcagctattgtggcaaccaaatcaatgaaagcagaccctcggacagagccacgctatgctgaacgagtgccttatgttgtgattcatggggagccaggagctcgacttgttgatatggttgttgatccactggttcttttggacgtcgatacaccctaccgactgaatgacttatactacatcaacaaacaaattataccagctttgcaaagggtatttggactcgtgggtgcagacttaaaccagtggtttttggagatgccccgtctcaccagaagctcccttggtcaacgtcccttaaactctaaaaactcacacaaaacaaggattgattatttttatctatcgaaacattgcatcttgtgtggggaagttgttcaagaatctgctcaactatgcaaccggtgccttcaaaataaaagtgctgctgctgcaaccattgtttggaagacttcaaagttggagagagagatgcaacacctagccacggtaagtactccaaaatctaacgtttatgaactgttacagaacttggtaacgtttacaaccatcatcttactgtctttactttccaagagatcgtgtgcttcatagaaacttgtacactttctgatgtgagcatttgcatttaatcttgcacacactttgaattcaaagagacagtttcatctcatggtagtcgcaaaacaatttatgctaaaaagtggagacttattagtttcagattatctttcagaaatgtttgctattttataacaagaacgagtgtagacctctttccatgtgtgcttaagttgtgaccttggtgaatctctgtagatgcattcagttccaactttgttggtccattaattgatttttctttatattatcttatttgcagatatgcagacactgtggtgggggagactgggtggtgcaaagcggagtgaaatgcaattcccttgcgtgctcagtcttttacgagagacggaaagttcagaaagagcttcgtggcctctcctccattgctactgagagtgagctttaccctaaatgcatggctgagtggttctaaccttgacgaaaactcaaaaaaaaaaaaaaaaaaccagtaatctaactctatcccatacgtatttccactcaaactaatctaaaccatcctatcctgttaagtaacgatgtgaatttttgtatttgcaggattttgagcgaactagtaggtttatatggttgtgatcaaagagcatttttttcaaggacgtgtgaatatgtgtatagatagtagtagcacccacgagtacagtactgtcactcatcattctgttcaactcctttgtgttgtgttgtgtataagcaatcttggaaaaaataattataattttgtatagcataccaagttcacgagaaagatagatagatagataaagaaacaaaaacaacataacaaaaaaaattaacagaagaaacaaaaacgcctacgagtcttttgggtggtggtgagatggtgcaatgcttcaatctctctctttttaagactttcgagcacaaccaactgtttcacacaaaatgggtgataatcccttcaatgtaggcaaaacttatagaatgcttaagaaaactgaataaggaaaaaacctcacctcttcaatagcacgctcccgcaaaatcgtaaagtgcatagccctgtgtttggatataatcttcgtatccatatatgataaagcaactacatggaaactggcagagttatatcaaacatataaatggtcatggatatgagtgtacaaaaagtaaaacagatttggtcatacacaatttgaatttcttcccgtaataaacatattcttaggctctatatatatatattgtatcaatgttattgagatcaataacacataataaagagttttcccccaaacccttctctagttagtagtttctataattttggcaaatagtattcaagtgctcttgcattctcaagtgattaattcaattcctaggtttcggtttcggtttcggtttggttcggttcgtctcggttattttaggaaaagaaaacaaaattagagagcaaacacgattggtcaaagtcaactcttctctaccttcctcacttcccagcttcactgatcatcgccaatcacaaaaccaactacacacattcatcatcatttcgattatattttacccgaccatg

SEQ ID NO: 31874 - DNA, 3003 bp, Unknown; identical to SEQ ID NO: 17524
  misc_feature (1)..( 3003): 2750-1469P.txt file - cDNA_ID_3046732; gDNA_ID_1621169; Annot_ID_173917

SEQ ID NO: 31875 - DNA, 3000 bp, Unknown
  misc_feature (1)..( 3000): 2750-1469P.txt file - cDNA_ID_3046739; gDNA_ID_1972148; Annot_ID_179372
aactctttcaccggatctcaacaagtgtaaacagcttcaacggttgatcctctccgctaacaacttttccggtgagattcctggtgatatctggccggaattgactaatttagctcagcttgatctctctgctaacgaattttccggcgaaatccctaaggatatcggagagcttaagtctctctctggtactttgaatctctcctttaaccatttatccggccaaatccctaattccttaggaaatctaccggtgacagtctctcttgatctccggaacaacgatttctccggcgagattcctcaatctggttcgttctctaaccaggggccaaccgcatttctcaataatccgaaactgtgtggtttccctctccagaaaacttgtaaagacactgatgagaactctccggggactcgaaagtcgcccgagaataatgcggattctagaagagggttaagtactggattaatagtgttgatctcggtggcagatgcagcaagtgtagcttttattggtttagtgttagtttacttgtactggaagaaaaaagactctgagggagggtgtagctgcacagggaatgcgaaactcggtggtggttcggtgaaggggaaatcgtgttgttgtatcacggggtttccgaaagaggatgattcggaagcggaaggtaatgagagaggagaagggaaaggagatggagagcttgtagcgattgataaagggttttcttttgagcttgatgagttgttgagagcttctgcatatgttttggggaagagtgggttagggatagtgtataaagtggtgttagggaatggagttccggtggcggtgcggcgacttggggaaggaggggaacagaggtataaagagtttgttacggaggttcaagctatggggaaagtgaaacatcctaatgtggtgaagttaagagcttattattgggctcctgatgagaagcttttgattagtgacttcgttaacaatggaagtttagctgatgctcttagaggtattacattacttcttccttcttctttttctgcttatcgaattagtctactaactaaagtttgagatccggttctgttctattgacttaagaaatttatgttgactttgactttgtcaacgctagattagacattactaccttagtgagagatgagattagatctgagagatagtttgtgggattgtcaaagcaagagtggaccaagatttctttctctttttaggcatattttggtattttaatttagaatttagtcaagttacatgtaaaagagacatgtcttgtaagagaattcgacatgtccgaataataaatatcttttttaagtattagtatatgatttaagtgtggtagagtcttagagtagaagtaattagtaaaaatagcagaatgaggaaacaatgatgagagaagtttacttgtgggctaagagtaatgattttatacacccactctgttgagcctctagctgtcccgtctttttctcatcgtaactcattacttactttaatattggatacttgtttgttttggtgtgtgaatagggaggaatggtcaaccatcaccgagcttaacatggtcaacgcgtataaagatcgcaaaaggagctgcgcgtgggttagcttatctacacgagtgtagtccaaggaagttggtacatggcgacgttaagccttccaacattcttcttgattcctccttcactccttacatctctgacttcggtctcacacgtctcatcaccatcactgccgcttctgcctcttctaacgaaccttcctcctcctctgctgcgggtggtttcttaggtggagctcttccttacacttccatcaaaccctcagatagatccaacggctataaagcccccgaggcccggctccctggagggaggcctactcagaaatgggacgtatactccttcggtgttgtgcttatggagcttctcaccgggaaatcgccggattcttctccgttaagctcttcctcgacgtctacggtggttgttgaggtgccggatttggtgaagtgggtgaggaaagggtttgaagaggagactccattgtcggacatggttgatccaatgttacttcaagaagttcacgccaagcaacaagtcttgtccgtttttcatctagctctcgcttgtaccgaaggtgaccctgaagtccgtccacgtatgaagaacgtctctgagaacatcgacaaaatctgattcaattattatattcttttttctttaatttttcctattatatttttgtatctccgatagttcttacacgaggtcgttacgtcactcccacgtctgggactagtggtcgatttgtttttattgaataattatttgttatgaaaattgaatcaaatgagttatactttaggctttaaatggctttgtcttttattttgctgtctttttctcatctgttaaaagacaactcctagttaacgggcacttgtcttgtccttcagttgaagatacacatacaagatctaatatcttccaagaaccatccatttgaaatttcgcttttcatagagtttatgcaaatgtggatttgggtttttagatttaaacgggtcacagaatatttaacttggggtaaattttcaaaaaagcataatggataattaaaatttagattggcccattatatttatcaggcccactaattaaatgtttgttgcttttctgctttttgacattttacaccggcaacctttgtcggagaacggttaagtagctgggataactcaggcggcgtcgcggttaggtagagtagaagaaactacaagcaagagagagcgattcactgaaggtaaccacgtcttaaacaaaatgaaccgaactataaccgtttggttagaagatttaaaacggaatgatccggtttgattttttggtttcagattctgcgggtactggcgccaaatcataattcgtggttccggtcaaagtcacggcgaaacagccatg

SEQ ID NO: 31876 - DNA, 3003 bp, Unknown; identical to SEQ ID NO: 17525
  misc_feature (1)..( 3003): 2750-1469P.txt file - cDNA_ID_3046739; gDNA_ID_1621169; Annot_ID_173915

SEQ ID NO: 31877 - DNA, 3000 bp, Unknown; identical to SEQ ID NO: 27980
  misc_feature (1)..( 3000): 2750-1469P.txt file - cDNA_ID_3046744; gDNA_ID_1621170; Annot_ID_173934

SEQ ID NO: 31878 - DNA, 3000 bp, Unknown; identical to SEQ ID NO: 17537
  misc_feature (1)..( 3000): 2750-1469P.txt file - cDNA_ID_3046752; gDNA_ID_1621170; Annot_ID_173932

SEQ ID NO: 31879 - DNA, 3000 bp, Unknown; identical to SEQ ID NO: 7881
  misc_feature (1)..( 3000): 2750-1469P.txt file - cDNA_ID_3046792; gDNA_ID_1621170; Annot_ID_57251

SEQ ID NO: 31880 - DNA, 3000 bp, Unknown; identical to SEQ ID NO: 7870
  misc_feature (1)..( 3000): 2750-1469P.txt file - cDNA_ID_3046792; gDNA_ID_1621170; Annot_ID_173955

SEQ ID NO: 31881 - DNA, 3000 bp, Unknown; identical to SEQ ID NO: 7871
  misc_feature (1)..( 3000): 2750-1469P.txt file - cDNA_ID_3046796; gDNA_ID_1621170; Annot_ID_57250

SEQ ID NO: 31882 - DNA, 3000 bp, Unknown; identical to SEQ ID NO: 7871
  misc_feature (1)..( 3000): 2750-1469P.txt file - cDNA_ID_3046796; gDNA_ID_1621170; Annot_ID_173954

SEQ ID NO: 31883 - DNA, 3003 bp, Unknown; identical to SEQ ID NO: 17532
  misc_feature (1)..( 3003): 2750-1469P.txt file - cDNA_ID_3046804; gDNA_ID_1621170; Annot_ID_173948

SEQ ID NO: 31884 - DNA, 3000 bp, Unknown
  misc_feature (1)..( 3000): 2750-1469P.txt file - cDNA_ID_3046808; gDNA_ID_1621170; Annot_ID_173947
caagcattcccaaaagctcataagcatcagccacggtctgcacaatgtgcttgtccggaggcttacggtcataactctccagatccttgaatagcttcataacccacataacaaaataaacacaagtttgaggtcaccacgaaataaagtaacttactagttcagttaagtatcaatgtgcaatgttttcttatttagttttcggtcagtgaagacaagggggaaaaagaaccttaacaagttcctgtaacatgttgttccggaaatatatgcgcatcatttgtaagcataattgccaaggcacagaatgcagatcgttcccaactttctttcgccagataacatgagcctcttctgctctacgatccatatctaacgcccgtatcaactgtccgtacgtccccatcgtgttcccttgtcccttacttaggatccactttatcacctacaaacgattaaacaggggaaaagaaataaacacctccccaagattctattctactttttcagttactatagcaatagacatatgttcttggatatttgattattcatggttcatgagtcccagaaaagagatagaacactcaggtgatagatacctggaccattcgatgccattgatgttccttttcaagactagctattactattttgagggaagcaatggggaaattgcgctcccaagcaacccaagcatccagagctccataaacagcctctttattatcttcaatatcaagaagctgcattcacagatgagagcaaaataagaaccataagagtaaaaaactaaggttaaacaagaatatgaaaattctcataatcgacaaaccattagaaaggcaaaaagaaatagcttagtgtacaaaaaaattctgcttacagtgttcacaagaaactttattttatccttcttgggtatgttctccccaatttgatgtttcctagggttttcagcgtttcccttctttgatgaatcagaaaaatcttcctcatcctacaacaagatgaaaaatatgcatcctaaggatctctcgttggtgaaaaataacgcaagaaatataattgatgaaaggcacaattctcaggaatttactaaccaaaaatacatggaaaacagaaagtaatttgatcatcagatatatcagtgatgtgtttgactatatgaactactgagatcgacaggccagtgaatgagaacacacactttagttatgtgctatgaactactgagatcgacaggccagtgaatgagaatacacactttagttatgtgctataacttatatctaggtgaagatgtataagatctgtctgcaagagaaacataaattgagctcacactaagacttggacagcaaaacacaaagccgatcttcagtgtaatctattgtacctcattcttcacaatacgtttaggagatgaatgagaatcagcgacaaactgatagctcatagattggacccttaaaaaggcgggcttgtttgtctggttgacctgagaaataacatgtatcacaaaatgaataaaaggaatctgaaatatacgtgtgcaccttttatttattggggtttttgaagtttaagatgaaaaacatttcacaactgaaaacttaccccaagaagatgatgaaatggaccagttagtgcgccagcattaccaacggtgttgtactttctgtagaagaatggtaaagtatcagattcaaatcaatacaccaagactcaagatgcagcttgtttttggcagtacaaaagcgagacttggagagcagaaagaaatgaagctaattgatccaatctgagcttttaccttattccattggaatgagaaaacactcctggctcacctacaataagtttcaaatcataagagactccgactatatgaagacctcaaccaggttacacaatctagcatttcacatttgtatgcaatttaatcaacttatcagaagaaaaagagagacctttcaaagttttacagaaattgtctacttaattaaatgaccatttttacagaaatcagctccaaattcgaaacttagagattccaagtcagtaaccaaacattagagtgctatcttcttccgcattaaacttttaagtatacaaacgaatttatcatgagcaatactaaccataattttcgtcacatcctcctccaatgaagagatttcttgctgctgaaatagaagctaacggcgccgttagatttcttgttgcgctactaacggcgcgtttcagaagcgttctaggaattagagaactgaaacccgccattggagacggtgctacgagaaccaacgaagacggaggcgtattaagggaggggttttcagaaatgatactgttacaattagcccattaataaaaaaaattggcccattaataacaaaaagaagcttcttctctatgtagtagtagatccgttgaaatagagatgataaaacgtgtagcccattaagaaaagaattggcccattaacgagaaagacgcttctctcttttctattagatccgttgaaagcgagatagataaaccggatcggtttaatgaaaaggggtaacatcggaattacaaagtttcatgattcttcttcgttcgctttccaagttccaacgtccgttttggggggaaataaaccaggggacaagaaaatccaagaaaaaaaaaattcaggtttctgcgagaaaatctggatgaaacagacctatgtgttctgggattttttttcaaagggaaaaaaactcaagggtttaagatcctctgcaatcgtcacgaaattttgcgcatgtagcctcgtttatgtttctatgttgttgacgtcgatcagaaagttttgaagctgggaaagtgaaattttggttcttgattttatcatggatccgttgtgattggattttcaaaagtttgtgttgatgtttctcccgttgttgggtattgtcgagccgggatcgttttagaaaaatctgaccaaattccatcataacaatg

SEQ ID NO: 31885 - DNA, 3003 bp, Unknown
  misc_feature (1)..( 3003): 2750-1469P.txt file - cDNA_ID_3046820; gDNA_ID_1621170; Annot_ID_173940
aaatcagatcttttgtttaatatcctaagacgcaaactctaataagaagctttattttctcttattatttataaatgagagtattaaatttgtccggttatgagcatttgtaggtttctttgtggtttgtctttaacaaaacccaaatttctcaaaccctgattgttcgcctatagactcgatcttcgttttttttttgtcttaatcactcaataatatattgtctaaagtacattgtatatcattagttatgaattatgatgatatagctcgacatataaattaataatagaattcaaatgctcgctcgctgactgtagtaccctgatatcactagccaatacaacttacgaaaaaatgaaaaatgaaaaaaattttaaactcgaccaatcaatcgtccatggtatagttgtatcatcagacagcctttactaaggaaaaatgttataaattgggttcgtggccaaatttatgactttcaactgtcaccaaccttacattttgctatataaaccctaagaaactcattataaacttcaacaacataaaagacgatcaatataatctagaaaaaaaaaaagaagagagaagagagaaatgtcgagagctttgtcagtcgtttgtgtcttgctcgccatatccttcgtctgtgcacgtgctcgtcaggtgccgggagagtctgatgagggaaagacgacgggacatgacgatacaacaacaatgcccatgcatgcaaaagcagctgatcagttaccaccaaagagcgtcggcgacaaaaaatgcatcggaggagttgctggagtcggtggattcgccggagttggtggtgttgccggcgtgggaggtctagggatgccactcatcggtggtcttggcgggatcggtaagtatggtggcataggcggtgcagctggaatcggtggatttcatagtataggcggtgttggcggtctaggcggtgtcggaggaggtgttggcggtctaggcggtgttggagggggtgttggtggtctaggtggcgttggcggtctaggtggagctggtttaggcggtgtaggtggtgttggcggtggtattggtaaagccggtggtattggcggtttaggtggtctaggcggagccggaggtggtttaggtggagttggtggtctcggtaaggctggtggtattggtgttggtggtggtatcggtggtggacacggcgtggtcggtggtgtgatcgatccacatccttaatagagagtatttgttggttagggttttaattaaggaataattaattagtttcgatgttattgttggtcttttaattctgtgatcattagggtgacttttgatctattttctagtttgggcttttgtaacgtttgctttgatttcggccgtggtgttatgaaatgtgcgactctctatgtttgaatcgttttggtttaggaggttctcttcttccatacttttgcatgttcaaagacaaatttttaattaagaggaattatcaaggtttccgacgagatattttttgaaaatgaaattggtttgaacttgtaatgatatttaaaatatgaaaacatcactcaaaaatggatggagtacaaactttttccactatatatacattacatgtaaaaagtgtatagatttcgtttttgttgcactgtctaactctaaataagtcggatatcaaagttagtatatagtaaaaaaaaaaaaaagttagtatatatatccaagtggtaaaacccgtaaaattaacatatatatatatatatatatatatatatatatgagtttggtcaagggttttgaaagatctcgactaagagaagacatatgagttttggttcaaaaagtccttcgataatcattagaaacgaattaatatatagtaaaattgagtaaaaatgttaatctattaaccaaaggttaactatatagaagattaatatattataaaactaaccaaaacattggatattggtatatccggattattttcctcgttgatgatcgcaatattgcattcagccatctactacacacttcctcgttgatgatcacaataatgcattcagccatctactacacactgacacatatgattcgtaatttcgtatgaaatgtttgaactcatacttttaatttacatatttaagatggacgtaacaatgaacatttgttcagaacttgagattgtactacccctataaataacgcctatttactaattactatgcatggttcatcatggttggaaatttctttgcaaatgatctagtgtatattaatccaaaatatataggaaaaatacattaattgtgggaggaagacagcaagaatccacaaaaaggaagcactaataaatgacgtaataattgcgttgggatgagagggacacaaattaaagaagataggatttgcatgtcaaacacttgttgtcccatttcatgcatcgtcctctctattgtctatttcgctgtcacaacctctaaatttacatctcatgcaatttattacgacgtatacatacacccttcaaatttttattcgtttgcatttgtatatatatacatatatattagctagtaaaattaatcacaatttataattttgtaatcattaaaaatattgtagtaaaaaaagcaaaacccaaaaaaaatagaaaagaaaactgaactggttggtgtttgtggtattttttttaataattttgttaaggatttgatatgggtttcaattttaatggtggaccgaattgaaaatcatcgagtgaaaattgagctacttacaaagcccaattagatccaacgggcctcaaaatatcttttatattccattttttttaatttgtttttgtttaataaatcaaaaattgaaaagcgaaaggcagagaaaatttccaatataggcgaaatgtaaagagcgggaagctaaagcctagagagagattctcacactgccaaaacaaaatttccctgtagagagagagagaaagagtgagtgatg

SEQ ID NO: 31886 - DNA, 3000 bp, Unknown; identical to SEQ ID NO: 15422
  misc_feature (1)..( 3000): 2750-1469P.txt file - cDNA_ID_3046829; gDNA_ID_1621171; Annot_ID_173984

SEQ ID NO: 31887 - DNA, 3003 bp, Unknown; identical to SEQ ID NO: 17540
  misc_feature (1)..( 3003): 2750-1469P.txt file - cDNA_ID_3046833; gDNA_ID_1621171; Annot_ID_173979

SEQ ID NO: 31888 - DNA, 3003 bp, Unknown; identical to SEQ ID NO: 21610
  misc_feature (1)..( 3003): 2750-1469P.txt file - cDNA_ID_3046844; gDNA_ID_2926134; Annot_ID_197125

SEQ ID NO: 31889 - DNA, 3000 bp, Unknown; identical to SEQ ID NO: 7896
  misc_feature (1)..( 3000): 2750-1469P.txt file - cDNA_ID_3046844; gDNA_ID_1621172; Annot_ID_174014

SEQ ID NO: 31890 - DNA, 3003 bp, Unknown
  misc_feature (1)..( 3003): 2750-1469P.txt file - cDNA_ID_3046902; gDNA_ID_1621173; Annot_ID_174033
aaaggaaatgcttttagaagcaaatggaacagataatggtgcaagacttcagtttacaactaccaaaaaaggttcaatttggtttgatcaagtctcagccatgcctatggatacttacaaggtttgtttacttcattgagacaacggcttatagagtctagcagcattttcaaggcagagtaattttgatttttcttgatttggtcacagggacatggtttcagaaatgaccttttccaaatgatggtcgatctaaaaccgcggtttatccgattcccgggtaatttctagagagtaaaatagcatttcacttggtaaaatatgtatgaacataaaaaatgagaaaagctaaaagaattagcaatgttttgggagttaggtggttgttttgtggagggtgattggttaggcaatgcattccgctggaaagaaaccgtgagagcttgggaagagagacctggccattatggtgatgtttggaagtactggactgatgatggccttggccactttgaattctttcaagtaagggatttttttcttttcggttctatatccatttaaagtgtttcaataattactaagctcgaaacaaatatttcttgtagcttgcagaagaccttggtgcatccccaatatgggtgtttaacaatggtaattcttaagctctatatctcaagactttgctttatttacatgtattaacctctgagtgactgtttcagggatcagtcacaatgatcaagttgaaacaaaaaatgtcatgccttttgttcaagtatactcatgaaactttctattttaataaagagagtgatagtaattcattagtaagccaaaaattaaactaaaatgtgtatttctctgtctaaggaagcgattgacggtatagagtttgctcgtggagattctaattctacatggggatcggttcgagctgcaatgggacatccagagccttttgaactgaaatatgttgcggttgggaatgaagattgttttaagagttactacagaggtttttgcatttctctctgttatttaaaaccattttgaaagatacaaacaagagagctttggttatactaacttaaatacacaactttttacaggaaactatcttgaattctataatgctatcaaaaaagcttatccagatattaaaatcatctccaactgcgatgcatcggctaaaccgctcgatcacccggccgattactttgattaccacgtaaaaaatacaaaaaacaaaaaaaaactttcaaattttaccattcatatcattgattttgacagaatcttgttattcagatttacactcttgcaagagacttgttttccaagtcccatgattttgacaatacaccgcgaaacggtccaaaggtgcggtaatagatgaaacaaaagagttcattttcgacaatgaaaaactgcggttattcgccttgtatattcttctaatgaagaagctttcaacattttcttggttataggcttttgttagcgaatacgctgtaaacaaagcagatgctaaaaatggcaaccttttggccgctcttggtgaagcagctttcctccttggtttggaaaagaacaggttttttttttctcaaacctctatcttcttctttggttttgaaaagaaaagttaaaacactcactgtcatgtttttgttgcagtgacattgtagaaatggttagctatgcacctctctttgtcaacacaaacgatagaaggtatctctcactttagtttcaacggtttttatcggtatatcttgaatgcggtaatcagaaacaagcccgttgcttttgttttgtttttcaggtggatccctgatgcaatagtttttaactcgtctcatctatatggaactcctagctattgggtccaacacttcttcaccgagtcaagcggagcaactcttctcaattctacacttaagggaaagacttcttctgttgaagcatctgccatctctttccaaaccaatggcaaagattacatacagatcaaggtttgcttatctcccatacgcacaaaacaaatgtctagaaccaaatgaatgttctgaccaaatatgaatacacaggctgtaaactttggagaacaatcagtaaatctaaaggtagcagtgacaggattgatggcaaaattttatggatccaaaaagaaagtacttacatctgccagtgtgatggatgagaactctttttcaaacccaaatatggtaaaacatatgaagaatcaatcatacaagagttagggcttagtattgttctgaatcttgaaaacgttgctaagttgttttctctgttcttttctgtagattgtgccacaagaaagtttgctggagatgactgagcaggaagaccttatgtttgttctcccgccgcactcgttctcttccttcgatttgttgacagaatctgaaaatgtcatcaagatgccaatatctgattcatacaagaaaacttcaacaatgtgaagagaaacatcatcttggagactttcatgtcttttgtctttactcttcagtggttattaaacacataaacctatatgttcgtgaataataccaaagttagttgattataatcacgttatgcccttagattacttgatatgcaagattactcttccttggtaaaaaaaaaacaatggtaacacattagaccctaaacagttcagtcaaaggaacttacattgtgtcgtcaaaatgcagctaaaaatagcccaaagtttaattctttattgtttaaaatccttatctaacaaacattgcttctcacagtttcttgtttttttcttttcttcaaactataattagaaagacatcgagaacatatcttaatacttgagaaactaaaatcccctaaattccagcaatttatctgtcctttcaaagcaattttaagattaagagaaccataaaattaaattccattactctcacacaatttttgattatattataacattttgtatgttggagcaagatg

SEQ ID NO: 31891 - DNA, 3003 bp, Unknown; identical to SEQ ID NO: 21318
  misc_feature (1)..( 3003): 2750-1469P.txt file - cDNA_ID_3046942; gDNA_ID_1621174; Annot_ID_174099

SEQ ID NO: 31892 - DNA, 3003 bp, Unknown
  misc_feature (1)..( 3003): 2750-1469P.txt file - cDNA_ID_3046944; gDNA_ID_1621174; Annot_ID_174096
agaggaaccatatatcaaggtaacatgttagaaatacctaacattaaagaaatgagacgttgagtgatatatgaataatatggtctaatccacttttgttttgaattgaaaagccaaaataattacaattaatatataattgtttaacatttaaaattcaatgtatcatttcttaaaattatttgtagctgagacgaattttctttccagatccctatgacaactttaggtgtactgttgatggataaatcaggaagacgaccattacttctagtaagaaaaaacaagtgactaacatttttttataatgttattagtcaaatacaaagtaatttttacaagtaccttttctcactatattaaaaataaagtttttaaagaatttatgttataactgtagttccaacttattattgtttttttatcttttattattattattatacattggtggataattatatattgcctccctagtccctatatatatgtcaatatgtatatgttgaaagaattacatataatgaatttaatattttatctcttcagatttctgctactggaacatgtatcgggtgtttcctcgtcggtttatcattttcattacaggttctctccttatttatattttaaaataatatcttgattttatctatttttaacatattatgttttagtatattaatatcagtataaaaattgaatattttttgtctacagtggtgccatatgactttattgttaccataattataattttttcttctaatagagatttaatatattttctcgatctatgtctagatctagatgataaatatctagaaatattaatttttattgtttgattgtatattaatattaaaacttctcaagtagttgcatatatgcttcaaaatgtttataatttcatattatgtactataatttttgggttcatcctgttgtagtttgtaaagcaattgagtggagatgcttcatatctagcacttacaggcgttttggtaagtttgacgactaaaatctagatttcctttttttttatcctcaatttgaaaagtttgaaaatagttgatatgaatatgatagttttggcatactgaaacgttgctgtttgaaagtgggaatgactgtaccaataagatggtgcatgaaaaaaatagaagaactgatatacacatctatatcatcaaaatacgtttatttttcctgtaactcgttctgaaagaactatatagtagacgtgtttgagttgaaggaattttacgatgaatgacttgctaaaacaaatttccgaatactatgtcggtgaggaaaaactactagaaaagaacaaataatatcattattgttattaacaagtatttcgtggcttctgggatagcgaaccaactattggatgaaattagaacccacacacatactttgaaagatcgtagacgtccataaatgataaatttatcttattttttcaggtgtacaccggatcattttcattagggatgggtgggattccttgggtcattatgtcagaggtaagtaacattcataaaaattctttggttttaaacatactcttatacttaataatccgatcgatgtcttaagaaatattaaactttatatcataaacctacggtttagtattaaaattaaataataaattatttaactctcatatggttgtatgtggtatgattttgatcagtgtatataaattatgttcctttatgatttatttattgattctttgtttatataacattttaattcaatttagttggtgcgtagatattaattttatgttttatatgataaagatatttccaatagacataaaaggatcagccggaagcctcgtgactgttgttagctgggtcggatcatggattatatcttttacatttaactttctaatgaattggaatccggcaggtataaaatttgtttaaattttgcttttatcaataaattttgttctttatctaatagtggcacaagttttaaattttcaggaacgttttatgttttcgctactgtttgtggggctactgttatttttgtagcaaaactcgtaccagaaaccaaaggtcgcacacttgaggaaatccaatattcgattggttatgtagaattgtaatgtatagtagttgattacgagaatatcagtccctaattataacgattaaaagtaagattttttatttttcttctttccttttggtataatcgtatcatcctttttgcttagtgaatttgaataaatggtgttgtttttggttaccaaatatcggagaacataattgaaggtgtcgaggaaaaaaatcgaggttatgacgagtttacaacttctaaagacagtgaaagatattcgaagtttttttggacatatatgttgggttctacaaaaaaattataaaatatttctttgagatagttagaccgcttacaaaaatgttatgtatggaggtcaattttgatttcatggatgagtgcaaaaaatcaattttaaaaaatgattgtttgacaaatatccattcaaaatatactaactaagggattagatcacgatattaatgacatattcttgttttccattttttcctttaacacacacaaaccaaaaaaaaaattaaaaaaaaattttaaaaaaatagtcatttttcctctttttatatctaaaaacaagaaagaaaaccaattaaaaagaagtgacagagattgaagtgtgaagccatctgacgtgggacttatcttacgttctcttctaatctctacaggtcatctttctcggtggcacctttattcaccaagcaaaacaccgcttctttcgatcatctatctctttcccattttcttttcttgacttttttttctctctcttcttgttctattataaacaaaaaatgtgtaataattattcatcaatcctcagaataatacaaataggggagtaggtatctatcttgtcaccctctctctctctctcttgttaccaagatg

SEQ ID NO: 31893 - DNA, 3003 bp, Unknown
  misc_feature (1)..( 3003): 2750-1469P.txt file - cDNA_ID_3046948; gDNA_ID_1621174; Annot_ID_174095
tgtttagacccatttgcaccaaagcagttaatgcccaacgactagtgatttgggtaatcaattgctttgtatgttgaatcatatctttcttttttaggttagatttttttttttcttagtcaacatgaataatcagattatataccctaaattttttagaaattgctacactataatttcattcaccctctttattctagctaatcagaagctatcccctaatttttaaaaaatatatttaattattattgaatttgctgttcaccatttaaaaaaatgtactccctctagtcaatgtgttctcaactatattacatgcattaataaagacttaaagagtgactaattcgaaatcttgtcagattattgaagtaagagttttattacgtcgttgttagtatacagattatataacaaacaataaaatgtggttcccgtgtaaagataattataagttataaccttatattagacgacaaaaaaaaaaatgttataaccttatattatttgagaagttacaaaaaaagattaaataaatatggacgaacaagagaaactatatctgtatatagtacttaagttataaccctataactcacacattctttcagtagcaatgagtttaatcaaaatgattccttagacttgtatttatccactcacacggtttagtaatatattaaatgaaaaaaagctctaaaaggaagttgctcctatatatcttattcttcttttatatggttttacaaattcataaaattcaccaaaatgacagtaccatgcatataccaaccaccctacgatcaaacagcaaggctaaaacataactgtaagtgttttcactattttgtttcatgttttcaccctcttggttacgaaggcaactatgccaaaacttattagtaaactttgattaactgacttttgttgagaccaaagaacagttccaaatcttgcgtctacccgtctccaattatttaaagaatattttgtcagagttgcacgtttttacgaacaccatttcattaatataactatatgttcttttaaaataaaggccaataatttcaccaaaaaacttaaaaataaaagccaactactgtttttttgtcctacactcctacttgatttgtttttcgtcctttgttaattacccacgatatcttcaagcctttttaaaaaaaaagtgtctaaaacttctcaagatcctatataaatgtatgaagagttttgaacttagtacttgtcacaaatataagtgacaatatcctcttaagtctcttactctatctctctctttaactgtatcttaaacaaaaagaaagagtatgatcatcagaagaaaaaagaaacaacaacaatggagagacaaaagagcatggaagccagtttactcaggaagagtctcagcataagagaaaggaaacacccaaatgaagatggttaccctgaatccagtttactcagaaagtgttcaagcattttatttaacaccttctaggcgtgaaatgaaagatctaaatcaacaggggtcaacttaactagcattgagctcttctctaagtgatgagactatgcaactatatatcatgaatcaaacattaaacaccctaatctagcctaacgatcacctatgaatgagactactcaattattatgacaattaaaatacaaaatgtaagaaaactaaagattatcaataaattctaaaacaattgaataaatgttagtgatgttagcccaaaagagtttagatctaagaggctactgaaagtaagagcaagacggctactttaggtaatgttttgagtgaactttgctttgtattatttcacttaatctttaggttacaacatggttcccttttatagctaaacaatgctagggtttcaatgattgtaaactgacagctgtctctgtcttatcaagcttcggaggtcaccaaacaaccaaatctgttctttgtgttgattggatccgtacagacgctcctcttctctgtcttcactctgatttgttttcttgcacaggtggtggtcttgtctgttgagaagaggaagaacacttgttgggcttcgttgttgtgttggttgtgttgtcattgggcctgtttggtgagtggcccaataaccattttcctttgttaagctgagcgacgtcgttttctttctttgactctttagctgaacttgagctctgcttcgatctcatttcagatcttggagctgttgatggcggagcagtggagctcttgctaatagctactacaactaaccataagtgaaaactatatatgaaaagcttaggattttagttcttatatgatagtatttatatgaaaatataagtgtatccggatcgaccgattcagattgggcaaacccttaaaggagaagtagataaatgattgatcgtctggtcgattaccattataaatctcatgaaatacgtatgtctttcctctttttcgttgaaggactaacttttttcaagagagatttacccgttcgattgctactggtcttagtttcttcttactcgaactcgttattctcttcttggttctttgcttgttcccatctatagagtgtgtgcttcagatagtttcatagacctattaaaagataatatatatttgcaatgcatatgctctaggatcttaaattcaaatcaaaactaaaaatacaaaaaaagaaaagaaaaaacaaaaaaaagaagacataaacctagttgtttaaaccactaaaatacaaacgcataaacttactacacatgaaaatgaaacgactacatacgactgactactttgcatatatatatttgtgaattactcttcactttttctctatatataataacaacttgaagacaaagacaaaataataaaataaccttatctcttctctatatattagttcttgagatctctccaacaactctactttgtctttactcaagtatttcactaagaaagatagaatcacaaaaaggaaagagaaaatg

SEQ ID NO: 31894 - DNA, 3003 bp, Unknown; identical to SEQ ID NO: 17557
  misc_feature (1)..( 3003): 2750-1469P.txt file - cDNA_ID_3046955; gDNA_ID_1621174; Annot_ID_174089

SEQ ID NO: 31895 - DNA, 3000 bp, Unknown; identical to SEQ ID NO: 7923
  misc_feature (1)..( 3000): 2750-1469P.txt file - cDNA_ID_3046969; gDNA_ID_1621174; Annot_ID_174076

SEQ ID NO: 31896 - DNA, 3003 bp, Unknown; identical to SEQ ID NO: 17383
  misc_feature (1)..( 3003): 2750-1469P.txt file - cDNA_ID_3047013; gDNA_ID_1621175; Annot_ID_174131

SEQ ID NO: 31897 - DNA, 3000 bp, Unknown; identical to SEQ ID NO: 7947
  misc_feature (1)..( 3000): 2750-1469P.txt file - cDNA_ID_3047017; gDNA_ID_1621175; Annot_ID_174122

SEQ ID NO: 31898 - DNA, 3000 bp, Unknown; identical to SEQ ID NO: 7948
  misc_feature (1)..( 3000): 2750-1469P.txt file - cDNA_ID_3047025; gDNA_ID_1621175; Annot_ID_174120

SEQ ID NO: 31899 - DNA, 3003 bp, Unknown
  misc_feature (1)..( 3003): 2750-1469P.txt file - cDNA_ID_3047032; gDNA_ID_1621176; Annot_ID_57343
tgttttgtagtttgagcctttttgtctatgttaatttctctgtaattcgtccatggaagttgaaaacttaggttctgatgtttatggttagatttagttctgaatctctgaagttgatgcataataatgtattttgaagtactttgaaatgaattgtgagaagactctcttcccttgatctggctattgactcttctttaagttgtttcatcttttgttagaaattgttaacatgagcattaagtttagaatgattgtaattataagtttgtgtttatttttatgtgtagaggtacgcggattaagacccgcaaaaggaatattgctgctcctctcgaccctgctgctttttctgatgcactagttcagatttatctggataatgctggtgatctggtactttttttttcgtgttttaagtatttatttatctgtttttatttgcttgtaaaatgtcgtgcaccttaacttatgactttgtttttgttttgtcttaggaacttgttgccagaagtttagagtcatctgatcttaatttctcaagatacggtgatattttctttgaggtaaattctccatatatcaatactgtctcagctatcttctattgcctgtgtattttttgttttcttgtagcaaggggctttttgttttgcttgtctttccgagatttaataattgatggatctcttttattatataaggttgttttcattggaggacgtactcaaactggttcagtgaaatctgatgaaggggaacgccacccttactctataatcgactgtgaaccaaagcgtgaagctattttaccatcagttgtatacatacagaaaattttgcggaggaaagccttccttattaagaaccttgagaatgttacacggagattcttacagtcactggagctttttgaggagaatgagaggaagaagcttgcaatattcacagcacttgcattttcacagaagctctcaggattacctgcagagactgtcttccagccattgcttaaggatactcttgttgccaaagggatagttctcaattttgtaacagacttcttcaatgaatatttggttgagaacagtcttgatgacttgatttctattctgaggcgtggcaagatggatgacaaactcttggagttcctgccacccacaaagcggactacagaaagttttgccgagcatttcacgtgagttttaatttcttgaagtttgctgcattcaatagtataatgttggttctttttttacttgttgtagtttccttgctcttctgtttacctgcgtttctctaaattttagtcgcttaatactgatatgattgccatttctcattgataagattaaattagtgaaaatgcttctatataggttaacttttgtcactagtttgttgtgttcaacaattctcagttacttctgattctgtattcgattatcacttgtcttttatctctgctttcttattgtatatgtaaaattgatatatctgctatacttttccttctgattttaagtaaggcaggattgacagctctggtagagtacaatgaaaggaaaatatttgaggtgaagctgaaggaaatcaaagcggtccttacgagccaagtgacagaggaaataaacgtagatgaagtgactgaaatggtgaagcaacaggtgaaagatgcaaagctgccagagactgaggttgtgcatgtgatctgggatgggataatgaatgctgttcaatggtctgggaaaaaccagcagcagaattcgaatgctgtattacgccaagtgagttgattttctattttattttgaagcaagattatgttgttttgttcaaagctaagctaagctagccgctgttttgtggtaggtgaaaacatgggcaccccttctgaacacgctgtgtagcaccgggaacatggagatggaactgatgtataaagtacagatgcaatgctatgaggatgcaaagctgatgaaagtgtttcctgaggtagtgagatctctgtatgaactggatgtgcttgcggaagacaccattctgcactggtatcgcaaagggaccaaccctaagggcaggtactattttcgagtttttcacaaaaacaaggttaataatagtattctcttagtaacatatatgtaataatggtttgtgttggttttgcattgcaggcaaacgtttgtgaagggattggaaccgtttgtgaattggctcgaagaggccgaagaagaggagtgagtgagacgctctgcttcttgttttctctttttactctcttctaataaaagaaagacaatattttacttctcttaacgcaaaattcagatgctctacattgttggtgacttggtgtgatctcttttttgaatgaataagtacttctttagttgattatttgttggttttggttaacctctttgtgaggtaatacaggaatgtcatcttgaaaaatactaaccaaaaaataaaaaatagagaatataaaaccttatccaaaagtagggagattgtgttatttaaaagggaaccacagaaaaaaataggcgaggaaagaccattaagccgttggccacacaatcagatatcataatggaaatacactccgatgactacttcttccttcctcctccctgcttctcctccctcagccgcctttctccggcggcgcttcttccgccactcctggctttcctctaagatccaccaccgtcttccccaaggtacattactactcttctctatttcacctgtcaccacttctctgatctttggattattctggaatcttcgttttatgtgatcttgttacaaaaagtttccattacgattccatgttttaacccttaagttcaaaattgtggtacaattctatctcataggtgttttgagttgaatgataccttctgattttctggagccctattgattgtatatctcccactctactcttatcttactatgcaactatcctgtctttctttacttgcttcagttatg

SEQ ID NO: 31900 - DNA, 789 bp, Unknown; identical to SEQ ID NO: 7961
  misc_feature (1)..( 789): 2750-1469P.txt file - cDNA_ID_3047042; gDNA_ID_1621176; Annot_ID_174174

SEQ ID NO: 31901 - DNA, 3003 bp, Unknown
  misc_feature (1)..( 3003): 2750-1469P.txt file - cDNA_ID_3047046; gDNA_ID_1621176; Annot_ID_174173
gtttcgtctccgatttaatctttctacgtcttggtttatgaggtaagcttgtttcacaatctttcgttaggatttctgatgatgacgaatctaccaattttgtttctcgtggaaatttgattcagatctcatctcttccttcgattttgcattcttctgaatttgtttataatccttatagctattcattgttcttaattgaattagatttgtctcgaatctatgaattacggttgaaacgagacttgtttcgactgctagggtttcgtatgtatattcaggatgatttcgttatcactgctaatctgttttattgctcttttttcttgcagctcaaaggagaagcccactctcgggtatgtgaattttaaagcttttcgacatttatttgttttgtagtttgagcctttttgtctatgttaatttctctgtaattcgtccatggaagttgaaaacttaggttctgatgtttatggttagatttagttctgaatctctgaagttgatgcataataatgtattttgaagtactttgaaatgaattgtgagaagactctcttcccttgatctggctattgactcttctttaagttgtttcatcttttgttagaaattgttaacatgagcattaagtttagaatgattgtaattataagtttgtgtttatttttatgtgtagaggtacgcggattaagacccgcaaaaggaatattgctgctcctctcgaccctgctgctttttctgatgcactagttcagatttatctggataatgctggtgatctggtactttttttttcgtgttttaagtatttatttatctgtttttatttgcttgtaaaatgtcgtgcaccttaacttatgactttgtttttgttttgtcttaggaacttgttgccagaagtttagagtcatctgatcttaatttctcaagatacggtgatattttctttgaggtaaattctccatatatcaatactgtctcagctatcttctattgcctgtgtattttttgttttcttgtagcaaggggctttttgttttgcttgtctttccgagatttaataattgatggatctcttttattatataaggttgttttcattggaggacgtactcaaactggttcagtgaaatctgatgaaggggaacgccacccttactctataatcgactgtgaaccaaagcgtgaagctattttaccatcagttgtatacatacagaaaattttgcggaggaaagccttccttattaagaaccttgagaatgttacacggagattcttacagtcactggagctttttgaggagaatgagaggaagaagcttgcaatattcacagcacttgcattttcacagaagctctcaggattacctgcagagactgtcttccagccattgcttaaggatactcttgttgccaaagggatagttctcaattttgtaacagacttcttcaatgaatatttggttgagaacagtcttgatgacttgatttctattctgaggcgtggcaagatggatgacaaactcttggagttcctgccacccacaaagcggactacagaaagttttgccgagcatttcacgtgagttttaatttcttgaagtttgctgcattcaatagtataatgttggttctttttttacttgttgtagtttccttgctcttctgtttacctgcgtttctctaaattttagtcgcttaatactgatatgattgccatttctcattgataagattaaattagtgaaaatgcttctatataggttaacttttgtcactagtttgttgtgttcaacaattctcagttacttctgattctgtattcgattatcacttgtcttttatctctgctttcttattgtatatgtaaaattgatatatctgctatacttttccttctgattttaagtaaggcaggattgacagctctggtagagtacaatgaaaggaaaatatttgaggtgaagctgaaggaaatcaaagcggtccttacgagccaagtgacagaggaaataaacgtagatgaagtgactgaaatggtgaagcaacaggtgaaagatgcaaagctgccagagactgaggttgtgcatgtgatctgggatgggataatgaatgctgttcaatggtctgggaaaaaccagcagcagaattcgaatgctgtattacgccaagtgagttgattttctattttattttgaagcaagattatgttgttttgttcaaagctaagctaagctagccgctgttttgtggtaggtgaaaacatgggcaccccttctgaacacgctgtgtagcaccgggaacatggagatggaactgatgtataaagtacagatgcaatgctatgaggatgcaaagctgatgaaagtgtttcctgaggtagtgagatctctgtatgaactggatgtgcttgcggaagacaccattctgcactggtatcgcaaagggaccaaccctaagggcaggtactattttcgagtttttcacaaaaacaaggttaataatagtattctcttagtaacatatatgtaataatggtttgtgttggttttgcattgcaggcaaacgtttgtgaagggattggaaccgtttgtgaattggctcgaagaggccgaagaagaggagtgagtgagacgctctgcttcttgttttctctttttactctcttctaataaaagaaagacaatattttacttctcttaacgcaaaattcagatgctctacattgttggtgacttggtgtgatctcttttttgaatgaataagtacttctttagttgattatttgttggttttggttaacctctttgtgaggtaatacaggaatgtcatcttgaaaaatactaaccaaaaaataaaaaatagagaatataaaaccttatccaaaagtagggagattgtgttatttaaaagggaaccacagaaaaaaataggcgaggaaagaccattaagccgttggccacacaatcagatatcataatggaaatacactccgatg

SEQ ID NO: 31902 - DNA, 3003 bp, Unknown
  misc_feature (1)..( 3003): 2750-1469P.txt file - cDNA_ID_3047050; gDNA_ID_1621176; Annot_ID_174172
cttttcatcagcagctaaaggccagtctttggaccatccattctcatatgcaaactctttcacatcttccaatcgattcttaatcagttcaatggcagctgctgcatccactggttcccaacctccaatggatatcttacgagaccagactttacttatcctttgaggcatatgctttgtctcattaggtataaactttgcacaatgttcttgatcaagatgattcttacactcttcagcgctagtgaacttgttcgaacaagaccgacacatccagaatctccatttcccctcttcccttgcaaaagtgagaacttgctccaacgcatctcgtccttcactaccatataacccctcaacataactcgtaagttccgcagtgcttactttcataaagttccgtttgatctcaacattcaaaccagcccaatacaacatcaatcctttaatgaaatcaggctcactcttccttgtatccacatcttctttttgttcacagttttttacaacaagtcgtgtcttggattcagcaattctcgactctgcaatcttgatcacagacaccattgctttctgttctttcttggtgaattctggatcctgcacattcactgaaagatgatacaaagtttcttttgctttgcgcacagatttcttgtaatacaccactgactgaatctgttgtgccaaagtgaagagtgaaatagccgccatcgatgacaaagcaggagctatggaaacgcattgtacagaacccaacaagtaagcaactttcacatcagtgttctctgtttttttcgctagctccttaaagatttgaccttgtagtgcattaacacacaccctgtcgttcccttggacgaaacgcaaatcttcaattatctccaacgccttgatgtaatctttcgcaaagtaggaatcgtaggcacgtttgaagagattttcgctgttagcatcttctagagtaggacgctccatgttggggaagagagtagaagctagtaacgcttctcagtgatctgatctttgcgttttcttggtatcgagagaggttttgttcgtgacgggagaaaacagaggagaagcgggaaaaaatcaacgagtaaggtattgaagaagatgtcacgtacgagccacgtgacagggtctttgtggaattgtgtcgaacacctgtgggcatcctccgtgtggagtaaatgacatagctttctcgatttaattggaccttcccagagtaaatttgggagtgtagaaaaatagaaaagcattcaaatttgggtgtgtagtgacttataagtggaattgtgttcatgtttgggatcaaattggtcatcccaataggctttggttttgaaagagcaacagaaggtgaaagcttcaaaggtatgtcaaaagaaaagattattggaacggtattgtgggtcgggttcggttaaaatccgatcgggtacggttgctttaagtagagaagtttaagagctaagaaggtaaaactaaaatattggttaggtttcggtttggatctcatcgggttcggatcaatctgggtataaaaattcaaaactgctaaatacttttaaaaatcaggtatcctttaaattcaggtatactcgaattcccgtaatttactcaaacactcaaaaaatttatgcaaatagtcgaaaattcatcaaaatacccaaaacttttacccaaatatccgaattttatctgaataaccggaattttgtctaaatatccaaaaacaaattataagtatctttgattaatatattgttaaaatttcatttgtgatgtcgatgtttaattaaatttattcggttaactataaaatagttaaattaaaatatgtaactccaaaactaccaagctttcatcaaaaaagattatttgccatgatacttgatgaaaaattcagaaaaaatcaatccaaaatagttacataacgcaccaaaaatcaaaactaagggtccattagatgttagattcacatattcaaaagaagtagtcataaaatagtaataaaatcgatattgttgtaggctctgtcttgtcgtttcaagatcgttgctctgttttcaatattattgctctgtttttcttgttttgtttttgagatatatggagataaactggatagcaagaaatataatgcatatcaagtattgtgaatcgtcaacgtcctttaatgaagtaaagtctgcccgaaaaatattcgcagtgtgtagatttaagggtaaagaaactttatcccagttgtgatagacttgtaaagagtttttcccttactaacttttcacataactccattgtattcagttggttaattaatttgaatttttcggaaaagaaatcgttattttgttatagtaaaattatttttgacaaaaatcaaactgaatctaaatcgaataccaaattgatccaatacaaaaatcaaattaaaccaaaaccaaattataaaagaaaattatcaacaaaaaaaatatcgttttagtttttataatactactgataaagcaaagaccaaaaaaaaataaaaaaaaaataaaaatacatcaaatttccatcttttaagtatatcaatatttgtttaaatatgttatccattcgcaagctagtttccaatagtttatttttatttttggtcggtctttcacctatggaaccaaatgaacaatggtctgcacatccaatagcctctctacgctcgcagtcttcaagttcatcaatagtgaagtaaaaacaccactgctagaatagataggaaaatctttttgaaattttatgaccttgttgctgcgatgaaaactggaatccttgttttttctttttgccaaggatccaaaatgttgggctcgttactaattgtaagacctaattatcatgttaatgatatataccctttcgcaacaacttggtcggtctttcatggcatatttcaatattatcttagacaacaattaaaatagaaaaacaattatcagacaaattaaatgaatg

SEQ ID NO: 31903 - DNA, 3000 bp, Unknown; identical to SEQ ID NO: 7958
  misc_feature (1)..( 3000): 2750-1469P.txt file - cDNA_ID_3047054; gDNA_ID_1621176; Annot_ID_174171

SEQ ID NO: 31904 - DNA, 3000 bp, Unknown
  misc_feature (1)..( 3000): 2750-1469P.txt file - cDNA_ID_3047062; gDNA_ID_1621176; Annot_ID_174169
ttagaaatagatgagaagccgtggaaaagaagaatgaagatagcagaagatatcgccactgctttagcttaccttcacactgccttccctaggcccctcgtatatatgattttgtctcatcggaatatcttattggatgaagatggtgtcgcgaagctgactgatttctctcactgcgtctcaatcccagaaggagaaacatttgtccgggttgaggcagaagatggattctatagttactttgctgataattacgttaacagtgttgtagtctcagagaaaacagatgtctttgcctttggaatctttatgggtctaacgcttctattaggatacaaaagctatttcgagcattatcgaggagaagaaaaagaaagtgaagaagaagaccctgaagatactgatgaattagattattttaacaagaaaagacatgctcgatattggctgtcaaaattaaagaaagaccgaccaatggaagagattgcagatcgaaagatgataaaaaatatgggtcaaatcttagaacaagagctctttcaaatgaaagctttccggatgctctcactgagatgcatgggtcctagtgaagaagttccaacgatggtggaggtggccaaagaactaaagaagatccaaaaatctcttaataaagattcttatcgaggagaagaagaagaagaagaaagtgaagatgaatttaacgactcttcttctctttcttcaggtcaaacccaattcgactctgcccaagacatttcttccacagtggtcctctcaaaccaaacttaaacacaaaggcattgctaccaagtattgcctgccaggtatttcgtgaaatgtttcaatgggttatgttgagctggtttcgttttttcaggaaaaatcgaacaatgtgctgaaaataagttgaattcatgttcgtattaaaacattatcaagtttcatttttgttgttgtatttataaatagtgctacgttacttttgattcattatattgtcccttaagagtttgtgtatgtgtgtttgggttttgatcgatccgtctgtttttgttaatgtaataattttatcaagagatgttatgatatatgtgaatcttgtattgatgattgtctactcgtgtattataagggaaagtctcccaagtcaataacaattctaaagtttacattgtgagttgggaaacatggttcattgacgtaagtttgcaatttccagcaactacatctgactatcaatattgaactgtcaactccactactgttgggtttcttatatatggatacacaatagtttaaacatacttatataaatcatatctaaccaagtctcgagcttccagaagtttctaggtgacgcacaacacctcaacaagattagttccataacatgcaatttaaactttacgaaagttaaaaattctccgatccaaaacccatattttgcgaaatattactaaggcaaaaaaaaaaaaaatcatcagaatgtccaaaataaagaatgatgttcataaaacacatcaagctcaaatcatgactagcgcttagagggagacctccaactaaagttaaacattgttcacgagcatgaattcaattgttgaaaacctcctcaaattttcaatcccatgcatgagttagttagtatctaattatatatagaatattcattcacttttttttccctatcaatcagaatctatcgcctaattaaaaaaataaaaaattaaacgcatttaattataaaatcaaaccctaatcacttttttataaaatctaaaaaatcatttaaaatcattttacagttattgtaaaatctaaagatttgggttactctagtaaacattttccatgagatgttaaatgagttattcttgcaaagagtagagtgcagtctgagtaattttcacaatatttatatgtaatgttgttgacttgaagaaataaagttttgagtttatttttgtcctatatcatttggttctaaatgttattgggattgttaatgttttgcgaaagatgttagcttttttctttcgtatttttcttgttaactcatgtgtttaaacatggaataaaacaacataacataagacatcaaaacttcgaaaacaaaccttttttcttaagtaataaggttaaaataacctcatacacttgagaataagattgcaatggacattcgatatggctgtaacaacgattaaggaagtgccaagaattattgttttacatttgacgaaataactttttcagtcttcacacatatattataactactgttcatccgttgcataatttggagattgttatcctaatatttaaagtttcttttttattgattcatataagtatcaagtattcatgtatccttgtcctctctactttcaatggtcatgggatccatgtaacttgcattattgtgcactgagagattttctaagatgacccaacgttcattattttatgaaagggtaacatgatttagttatgagggtaggttttagtaatatctgtctttattttaacaaattataaatcatcttgtatttagaaagctattaagaaaaaacttgtttgcatcgattgtgtttttattgatttatcgatttatcgtgttagatataaataatgttgagtaggtagcagttatctgtcagatttaatatttactattgttttgttgcaataatgtaacaactatttattgacccattaaaactctactattaaatagaaagtcttttgcaatgtaaatcgtgcttcgttgatgttggcacgttatcaaaatcaaatgatgaatagtttagtgattaccatgtcagatctaaactttcttttactaatataataaaaaaacatataattaaccattaaatgagtactaaataaaataactagtattgtttttttcacttatctccgtcacatgagctaagagaaatcagagaccaaaagttcaacgagaaattctcactagatctcttagtaaccatg

SEQ ID NO: 31905 - DNA, 3003 bp, Unknown
  misc_feature (1)..( 3003): 2750-1469P.txt file - cDNA_ID_3047084; gDNA_ID_2926130; Annot_ID_196856
tcacattgaattcctgtaagaacaaaagacagtttagagactattattacaggttttatactaaatactttaaaaacgattgtaaatcatgtttaacacttttaaaagcttttaaaatcccttataaatcattcaatgtcacttacttatgctttaaaaacgattgtaaaccatgcagacacttttaaaatcccttgtaaatcattctatgacacttacttatgctttaaaaacaattgtaaatcatgtttaacccttctaaaagcttttaaaatcccttgtaaatcattctattcaacttacttatgcttaaaaaacgattgtaaatcatgtttaaccccttagaaaaggttttaaaatcccttgtaaatcattctattcaacttacttatgcttaaaaaacgattgtaaatcatgtttaacccttagaaaagattttaaaatcccttgtaaattattctatcccacttacttatgttttaaaatcgattgtaaaccatgcaaacacttctaaaatcccttgtaaatcgttttaagacacttacttatgcttttaaaatcccatgtaaacgtgtttaacacttctttaagcttttaaaatcccttgtaaattattctatgttagttacttatgcctaaaaacggttgtaaaccatgcataccctttttaaaatcccttgtaaatcattatctgccactaacttatgcttcttaaataattgttaatgaagtaaaccccttttaaaagcttttaaaatcccttgtaaattatctataacacttacttatgttttaaaaatgattgtaaactacgcaaacagttatgcaaatgccttgtaaatcattctacgacagttaattaagctttaaaaacgattgtaaaactttattacctgttgtgagatagaactctctcaaggagaaacagataggttgagaatcaactctaaaccaaagagttgatccttttgttttcactctctgctgcatgagatagtgaaagattttcccagaaaatctgattcccttcttagccttcatttttggtcccaattcaactagaagaccaagaaacgaacttctaatcttctgaaataaacactcgcctaaagcttcctctactttactaactaaattccaatccaagtattgttgaacggttcccagtgcaatagattcctcaccttctctgtagatctgttcaggcaatgtaaggatttcactctctgaatccatctgcaaaacatgttatgaaacatcgtcagatctactataaaatcgactataaaatcgattataaaaacggttaccgtcggatctatcgatatctctggggattgtttgcgtcgtagagaaatgatctgaatccgtcagcgaagaacagatttatcggagaggaaattcgtcagcgattttggggtttctcggagagaaaatttgtcggcgattttgagtgaaatcggagaggaaattcgttggcgattttgagtgaaatcggagaggaaattcgtcggcaattttgagtgaaatcggagaggaaattcgccggcgattttgagtgaaatcggataggaaaattcgttggccaaaacgaagaagtttgtgccaaaacgaattgtattgtgaaacgaatgtgaaacctaatcattcagtaagggtaagacagtcatttgccatattagaaagggtagttttaaaaatggccttcaggaaaggacatttttacaaaaggttattagaataagggcagttttgcaaatctcccaattaaatattaaagtattttgaatcaatggcatttttgtaattaatctaaaccggaaggatattttttggtttatattttatttctctttcctatttacgtaaataacatatttttatgtataaattcttaatattctgtttatccatgtatatatttttaactcaccctatagttttctaagtaatttaagtattttggttacatttggttatattttggtaaaatataactaatatatttttggataaactaatcaggcatctcggttagatttaggtatagatgagtaaaaaactcgaactcgacctgaacccaaaaatattttgagtatttttgattatttttcaattcttactaaaataactaaatcgatccaaactcaaaccaaaaccgaaccaaaattttagaatacatgaatggtttttaacttcatacctaaatagatccgatactcaaaaaaaaaaagaaccgaacagatatgagtacccgaatatctacacctgcccagtattattattattattttttttgaacaaacaccggtactattattttaccagctaatttttctccctttaagaacgttttggacctattggtctattggatacaaaactattgtattcattttaaatttttaatgggtcttctttgttaataaaggcccattaaatatactatccaggcccatttagtccaactacttattacactgttgattaatcgccgtttagatattttgcattggagagaatcttcaccgttcagaaaactgaagatcgaagatcaccaaaaccggccaaaaagtatagtacacgtccgaagattctagatccatcatgccatttgcattgcatggcctaactctcgtagaaaacccaaacaaattctcccccacacaaataatgggacaaaaaccaaattaaaccaaattgtttccctattgaagaaaataaaatcttccacaaattttatgaatttttcataaagtcggcaacttcacacgagtccaggtcgattcttaaaacaatgatctttaaccatccacgtgtcaaaatcccaccttagcttacctcatttgttctattccaaatacctattctatcccttggatcttgacttatatgttcataagaaagtgtaccagataagggtatatacgtcatttacagtccagctcaacggttataaaatcctaattcgtgaggtttctctgaagaacaaacacaaaaatg

SEQ ID NO: 31906 - DNA, 3003 bp, Unknown; identical to SEQ ID NO: 31905
  misc_feature (1)..( 3003): 2750-1469P.txt file - cDNA_ID_3047084; gDNA_ID_2926130; Annot_ID_138716

SEQ ID NO: 31907 - DNA, 3000 bp, Unknown
  misc_feature (1)..( 3000): 2750-1469P.txt file - cDNA_ID_3047084; gDNA_ID_1621177; Annot_ID_57358
cattgaattcctgtaagaacaaaagacagtttagagactattattacaggttttatactaaatactttaaaaacgattgtaaatcatgtttaacacttttaaaagcttttaaaatcccttataaatcattcaatgtcacttacttatgctttaaaaacgattgtaaaccatgcagacacttttaaaatcccttgtaaatcattctatgacacttacttatgctttaaaaacaattgtaaatcatgtttaacccttctaaaagcttttaaaatcccttgtaaatcattctattcaacttacttatgcttaaaaaacgattgtaaatcatgtttaaccccttagaaaaggttttaaaatcccttgtaaatcattctattcaacttacttatgcttaaaaaacgattgtaaatcatgtttaacccttagaaaagattttaaaatcccttgtaaattattctatcccacttacttatgttttaaaatcgattgtaaaccatgcaaacacttctaaaatcccttgtaaatcgttttaagacacttacttatgcttttaaaatcccatgtaaacgtgtttaacacttctttaagcttttaaaatcccttgtaaattattctatgttagttacttatgcctaaaaacggttgtaaaccatgcataccctttttaaaatcccttgtaaatcattatctgccactaacttatgcttcttaaataattgttaatgaagtaaaccccttttaaaagcttttaaaatcccttgtaaattatctataacacttacttatgttttaaaaatgattgtaaactacgcaaacagttatgcaaatgccttgtaaatcattctacgacagttaattaagctttaaaaacgattgtaaaactttattacctgttgtgagatagaactctctcaaggagaaacagataggttgagaatcaactctaaaccaaagagttgatccttttgttttcactctctgctgcatgagatagtgaaagattttcccagaaaatctgattcccttcttagccttcatttttggtcccaattcaactagaagaccaagaaacgaacttctaatcttctgaaataaacactcgcctaaagcttcctctactttactaactaaattccaatccaagtattgttgaacggttcccagtgcaatagattcctcaccttctctgtagatctgttcaggcaatgtaaggatttcactctctgaatccatctgcaaaacatgttatgaaacatcgtcagatctactataaaatcgactataaaatcgattataaaaacggttaccgtcggatctatcgatatctctggggattgtttgcgtcgtagagaaatgatctgaatccgtcagcgaagaacagatttatcggagaggaaattcgtcagcgattttggggtttctcggagagaaaatttgtcggcgattttgagtgaaatcggagaggaaattcgttggcgattttgagtgaaatcggagaggaaattcgtcggcaattttgagtgaaatcggagaggaaattcgccggcgattttgagtgaaatcggataggaaaattcgttggccaaaacgaagaagtttgtgccaaaacgaattgtattgtgaaacgaatgtgaaacctaatcattcagtaagggtaagacagtcatttgccatattagaaagggtagttttaaaaatggccttcaggaaaggacatttttacaaaaggttattagaataagggcagttttgcaaatctcccaattaaatattaaagtattttgaatcaatggcatttttgtaattaatctaaaccggaaggatattttttggtttatattttatttctctttcctatttacgtaaataacatatttttatgtataaattcttaatattctgtttatccatgtatatatttttaactcaccctatagttttctaagtaatttaagtattttggttacatttggttatattttggtaaaatataactaatatatttttggataaactaatcaggcatctcggttagatttaggtatagatgagtaaaaaactcgaactcgacctgaacccaaaaatattttgagtatttttgattatttttcaattcttactaaaataactaaatcgatccaaactcaaaccaaaaccgaaccaaaattttagaatacatgaatggtttttaacttcatacctaaatagatccgatactcaaaaaaaaaaagaaccgaacagatatgagtacccgaatatctacacctgcccagtattattattattattttttttgaacaaacaccggtactattattttaccagctaatttttctccctttaagaacgttttggacctattggtctattggatacaaaactattgtattcattttaaatttttaatgggtcttctttgttaataaaggcccattaaatatactatccaggcccatttagtccaactacttattacactgttgattaatcgccgtttagatattttgcattggagagaatcttcaccgttcagaaaactgaagatcgaagatcaccaaaaccggccaaaaagtatagtacacgtccgaagattctagatccatcatgccatttgcattgcatggcctaactctcgtagaaaacccaaacaaattctcccccacacaaataatgggacaaaaaccaaattaaaccaaattgtttccctattgaagaaaataaaatcttccacaaattttatgaatttttcataaagtcggcaacttcacacgagtccaggtcgattcttaaaacaatgatctttaaccatccacgtgtcaaaatcccaccttagcttacctcatttgttctattccaaatacctattctatcccttggatcttgacttatatgttcataagaaagtgtaccagataagggtatatacgtcatttacagtccagctcaacggttataaaatcctaattcgtgaggtttctctgaagaacaaacacaaaaatg

SEQ ID NO: 31908 - DNA, 3000 bp, Unknown; identical to SEQ ID NO: 31907
  misc_feature (1)..( 3000): 2750-1469P.txt file - cDNA_ID_3047084; gDNA_ID_1621177; Annot_ID_174197

SEQ ID NO: 31909 - DNA, 3000 bp, Unknown; identical to SEQ ID NO: 7966
  misc_feature (1)..( 3000): 2750-1469P.txt file - cDNA_ID_3047087; gDNA_ID_1621177; Annot_ID_174194

SEQ ID NO: 31910 - DNA, 3000 bp, Unknown; identical to SEQ ID NO: 7972
  misc_feature (1)..( 3000): 2750-1469P.txt file - cDNA_ID_3047132; gDNA_ID_1621178; Annot_ID_174217

SEQ ID NO: 31911 - DNA, 3000 bp, Unknown; identical to SEQ ID NO: 7986
  misc_feature (1)..( 3000): 2750-1469P.txt file - cDNA_ID_3047150; gDNA_ID_1621179; Annot_ID_174256

SEQ ID NO: 31912 - DNA, 3000 bp, Unknown; identical to SEQ ID NO: 7985
  misc_feature (1)..( 3000): 2750-1469P.txt file - cDNA_ID_3047158; gDNA_ID_1621179; Annot_ID_174252

SEQ ID NO: 31913 - DNA, 3003 bp, Unknown
  misc_feature (1)..( 3003): 2750-1469P.txt file - cDNA_ID_3047215; gDNA_ID_1621182; Annot_ID_174319
ccagagctccgggaatatctgtatcaatacgtatttcacaaatcgatgttatgggagaatcaagatcaaaagtatgcagaaaatcataagcgtttgaatcacacctcagaacttgttcaggggctttgtctacgcgttgctggaaattaacccaattctttttatcagcatctccctgtacaagcatggaaaatgagaatcatttgaggccttttgaagtttgcaaaaatggccatgacaagtgaactgtttacctcaaaatcgttcattagcgatttcatttggtcgtcaacttctctctttgagaccaaaggtttagctacttcatcatctcctgacatctcagtatcatactcactttcatcctcattgatcaatacaaattctttccataaactcttactcgcaactgcacaaaccgaaaaattcatatcactagttatacaaagtttcagggctaggaaaagtttgtgaattcagctaacctttctgcttttcagttggagcaaccccattattgacagggcctgagtcagatgtttcgctaaccgttcgaagctgttggcattcggttttatgacccaagcgccaatgcagggcctggaaattagaaacaacacagattgttcaaatttgctcaaaagagcagaatctagcggaacaaaagaaactacgatgcacatatgcacacacctggtgtttcggtgaacagtatcgagcatttttgcagccgctacatagtttatctcctttccatgttccacaccaagtgcaaagcggagctaaagtgaaacaaacaatatcaagaattgacaattaaaagagaattctcggcattcagtcaaacccatcaatcagttcataatacctccatgacccaatggcttgtctgttccatcgtgctttggagcctcactcgagtaaaaaggattagctcgaggcaattggcaacggaaaaccttcgtacttcaggaacaaaaaaaacagtactttagtgtaacaacccacttggagaggagacaaacaatacaaagatgcaatatatagtaagaggtttctttctacctccgcatagccttctctggggcacgtttccattgttcatgttgatcacgaaggagacaagacatagatggacacatgaagagaaacaatgtccgatgaaaagctgattccttgtctgttaaaggagcataaagctgccaaatttccacaacaaatttcataaataaaccgacaaaaaacatgcaagaaacaacaaaatagtttgtatgaaacttacttgaagtacaaattgcataggttcttcacatagatcacatagaattgacttccctgatggtaaattaactggatccaaccatgcctatattgacaaatatcaacccaaagaatcaatacctaagaacataaagaagaaacagtttttgattgcacaaattgaaagatgttttaacttagtaccggaacaccaccagctaaattagggaacagttgacgaagatttgaccatgcgaatttaggactctcaacgaaacctaacatcacaggttcataatcttcatcatcttcctcatcatcatcatcaaattcatccatatttataggttccaccgcagtttcatcatcgtcatcatcatcaagctgagttattcggaggcctttgaaatcatccatggagtctccgttgaagctactcatcgaatcttctgtgttgaatttgatgaaatgaagactgcataacagagcaaaggaattgaattctagggttttactctgtttcataaacctctcaaaagtatttggcaagaaacaacgcacaaatcataatctgttaatgggtctttcgcaaaatactaaactcactaatttttcaagatttagagctcaatactcagctaattacaaatcccagaattggtacgaacaaatgttaaaaatgagctcactagtcagtatcaacaagaatcaaaatccaaaagaaacttacaacaccaggcgatgatggagatgttcttcagatagcctttaaaggtcgaatcttcttctatcaatttaaacagcaaaattttgtaaacatctttcacgaagacgaagacgaagacgacgacgacgacgacgacgaaaggaaaacaaacgtcactctggcccaaaaacaaaccctagaatagacgatgtcgtttaacataggcctataatagactaagcccaataaagtaatataagcccataaaggtttctaaattggttacgaataaaagtataaccttatcccggacaaccttatccttaaaatctcaccggtactccaactcccgttcaccggagctctgactctctgtaagcgaagattctctgctctttagctaatttagtcgaatctctattatgggtctgatccagtttcttacgagaatctgatttctgattttataacttgatttctcgatttcaaatttgtgttcttgcaatcgatttttttgcaggtaaagaagaagggagaaatagataatgagcagtagaaacggcaatgagagattaagaacagtgtggacacctgaaatggatcagtatttcatcgagcttatggtggaacaagttagaaaaggcaacagatttgaagatcatttgtttagtaaacgagcttggaagttcatgtcttgttccttcactgccaagttcaagtttctttatggcaaagatgttttgaaaaacaggcataagacattgaggaacttgtttaaatctgtgaataatcttttgatagaagatggttttagttgggatgatactagacagatggttgttgctgataactgcgtttgggatgagtatcttaaggtgcgttttgcgttttgtttacttgtgattttgtgtcttcttctcagggattgatttgtttttgcttttgggttattgaagattcatcctgattcgagatcttttcggataaagtctataccttgttacaaagatctgtgcttggtttactcagatggaatg

SEQ ID NO: 31914 - DNA, 3000 bp, Unknown; identical to SEQ ID NO: 7998
  misc_feature (1)..( 3000): 2750-1469P.txt file - cDNA_ID_3047229; gDNA_ID_1621182; Annot_ID_174309

SEQ ID NO: 31915 - DNA, 3000 bp, Unknown
  misc_feature (1)..( 3000): 2750-1469P.txt file - cDNA_ID_3047250; gDNA_ID_1621183; Annot_ID_174341
taatataagacataaattgcttcagatgttgttgcagctgtataaataaactcaccagtggatcatgagtaatacctctcagcccccaagaaactttccagatcgggtcacgttgaggaaattttctaagtgaccgttcttgtttctcttcatcctccaaaacccaaaatcatttaccagagacgtcgtcagagcaaacccatgcaaattttccttcgtagttgaggaaaaatttgcaaagtaaattatcagccgctgattttcttattgtgttgaacttttcgtacctcacatcgaagctcataaggactttctcaacttcagaactatcatcgactccaaaaggtatactcgcttcataatacacttccccgttgatacatatactttgtattagtccctcggcggatagagggacatgtttaggggtattttgtgtcactctccatgattcttgaggtcccaaagtaaaaacaagaggatcttggtatctagagcatgagatgcacaagactttatacttaccctcgaccggatcatatcctaaagagctacattcaaatgcgacttttggtaaggtaacatgttgtctcatgattggattccaaactacaatatgccccaagaatctcccaaacatatcaagccatggaccgactgggaccattcgtgataatcaaatatgagagtgtctttcagataacgctccacatgtggataacatgatctgtccggattttcatgttggggcattgcgcagaaaatacgcttgtcacttgttttcacgcagaccaaaagacacaacctagttgaagactgactcgcgaacgacctgatgaaatctggatgagtggtgattgatgaccatagctaagagacccagtggaacctcgcagcagatttagcaggaagtctcaagagtatatcaggaattagatcaagaggaatcatctcgagaaacttacaaaaactctcatcttctttagattgtatacttacttccctatcttccgcctcttcctctactctatccattggcgtcgatccactagtttttttttttaaccctaatttttcaaccctaagtttttcaaaccattatagtagttgtcatctctggacaaaaggaacaagtcaatgcatcgatcaccgaaaaggaagcatcgtacaaagagaagaaaactgaagattaagaacatctctttctctttaacttgcatacatcatgttcaagaactacatcttagcaaatccaacgaccgaagacgaattgatcatggacactctagctagtgaccattgttttaaaaaccatactcaaaatgtattaaaaaaacaaataaaagaattttacatttggttgtatttgacaaaacatatcaacactttagattcttgcggtaagtcagaattcttaccagaagaatctaaaactttggttcactgattcatgagaactttgatccgaacaatatttacctagaaaactgatctcaccctcatcaatactgatcttgatgaaagtgaatcttacaaaaacaaaaaaataatgatagatttgcacttaattactgataagtagactaaaagaagaacgatgaaattatagcaaatcagcaacatgaccatcacggaactagttaatactaaaaagcatcaaagttggatttctaagtgatctaacaaacgcttttttaaagattaaattcgagatgaaaatatggatgaaaaagaattaaattgctaacataaattgaccaaaatcgtaagcattgatcatcacccatatcttcatctcaaatgaatccatataatcaacactctaacgtaaccagaaaacttgttatacttatttttgggtaaaagattataaaatttagatttccaagcaatctacgagcaaatttttaacggattaaatttgagatggccatatgggtaaccaatatataaattggtaacttaaattgaccaaaatcttaaatattagttacccaaacagccatctgaaatgaatccatgcatatgatcaactctctaatgtaacaagacaagtttatccactctaacgatagatagctccacaacgtcatcaacataattaacgaaagatagacgtcgatatctatctactgtgaaaccaaacatgagtattatgaatcaaaaagatccattaatgttaattcatactcatgtttgacttcacaacagagagatttcgacatctacctttatccatcggcgactcacttttgtttttctaaaccctaattttctgtctgggtctctctgtctttgacgtatttatagtacaaaaaaaattgttgcccaagaaaaaaaaaaaaaagaaaaacaaaccttctgaatccgacagaggctttaatctgttaccgttaaagtgttgtatgattccgttagaatctgcaactccgttaatattttttccgttttctttcagggaagagaaaaaaaaaacacagacctctcttttctctcttcatgttttcatcgatagtggaagagatcaagtgaaagaaaaacactcagatctggaaattcagcttcttagatctatgaattttcaaattcgttgatccatttttccgcttcaatcgtctccgatctgatttcatcagcttcgtaccgctccggtcatgaatccattctcttccggcacgcgtctcaggttaggaatcactttactccgatctccaactagtaatctgctttttctctattgcgactttgcgatacttccattttcgtgcgttttctagtgtctaaatccataatgtagcttgattcttctagtaatcggcaaattcaatcggaaattgacgattatcagaaaaatgttttggctgattgtgtgagattaggcatgttgtatgatagaatcctcttagcatttttgatgaagcttcgattctttataaattgagagtatgtaaatgtaaatgaattcatcattttaatgacaatttgtgttgcagcgacatg

SEQ ID NO: 31916 - DNA, 3000 bp, Unknown
  misc_feature (1)..( 3000): 2750-1469P.txt file - cDNA_ID_3047262; gDNA_ID_1621183; Annot_ID_57411
catgaagatatttccttaggatatccgaatttgcggttctatttataataggaattgattacgtcatgtgagtatttgcatattcttgattttacggaccaataactcgaaaatgggtccatagttactgtatatcgtttggtaataactgtgatcattaaaatcgtaatttgaataaaatgtgtatagtaacataaaatatcgcacgatggtctctgtatctcatgtattacattttaacatttacttagcgtggctgaaatttgggattgcagtgatggttgatttaccggttgttcgaaatgtaaaactaccatatgaatcttataagccactgcaatttacatgacgtatcacattcacatatattagagaaacttagattcactaggttaattagtgtttctaattacaaagtagaaaaaagtttgagatcatataacataaaatattgtagtcttttagtaaaagtggttgtaatacatgtgcgataagattgttttttaataaatccttaaatgagccctataattactactcatgttataacgagctaatagaacattacttgactattacttcactacttgtcgagttgaagctatatatttgcacctcttggttttgttgttggttttcatatttctttttgaattgttaaacctcgtatatggttttctgaaatctttatgtcccgtgtctttaaattttaaatctaaaatttactttaagaaaagtacaataacaaccctataaaaatttgagtcaattgagacggaagaactatgtactttatagatttctcagtattcttccactgataataatcagatatataatcattcctagaaatctcactttagttcgtcttataatcaaaccctaagtcctagcatatctcttccatacgtagtcatcattaaagtggtgtttttaagatatttttttccccctggaaaagataacgttagttttataagataaaagaagatgatgatgtaagaaaacaaatactttaggggaaagagagataaatgacaatcattgtgtggttgaacgtataatatagttactaaacaacaaataactaatgagctataggggtcgaagtttgacaacaacaacaacaaaaaaaagaagctataggggtcgaaaaaactttcttgcattgtggataatctctcaataccaaaagtagattttgctggtaacgaatatagtagtcacaattgtccatttcagatgggagtgaatttcccatatgggttctttcgtgaaggaatgggtacattatatttgctattcaagaacactaatgggacgacccattcttagccctgaaccaatctgcgacatgaaccggagttcaaaagaaccaaatcggtactaaccgaatgaatcatgcaaaagtaaataaaaacaaaaataaaatgtcaagagaaagcatttaagtccgtgaaagtgagaaaaaagagataagaagttgcagtgtcccttgtccacccaatccacaatttctgtttttatttatcttttttttttttgggctatttatctacctatacttttgtttatttctttgcccaaaaaaaaatactagctttttttttgtctccaatttctaaagtattattttatttttgtttttttattcttcatgagtggtaccaaaattgattttttggatctattagttaggttatcttcagctatctctgattttttttcttatattcgtctaaatctatataccatatcgttttgtccatggtccaagttcaacgtgcattaaatgttatattcggtcgaatttgaaaatatgcagaataatacataagcttcggtggttgaagtcttgaagatgaactcatatcagtatgactaatatagtactatttggtacccattgttataatttcagtgttaaacgttatctatacaaatgagcaaaagggaaatatacacacaaaaaatcagtactaactatctttaacatcattttttcaagtatatgcatgatgtttatatcgaattatgggtagttggacaaaaataaacctctgtaagaaaatatcgaaaaaatattagttacctatcgttacgaaattgaaacgttacaacttacaagtgaaaaacgactcgaaaaatattactttgaaaatctgccgtttcaaactaatatttttctccattcttacaaacgttacaaacatattaaattataaattaaacaaaagaagacaacaccttacgtttctttttcagaaagtgcaatttatgtaactgatattttttatttgattacacaaaaagaaacttattaacttcggaacgataagttattctttgacagtagtagtataatcaagtcctaaataaaagtcaaacgctacaacattcgatgattaactgctaaaaactatggtttattggcttatcacatgatctaaaacgagtaagaaaattaaatgcaacttaaattatatgaatcagtaagaacaaaaacaatgtcaaaatcatcggtccctgatctccggtgccggcacccacccgttcaaatcaactatttaatttccgaccatcctattactctattccattaaatttttaaactccaaaaataacaaaaattaaataaagtaaacgtcagagatgccccaggcaaccacagtcaaatttgcaacaatatggttacaaatctttaaataatattattattcttatcattaatcaactcccaaatgacagtccaattaaataatcacaaaacatcataaaagtgaccaaaattaaataataacaattgttttttgggtttcacatgttttataagcaaagccagtgtggtggacctaactcttcacgctgtcccgaaaaagactcttctcttctctcttcctctttccttcacacaactctctcattctactctctgttttttttctttaatcataacatttttttgaagaacagagattctttttgtttgtgtaagagatg

SEQ ID NO: 31917 - DNA, 3000 bp, Unknown; identical to SEQ ID NO: 31916
  misc_feature (1)..( 3000): 2750-1469P.txt file - cDNA_ID_3047262; gDNA_ID_1621183; Annot_ID_174331

SEQ ID NO: 31918 - DNA, 3000 bp, Unknown; identical to SEQ ID NO: 8035
  misc_feature (1)..( 3000): 2750-1469P.txt file - cDNA_ID_3047286; gDNA_ID_1621184; Annot_ID_57425

SEQ ID NO: 31919 - DNA, 3000 bp, Unknown; identical to SEQ ID NO: 8031
  misc_feature (1)..( 3000): 2750-1469P.txt file - cDNA_ID_3047286; gDNA_ID_1621184; Annot_ID_174371

SEQ ID NO: 31920 - DNA, 3000 bp, Unknown; identical to SEQ ID NO: 2784
  misc_feature (1)..( 3000): 2750-1469P.txt file - cDNA_ID_3047286; gDNA_ID_1620594; Annot_ID_161489

SEQ ID NO: 31921 - DNA, 3003 bp, Unknown
  misc_feature (1)..( 3003): 2750-1469P.txt file - cDNA_ID_3047302; gDNA_ID_1621184; Annot_ID_174365
taccccacggttgggctgtgtacatctcaaaatcagaagcatgccgcaatcttggcaaaggtatcttctcttttccatatggtgtcaagagaattccttcagtcaacactactgcagcaagacacaacttttcttcatcttcaacagcaggttcaccttccttaggttttaaaaacaatcgatcttcgagatcaccaagagtataagatcctttactagcccaaaagtatggttcttttacaggatctttcccctttcgtcgaagttccctatgaacaggttcacattgaattcctgtatgaacaaaagacagtgtagagactattattacaggttttatagtaaatactttaaaaacgattgtaaatcatgtttaacacttttaaaagcttttaaaatcccttataaatcattcaatgccacttacttatgctttaaaaacgattgtaaaccatgcagacacttttaaaatcccttgtaaatcattatatgacacttacttatgctttaaaaacgattgtaaatcatgtttaacctttctaaaagcttttaaaatctcttgtaagtcattctattcaacttacttatgcttaaaaaacgattgtaaatcatgtttaacccttagaaaaggttttaaaatcccttgtaaatattctatgccacttacttatgttttaaaatcgattgtaaactatgcaaacacttctaaaatcccttgtaaatcgttttaagacacttacttatgcttttaaaatcccttgtaaacgtgtttaacacttctttaagcttttaaaatcccttgtaaattattctatgctagttacttatgcctaaaaacggttgtaaaccatgcataccctttttaaaatcccttgtaaatcattatctgccactaacttatgcttcttaaacgattgttaatgaagtaaaccccttttaaaagcttttaaaatcccttgtaaattatctatgacacttacttatgttttaaaaacgattgtaaactacgcaaacagttatgcaaatgccttgtaaatcattctacgacagttaattaagctttaaaaacgattgtaaaactttattacctgttgtgagatagaactctctcaaggagaaacggataggttgagaatcaactctaaaccaaagagttgatccttttgttttcactctctgctgcatgagatagtgaaagatttttccagaaaatctgattcccttcttagccttcatttttggtcccaattcaactagaagaccaagaaacgaacttctaatcttctgaaataaacactcgcctaaagcttcctctactttactaactaaattccaatccgagtattgttgaacggttcccagtgcaatagattcttcaccttctatgtatatctgttcaggcaatgtaaggatttcactctctgaatccatctgcaaaacatgttatgaaacatcgtcagatctactataaaatcgactataaaatcgactataaaatcgattataaaaacggttaccgtcggatctatcgatatctctggggattgtttgcgtcgtagagaaatgatctgaatccttcagcgaatccttcggagaggaaattcgtcggcgattttggggtttctcagagagaaaattcgtcggcaattttgagtgaaatcggagaggaaattcgttggcgattttgagtgaaatcggagaggaaattcgtcggcgattttgagtcaaaacggagaggaaattcgccggcgattttgagtgaaatcggagaggaaaatcggagaggaaaacgaagaagtttgtgaaacgaatgtgaaacctaatcattcagtaagggtaagacagtcatttgccatattagaaggggtagttttaaaaatagccttcaggaaaaggcatttttacaaaaggttattagaataagggaaattttgcaaatctcccttcttatattgaagggagatttgcaaaaccaccttttttttactacccttttgcaacaatatcctttcatgttgtccatttttaaaaatactcattcccttgaacaaaatgaccaaattaccctcatctaatagaaaaaaggagttgaaaactgaacttttcccgccaattttttggcgccaaaagttttatttcccgccaaaaaaaaagtttccgccaaacttttttcccgccaaaaaaaaaaatattctcgccaaaaaaaaatttcccgccaatttttttttttcgtaacaaatttttctcaaccaaaaaaatgattttaaaaatccttgtaaatatttttttgcggcaaatagatttacaagagattttaaaagagttttaaaagatttacaagagattttaaaatcctttgaaaatctttgaaaacacttttaaaccctttaaaaatctttataaatcctttgtaaatcttttaaagccctttaaaatcccatggaaatattgtaaaactcttttaaaatcccttgtaaatattttaaaatcttttcaaaacaattttaaaccttttaaaaatctttaaaatacctttgtaaatcttttaaatccctataaaatctcttgtaaatcttttaaaacccttttaaaatcccttgtaaatctttttaaaaccttttaaaatcccttgtaaatcacccttttaaaatcccttgtaaatattataaaagccctttaaaatcccttgtaaatctatttcccgcaaaaaaaaaaaattggcgagaaaaatatttttgaaaacaaaatttggtgggaatttttttttcgaaactttttggcgggaatattcattttggaatattttaggtgaaaaaatattaatatttcattttgttaacctaaaacaatttccaaataagggtaaaatggtcattaaaaaattaaagagggtagaaataaaaatggataaaacaaaatggtaaagttgaaaaggggcatcatgaaaagggcatttgaaagaatttttctatattgaattggatattgttacttgtatttatg

SEQ ID NO: 31922 - DNA, 3003 bp, Unknown; identical to SEQ ID NO: 21613
  misc_feature (1)..( 3003): 2750-1469P.txt file - cDNA_ID_3047322; gDNA_ID_1621185; Annot_ID_174399

SEQ ID NO: 31923 - DNA, 3003 bp, Unknown; identical to SEQ ID NO: 21620
  misc_feature (1)..( 3003): 2750-1469P.txt file - cDNA_ID_3047331; gDNA_ID_2926133; Annot_ID_197033

SEQ ID NO: 31924 - DNA, 3003 bp, Unknown; identical to SEQ ID NO: 21620
  misc_feature (1)..( 3003): 2750-1469P.txt file - cDNA_ID_3047331; gDNA_ID_1621185; Annot_ID_174383

SEQ ID NO: 31925 - DNA, 3003 bp, Unknown
  misc_feature (1)..( 3003): 2750-1469P.txt file - cDNA_ID_3047335; gDNA_ID_2926133; Annot_ID_197032
ctaaaatacatctcgtgcaccgcgcgagcctacttcaagtaaattatctaatatattagtaagaggtaagtggatattacttttaatgtgtgaaaaattcttaaacaacacttcaaatgaaataaagatagtgtatgttactccaccattgaaatcaaaattcaagaaaggataacaaaaatggtaggaccatattccagcaatccacaagtgacaagtgcttctgctggttatgttttacccaattttgtggatttcatcaattgattggatgataatggaagaatatgcatagtcttttctcagtactactttaaacccacctatctaggttaggcccgtctagataggcgggtttaaaaaatatttataaatttttatcgatgatatttgaattttaaatagtaaatgataattatttttaaatatttaatttagtaaatttgttttaaattaaattttaatcttacaataatcttacattgcagaaaattgtaatattgaaattcgatttaaaacaaatttactaaattaaatatttaaaagtagggattatcatttactatttagaattcaaatttttggttaatgggatctcaccgctatagattcaaatatttttataaatttgttttgattagaaccttggctataataaaacaataataaaatattaaatatagatgataatatagaagaaaaacatatgaaatcgtaatatttttaaaaaaaacagatgacttaaataacgtaagtagatcaaaggaaattgatgcatttgatgctcctgatataaattttttggaccgttctttcaggtttgtttaatgaattgatccatatatttgtgaacataaatgttggcatggatcaagcggcgatcttgcgaaatttgacatcgaaaatttcgtataaacgtatcaagaaatttactcttgttaataagatattagttttagttaaatataactaattgtggtaataatctaatagttgaataaattatcatcaaattgagagattaaggtttgaccgtttgagttctcttttatatgataaaaaaatatctaacattctatatatctcaaagattgattgggttgggattatatccggttatattaaaaatattatcaacagtgattggtctgtaaaccaggattaacttcagtttttttatatacaaacaaaggccaagtcaacgaacgtactaaattaataattatgttttcttttggtattgacgactttgcataaacaaatagaggtaggaagaaaattcggcagacgatatgttatggtgactttcatgtcgatttcgagtttgtgaaaatataatgtttaaaattgggtccacccacactattcaaaggtggttttcatgttttgctatgatccttgacatttataaaaattctaacgtatctcgatataaatagctgccatattttgatttttctattagtcaaactcacatttgatccttatctaaaatttccaacataactcgagattagtccaactgactcaagccaaaggtttgaattctttgtacttagttcagattcattcagcactaatttcactatctttgatgagtattggtctagtttacttgcttcatttgagtttccaaaatctttgactacttctcatactagtttcattcatcttttcgtactaatctgtaactttcaaatgatgtccaatttggaagaaggaaaaaaaagcttgagtccttaaaatttctaaattaagattccgaatggagacgtgcggttcaactgcggataaagtgcggtgcggttcaaatagtaacaaattatatacatatatatatgcaaagaatttcgttattatttaaaacacactgcactgcggttcggtcaccattcgaaacctaagatccaaaattatttcaaaaatatcgcatactaaaaaaatgtggaaaataatcagcataaagtcgcagggattagcgattaaaaaccaaccttcatctctttttaatcttttcttcatctctttcattttctgtcgataccactttttttggtgattccgtaaacagtgcaaataacatcgataaccttggaaactcttttataatatagcgacaatcaatggtgtatagatcttcaatctaaatacactacacacatcacaattgatatttttttagcaagaaactctcaaatcttccctctgtattaaactttactagtttgacaacgagaccaaagaatacatattacaaatccaaatccaaaatgtcataaagttgactaaaaaatagtaattgtataataattaaatcaaacctttcatgaaagcttttaacaactgtcattatttctcaaagctttatcaacccccacttataataattaatttttaaaagattttcttaaataacttgtacaaatatagtatcaaattttaaacctatgttaagtactacaataacacgctttcctctgtattattaaatcattaatacgtatatgtgacgagaccaaaagtacaaaaagtccaaagtacaaaactctcaatccccaaaaagtctcaaactttgacaagaaaaaaacagtaaacagagaataaaatgaaaaaatcaaacctttgcatcaagcttgcaactttccttttcaacatctgtcttcattgcctcttaagccccaattatgacaacaaacctcacgcgtactgtcttcttcgtcttgttcttcttcatctaccatgaaagctcttctctttcttcttacccttttcctcatcctcccaaacccaatctcagccattgatttcatcttcaacggcttcaatgactcatcatctaatgtctccctcttcgggatcgcaacaatcgaatcaaaaatcctaactttaacaaaccaaacatcgtttgcaactggtcgtgctctatacaacagaaccatccgtacaaaagatccaatcacatcctctgttttacctttctctacttctttcatcttcaccatg

SEQ ID NO: 31926 - DNA, 3003 bp, Unknown
  misc_feature (1)..( 3003): 2750-1469P.txt file - cDNA_ID_3047335; gDNA_ID_1621185; Annot_ID_174382
ttccgtatattatatatcatctatttaaaactactttatctaataagtagcaatctgcataatacaaatgatcataaaacaaatataattaattttgtactgaaataataaatatcaaataaacttgtaagacatagggcatagccattagttacttaagtacctcattaaaatttttgttctaaaatgtccgatttattatatttttaagtcaaaaacatgaataactatatatataacgcatgtaatataaatttaaaactaaaatacatctcgtgcaccgcgcgagcctacttcaagtaaattatctaatatattagtaagaggtaagtggatattacttttaatgtgtgaaaaattcttaaacaacacttcaaatgaaataaagatagtgtatgttactccaccattgaaatcaaaattcaagaaaggataacaaaaatggtaggaccatattccagcaatccacaagtgacaagtgcttctgctggttatgttttacccaattttgtggatttcatcaattgattggatgataatggaagaatatgcatagtcttttctcagtactactttaaacccacctatctaggttaggcccgtctagataggcgggtttaaaaaatatttataaatttttatcgatgatatttgaattttaaatagtaaatgataattatttttaaatatttaatttagtaaatttgttttaaattaaattttaatcttacaataatcttacattgcagaaaattgtaatattgaaattcgatttaaaacaaatttactaaattaaatatttaaaagtagggattatcatttactatttagaattcaaatttttggttaatgggatctcaccgctatagattcaaatatttttataaatttgttttgattagaaccttggctataataaaacaataataaaatattaaatatagatgataatatagaagaaaaacatatgaaatcgtaatatttttaaaaaaaacagatgacttaaataacgtaagtagatcaaaggaaattgatgcatttgatgctcctgatataaattttttggaccgttctttcaggtttgtttaatgaattgatccatatatttgtgaacataaatgttggcatggatcaagcggcgatcttgcgaaatttgacatcgaaaatttcgtataaacgtatcaagaaatttactcttgttaataagatattagttttagttaaatataactaattgtggtaataatctaatagttgaataaattatcatcaaattgagagattaaggtttgaccgtttgagttctcttttatatgataaaaaaatatctaacattctatatatctcaaagattgattgggttgggattatatccggttatattaaaaatattatcaacagtgattggtctgtaaaccaggattaacttcagtttttttatatacaaacaaaggccaagtcaacgaacgtactaaattaataattatgttttcttttggtattgacgactttgcataaacaaatagaggtaggaagaaaattcggcagacgatatgttatggtgactttcatgtcgatttcgagtttgtgaaaatataatgtttaaaattgggtccacccacactattcaaaggtggttttcatgttttgctatgatccttgacatttataaaaattctaacgtatctcgatataaatagctgccatattttgatttttctattagtcaaactcacatttgatccttatctaaaatttccaacataactcgagattagtccaactgactcaagccaaaggtttgaattctttgtacttagttcagattcattcagcactaatttcactatctttgatgagtattggtctagtttacttgcttcatttgagtttccaaaatctttgactacttctcatactagtttcattcatcttttcgtactaatctgtaactttcaaatgatgtccaatttggaagaaggaaaaaaaagcttgagtccttaaaatttctaaattaagattccgaatggagacgtgcggttcaactgcggataaagtgcggtgcggttcaaatagtaacaaattatatacatatatatatgcaaagaatttcgttattatttaaaacacactgcactgcggttcggtcaccattcgaaacctaagatccaaaattatttcaaaaatatcgcatactaaaaaaatgtggaaaataatcagcataaagtcgcagggattagcgattaaaaaccaaccttcatctctttttaatcttttcttcatctctttcattttctgtcgataccactttttttggtgattccgtaaacagtgcaaataacatcgataaccttggaaactcttttataatatagcgacaatcaatggtgtatagatcttcaatctaaatacactacacacatcacaattgatatttttttagcaagaaactctcaaatcttccctctgtattaaactttactagtttgacaacgagaccaaagaatacatattacaaatccaaatccaaaatgtcataaagttgactaaaaaatagtaattgtataataattaaatcaaacctttcatgaaagcttttaacaactgtcattatttctcaaagctttatcaacccccacttataataattaatttttaaaagattttcttaaataacttgtacaaatatagtatcaaattttaaacctatgttaagtactacaataacacgctttcctctgtattattaaatcattaatacgtatatgtgacgagaccaaaagtacaaaaagtccaaagtacaaaactctcaatccccaaaaagtctcaaactttgacaagaaaaaaacagtaaacagagaataaaatgaaaaaatcaaacctttgcatcaagcttgcaactttccttttcaacatctgtcttcattgcctcttaagccccaattatgacaacaaacctcacgcgtactgtcttcttcgtcttgttcttcttcatctaccatg

SEQ ID NO: 31927 - DNA, 3003 bp, Unknown; identical to SEQ ID NO: 23853
  misc_feature (1)..( 3003): 2750-1469P.txt file - cDNA_ID_3047382; gDNA_ID_2926145; Annot_ID_197698

SEQ ID NO: 31928 - DNA, 3003 bp, Unknown; identical to SEQ ID NO: 23853
  misc_feature (1)..( 3003): 2750-1469P.txt file - cDNA_ID_3047382; gDNA_ID_2926145; Annot_ID_139081

SEQ ID NO: 31929 - DNA, 3003 bp, Unknown
  misc_feature (1)..( 3003): 2750-1469P.txt file - cDNA_ID_3047382; gDNA_ID_1621187; Annot_ID_174503
ggtaaatcacactcaatttatattgtagttaatcaagctcaacaacactgatgagcagcatctacgcactcgatttaacatcaattaaaatatgagatcatcgattctaaagtattagagtatttgaaatagagaaatgatctctaatagcacataatcaagtttcacaaaaagcaccataaactctttagataaattctcacaaatagcacaattttaagttttttggacaaaaatagcattaaaattttttttgacataaatcgcattcaaataattattttatatttaattattaaaatttaaaattcaaaaaattcaaaaatacacaaattctttaccaaaaattcccgccaaaaaattcctgacaatattttcccgccaaaaaaatttccgtcaaaatttttccgccaaaaaaatagaaattcatgacggattttacaaaatttaggaaggattctaagcaattcaagaaagattttacgaaatatagaatatattttttttgtatcccttcctgaatttcataaaatccttcctgagttttgtaaaatatttcctaaattttgtggaattcttcaaataatcattttctgaaatttaggaaggattctacgaaattcaggaagggtttcacgaaatttttatttgtgaaagctttcctgaattacgtgaaatcattcccgaataccgtagttaccttcttgaaattttttttgcggggaaacttttacgaagattgttttggcgggaaaatttgataggaaagtttttggcgagaaacttttttacgaaatgtttttttgtgggaaaccatttgacggaaaatatttacttttatttatttattttagttaactaatcgtttatatttaatatttaattaaagttttgagtgctatttgttgattttttcaaaagagatgttatttttggaagaaaaaacttttagtgctatttttgtaatcctcctaaattttaatcaaaccttaaatataaattaataattaagaaaatacaaatacgaatacacaaatttatcgccaaacaaagattattaagtttttcatatgtatttatactataaattgttttgtaaagcctttaatttgtggactatactataaatttttcagtagggcctttaatttgtgggcttttttttacatacaattatataaactaaaacctaaatgctagagttaaaaaaaagggcgatttgtgagtcaacttaatttttgtacaagtaaaaatcatagtttttgaggttaattgttagttttgcttatgaatttattgttattcttcctttctatcgtggcaaaatttgtaagaaaaaaaagatgcaaatcttgtgataatgtgattagttaaactccaattttagaatggatcgatcactagctttgttaaaatatgagacacaaactttcatcaaatttaacgtatttgaccttgatttgtgttaaatatttgtcgcaatataaagttgtaaacgttatataaggaaatgttcaatctctcttctttttttttgaattctttttaactgaatttgtagatgttatataaaaatatgacatatgacaatgttttataaacatgagtatatttgtcacaatgtttaacataataattttgaaaagagagaacaaactgcaacaatgttgttatataatacaattttccattaatattgaaaatatgagatttctatgggatattgcacaaaagctaaattacaattcataagattaataaaaatctttaagtacaatgtatcacaccaattctgctagttttagaaaaatataatatcttttttttgcctttttcataatgagtcaaatttatgtttatggaggatagaatctcaatgttaaaaaagagtaacaattcataaaattaattaaaatatttatgtgtaatgtatcacactatttttgccagctccaaaatgttacttttagaaaataaatgagaataggatatttgttttttgtctttttcataatgagttaactttatgtttacggaggatagaatctcaatattaaaaaggggtaacaatttatacgattaattaaaattttatgtacaatgtatcacaccatatctgctagctctaaaatgtaataaataagaatataatatatattttttgtctttttcataatgggtcaactttatgtttatgaaggatagaatctcaatgttaaaaaggggtaacattcattagattaattaaaatctttatgtatatacaatgtatcacactattttcgccagctctaaaatgacagttttcgaaaataaatgagtcaactttatgtttatggaagataaaatcttaatttaaaaaaaggtaagaaaatcttctatataaattggtcaaacttcctttcagtcttcaattcaaatcattgttttttattactaaaaggaaatataggatttaggatagtcccccaaaatgctaagtttcaactaatataaaaagaataaatctaaattacagctcatctctttaaatgaaattgtaatggacagtgtatcacaagatttttgccagtcctgaacgttctaaatctttaggcgtttatttgttctatttataaatatcaaatcgtagctttataatccattcatagtcctttgctcttgttttactactctcactaatttttttataaaaacaattcttagctactagctagctccatttataatcccttcactcaactttcttgtttcactattctcactaaacgtaagttttcttgcatcatttttctaaattttattgtcgatatcaaactagattcgaaggatttcaattgaaagtcttatgatatttaattgttacgtcgatataatctatgtgatgtagaaacactcatttttaggggtctaattacatctattcaagcaaatcttttatttaaagtgtgcatgctaatgatttggataattttgtttcaaattagggttttctcggaaatg

SEQ ID NO: 31930 - DNA, 3003 bp, Unknown; identical to SEQ ID NO: 23852
  misc_feature (1)..( 3003): 2750-1469P.txt file - cDNA_ID_3047390; gDNA_ID_1621187; Annot_ID_174498

SEQ ID NO: 31931 - DNA, 3000 bp, Unknown; identical to SEQ ID NO: 8052
  misc_feature (1)..( 3000): 2750-1469P.txt file - cDNA_ID_3047399; gDNA_ID_1621187; Annot_ID_174477

SEQ ID NO: 31932 - DNA, 3003 bp, Unknown; identical to SEQ ID NO: 17605
  misc_feature (1)..( 3003): 2750-1469P.txt file - cDNA_ID_3047407; gDNA_ID_2926145; Annot_ID_197683

SEQ ID NO: 31933 - DNA, 3003 bp, Unknown; identical to SEQ ID NO: 17605
  misc_feature (1)..( 3003): 2750-1469P.txt file - cDNA_ID_3047407; gDNA_ID_1621187; Annot_ID_174474

SEQ ID NO: 31934 - DNA, 3000 bp, Unknown
  misc_feature (1)..( 3000): 2750-1469P.txt file - cDNA_ID_3047429; gDNA_ID_1621188; Annot_ID_174514
tcagaagaagcagcagatcaatctactcgcccctcctactcgatcctctactcaacccatttactagaccaagggcgaccaactctaccagacttgttgatctatcaaagcgtcttcagatcttcctcattccccactcaaccaaacatctgagcatacggataggagaggaagaagcatctcctcgaccaattgatcactcggagcatggacacaaagaggcagactttgcagcaccctctttactcgatccccaagattgagcactcgcccaaagcgcctcaagtctctcgtcttctagtgaatctagggttttcaacattttactataaatagatcactttgggatttgtccaaaggatctagcttttatccttttttttttttgtgttcttgaagcttcaaaacttaattactcttaatctattttgtttttgcctttagttctttgagtaaatttgtttagtttgtttagatctacattttggtatgatttcagtaatttatgggtttgtgttcttagttatgttggttgagtagtgattagggttcttgaggatggattagattagggtaatctctaggttagttagatggttaagattatgttagatcccttctggattcgttggcccctatgcggttttcgctggctaatgtggaaattcgaccataaacgtctagcgtccaaaagacgttcaaatggttgcctgatctacgaattccagagaattgtagactatagaccaagagattggctagtctgtttattggctttggtagattgttgcttaaaccctgctcttctatgtttcatcaacgagagttgagattaggaagtggtagagttatgggggtctctgtcacgagagtggattgacccggtttttgaatcttttgtctagggtttctgcctttcacctgttagccacctgatgaaccctagagttgcccttatcaatgaatccatccttaggacttctattcttcttagatttatttgtattcacccctgattacacttttatttacctgttatttgtatcccatgttgattgcaatttagttcttaaattgtcacttgttggttctactcgacccaatgatcgagtagggctcttaagttctcatttttacctgtttgaatcctgacctaggattgttgctagaaacccactatcattataatctggcttgacttagttgcttctgtacacatcttgattgctagcaataacagtggactggattgacaccccctatagctgcatcgacatgttagtgtttaaggggaattgaactgaactcaccacacttcagcaaaaaagtaggcctaaaaacctacttatcaatttggcgctgttgccaattcattgttgcattgttacattcaagatattagaaaaagttaagatcaagttcttttacatttatcaagttactaactcatcatttcgtttgcttgtttttgtggtataggtactaaactttgtgcatgcaaactcggtccaaaggttctgcacacctactaccattctgagatagaattgacagaatagctcgtgagttacaagaaatcaaagcaaaggcaacctgtgatcagcaaagaccagctgttatggatcaagagaactgaccagttgatgttcaagacccactaatgttgatcaaccaacaaacattggtgctggtgatgccccaaggaatcatcaccaaagacaagggatagtgcctccaccagttcagaataacaattttgagatcaagagtggtctcatctcaatgatacaagcaaacaagtttcatggtctacctatggaagatcccctagaccatcttgatagctttgataggctctctggccttaccaagatcaatggtgtcactgaagatatgtttaagctcagactatttcccttctctttgggagacatggcatacaactgggagaagactctgcccccagacttcatcacctcctgggatgattgtaagaaagcgtttcttgccaagttcttctttaatgctcgcacatctaaattgaggaacgagatctcaggcttcacacagaaaaacaatgaaactttctgtgaagcttgagagaggattaaaagctacaccactcagtgtccccatcatagtttcaagaaagcttcattattgagcatagtctaaagaggagctttaccaaagatcagaatactactcgacactgcctcaaatggaaacttcctgaacaaggatgtagcagaaggatgttagttggtcaaaaatctagcacaatctgatggatgctacaatgaagactatgatcgctcaatgagaggaactggaggaactgaggataaatagagcaaagatatcaaggctctggatgaaaagctagacaagttgttgttggctcagcagaagcagatacactacatcactgatgaagagcacttccaaatgcaagaagggggaatgatcagactgaagagctagctgtgttacattcagaacaaaggagggttcaacaagggctacaacaactacaagcccaacccaaacctctcctacagaagcactaatgtagctaacccccaagatcaagtgtatccaccacaacataatcagtctaagccttttgttcaacacaaccaaggttatgtccctaaacaacagtttaatggaggctactgaatagtgtgtattttgcatgttttgagcatccatttgtcatcactttagcatcatatcatcactgttttatacaatttctcatcatttgtcatcactttacatgtttaggatagttttgcatgcatgttgcatatttgtgttgttttaaggtgattcgaagctattgacgagctaattggaagaagcggacctgatcatgcaaaaccactcgacccccaggtcgagtagacgcttcacaacctcagcagaccactcgaccccctggtcgagtagaggacatcaccacttcacctcaccactcgaccacgaggtagaatg

SEQ ID NO: 31935 - DNA, 3000 bp, Unknown; identical to SEQ ID NO: 8078
  misc_feature (1)..( 3000): 2750-1469P.txt file - cDNA_ID_3047461; gDNA_ID_1621189; Annot_ID_57476

SEQ ID NO: 31936 - DNA, 3000 bp, Unknown; identical to SEQ ID NO: 8071
  misc_feature (1)..( 3000): 2750-1469P.txt file - cDNA_ID_3047461; gDNA_ID_1621189; Annot_ID_174541

SEQ ID NO: 31937 - DNA, 3003 bp, Unknown; identical to SEQ ID NO: 17612
  misc_feature (1)..( 3003): 2750-1469P.txt file - cDNA_ID_3047469; gDNA_ID_1621189; Annot_ID_174535

SEQ ID NO: 31938 - DNA, 3003 bp, Unknown; identical to SEQ ID NO: 17613
  misc_feature (1)..( 3003): 2750-1469P.txt file - cDNA_ID_3047473; gDNA_ID_1621189; Annot_ID_174534

SEQ ID NO: 31939 - DNA, 3003 bp, Unknown; identical to SEQ ID NO: 17614
  misc_feature (1)..( 3003): 2750-1469P.txt file - cDNA_ID_3047477; gDNA_ID_1621189; Annot_ID_174530

SEQ ID NO: 31940 - DNA, 3000 bp, Unknown; identical to SEQ ID NO: 17617
  misc_feature (1)..( 3000): 2750-1469P.txt file - cDNA_ID_3047489; gDNA_ID_1621189; Annot_ID_174524

SEQ ID NO: 31941 - DNA, 3000 bp, Unknown
  misc_feature (1)..( 3000): 2750-1469P.txt file - cDNA_ID_3047493; gDNA_ID_1621189; Annot_ID_57459
gtgacatatgtggataacctgttgaggttggagaatagctcaatcggagaagttgttggcagcgtgattcttatgatggtaatggagaggatgctagatttagatgtaagtagatgttaattttttataaaaatgtagccactaagtaaagtggcaagtgaatgatatgcttgagcatctttgtagttggtaagtggatgtgatgactctaatggaggcatgtttgatatggaacttgaagatgcagttgaaagcactatgaatgaaggagacgaggtagggttagtgtaattttttgctatctttgcaaaatcccgaaacttactctgtttagtaatgatcgaaagttacttgatgacaagataccattttctcttgttgtgaaatgttagacatgacctctggtttcctggagaagaatgtgtcatcattcataaatttgatctctttttgcagtttccagtgggggctctaaaacaaaatacttcaggtggaaatgtagtctctgaactgttggacaaattgatggtcctattttttcatcatctagaatcctgtcaaaactctgatcgtttggatgaggtatggcaccaaatggtacttgttcaacatatttttcctttcctttgtggtagattcattgatcttttggtgtttctgtttttcattttggcataggtatttgaaatcctctttaagtcgttcgagaactatattctgaacacatacaaaacaaaattttcacaggtaggcatcaaagctatcaccttacatactacaaagttttcattgtaggcttctagcattagttcattatcggcatgtgatgtcttggcttagactcactctactttcatctgcagtttctgatgttctatgcatgctcactagatcctgaaaattgtggtgtgagatttgccagtaagctgttggacatatatctctccagcaacacatgtcgacttactaggcgagtttaatcttgtccttcttggtaaagatttctctgcatgatatgaagctaatattgttctaatcaccacttgtgtattcttttgttttctctttatacttaacaggatgagtgcagtggcttatctagctagctatttgtctcgtggaaagtttttgcctgcttcttttgtggctagcatgttgaaaaggtacgtattgctaaaaaatggaaaatgtaattgtttgatctgatttaagtctcgctttgttgtaacatagtttctcttttgctgaaatcctagattggtggacgagtgtgcggaatattgcggaacatgcaatgatgatgtgaagccagaagcacatcaagtgttctattctggatgtcaggtatagtccaagtttaagaccatcttatggcttttgattccttaagaactcttctgtgaaatcattgacgtctctagttatcaatcattgttaatgttcacacccttaccagaagcttattggcgtttgggatcatatgctattatgtcatgtatcgcttaaagttgttacttttctatgactgtaggcaatcttgtatgtgctatgcttccgaatgagatccatagtggagattcctcgctttcaatcgcagtttagatcattggagtcaattttatctcacaaactaaacccactactggtgggtgacttacactaatcattttcttctcatagctcaactgttattttaagtagtcttcactccaagtatcaaatgcattatgcttgcaccattcattttgtgtgaacaggtgtgtcttccatctgtagtttccgagttccttaaacaagccaaagctggtggtctgttcattgtctcagaatccttcattttcgatgacctacacgagtctgagctctctcgtgcttttggtggctttgaaaggcttgacacattcttcccgtttgacccgtgcttgttgaaaatgtctagcaggtttgctatctttactcttgattattttttctcttccaaagtaaggacaaatcaatgtgagaatcttacacaaggttcttgactcactggatgaatttacccgacctgggcatatttgatacaaattctactgcatacatcttaattacagtcttgaaatgacattgaaaattattttaatatgataaaacaagtgatgaatcaaagtatttgcattggataggcttgaactctctttctcacacgtgttttcttgtcaattcttgaagctacatctccccgaacttcaacttctggtcaatggtgaaaacgacttatggagaagatggtgacgaagagctttgtgatgaggtcatagtgaatggagatgcagacagtgcggaggaacctgacgatgacgttgaacttgatagtgagatgaacacgatgtctacaactccgaaacactctttcatgcgagaaacagagaggctcttgaagatgccttcaagaatcagaccatccactagtcctcctgaatccttcttaatctaatagtcatagagagagggaatgcaattttgcaatgtaggtttcttattacaatctcttagctagtgcgtaaactctaaaaaaaagaagttgacatgagttttgtgcgagtctgtggtattatctgatcgcatgtggttttgtagcaaaattttgaagaacatctatgaagtaaaatttagtcagttggtttatgattacctaatttgagtttcggtttaatttggttaagttgaaatgctgaatgattgatttctcggtttagtgttcaatattgggtttactttgtccacaaaattggttaaaaatagctctttgtattttggtaaatgtcccgcaaatggttaaaagtaaaccgggaattgaccctccgatttaaaccggtccgtaaaccagctgagcaatctctctttaacctcggcgtcggcgtcttgtagcttcttctgctaggctttgttaatcagcaaaaaccctagaatatcttagagcttcgcttcactttcaagctcgagactttgagaaagatg

SEQ ID NO: 31942 - DNA, 3000 bp, Unknown; identical to SEQ ID NO: 31941
  misc_feature (1)..( 3000): 2750-1469P.txt file - cDNA_ID_3047493; gDNA_ID_1621189; Annot_ID_174523

SEQ ID NO: 31943 - DNA, 3000 bp, Unknown; identical to SEQ ID NO: 8083
  misc_feature (1)..( 3000): 2750-1469P.txt file - cDNA_ID_3047521; gDNA_ID_1621191; Annot_ID_174587

SEQ ID NO: 31944 - DNA, 3003 bp, Unknown
  misc_feature (1)..( 3003): 2750-1469P.txt file - cDNA_ID_3047524; gDNA_ID_1621191; Annot_ID_57494
gaagaaccagttgcgcagttagctacagccggagaaccaatgatcacgttcggtggcttggctttgacagggtttcagccagaaccgacatttcaggtgaacgttcctgatgattttgagccgtcttctacaccaacatttaaggccacggagactttgcctatgaaatgtgacccgtttacaacatttgagagttttgggttcggagagacattttcagaaaatggaggggtaaatcagcaatctgtattgcaagaacagcagatatggttgcagaaccagaaaaagatcatagccaagcacttgagttgatacaaaatttatttggctagacagaggttgagatgtttctttgagtttttcttttgttacattgtcaacttaactcttaactcatttttccataacttagagaaatgtgaaattcagaaattctttgattaaaaagatatttccgcggattctatcttcgtacttgcattcctgtgtatacacgatgtattttgtgtgtcttgtatcataatcacattgagaatttgattttcaagtatatctcaacgaataacactcaaatatctaagttcaccttctgaatacatttacgtacacggtacactttgggatttacttttgaatatgttattttctttgaagtttttgggaattgaaatttagctagcattttgatcatcgtgatgatgttatgtagcatttagtttatgtatttttgaaaatatttatgtattcatttttagtctatattaatataacaagttttcacataatcacacaacagatgcatgcatctaatgtgtgtgtattagatgaatgtatccgatatgcgtattagatgcgtatatctggcaaacaattttttgcattttattttccgatatgcatgtatttatgtgttatgatatgcatccgtgataatgcgaatgataaaatgaatgtatatcggtggaagataacgaagagggaagccaaatggaataaattaaggaggtccactagtaggtcaagttggctttgtggtgtcgataacatgagattgaccaaagctgtagcttgaccccaaggccacgagggagaaagatctaccaaaccaaaatcatcataacacatctctttctagtatatagcccaccacaaatattaattcttttaatagttatacaccacaaattttatcccccattggccattgactagagtcgttttcgtctttgacagtggtaaaagcttctgtatatgtgaatttaggattccacctttcttaggtttctcattacaagttgatttaacttcttgacttctcaagttgttgttttgtaatttagtaaaaatttgcttacaagtcatacatgattgaatataacaccggctgctaagcctatttttctatcataagtttcgctttcgagtcaaaatgttagtcaacatgaaataaaacacgtttctttatttgttttgcttattgatcaactttaaaatagtcccataaaatagcaaatattaagaaatttcaaatcaatacattagttgccaaaacccgtctgtgatattatactttttgaggctccataataatgacgtgagatttgtttgtgactgaggaagtggaaaataaagttaagcatgtcttactattatcaaatatcagtttttctataacaaagtatgaatgttgatcaaagacaaaaacaaaaaaaaggtgatccacctttctccaaatagaaaggaagtaaggcaatgaatgttttttttttttttttccattgcatttgcttttaaatccttataagaatttgaaagaaaaatatcttatcaactcttagaggtgatctttgggccaaagagggaaccacgtaatcgaatctgaacttctccgcttaaatgggaaattttattagatctgataaacggccaaaagtgatagctcatgattcttaatatagacgtgcatacagagatgttgttaccggccgaagagcagcttcgtaatcaacggacacaaataaaccactattggtccatcaaaattaatacaaaacgaatgaaaactgctgtgtcataagactaaataattttgtatattattatgatttagatggatgcggtctacaaatttttttaacaaaaaccaaccattagtttgtttaagttacttgaaaacaagaaaaggttcagtgaaaggtgatatataagctattattattatacacagagtaaaaggaagaaatgtgaaaaggaagattaatccacactaaaagtaaaaggaagaaaacgggtcaaacaatgaatcgtctgactgagtaataatatacgtcgctgtcatatattttgtataaccataaattttttatattttttccgacccaaattatttttagttttctatagctagttactaaattaaaggtgatgaatagtaatcatgactttatgtcacacgataaggttattatcacctacctttgagtatatttaggattttccgaagacttggacgacccaactcagtttggataaaaccttgtggtctattctaaatttaattctaatttacttctgattatgtggatttatacacggttaaacatcagaggctgaataataattagtttgatagatctgatagttcctctgttttctttttcttttttgagttgattatactgtttgcttttgttgattattagtccaaaacattaaaagaacaaaaacaaaaaaaagtgttcacgctttttggtcgaccgtaacatactttattgaattttgttaaaaaatcattacacaaatgatattatggatgtgtgtggtccaaaaaaccaaatattgactgtagaatgataactcgtagaagtaactcaaagctcctctctgcgcttcttttctctctataaaaccaagtctttgatcatcagatttatatcaaacttcaaaagcgtcaaacataaagttaggccaagaaacccatttaaaaaaaaagagagagagatg

SEQ ID NO: 31945 - DNA, 3003 bp, Unknown; identical to SEQ ID NO: 31944
  misc_feature (1)..( 3003): 2750-1469P.txt file - cDNA_ID_3047524; gDNA_ID_1621191; Annot_ID_174585

SEQ ID NO: 31946 - DNA, 3000 bp, Unknown
  misc_feature (1)..( 3000): 2750-1469P.txt file - cDNA_ID_3047539; gDNA_ID_1621191; Annot_ID_174571
gatatgccctgtctccaggatgcaactatcgatgtagatgaggcttatcatccggatgacaaatttctaacatctttttcttcagtcttgtctcttcgaatgcatttgtctgatgcaatggtatctagctctctaatttcatctcattgtaattccattgctgcatctaactacttacttaagttgtgtttgttttcctttcaggttatgcgttgtaccaccatcaacttctctcgactaataaagttaagcatatatccctatggaccagacatgttggaaacactcctacgtttacttggaaatgctccaaaactaaaagagtttttggtagattatgtacgtatcatcctcctcctcctcttcttgctttaatggactatctataatctatactattcaaatttttgcttatcatatatagccctcccttattgcttctcagaaatttgtctataatcccgaggatctcccatggtcatggaaacaaccgagtcatgttcccgaatgcttgtcatcacagctcgagatattcgagtggagagactatggggatagaataatagaggaagaattcttgacatacgttttggccaactctaagcgtttaaaaaccgcaacaatctccctgaggttaaatcttgaagatccagagttgatcatcgaggaaataaaagaccttcctagggtttcaacaacatctcaccttttgttcaaatgaaaagtctacagaagctcagtgaatgtgcaagcttaattagccttatctgctataagataccccaaaataattgatgttcaaggtttctttttctttcttttaaagtaaaaacactatttacggtttcttgatagtgttcctttttccaaatactggataagttgcagagggcttagtttcctagtttacagtcttaacaataacatcatagcctatgattcatagggtgtttaattgtttattcacatatttctgctgggtcgctcttaatgagtcttttcttacaacatcataaaacaaattttgggtttaaagtcaaacattgactcgctgctggccctctgatgtttggaatcttacttagttcttgaaattgtatggggaaaaaacaaccaatgttattgaaaaatggtcaagcctcgttggacagctgatgtgaggaatatcgaaacatgtaaatggaataagtggtctatagtagtcaacgttatacttgtcaacattcgtctgaagttaaccgtaatccgtgggcagaaaacaaacaaagtaagtgtttggtcatctcaagtctcaacatatcccattaccattatccaaattatcatatatacatattctagttccaaaaagtttagattgaactaggaaaaaagaagaagaaggaaagcgtggaaagaaaaagcaagtctctcatcctctataaaatattccatttatttcattcttgtttccaccacagtggtgcatttgatatctttgcatgaggaatgtcttaagtggtttgtctgctttcctctgtttttgttcttttgcagatcaagaggcttcatcttttgcttactgtcaaggagtcagctatggatgttccatccaacttggaatctcgaaggcgtcttacagtactttcttttcaaattcactattaatgggacatgcctgctgcacccaagattcgcaacatgctttccttctcgtaggttccaggcacaattcaagttaatttatggtcgtcttctcataggcttactatatcttaacatcttccattttgcgttgtcacagggtccttacaccatacttccgttgattgataggtatgatagttaagctcaataaatgaccacacttgtgtttctttttgttgatgattagggtttttgggtttctttgatcttaagcataaaggacaagctaacataacccatgtcggggatggctttgcatttagaaatcttagatggggcttttgtgtccttttacttgtgtgttaccgtgatttaaaatcatcgacaagtcaacacatatatacttaagtaaagagatcttctacccgcaatttgtgacaatcaacgtaaatatgttctcttcgagcccaatgttttggcacaataactgtatccctgtaagattttcaaaagaagccagaacagaataatacaagcacagcagttagatagaaaaccatggagcgccgttacatgagaagtaaggggttaccctcagaaaaagaaaaagaaaggaccacttccgttccattgtataaaaatccagacatcaccttcttcttcccctgtaggttaatctcactgtccagttgcaaaacagagcatgaacagtaagctttttgtttaagattttaatagtgagtgtgagtcatcacatgctgatctcgggttttactaatctctcgtcactttttatatccactaattgggccaattttcattttcagggcccattattataatatttataggcccacattctcttaaccctccatccagttcacattgcgccatgccttagcgcaaacgttaaaatggcgttgtttccaacttaaatccaaatccattaatgtatttatttattttggattttttttccgtatacaaactatattcaaattttgattttttttcgtcatccgctaatcttttcgttttccaaaagttaatgaagcaacaaaaatataattttaattgaaatgattgcatatagtttgtttcaattaagttctaaatacattatcgtagtgtaatgaaaaatatttttgattacaccaatatgctcataagtcataattaaaatctgaatttcattgtgatgttgtagactttttatttttgttcagagatgttgtggcataaatgactatatgggataatatcgttggctcgttgtggtatctctctaattttatctcattgtaattccattgctgcatctaactacttacttaagttgtgttttattttatttttataagataccccaaaatg

SEQ ID NO: 31947 - DNA, 3003 bp, Unknown
  misc_feature (1)..( 3003): 2750-1469P.txt file - cDNA_ID_3047543; gDNA_ID_1621201; Annot_ID_174930
tgacttagtcgaagaaaacgttcattaaatggttcccgccaatggcccaacggccccaaacgcgtagaacgtaacatgcatggggatccatattaatggcttcttcatcccacttgcttatttctttcgactttggaggtttcatttacctattatataagggaatgttcagttccagtgactgagatatcacaagcaaacaagagaagacattttattgttatttctctctctctctccttgtagatggaacttaagggcgttacttgtttgcttctttctttggttttgcttaattcgtgtgtggaatgtgttttgggggatggatctgtggtgggtcctgcgaggtttagagacgatgattgtaggtggggccggaggtgtgctggacgtggccggtttggacgcggtggtggtggagggttcggcggtgggagaggaagtggtggcggtataggcggtggtggtggacaaggtggagggtttggagccggaggaggagttggtggcggagctggaggaggacttggtggtggaggcggagctggtggtggtggtggaggaggtattggtggtggttccggtcatggtggtgggtttggagccggcggaggagttggtgggggtgctggtggaggaattggtgggggaggcggagctggtggaggcggaggaggaggtgttggcggtggttctggtcacggtggtgggtttggagccggaggaggtgtaggcggcggtgctggaggaattggtggtggagggggagctggtgggggcggagggggaggtgttggcggtggttccggtcatggcagtgggtttggagccggaggagggattggtggtggagctggcggaggagttggcggtggaggtggaggtggaggtgggggcggcggaggcggtggtgccaatggtggatccggtcacggtagtggttttggtgctggaggtggagtaggaggtggagtaggaggaggtgctggtggaggcggtggaggtgggggcggcggaggcggtggtgctaatggtggatccggtcatggtagtggttttggtgctggaggtggagtaggaggtggagtaggaggaggtgctggtggaggcggtggaggaggcggtggcggaggaggtggtgtgggtggtggatccggacatggtggcggatttggtgctggaggaggactcggcggtggtgccggaggaggactcggtggcggtggtggtgctggaggtggaggaggaggaggtttggggcacggtggtggtgttggtggagggcatggaggaggcgtcggcattgggattggaattggaataggtgttggggtaggtggaggctctggtcaaggttccggcagcggaagcggtagtggtggcggcggcggtcgccattaatcaaagctcttattaccaatctcacgtttagtgtcttgacaatactacttcttgtcattctatttctcttgtattgtttcaagactaaacaaaaaaatatgtatgatacatttttcacttcaagatgtgatttcttctatttttgtgtaagaatgttttcaaaaaaaaaaaatctaataagaaaatattgaatacggattgatcttaattttggacttaatccgttttctttctttttctctgaagacatctagtcagttttctaagaggaacacataaccaacattgtttcaacaatatatctttctttttgcaaaatacaaatttcaattgaattaacttgtgtaacatatgtacgacccatatttcagttttgaggtcctatcgtcagatatttctctacgaaagcaacataataatagttttagcttttattgctgtattggctacgttgacttatttaaaatttgagtttgcataaacaataactttctacaatgattttgcataaacaataactttctacaatggattttgcataaacaataactttctacaatgattttgctatagctatcgtcattttgtgtcaaccgcttgtgtctactttcaatattgattcttgaaacttgcctaatccttaagaaccttaacaaacacatgaaataacatctcatggtcacggtcacttccgacctttaaatagaacaacaaccaaatctcgtcatggactcatggaacattcgaaattttgccaatgatgaaggagactgacgtcgataaagccgtcatctaaatgtctaaagactctaaactcaacatgcatgttatagtgcttttctatctacgcaccaatgtctatttcatttttttttctttttttcagtttttagtttaatgatcgaaactatatggtattttaagttttttttttctttgaaatataccatatactccctccgtcccactaagatgaaatttttagaaatttcacattctttaagaaatattgtataaagacaattttaacctcttaatatactttaaaaacaataataaatatttatctaattatttagtaagggtaaaacgggaaaacagttttaaaatttgcattggaaatataaaacttctatctttgtgggacaaatatttttcctagaaaatttatctttatcggacagaaggataaagtcaaatagatcataaagctatagtttccatcattaattaagccattattataatacagtatctactaaaagttttggtagttatgtagagattgtgattttgcgtctcacattacacatgtatcggtttcacataatgtctataatatacgatacctaagttaattttccatttagcattgcttctccaatttaatttgatacaagatcttttggttagattgctgcagtcacaatttgctaatcgaaccgataggttagttgacacgtctgtataatgtcgtgtttcccgccgttctggacaatcaacaaaaaatggaaaaatagaaccgaccactttatagaacatagtaaccctaaacttaaaattttccaattatcctcaattttgcgaattaggacagagatg

SEQ ID NO: 31948 - DNA, 3003 bp, Unknown
  misc_feature (1)..( 3003): 2750-1469P.txt file - cDNA_ID_3047558; gDNA_ID_1621192; Annot_ID_174614
gttgactaatgcaccggtattggtcttaccggaggaaggtgagccctatacggtttatacggacgcatccgtagtgggactagaatgcgtactgatgcaaaaggggagtgttatcgcatacgcatcaaggcaattacggaaacatgagaagaattaccctacgcatgatttggaaatggccgcggtagtatttgccttgaagatttggcgatcatacttgtatggtgctaaagttcaaatctatactgaccacaaaagcctaaagtacatattcacccagccggagttgaatctaaggcaaagaaggtggatggaacttgtggcggattacgacttggatatagcgtaccatgcgggcaaggccaaccaagtcgccgacgccctgagtaggaggcgctcggaagttgaggcggaacggagccaagtggacttggttaacatgatggggacattgcatgtgaatgccttgtctaaagaagttgaacccttagggttgggagccgccgatcaggccaacctgcttagtaggatccggctggctcaggaacgggacgaggagataaaaggatgggcactaaacaataagaccgagtaccaaacctcgaacaatggtacaatcgtggtgaacggtcgagtatgtgtgccgaacaatagggcattaaaggaggagatcctaagagaggcgcatcaatcgaagttctcaatccatcctgggtcgaacaagatataccgcgaccttaaaaggtactaccattgggtaggaatgaagaaagacgtggccagatgggtggccaagtgcccgacttgtcaactggtcaaagcggagcatcaagtaccaagtgggttgttacaaaacctacctataccggaatggaagtgggaccacataacgatggacttcgtcactggtagaccgattgactaagtctgcgcacttcatggcgatctcggataaggatggagcagaaatcattgccgagaagtatatagacgagatcgtgcggttacatgggattccagttagtatagtgtcagactgagacacaaggttcacgtcaaagttttggaaggctttccaaaaggccttaggaactcgagtgaacctaagtactgcctaccacccacagacggacggacagtccgaacgaacgattcaaaccctcgaggacatgttgagggcatgcgccttggattggggaggaaactgggagaaatatctaaggttagtagagtttgcatacaataatagttttcaagctagtattggtatgtctccctatgaggcgttgtatggccgagcttgtagaacaccgttgtgttggacgcccgtgggcgaacgtcggttgtttggacctatcatcgtggatgaaaccacggagagaatgaagttcttaaaaatcaagttaaaggaagcccaagatcgacagaaaagctacgccaacaaacgtcgaaaggaattggaattccaagtagaagatttggtgtacttaaaggcgatgacctacaaaggggcagggcgattcacctcaaggaaaaagttaagcccaaggtatgttggcccgtacaaggtgatcgaacgagtaggggcggtggcatacaaacttgaccttcctccaaaactaaatgcgtttcacaacgtcttccatgtgtcacaattacggaagtgtttaagtaatcaagaagaaagcgtggaagatgtacctcccgggttaaaggagaacatgacggtggaagcatggccggtacagataatggaccgaatgacgaaagggactcggggaaaatcaagggatttgttaaaagtcttgtggaattgtggaggtcgtgaacaatacacttgggaaaccgagaataagatgaaggccaatttttcggagtggttcaaggagatgggtaaaggtcaacttgatgcggattcaaggacgaatccaattcaagggggggagacttgtaacgcccgcgatcctcaataggatcgttggctaggacttggtccgagagaagaaggtggagtctcggacaagcgagaaggagctggccataagctcggacaaaggggaaattgtaacgaccgcgtcccgcgttcataaagaggccaggttgttttaggagaaaactagaccatggtcaagaaacggactagaatacttagtcagaagaataagaaagttcaaagctgaaccagctaggtgagctggacaagctaggatgaactagctagctaagctaggtgagctaaaccagctggaagactagctagctcggctaggtgagctgaccgacagctcaactgagctcggtgagctgatcgtgtactgacccagctgggtggtccggtcagctgacactcgagctggtggactgtggtagctcacgggtgaagaggtgtctcggccaaaaggtgtaaggtcgagcgggtaccaacgaacggttgcatcgcctaatagatgcaaggaacggatgtgaccttttggaaggatgcaaggaacggatgtgacctttcggaagggtgcaaggaacggatgtgatgcttcgggaagcatccattcgccccctatataaaggaggacgcccaaggcctttggaataatctcacatcatctcacaatctcacaatctcacatcatctcacaacatccaaaacaccataaaacgttcttaaaggagtcccaacacatcctagagttgttggtcggaaaggggatgcggctcggcgagtataactcgaccgaactgatgcacatgctacctcccgatccaacggttcgatggagtgtagaggatggagagggtagaccgttcgtcttagagacgaatcggatctagtagaccgatcgttggatcggatcggccagaccgatcgtaagacggatcggccagaccgatcgtaagacggatcggatcggccagacggatcggacagaccgatcgtcggacgggtcggatgggacaggccgatcgtctgacggaacgggtcggacagaccgatcgtcggatgggatg

SEQ ID NO: 31949 - DNA, 3000 bp, Unknown; identical to SEQ ID NO: 8087
  misc_feature (1)..( 3000): 2750-1469P.txt file - cDNA_ID_3047570; gDNA_ID_1621192; Annot_ID_174603

SEQ ID NO: 31950 - DNA, 3003 bp, Unknown
  misc_feature (1)..( 3003): 2750-1469P.txt file - cDNA_ID_3047606; gDNA_ID_1621193; Annot_ID_174639
atttgcaccctttagttgttgtgtaacttgtgttactatcttctattttgacaccaacagtcaacacgttgaaccccataaggcatgcttgccttgcaggctgcagcatccaatagcattgcaacttgttgacctgaatagaacacaagcgtggagtatccgattcgtcagcgctgccttgttatagcaattgattcttgcaaagtaataatctgaagctataaggttttttgcgccacaacttgacttgcatcccaccacacttggctcgacattcgttaaggatgccgtattgttgcaaccagccgctataagtgtttgtgctatttttcttatgtatctcttctctgtttatagtctcagatttctggtatgcaggttgtggccagagattctgttttatgaagctggtccattgatggcctaaagagtgaatagataagttaagcagtgaaggtccctagtttctgcaacttcaaagagctagaggaatgtgttgagacattttgagatatacacaaacaaaaattaataactaagaagttcattaaataaacacataaaacagagtagtcatacaatagtcagatatgcatgatggacaaagagatattcctaaatatagatagagcgtttggtggaaacaacttcacattcagttctacgcttaacacaaatagtcctagagtagtagacatggcatgatagctaaatagatatagatagagtgtttggtggaaacaacttcacattctcttctacgcttaaaacattttcctagagttcacaacttcacattcgatctccacattcaaagtatcttcatccaagtaagcctcctgaagatcagctaaagacaaggattgaggaatacccctcgctttggtcgctgccatgatccattgttgaactacaagaacaaggaatcaatgtcgtcaaaagagttgggacatttgcttattgaaaatgtcatcagtatcatccatcaaggcaagacataagcattgtgaaaatagtaatatcaatagtttttgacttacgccagactgttttgtgtttggatccacgcgggtctaaagcccttagttgtgctcgcacggaaatcatctcaccaggcgataagacttcaccgtcagctaaatgcaagtacttgcagaactcgttatctgcctcagagtctccctttggatacacagttagagtcctgtaaaacattatcatccacttgttagcaagttaccactaatacactcatacaacaatatctatcagaaggaaaaaactcaccaattctttcctcccattgcaaaggttttagatatgcaatcattctgtttcagaacagagaaatcacgaatgctccaagagaatttgtgaaaagggagattctcatcaacagggacgggtgatgaagcaatcttcacatgagcaccaaactcacatggttctccttccacgataaatccctttgcagggtcagtgaatgtttcaagcgacatagcttttggcaatccccaaaccgttttagaagaactgaaacgcttaacttcaacatctacatgtttacacgtatacacacacattacgattcattcattcatatatacatacgagagaaaaagagagataataaggatttgagcatacgaaccttggattgagaggtacttgttgtctttcttgttaaagacaaagaaagagagataatcaaacacatcaatgggtggtgttgtggatgagagacattccacatacatagacacaaagccctttccattgtcctcttcgtttccttttgggtaaacaaccaatctcctgatttttacaaaaaaggcaacatttcttagttatatatgcttgtagtgaagaaagatgtgaaagtctgacaagagaacaagacgaaggaggagtctttctccaagtcttcaacattgcagaatctgatgcatatgaacccattttctctacaaaatgttgcaaccctagagagcaaaacaaaacatacccataatcagaaatgatctgacgaaaatcgagttacaatacacaagagaacattttttttagaattctcagatattaaaaatgacacagaaagctttatgctttttcctcttaaaagactaaacaagttgaaatctagagaaagaactgaccaacctgagacaacgagagagacttgagagatttcttcggcacttactattagatctagggtttagataccatttatatagagaaagttttagagttgcacaaaacataaattaatgtgttagaatgggcctaaagctacaaagctggcctggttttgttttaaattgttggtttcatggacattttcgacatcttcgaacatgttattttttgagactatgcaaacttgaagctctttactcgagttgaaatcgtatgacttatagtgaaattgtacatttggtttcgatttttcttttacactctttcttctttgagccggtaaatttggaatttttcttcatagtggaatcatatgctgttttttttttttatagtaaacgttacaagaatgaatggtaactttatccaaaaaaaaagaatcatattattttgaaatgattttaagtaaattctaggttcaataacataagatttgagactaaatttaaaatttcttagtaaaatatatgatttttttataaatacctataaaattagtaattaacaatacggattacgtactgaatcaaaccctttgtattttgtttttcctagaaataagtgtagatttttggaattttgcattaattaatcacttcttgggtctgaaaggctaaaacaaaaggaaccgaaagagaatgttctctctgtctttatcttccacttccacttccaggtcgcgttgcttcactctccattgcaaagagaggtctctgcgatttctgcaactcacccctgaaaccttcttaatttacttcaactgccgctatacctaaaaacttcatctttctcctctgagctatg

SEQ ID NO: 31951 - DNA, 3000 bp, Unknown; identical to SEQ ID NO: 8095
  misc_feature (1)..( 3000): 2750-1469P.txt file - cDNA_ID_3047610; gDNA_ID_1621193; Annot_ID_174636

SEQ ID NO: 31952 - DNA, 3003 bp, Unknown
  misc_feature (1)..( 3003): 2750-1469P.txt file - cDNA_ID_3047618; gDNA_ID_1621193; Annot_ID_174629
ctttgcttgccttctccttgttgctatgctattaactgcaatatccctaatagaccctttggttactgttctttcactcccaaaacttgcaattgctttggttgccatatctgagatcttctacttcattgtaatttgtaagtttcttattcttctctgttcttagtttctgctcagttcatgttttgatgtttggttatgaatgttttgattccaggggagagaaacaagtgaatctaaatcttgattcatcttcaagtgtgaaagggaggaaaaaaagaagaatatctgttcttggtttgagtcttctacttattttttgtctataatttatttttcagtcttcattaaatttcattacctactatctcagcaacatcatcatcctcattaattaattgtctttttgcatttgccattttttcataattttctagggttttttttgttttgagaatcttgttcacacttcaagcaagatttgtttcttcttctctgttcaatcaattctctctatctgtctttctctctctctttttttttttttttcattctcttgtttacttcatcattttgtttcttatgtgttttaagaaagttaaaagttagaatttagcatattttggaaaagagtcattgtttggttaagctggcaattggaagagtatttaatatgatgatgatgatggtattgatggtgatggtggtgatagtgaagctgttaaagttaagtctttgtaatgagtgacatgttaagaaaatggatcaagtttagtgccttattctgatctgataagatctttaagtgttttagtttaaaatagaggaaaaagagtaaaaaagcaattattcatcttcaagtgcagagactagacaatatctttgaatatgtttatttatctgacactgttattattgtaagagatgttttatgtcaaatgtttgttccaactctctctattgcgttagcgtaagtaacctgcaagatctgtaaattaattactaattgttatttattattcacacatgggacatcataaagttgtcttggtgataaatttagtcaatatgtgtgtgtgggttaagagtgttgactataccagtttccccgtgattgattggcttttattaaatcggacaatttgcatttatattcacaggtcatgtttattaaactctacattgctgtctaatgtctatagtacaccaagtctattggtgattgaaatgtcggagaacggtatagtttttctgttcttacaataaaaaggtagattaagaacactgattaactcaatgtaacccatacacttacacgtcgggtcaatcttgagcggtgatcttttgggtttacctctaaccccggactggttaaacacttttctcacctcaccacatcaaagccataatcagggcccaaatttgagtgcctacagcaaaaagattttggcccaataacaaaaaactgttttttaaaacaattacaaaattttcgtctaaattagattcaaaactgtatagtaaaatgtttgggactaaccactaaactacagtcacatttttgaaaatgatgactctaaaacaagttataattatttgctgcgtaatacccttgcttcatgggattacgtggagaagaagagtaagtatcaatcaatttattgctagagatttgcaaaagggggaatccgtgtgcagaggtgtctagatgaagccatgagtctacagcggagtttgaatttgcggtggatgagttacggtggagatgacattttccaaacattacaagccttaacacgtgtacctactgagattttgatagaacttgaaattgtttcccaaataaacctcttattcggaagttaggttttggactcaaaatggatgggatgcatcatgaggtatgagatatgtttcccaatgtagtctccggcgatgagattctttatcaccatttttatttaacgttaatacttaaatctttgtaagacagaaaaagaataagatgttagtcaagattagaataacgagacctaatttgtgaaattttccgtagctttttgtggataatagtttgtttagtaaaactgatccgaattaatgtgaactcgtaagactcctccatctcaatggagcggctaattagaacaactactaaattgtgacaaatctaaggttgtctcacataattcaagagtttaaaatatggtatagtcttagatatagatatcttataccaatattcataatttgctaaagctaactagacattcctagataatttaccgccaagaaaactaattaattggatatgtttttcttttctctataatttttgtatatttaattaatgtaaatatacaaaattatatcaaatatattatttccttatatgtttcattttaatcattttttattaaaatgaataattggacacctagatagctaggccaaaacaatttttgacattccattgacttatttacccaaaatggaaagtgtgggtgattctggctgtttagatgcttagacataatcttactttctatccaactaattattacctgtaactgtaagtttcaattttaggcattttatattaattatattaaaataaaaataataacaaatagaaaaatgtatagagaagaaaatatcttaaattacctttgaaatatatattttcctttaaatggactttctatataaaaaataaatcacattacatatatgatacaattttccccctaaatgtctggttttatgccccccaaaaggtaaaatatctatatgggctgtctataaagataaatgattatcactttaccatcaatcacatgccaacacgtaagggtgaaagtaataccatatcctgaaaataaaaattgaaaatagtccagcaaagcaataagaaacacattttatctagtatataaacaatcgtcctcatgctaacaaagcaaaacacatataacaaaaacaatagatatgaagagaaagatg

SEQ ID NO: 31953 - DNA, 496 bp, Unknown; identical to SEQ ID NO: 8107
  misc_feature (1)..( 496): 2750-1469P.txt file - cDNA_ID_3047627; gDNA_ID_1621193; Annot_ID_174621

SEQ ID NO: 31954 - DNA, 3003 bp, Unknown
  misc_feature (1)..( 3003): 2750-1469P.txt file - cDNA_ID_3047667; gDNA_ID_1621194; Annot_ID_174674
caaaatcaggaaataacgtgtacatgtgtatatcaaccgaacaggtggaccgtagatatcgactcaacaaaaaactacttttatgagattattacaagaactgaagaacatatgattaaatctaaagactgaacaaaattctctgcttattttgcaatttccaactgtaattcatttacattattttctaaacaccatttactggctagtatcttaacaacaacaggacaaaacacaaacgtttgttttcaacaatatcaaaattataaacgaactatatacttattttcgttttttctcttttgttagctaagccaaaactacgccgtttgacgatggagggatcaacgcctgatgctcgaagggctctattactgtaaacctccagcacttctgttccacgaaaggtacgaggggtctccgagttgcctgaaaccattaatacagaagatcatttcactgtacacgttccaaaatctgaaaagtgtaataatgtcttaacaaaatgaagcatgcatgaccctgagagtgacgtaccttggcttaactagatacaatacggcaaatgtaacagccaagaacaagcaaatactgcctacagtcagataagcaatcccgaggaaatcattccttccgccgagccagctagttgttgacagcactagcttcttctgcccattgaagctgtaagtgttgtagttgttctgcaacaagaccgttatggtatcacccgcgtgtaggtctgtctcaatcttcccatacagcttcctaaacgttggcaaagccgcggttcgcatccagactatgaggtcttcttgctcactcaactatccaacagacaactcttacacttgttaaaatcctatcagaagaaggaatctaaattgatcgatattcaaggattttttaccggtttagaaatattaagagttccaccgcctattggtgctcctttctgaaaatttttagggaagacatttttcccaaacttgttttctctgtcactcttccatgagatacctttcttattcacaagaagttgttggctatttcttgaaaagctataagtatcgttgaacaaactccaagcaacaagaccacatggcacaattggttctccacccacattatcctcaggtgcacaggtcttcacatcatgctcttcttttggacttcttagttgtgcatcgtttcgacttttcacatacctaatcatatacaatcaaccagaggagtaactgtattaatgcagggaaagtaacaggcaaaagcgataactattactaagcagataaggcaaagtaccgtctatggttttggtagaaattctcaagttggtagtatacatagacaggatgcttcatagcttttgtcacctgaaaaaaatgaaaggctttagaaagagccatacctagaagaacagctaatatacacaatcatagaaggaactaaattgccatagaagaagacatgtaccgttattgttctcttacagatcttatctccttcaccctgtatgtaagcgaccatgttgtttctagaagatgttggaatacagtctgtgtcatatcgatcaacaatctcgactaccttcaagtatgaatgaaacatatcctcaataaaaccacaaaaccgaagctggaaaataaaccattagaaaaggcagaaaaacaatagcatgatgcacatactccctgagaagcaaataagcagatcactccaaggggaatgaagacaaccccagcgacaagaaatgtcaagatcacctgcaaatggccatgaacaataagaaaacagcaaaaagagtaagagtcatccttttccactattgtaacattgaacttacccatcttggagtaagaattggcttgcacgctggaagctcttgctgagtaaacctagaatctggtaaagaaaattggttccttgtgaagttaagaacagagaatccaaagcaaccatacagtttgtttaatgggagaacaatgtttaaagttttcgaacaaaagatttcaaccaatgtcacatcaaaacccaacaactaaacgtgagtttcaactacacggtgtaggacaacttgaaaaaccaagctgatgaacctatacacctcttgtatatacgaatctacatcaaacccagagtatacaagaatgctattagaaatcaaagaaacatgcaaaaacacatggtgatcgaggtatagcaacaccatcaacagagaaatttttgtcaattcaatacgaattccaggaaagaaagaaaaaaagaagacgaaatttctaaggacgatccatgactatacaaaaagttcgaccaaatcagaagattagaaggatagatagagatagaaagatcacattttggtcgcttggaggtttttttgacaccggaaatctcagacgatccgcctcctccgacggtggaagatgccgcggtggaactcatcaccgaagaaattgattagaaatgaaatctcctctacaactatattccgaatcgaatggacggcatgagtcgttttgggaagaacagatcctacgcgaatgaggggaagaatgttaggttaggcttatgaaacatatctacttggggaagatgtatagatcttttagatgaagaagcaaaactctcgacaaggaaaaaagaaagacgactttgacaaatgctgttatcatgggagggaaaaataaaataataataagccaatttttatgttattttttaaagggcaatttgggtaaagaataaaaaacggaagttttcgaacaaacccggcaaatgcggttaaactgccacgtggattacacgtcattaataattaacccactcgaatacagtcaaataacccacctgtcatttttgacggatccaattttgaagatattttacttgtaaaaaatctcttgacaacatataatttcgttgcctagtagcttcttcacagcttctgatctcactagtgttcgtcatctttgttcgattgaagtttgggaagtggtgatg

SEQ ID NO: 31955 - DNA, 3003 bp, Unknown
  misc_feature (1)..( 3003): 2750-1469P.txt file - cDNA_ID_3047671; gDNA_ID_1621194; Annot_ID_57536
agcatatatgcccattgccatacatatatgtatattcttctactatcaacataagttagacagatcaaaattggttaaatatggtaaaaatttgcacattgtctccagtaaagtgatcttctgtgacaacgaaagtatgcaactaaagtgcgaatctttatgagaaacagaaccttatatccttccacaggttaccttgcaaggattctttgaggtttttgttttggtttgtacacatgcacatgacacacacacacatacgcgatatatataaagaacgagagagcgaagagacaaatatttaacctatcttggtcctgtttctttgtcttcttactcttgagagtgtatagctaattggttttatttctcttttggtattcatcttaaaaccatggaatcatatcgagtcttcacaactatttgtcttcttctttgtctctttctctcagccaacttcttcactcattatggtaaaatcatctctgtctctttctttctttctctctatccaactctatctctaaaagcatttgatattgattatgattttcttatatagtagtagatgcaagaaaaagcgtgggatttgagagagagccaaagaaggtgatgatgatcaaagcattaaagcacacatcattgttacagaaaatgatgacacagctcaatcttgctcagcctttagactactcttcatcctccaacactcaaccttatggcgttagcacaactctcactctacctccttatgtttcacttcccccactttcagttcccggaaatgcccctcctttttgcattaatcccccaaatactcctccttcctcctcttatcctggtcttagcccacctcccggcccaatcacattacctaacccacccgactcctcctctaacccgaactccaaccccaacccacccgaatcatcctctaacccgaacccacctgattcatcctctaatccaaactcaaacccaaacccacccgttaccgtccctaatccacccgaatcatcctctaacccaaacccacctgattcatcctctaatccaaactcaaacccaaacccacccgaatcatcctctaacccaaacccacccgttaccgtccctaacccacccgaatcatcctctaacccaaacccaccagagtcatcctctaatccaaacccacccattaccattccatacccgcctgaatcctccagcccaaacccgccagaaatagttcctagccctccagaatctggttatacaccagggcccgttttaggcccaccttactctgaaccgggcccatcaacacctaccggatcaattccaagtccatcatcggggtttcttcccccaatcgtttatccgccacccatggcaccaccgtcaccgagcgtaactccgacgtcggcttactggtgcgtagctaagccctcggtccctgacccaattattcaagaagccatgaactttgcatgtgggtcaggagctgattgtcattcaattcagcctaacgggccttgctttaagcctaatacattgtgggcccatgcttcgttcgcctacaatagctattggcaacggaccaaaagtacgggtggctcgtgcacgttcggcggcactggcatgcttgtcaccgttgatccaagtaagagaaatatttgtttatcaactattatttattggtaatattcatttttttaaacaatgttattgaatggcaaacaggctttaacgggtgccattttgatttcttctgatgcatgaagacgaagacagctctcactttacattttgttggatacgaataatatcaaagaaatctagatataatatgtttaggtgggtcgctcacttgtaagttgaaaccaattaaagcttatttcttgggaatggcataattataaatcttatgctaaatacgtatattgcttttgctaatggaattaggtcttctagacttgtggtacgttgcatctacttaactactatcactaataattcctttatttatacacacatcccttttctcccacaatgatttagtagctttgaaataaagtaatatacgcattctcagtttctcaccacgacatctttttttatttatagaaaaacttctacgccggtctattatctcaaacacgtgaaatgtcaccctgctaggttttgctgttgattagcgttgttcactaattttgtactaggtattcaaaagaatcgcaactgcagatttaagtgagtatatatgaaagagtctcaacaatgtaagtgaaacagtttacgtaggaacaatgtaacttgatgtaccttattctgttatacgaaaaacattcgtacaatagaaattaatcgttacaaatgtgggttaattctaccgtgtgcagatattgcgtgagtactttaatcacttgaatattttggttcatgcattttgttcatggtgaactagcaaaaaattagttgctataaaacaatatggcctttttagtaaccaagtaattactggtctagtggcgttttgaagacatatgaactgtggtttcgaactctgtgggtgaaaaaaaaaaaaaaaattttgtattgatcagaaaaattcggcaaaatccagagacctaatgttaaatggatacaaaagaaaaaaatgaatataatgttcgttcagcatttttgttttgtattgtattctgtacctatggaaaattagtttttaaaccagaatggaacaaaaaaatcgaatatatgaaaaagtggtaaactcaaaatcggcaaaaaaataaaaacagaaaaaaggtgagaaaataggaaaaaggtaaaaaagtaaaaaaaaaaaaaaaaggaagaacccttccgatttgatttgattgggactatataaagggaactctataacatcatctctctcacaagtcgcaacgctccaacgacttcaattcaatttactttcgattttgtcctcttccaaaaacccttccgcttaaaccctaattcacttcgccggccatg

SEQ ID NO: 31956 - DNA, 3003 bp, Unknown; identical to SEQ ID NO: 31955
  misc_feature (1)..( 3003): 2750-1469P.txt file - cDNA_ID_3047671; gDNA_ID_1621194; Annot_ID_174671

SEQ ID NO: 31957 - DNA, 3000 bp, Unknown; identical to SEQ ID NO: 8121
  misc_feature (1)..( 3000): 2750-1469P.txt file - cDNA_ID_3047679; gDNA_ID_1621194; Annot_ID_174668

SEQ ID NO: 31958 - DNA, 3003 bp, Unknown; identical to SEQ ID NO: 16914
  misc_feature (1)..( 3003): 2750-1469P.txt file - cDNA_ID_3047683; gDNA_ID_1621194; Annot_ID_174666

SEQ ID NO: 31959 - DNA, 3003 bp, Unknown
  misc_feature (1)..( 3003): 2750-1469P.txt file - cDNA_ID_3047687; gDNA_ID_1621194; Annot_ID_57528
agcatggcagattctcttataaaccataaaattagtatccccggcagaagtgcaatgaaaactttcatgaagtagtggatctgcctcttctgaagaagatccacctcaactccggcgttgcaaatagtctcaaacaagtaaggatctaagggaatgtcaacctagaaataaaaaggatatgacatggtgaatgtacatcattcatttccaaatacttgcaactataatttttttacttacaatatattctagagggaaaccttctttcatggtcacatacaatctctttaggtcttccgtgaaaacaacagctgcaacctgttatgaacacatacacagattatcgtgccaacataagctaaaaaaaagatctatcatcctatcacgtccagcttcaaattaattgctttggaaaaggaatatattcatcatattttaactcataatgaatataccatcacttgttatcatttaaaaaattcaactggatataatgacacttgccactcacaatcccaaagccggacaagagtataggttagagctgtacctcagaagaatcaagcttctgaaggaagtaggtatagggaagcttagggcgatatcgccaccatctctttgatatccagagagctctagttccctcagtttcagatgtccttccaataacatcttcgcgaagacttttctctacctctttcatatcaaattcaaccacatacttcgccgctgaggagtttaactgttctgataatttttctcgttctaacatttccttccaggttgcaagcctttcccgccaattacctacactgtctccaatttcacctatcatagaagaatgcaatagaggattagatggtcaaaagcacaggttaccaatgatagtagatgagggatctagaagtgctgctctgaaagaaacttgattagtgagataagattaggtcgtcaaaaacaaaggtttcgcacaataaatcacttcttgttatatcttcagcatgccactactaaacaagtatcacctaacgaatgtatactgaccagagacacccagatcttggcttagtttcttctttgcctctgtctgaatcctagcatttctaccaattattttcttgagagatccctctgtggtctctagatcgtcatcccacgcattttctccaacataagaactatcgtggacaagtgttccatcaggcgcttcaatgaacctttttaatttcaagcctttaggtgttgctttcctccacatatttctcttgaacctgaaacactagaataagtcaggacattctacaaaatcaaataaacagaagttcttttagtcttcccactcttgacgctttagatgcctcattagctgagtatttacttgttaaaggatgataccatagtttgaatatgaaccatattttaccatgtcccagtagagaaaattacaatcggaaactgaggattaggaagcacctacttttctatatttccaggagatggctcggggatcaaagcctccataaaagactctgttaactctcttctctctcgttctacccgaggagcttggatggcaacataaactctttgacaagaaagtaacagcgcaaaagcatatatgaacaaggcagcaactcgtttaccgtcccaattcctgatgtcctgatacaatacatcttccctcattaagaaacaacctaatacactagtatatgtcgctagaataagcgtagttgtagtctcctccaaaatttatgcttccgttaaatcaacaacaaaataaataaataccatacgtttgtccctcaatgttttagaacacaagcagaagtctaacaatacttgagaatcagaaatttgataattacgttaaaaagctgaaccagcttaccttccaatgctcccacttgttccaatcaataaacgaaggcactgtctcattcttaaagcgagtcagctcgtgatggcccttgtgcacactatccttaactcgagccacatactcattcactctcccacttgcttcttccgagtcaaacccaatttctgtcttcacagattctccaatcttctccccaatccgctcggcaccaaggcgaatagactgagccaatctcacccacgaaaagcctccatcgctattagatgaagacccactactactttcagacgcatagactcgaaagagctgttttttccgggtagctcccagtccatacttggcgggaaaccgaacaagaccaaaactttttgatcttttcaacaactgagtcgatgaagagataagcggattcggtttatacgaaattgcaatctccatgaatgaaatcacaagaaaaaaattaaaaagagaacaaaaccagacgcatttgaagatttttcccgattaaagagctctctctgagaaaattactgaaggaaaatggtgagtaccaaccattcagctcactcgactctccggcaagacttacgcttctctccggtaaggaggtttatctacactgatccgtcgttgagagtgtcctaatacttcgaaggagaaagatgacgcttaaactcaaagaggctcgaagcctattagttatataattgggctagcccattaaggtccatcagcccactatccgaaaaataatatatttaaaccgtggaatccaaggagagacacagtggcaaaaagggtaattatagggacatttcttggggtgttgtccaagctgcttttatataaggaagggatattgttctctcgcttctcgaaagatccattcaccaactctttataccagcctctgtaacgttcgatcatcttgtatttcatttcaaccactcatgtaagtatattctttcttcagattccgattgttttcttcgattaagttttgagctagattctctagatctgtttcaccgatttggttgatttctccgtcaatctgaactcgcggtgtgcatcttgttgtttgcagtgtttttagtttgttttacgaagaatcaactatg

SEQ ID NO: 31960 - DNA, 3003 bp, Unknown; identical to SEQ ID NO: 31959
  misc_feature (1)..( 3003): 2750-1469P.txt file - cDNA_ID_3047687; gDNA_ID_1621194; Annot_ID_174663

SEQ ID NO: 31961 - DNA, 3000 bp, Unknown
  misc_feature (1)..( 3000): 2750-1469P.txt file - cDNA_ID_3047703; gDNA_ID_1621195; Annot_ID_174711
gttcatatatactaatgtaagcatgctggatctcgttttaatattttaataccatatatatgaattatacatgattgacaaatcaatgatttatactcaaaatgttatatggttggattcagtcaggaggacatgggtgttataatcccttatgtccggtcggatccggaataatactagtcagtcatgaagttactcctggtttacttaccaagcacaacgatttcgaactctccataattaaggtcagtttttttccaaaaactattaaagacataactctgtgtgttttaggtatttttaagtatagtatggatatgtagtgttagtgtttttttggtgagatctagtgttagggtacttgtattccattcaatatatatatcttactttttactttttcatattagatattgcaaaaacatttgcataaaaataattaaacattgataaaaatagttattaaaattaattgtaagctttttgtctataatctttgccttttctatatggattttttttttttttttgaaatccatgaggttctgggccgaaacccataatcttctcagacccaaagccaaatcatttaacattagtttcgtcccaaacgtcactcgaatcggcgacctctaagtttcgcctagggtctttaccaattgagctaacgatacttggttttctatatggattttgttgagtacaggacaaaatatacgggcattggtggcttttgatgggtaacagtagcagctcaacttggaaagaaattgggttctggccaacacataggttcaaagaaagttttggtacaggtgtcgaatggggtggtgaagtctatagccctgcgtctacaagtcctcctatgggtaatagtcattttccgaagggagccccaaaatagactcatatgtccgtttgatcacgacttgggacgaaaattatggtttggacatggttgtgaaaaacacagagagattttcaaacagttgttataaagtgaaagatgcacagagtcgttttggccagatgtaggtcatcttatcgtttatggaggccccaggtgtacataaactttgttagtgcgtagcattattccaaaattgtagtatctgaaaatgttcaaaataaatcaagagaattacgttcttactatgaataaaaatatataagaaaaacgtaaagaaatttaaagaacatctttatattctttttttgttatcttgtttgacttggttagaaaggagaagacaaaagaactatttatatgttccaaattttaaaaacatcttacttattacatcatatatcattagaaaattccactacattaccttaaagatatataatattttctatagagatatagttctagacaaactttacttggtgtgttaacactcttaagtttttctagaacttagacttagttaattttgagtttggtccaataattaaactcttgatcatgatcccgtgattaaacttaacccaaagtcaagtttgatctcactaccggattatttgaggtgaatcaaaatataacaatataccatgtaattggtaggcaaaataaccaaaatttgaaaaatcaatccgaaccgaaataaatggttttatttggttatggttttttcttaaaactcatttggttatcatttttcttaagtttttggtttaggtttggtttggttaaaaaccaaatgatttttttttgtttttgattaaaattaagaataaccatatatactaatatattgtccaatttatattatgattagagtatcattggattttttctttactagacttatatacagtgatctcttagtaatatctgattattcttatattatttttattctacgtttcattttatttatgcatcaaacttatactttttttttgtaaaatacatggaataaccttaaaacccgtacccaaaccaaaaccaaaccaaaccaagatacatatagttttttatatgatttcaatttttacaaaactgaaaacccgtcataaattgtaaaaccgaaccataaccaaacttaattacatacggtttctttatggtttcaagttttttgtaaaaccaaaaaaaacaaactgaaactaaactgaaaaactgcacgcccaccctaatactatatttaaaaataaatctcaattaaaatcaaaaattaaagaaattaaagaaacaaaatacttatgattttaaggaaaatctaagaataattatttttatttattattttcatttgtcattctgaataatcacacaattagttttatacaaacattgattatgtcacatcattttatttatagtacatttttcttattttaatttatttataaatataatttatacaataggattataaatgcaagagaaaaaaatactatcttcaatttacacatagaaatgtattacaaatacttaaaataaatttcttattttcagattttttttagaggaaaagttacaaatattatgccaagcttgtgttaagaagttagcattaaagatatgaataaatgtcatcaatatatcgatgtaaatttaagaagaaattatgtttgacttgtatggtccacaaataattatgtcatctttgacttgtgcatggtcaaaaataacaataaatctcttaaaagcattcatggaaattagtaattacttagtttaagaagaaattttgtttgacttctgtatggttcaaagatatatatactatatttaggtttgaaggaatttaaggaaacgtatatgtattaattattttttctaacccttagctaggtgtatattctactctagtgaatcattcagaaatattacatttcttgtgagaaggtgattatcccaaatgacttcttcaaatctttctcctattactatatctcaataataactgtatatatagaagaaaaactaattatcaaatttctctagttcacaggttaatgaaaatgaaattggggtgtgcacttccaatg

SEQ ID NO: 31962 - DNA, 3003 bp, Unknown
  misc_feature (1)..( 3003): 2750-1469P.txt file - cDNA_ID_3047723; gDNA_ID_2926132; Annot_ID_196997
gatagcccaacaaaaaaatcaaaatatactgaagacgaatacgacgaaggaaaataacagattaatgaatctgttcgcgtgtaaagcttaccaacattcggaagcaacatgtttttttacactttttcgtgctacttaagtattggttgtatggtttgctgaggtttaatgtatatgttcattgatacatttgtattattgatttcaaattaataaagaatgaagatgttaaataaaaaaatattgcgtaatacatttgcatatatttttttctcgaaaagtggaagcacgactctgttgcgcaagccatactcttttggcattctcttttcttaatgataagaagataagaattcgtgtcgtcttttcttttctttttcaaaagaattcgtgtaatggtctagtcacaaatccataaacaagattaggtttctgattaaaaaaatcttgtaatttttagaaataaatatctgatctcttcccaataacaatttttgtcccattagtatgtttaactcagcgatcacttaatataactcagtcgtcacttaagctaactcaaccattacagaacatatctcagtcgtcacttaatataactcagccattatagaacataactcggtcgtcacataacatatttgccaaaaaaaaagagaacataactcagcctttacagaaaaaatcaaaacattaactcagccgtaacataaatattgataaaaaacagaacataacagagccgaaaccgtacctcaccaccattcgctttaatatcttcagcaatgacctattctatagttgcacgggtacggctaccaccccatctaagcaacggaatctcatccgtgttaacaacgttcccaaaacgctcggcgatggtgatgattgactcatacgcccaagcctgcaacacgaaaaccagaccactgacggtgtacgtcttgccaataggcctcagcaactttatagaaacgacaagggcttcatatgctgcccgaccccatggataagtcttcatggcttcgtcgtcgaaaactcttttggcactctcaaatggtatcctagagttagtatgcaagccaaaaagtccaatggatagaagagtcaataacccaaaccatctacgcttttcaggaggccaagctctgcacgttactaagccctgcctaagttcatctagattatgaccttcaccggttggcacacgcaattcactgaagaacgctttgtagtcagcttcaggctcaaacttttctgtaggcagttgatctatatttaaacccgtgatatgatgaaattcgttcaatccaaaccggatgggtttaccagccacgatacaccaaagctccttcttcagtattctcagctgtctgcatagtagataatgtacggtcttaccagaccatagaaaatgactatcaacaagcttagcaattaatccaagctctgtctctttcagttctgcccatatttcttttcctattgattctctaattgcagggaactctcccagctttatattatgattaatgcctttaccctccagattagaatccccctcttggtaaagtcttggagggtactcccttgcttggtcttcagacatctgtataaccataaatcagccgtaagcattccataactcagtgataacataaaacaaactcatccacagataccataactcaggcaaaacataaatctaactcagccatagataacataactacgtcataacataaacctatctcagccacacataacataactcagccataagataaatctaactcagccatattttaacagaaactcagtcaaaccataacataacaacagctcagttaaaacataaaccagactcagctatatcaaaacagaaactcagccataacataaacaaactcagccgtcatataacagaaactcagacatcgatgtaaggttaaaccataactcagtcacaacataaaacaaactcagacacagatgaattgataaatcataaatcagtcggcaaacaaacaataactcagccgtcaaatcaaatagatcttagaaatcggccaccatatgtcaatcaacgacgacgttaaaacccagctttaaaaactatcgttacgcatcggaaaacgatttcagtgacgggaatcacttgcgattgaacttagatgtcagagtcttacttaatggaaacatactcaccggaacttagatgtcgaatgtgacttcgcgcttacggaaatgcgactgcggcgtctgaatttcggccggaacagacgagaaaagagcaaaacggcgaaagaaatcgatttcgttccgtcgagagagaaagaggaagaaagcgacagttttttttttttgggagatgatgaacagtaaagccaagaaataagaaacccaaacgttatgcggtttggagatgattaatgacgtggattatggtaatgacatggaatgatgacatgtataatcactgtttttttatttaatttttagttaaaaacgaattaaataataataattaattaaaactagttaggggtgttaattgtaattacacaattactaaaaacatctgagtaataaaaaaaagatgtgttctattttaggaataaacatacaaatgtgttttatcttaggaattatttcttaaaaaatcttgtaatttttagaaataaatatctgatctcttcccaataacaatttttgtcccattagtaccaaaaccatatttcaatttgggatttatttctataatatcaaacccgaattttgtaaaccgaaccgggacaggataatgggacaaatgagcacttgtattatcacgtgcattaatcattcaccagttttatagtagatcacagtggttcatatgtatctagacgcaaactttgaatcattcatcaacgcaatctaagtacaaatatagatctcactgcaatgtttcaagcaccaacctgatcatcatcaaaaccatttcatccgtagtggtcaatg

SEQ ID NO: 31963 - DNA, 3003 bp, Unknown; identical to SEQ ID NO: 31962
  misc_feature (1)..( 3003): 2750-1469P.txt file - cDNA_ID_3047723; gDNA_ID_1621196; Annot_ID_57574

SEQ ID NO: 31964 - DNA, 3003 bp, Unknown; identical to SEQ ID NO: 31962
  misc_feature (1)..( 3003): 2750-1469P.txt file - cDNA_ID_3047723; gDNA_ID_2926132; Annot_ID_138797

SEQ ID NO: 31965 - DNA, 3003 bp, Unknown; identical to SEQ ID NO: 31962
  misc_feature (1)..( 3003): 2750-1469P.txt file - cDNA_ID_3047723; gDNA_ID_1621196; Annot_ID_174744

SEQ ID NO: 31966 - DNA, 3003 bp, Unknown
  misc_feature (1)..( 3003): 2750-1469P.txt file - cDNA_ID_3047760; gDNA_ID_2926139; Annot_ID_197365
ttaagaaagaaataaagtgacaatgtgatctgagaatagagatcttatgggttgactttgcttcaaccgtaaggtcgcccatgctgtctctaaatgcacgtgcagctgtttgttaatataaattcacatgaagacaaaacagaagctgtctttgtccttggtacatataatagcatgtaccctttaattcctttatgactacgaatctaacaacttaatgaatgagtcttataagagtaacatttaacatactgaaattattaccctatgcactttactagttggatgatttggttggcctaatatgtaatgatcatggtcaggagaacttacagtgtgaaaaggagcacaacagccctgtctcagtgtttgagattcaacatgaggaatatgacgaaacatcagactcttctttcagtcaatgccttgacaatgtggaaagtgagtatagatttccttcattgcaatcgaagcaagttctcttcttagattttttcagacttcgaagttctgaaacatacgttatgtaaatgattttgcaggaaccaaacaaaagctcatgcaaacgattcagcggtttgagtctttggccaacattagtcctttcaatttggatgaatggggctcaatggatgaagcatcttgcatggaaggaggacaagagacagataccaagtatgatgatgatgagaattgtgatactgttgatagagagagtgaagatgaatacaatgatgaggttgaagagaaggcagcacagctatggaaccgagtcaaagaaagacacgccatttggatccacgaagaacatctgataatggactatttcagagatgaattgatgcaaaggacaaactcattccacgaaactcaacactttgagaaccaattggtatgcgaggcaaaaggatggttgcagggaaagagagaatcagagcttgaacgcggaacaagtgagcagaggagacaagcatgtgctagagaaatcgaaagacgagactggaatgagaaacagatagaggaggagcacgaagtggtggttacacagattgaggaagaactcttcagcctgttaatggacgaaactttaacaacgctctctaccaaaactgattccagtccacctgaacatcacaaaacagtaacatcaatgcttaagctttagaaattagaaagcaaaaacatttttgaataaggctttgacttaaaagctcaggtttttttagctctacttttgtaagaatgaagcaaacgaataatacaatgtatattgacctctaaaaccatatatatatatatgcctaattcatatttctgcaaaaaaagatcaatttttagaagctaaatccatgaacgagttaaaaagtgacctcattcgaaacgagcaaacaacataacagaaaataaaaaggttaaacttaagaaaatgtcattcgcaggaataattaagcagcaagcgtggattcgcgatcgcagccattgaaattaaaatccctaaatcaaagcctatctatgggtctgcgaaacaatgaagatggaattgaaaaataaaccgatagaagaaactggagaagaagaagaagaagtaaattgaaaaaaaaatggaaagaagagggaaataagttggagacgttaccggtggtctctttccaggttggtgaagaagcttccgatatgtttctcatgtttttcgctagtcactgaatttatagatgactaatggactcattatattatctcacgaagcccattgtgttttttagagtcaaggagcccaattgtttttctttttcttttgataagggaggagtccatttgttttagtctaaggtgaggaaatttgggtattcgggtcgggtttggatcgagtctttcgggttcggtttagaagtttaagactggttcgattatacgtattatttaagctataggttctcttcgggtataggttgaagaacccaataaataaccaaaattattttgggtttcaatattatttaccaaaaccttgtccagatatacccaaacatatataaaactatccataaaattataacaagttttcctttattacaataataaaaaacaagaaataaaccttgtttttaacttgttccataatccaatcattaaacaattcacaaactcaagttatcagtatatatgtcctcatatgtatatatatgttcgggtaataaaaaatactcacggatatcaatttcggttcatgtaatacctgatacctgaaattatttgagaacagaacccgggtattttacaagaagatatgataagacctcgtttgcaaatctcagtccatgaactcgatttctttttttcttaaggaacaagtttaactatccaatactgaatatacatcaattcggtactaaatgtatagtagatacgaatttcctccggaatgactcagagaacagtgagagattagtagataagatacttaacttttggggagagacctcaggacccatatgacttgaagactcacaccagctctgaagttagacgggttttgggtctccgggtcaagtttaaagaaaaaatgttaaagtagatttccctttctactttggtttgagatgagtttagaatttagttcgatgttacgaacgtgaatatatacccaaaacttgtgatgtatataaatgcttatcaatctcgaatctctctgttactgtagcgtgtaatccacgtttgaagtttttgttcgattcgataaatgttggagccaaaacagagacatcaacaaaaacatgggatcccaatgaataaatagataaactcttgtctgtctataaatagacttacatcttcaaaaaagatttgtataagtctcctccacttaagaagatatcatttgtagcttcttacaatgtcgcgaccaatccccattgaaggttaaataataaacataattttgtgtcttatctctttagtctttatacaagttcttataataattttctcttcctcacagaaatg

SEQ ID NO: 31967 - DNA, 3000 bp, Unknown
  misc_feature (1)..( 3000): 2750-1469P.txt file - cDNA_ID_3047760; gDNA_ID_1621198; Annot_ID_174795
agaaagaaataaagtgacaatgtgatctgagaatagagatcttatgggttgactttgcttcaaccgtaaggtcgcccatgctgtctctaaatgcacgtgcagctgtttgttaatataaattcacatgaagacaaaacagaagctgtctttgtccttggtacatataatagcatgtaccctttaattcctttatgactacgaatctaacaacttaatgaatgagtcttataagagtaacatttaacatactgaaattattaccctatgcactttactagttggatgatttggttggcctaatatgtaatgatcatggtcaggagaacttacagtgtgaaaaggagcacaacagccctgtctcagtgtttgagattcaacatgaggaatatgacgaaacatcagactcttctttcagtcaatgccttgacaatgtggaaagtgagtatagatttccttcattgcaatcgaagcaagttctcttcttagattttttcagacttcgaagttctgaaacatacgttatgtaaatgattttgcaggaaccaaacaaaagctcatgcaaacgattcagcggtttgagtctttggccaacattagtcctttcaatttggatgaatggggctcaatggatgaagcatcttgcatggaaggaggacaagagacagataccaagtatgatgatgatgagaattgtgatactgttgatagagagagtgaagatgaatacaatgatgaggttgaagagaaggcagcacagctatggaaccgagtcaaagaaagacacgccatttggatccacgaagaacatctgataatggactatttcagagatgaattgatgcaaaggacaaactcattccacgaaactcaacactttgagaaccaattggtatgcgaggcaaaaggatggttgcagggaaagagagaatcagagcttgaacgcggaacaagtgagcagaggagacaagcatgtgctagagaaatcgaaagacgagactggaatgagaaacagatagaggaggagcacgaagtggtggttacacagattgaggaagaactcttcagcctgttaatggacgaaactttaacaacgctctctaccaaaactgattccagtccacctgaacatcacaaaacagtaacatcaatgcttaagctttagaaattagaaagcaaaaacatttttgaataaggctttgacttaaaagctcaggtttttttagctctacttttgtaagaatgaagcaaacgaataatacaatgtatattgacctctaaaaccatatatatatatatgcctaattcatatttctgcaaaaaaagatcaatttttagaagctaaatccatgaacgagttaaaaagtgacctcattcgaaacgagcaaacaacataacagaaaataaaaaggttaaacttaagaaaatgtcattcgcaggaataattaagcagcaagcgtggattcgcgatcgcagccattgaaattaaaatccctaaatcaaagcctatctatgggtctgcgaaacaatgaagatggaattgaaaaataaaccgatagaagaaactggagaagaagaagaagaagtaaattgaaaaaaaaatggaaagaagagggaaataagttggagacgttaccggtggtctctttccaggttggtgaagaagcttccgatatgtttctcatgtttttcgctagtcactgaatttatagatgactaatggactcattatattatctcacgaagcccattgtgttttttagagtcaaggagcccaattgtttttctttttcttttgataagggaggagtccatttgttttagtctaaggtgaggaaatttgggtattcgggtcgggtttggatcgagtctttcgggttcggtttagaagtttaagactggttcgattatacgtattatttaagctataggttctcttcgggtataggttgaagaacccaataaataaccaaaattattttgggtttcaatattatttaccaaaaccttgtccagatatacccaaacatatataaaactatccataaaattataacaagttttcctttattacaataataaaaaacaagaaataaaccttgtttttaacttgttccataatccaatcattaaacaattcacaaactcaagttatcagtatatatgtcctcatatgtatatatatgttcgggtaataaaaaatactcacggatatcaatttcggttcatgtaatacctgatacctgaaattatttgagaacagaacccgggtattttacaagaagatatgataagacctcgtttgcaaatctcagtccatgaactcgatttctttttttcttaaggaacaagtttaactatccaatactgaatatacatcaattcggtactaaatgtatagtagatacgaatttcctccggaatgactcagagaacagtgagagattagtagataagatacttaacttttggggagagacctcaggacccatatgacttgaagactcacaccagctctgaagttagacgggttttgggtctccgggtcaagtttaaagaaaaaatgttaaagtagatttccctttctactttggtttgagatgagtttagaatttagttcgatgttacgaacgtgaatatatacccaaaacttgtgatgtatataaatgcttatcaatctcgaatctctctgttactgtagcgtgtaatccacgtttgaagtttttgttcgattcgataaatgttggagccaaaacagagacatcaacaaaaacatgggatcccaatgaataaatagataaactcttgtctgtctataaatagacttacatcttcaaaaaagatttgtataagtctcctccacttaagaagatatcatttgtagcttcttacaatgtcgcgaccaatccccattgaaggttaaataataaacataattttgtgtcttatctctttagtctttatacaagttcttataataattttctcttcctcacagaaatg

SEQ ID NO: 31968 - DNA, 3000 bp, Unknown; identical to SEQ ID NO: 8184
  misc_feature (1)..( 3000): 2750-1469P.txt file - cDNA_ID_3047789; gDNA_ID_1621199; Annot_ID_174840

SEQ ID NO: 31969 - DNA, 3000 bp, Unknown; identical to SEQ ID NO: 8179
  misc_feature (1)..( 3000): 2750-1469P.txt file - cDNA_ID_3047806; gDNA_ID_1621199; Annot_ID_174834

SEQ ID NO: 31970 - DNA, 3000 bp, Unknown
  misc_feature (1)..( 3000): 2750-1469P.txt file - cDNA_ID_3047831; gDNA_ID_1621199; Annot_ID_174812
gaatcgaactcatcaagcctcttccggaatcgaactctctccaatgtaaatctcgatcttgttcgatctctatttttggtggaattgagattgttaattaggtcaaaaattcgtgattgtattaggatgaagcaatgggactggtgttgagtgcagcttcggttaaaggatggacaaccggttccggtatggaaggaccgtctctaccggctaaaaccgatacagacacggtttccacatttccatggtcattattcactaaatcgcctcgtaggcgaatgcgtgttgctttcacttgtaacgtatgtgggcaaagaactacaagagctattaatcctcatgcttacactgatggcactgtcttcgtgcagtgttgtggatgtaatgtgtttcataagctggtcgataatctcaacttgtttcatgaggttaagtattatgtgagcagctcgagcttcgattacaccgatgctaagtgggatgttagcggcttgaatcttttcgatgatgaggatgatgataatgctggtgatagcaatgatgtctttcctttgtaaagaacctttctacaatatctttgttatatatctgtatatagctaccttgtcatatcatcttggtgtgaataacatttggaagtaataaattggtcatatagctcatgttctgaatttcttggggaaggtagatttggttctgagatagctctttttagtgtattatataaatgcttcttcatatgctggatttacagaaaatagatgagagcatgtatttctagatatcagaaggatcgatagaatcttcgatgatttggatacaagatccgacagattctcctttggacatagcctgcgcgagcttcgatcgagctatctcatggcgacgtagtagcagtatggtgttaaggactgaccacctcacctgcgagtccgctttcttctgtgtgaaccccaaactcttcaccaaaccatctaactgttccatcaacaccacaaaaccataaagcatatttacataatcagaagagtttttaaggggtaaaagaaaagagaccttgctgatatcgtcaaggcctccttcagcataaccatacaggagatattctgttgctacaccagccagagcaatgcatgagaatctgttcagcatctggttttggaatagcaaacacagtttcttgttaggctgaagattttaaaaaggtttagaacttttttatgggaagtataagaaaacataccgtagcggagacttttccagaattaacctgcattgtcaagttgggaaaaaagtgttagaagcttggatttgaatgagtttctgcttcttcagaggatgtgaaagaagaaagagaggttatgtacttcttcaaggaattcatagtctacaaaagctgagccagcttgaatgttgagagatccttctttctgtaaagcttcaaggctagagagcgtgtatccgcgtggtagaatcccgactaagtaggccaccaagaaatgacccgcttcgtgctgagatctcagttcacagtaagtccaatgaaaaatgatatagtgtttctaaattttttcataaagagtgatatattgaagcagagtgaagttgcaggttttacctgaacaactctgttatggtatcgttggctaaacgtatgaccagttgtatcaagaaccaaactcccaattccgccattaaaagagacctacaacattaaggacatatgaagagactatttatgtgtgtgtttcatcttaagtcagagctttgagttaccaaatccaaagtccacaggaacataaacccaagagtaagaaagaaaagctgttgagaactcaagtcaaaggctttccaagcaactattccccctgagacagctgcgatctgaaggtttctttcgatggagccaagcgttgtatctgttggcgagagaagtgaagctgcgttaataccattcagtttcagttcctccaacgtgtagagtctctgaggcacctataacaaaacacagccaaagaaggaggataaagacaagaaatgagaccactgattacaaattacagttttagtaacctaaatgctacatttcaaggacaccaagatctaaactaaacctatcatagtatcaaatcatgatgatcacgacacaaaggccaaaacatgcattagatcaatcaagtccatcaaagaaccagagaaggagattcacattgacattatgatacattagaaaggaccaagatctaagctaaacttatcaaagcataaaactgtgatcattaagacacaaaagcttagagatagatcaatcagttccaacaaagatacagagaaaggagtatcacattgacattacgagattcaattcacaattgtaacaactaataatgatataaacaacagaagacagacctgccttgcagcgccaaaacatcgaaggccatcaggttttccttggagatctttgacaagagacaatgcagctctttcgtctccactagacaacttagaatcaacttgctccaaagcttgtcttcttatggacaaacctgtttcagatgaacaaactatgcatctgtaacggtaataactatggaagagaaaagacttttgttggtttgaacatggaattagtcccacactatgtaacaacataaccattcagcaataaaggattttgtgaaactaaatctgacccagtaatggatttgcaatagtaatactgacttagattaagaattcagcaaatgggaacaaaaattggagattttagcattagggaatatcaaccacttgttctggataagaatatatttaaatttgaaatcagagtactttacctgagtttgttaaacgttaatgattttagccattgctttggaaagattccactgtgaatctaggttaaaaaaaaggacgaagatgaagaaaggtaagggttcttctcccacaaagaaatgcagatagttttagttgaaataggtgactcattgtaaaatg

SEQ ID NO: 31971 - DNA, 3000 bp, Unknown; identical to SEQ ID NO: 8210
  misc_feature (1)..( 3000): 2750-1469P.txt file - cDNA_ID_3047856; gDNA_ID_1621200; Annot_ID_57650

SEQ ID NO: 31972 - DNA, 3000 bp, Unknown; identical to SEQ ID NO: 8192
  misc_feature (1)..( 3000): 2750-1469P.txt file - cDNA_ID_3047856; gDNA_ID_1621200; Annot_ID_174883

SEQ ID NO: 31973 - DNA, 3003 bp, Unknown; identical to SEQ ID NO: 17064
  misc_feature (1)..( 3003): 2750-1469P.txt file - cDNA_ID_3047871; gDNA_ID_1621200; Annot_ID_174871

SEQ ID NO: 31974 - DNA, 3003 bp, Unknown; identical to SEQ ID NO: 17686
  misc_feature (1)..( 3003): 2750-1469P.txt file - cDNA_ID_3047875; gDNA_ID_1621200; Annot_ID_174869

SEQ ID NO: 31975 - DNA, 3003 bp, Unknown; identical to SEQ ID NO: 17009
  misc_feature (1)..( 3003): 2750-1469P.txt file - cDNA_ID_3047879; gDNA_ID_1621200; Annot_ID_174868

SEQ ID NO: 31976 - DNA, 3003 bp, Unknown
  misc_feature (1)..( 3003): 2750-1469P.txt file - cDNA_ID_3047883; gDNA_ID_1621200; Annot_ID_174867
gcaggagcttgaaaagatagtcgctgcaaatcccaaaacgctaattaaaccctaggaaccacccggagaatcaaatatataacagaggtaatttcgacccaagtatgtgtcgatggagaaaggaacttactactcaggattcatggttttcgatctgtgggaggaagagcagcgagcgatacagagccagagatctctctctctcttttctgattttctctcgcgatttacaagaggaggagattcagtgtttgggccttgaataataatatgagcgaaggcccaataatgcaaaagattaaaattcattcttctttcacaagtttagggttcctacgatccactcagcaacgaaaatggatcaagcccgacagagtccagaggagcggaggcccaataacgccaagattaaaattcattcttctttcacaagtttagggttgtaaattggcccttcctacgatccactcagcaattggagattgttttgtggttcccagatgttggatctatactagtcttcttgattcatttttccaattgttgcttgctttttgattgacatctatattttaagttgggagatatactctaactctttctggaggaggaggttaaaacaaggtaaggcttggactcgggtcccatcttccagtagaagctctctctccagttgatgccttgtcgatttcagcaccgtctgccaaacaaacacaaatttacttacactcagtctctgaagactgagttgatctcttaaagtcaaagctatatggaggagaaaggctacgttaaaatccatgtaaaaaaaaaaaaaaaaaaatccatgtaggaatcccgcattgtgagccacttatcatccatcaccttgaacgcaatgcaatatcgaatatcaaatgcggactcgttttctaacaataaattatacaccatccaattgtcaatatatatggcttcgcgtttatctctcttaacccaaagctgctgtaactaactaactaaccagctactaatgtttccccgaccatcttaaaaggtaactaactaactagctgatgctagttggtgcctgagcaggggtgagatcaaaggaataacgagagtggtgatcccttttctgtgcacaaacacaagccagtccccgccctaaccatgcacctgatcctgccacaagatgaaatatgcatgtgactctctgcaacacactacaacaaggtaaaggagactagtgcgtgcttaacctgaggatgaatggcaggtgcgtcctctgtctaggctgtgagtaatccgcctgacactgacaaatgaatcctccattgttcttcccgattcataaaaagctactcttgatatcttcaatgcaaaaccagatttacgggttttggaggagcagtttgaatggtccgagggcgtttttttagaatggaaacaatcctaattatcgactaatccagctagtttttgatactttgtattttagatagatcacattccttagtttaaattggcttgagggaaaagaaacatgcatcatatgtagatgtacattagggagagtgaatgatttgtgataagaaaacagcaagtatatggtttttagaagataggttgtggttcatgaaaggttcttcacatgggatgttgacacaaaaaaggaccaaaagttgaggtagaacatcttacatacccactttcacccaaatccaacaaaaaaaaaaaacagagaaccagagacataaaaacaaccaaacttcagtcacaaagtcctcatgttcccaacaaattcatcgcgtcttgacatgtcacaaactgattttcttctctagataggcttgattttgaagtgcagagagatgagcgaaaaaacaagacatttcaagtcctgcaaccatgaaagtttcaaaaggaatatgttagagcacaaataaatacagaaactaaaaaaaaaaaaactacagaaccatgtaagggatgagtgttaacagccaaaccctaaatgttaaagtttgagacagtgaatacgttaaaaggcagagtcctaaatatataatcgagtccaatagagttaagggattaggtaaaagaaaagatggtaaggcaaggggtggaagaaaaagagaggagacctgaacaagatagtagaagatgcgaagtccttcaggatcattactgctctggcaatcaacaagagatccaatcttagatgtagcgaatgagatatgctcattacccaagacgatctcgagctcttgctttccaacacggtcaggttccggccaattgttatcgtcttctttcagaatctacccgcagacaaataatcacatgtcaggttgtacaaaatcatccattattcctagataatagcattaacaacgaagagggttctaaacctacaacactagtcaggaaagatgccctagatcgacaaaaatcgaagcaaaatcactaaaaccctaattggctattatagcgtcgattgaccaaaacgcggacaattaacaagagagaagcaaatcggaagagagagagaaaaaggacctcgctctcggagacgatacgcttgcattccttgagcacggcgggggtgagaaatacctccttgcggataatagtatcgttcttgtagttagagttattggcgtaacggagcttaccgtcctctctaaactcgaactccaggaactcgtgtccaaatttccctttgtgaccgacatagtatctcaggtagaactccgtcgcttcttccgcggccatgccttctctttttttctttctttctcgagatcgagattacctctccgtgtcctttgcccttctttaagtccgtccccgcaaaagaaaaaaggtaatgggcttacatattgggccagaacccatttgtaacccgaaaagttaaggcccagttttagtttttctgtttccatcgaaattgtgtgtgtatccgggctgcctgatttccgattccccgatacagagacgatgccgacggattcgaaaatg

SEQ ID NO: 31977 - DNA, 3003 bp, Unknown
  misc_feature (1)..( 3003): 2750-1469P.txt file - cDNA_ID_3047890; gDNA_ID_1621200; Annot_ID_174863
aaagaaacctcacctcggtcaagaaacgctctgaaatctgaactctgaaggttgtttttcttcttctttcggtggtgaaaaaattatctttatgaaaagacaaaaaagtttttgaaaaaaggaaatttttttcaaaaaaacagactgagagagagagagagagagtgtgttgttggccatgggatgcacggcctccaagctcgacagtgaggatgctgtccgtcgctgcaaggagcggcgccgtcttatgaaggacgccgtctacgctcgtcaccatctcgccgccgctcactctgactactgccgctcccttcgtctcactggctctgccctctcctccttcgccgccggcgagcccctctccgtctccgagaatactcccgctgtttttctccgcccttcctccagtcaggacgcgccacgtgtcccttcttcccattccccagaaccccctcctccgcccatccgcagcaagcctaagcctactaggcctaggaggcttccacacattctctccgactcctctccttcttcctctcctgccaccagtttctatcccactgctcaccagaactctacttactctcgctctccatctcaagcttcctctgtctggaactgggagaatttctaccctccctctccccccgactccgagtacttcgaacgcaaagctcgccagaaccacaagcaccgtcctccttccgactacgacgccgaaactgaaagatccgaccacgattactgccactcacggagagatgccgccgaggaagttcactgcagcgagtggggcgacgaccacgaccgtttcactgccacctcttcgtccgacggagatggggaggtcgaaactcacgtttccagatccggtattgaagaagagcctgtgaaacaaccacatcaagacccaaatggcaaagagcactctgaccatgttaccacttcttccgactgctacaagaccaaattggtggtaaggcacaagaatttgaaggagatccttgacgccgttcaagactacttcgacaaggctgcctccgctggggaccaggtctccgccatgcttgagatcggccgggctgagctcgaccgcagcttcagcaagctgaggagtaagtctcacactctactaactagatgtagatgatgatgcattgaaacccatctcattctcttactctctctatatttgttgtctgcagagacggtgtatcattcaagcagtgtgttcagcaacttgagcgcaagctggacctcaaaacccccattggcagtcaaatacaagctcgatgcatctaccctgaatgatgaacaaggcggcctcaagagcctctgctccactctagaccgactcctcgcttgggaaaagaagctttatgaggatgtcaaggtacattccctgtttttgttttcggttttcggcttaccaacggttacgaaataaacttgtgaattcgaatttaggcaagagaaggagttaagattgagcacgagaagaagctgtctgcgctgcagagtcaggagtataagggaggtgatgaatccaagctagacaagactaaaacttccataaccagactgcaatcactcatcattgtttcttcagaagctgttttaaccacgtctaatgccattctccgcctccgggacactgaccttgtccctcagcttgttgaactctgccacgggtcagtcttttttttgtagttgtgtttgtgtttcattgttccttgagggctgctggttcggtctaggcttgtttatatgcttctgcaaactcatgtgaacccgaattaggcatatgtaataccaaacccattgctgttctgccagtgggggattttataggtaagttcgaaataaaagtagggaggatttgtatgtgtctctaaccaccttgaaatgcagattaatgtacatgtggaagtcaatgcacgagtatcacgaaatccagaacaacatcgtgcaacaagtccgtggcctgatcaaccaaacagagagaggtgagtcaacatcagaggtacaccggcaggtgacgcgggacctagagtcagctgtgtccttgtggcattcgagcttctgtcgcatcattaaattccagagggagttcatatgctctctccacgcatggttcaagctgagcctggttcccctgagcaacggagacccaaagaaacagcggccagactcatttgccttgtgcgaggagtggaagcagagcctggaacgggtgcctgacacagtggcgtcagaagccataaagagctttgtaaacgtggtacatgtgatatcaataaagcaggcggaagaggtgaagatgaagaaacgcacggagagtgcaggaaaggagctggagaagaaagcatcctcactgaggagcatagagaggaagtactaccaggcatactcgacggttgggataggccctggaccggaggtgttggactcacgggacccgctatctgagaagaaatgtgagctggcggcatgtcagaggcaggtggaggatgaggtaatgaggcacgtgaaggctgtggaggtgacacgagctatgactctcaacaatctacaaaccggcctgcccaatgtattccaggccttgaccagcttctcatctctcttcactgaatctctccagactgtctgttctcgttcctactccatcaactgattatgtccaagtttctcatttatttttaagctctcattacgttggtatcatgtaaatttgaggattgattaaattgagtcttgtggttttgtgaggactcacaatctttctcatttaatacatgagcagacacggcacctaactaatggcccaaaggtggcccgccaaattgaatacaagggtaagaaatgggccaagaaagtgagagcccaaaagaggccgatcgttcgtttttgactcaatggccgttgacgttgacatcgtacgccgcacccaacgaccgccaaacagcaaacaacaacactttcccctttctctctctaaacatg

SEQ ID NO: 31978 - DNA, 3003 bp, Unknown; identical to SEQ ID NO: 17678
  misc_feature (1)..( 3003): 2750-1469P.txt file - cDNA_ID_3047894; gDNA_ID_1621200; Annot_ID_174861

SEQ ID NO: 31979 - DNA, 3000 bp, Unknown; identical to SEQ ID NO: 8205
  misc_feature (1)..( 3000): 2750-1469P.txt file - cDNA_ID_3047902; gDNA_ID_1621200; Annot_ID_174852

SEQ ID NO: 31980 - DNA, 3003 bp, Unknown; identical to SEQ ID NO: 17041
  misc_feature (1)..( 3003): 2750-1469P.txt file - cDNA_ID_3047926; gDNA_ID_1621201; Annot_ID_174925

SEQ ID NO: 31981 - DNA, 3000 bp, Unknown; identical to SEQ ID NO: 8216
  misc_feature (1)..( 3000): 2750-1469P.txt file - cDNA_ID_3047930; gDNA_ID_1621201; Annot_ID_57666

SEQ ID NO: 31982 - DNA, 3000 bp, Unknown; identical to SEQ ID NO: 8216
  misc_feature (1)..( 3000): 2750-1469P.txt file - cDNA_ID_3047930; gDNA_ID_1621201; Annot_ID_174912

SEQ ID NO: 31983 - DNA, 3003 bp, Unknown
  misc_feature (1)..( 3003): 2750-1469P.txt file - cDNA_ID_3047934; gDNA_ID_1621201; Annot_ID_174911
tctacctcctcatctcggcctcaagacttcaatctaaaaactctattcatgcatacttctcatcttctgatcaagatcaatctcagagcccgacaaaaatcgagcacatcgtctttgggataggctcaagcgcgatctcgtggcgtgcacgtagagaatacgttaagctttggtgggatgctcagaaaatgagaggctgcgtctttgttgagcgtcccttgccgtcttctcaaaaccacacagattcatatctccttcctccggtttgtgtttcccaagatacttcccggttcaggtaatttagttcaatttgtttattgttttttagtcagaaaaaagtttcaacttctgtttcatcataaattaaaaataagtatagtttgcgatttattagtttaacgtctattaaagatttaaagtataggatatataaatttaaaatattgaattgtgacatttttttgtaattttatatatgaaaacaatttaaagacagaaattaattagttgatattcctactttattccttaatcaatttaacttgcaaattagggtacagttaaatcgaatcggcctaatgagacaagcgtctacaggtacacttggagaggcggtgacagaaacgcgatccgaatcgcgcggtgcgttctagaaactgtcaggctattcaacacctcctcagaagaagtaagatggtacgtatttggagacgacgacacgattttcattcctgaaaacctcgctcgaactctctccaaatacgaccacacatcatggtattacataggatcaacctcggagatttatcaccagaactctatgttcggacacgacatggcgttcgggggtggtgggtacgctttaagcagctcattggctaatgttttagctagaaatttcgattcttgtatcgaacgatatccacatttgtacggaggagactctagggtttatgcttgtgtgcttgagcttggggttggattgtctaaagagcctggcttccatcaggttttaaagtctatatgtacgtaattaatagttattagtaaaaaaaaaaactgattagagatatttgtttttatttttgaagcagtttgatgtgagaggaaatgcattgggaatattgacatcacattcaacgagaccgttggtgtcactacaccacatggctcacattgacccaatctttccaaactcaaccactttctccgcggtccgccaccttttctccgccgtacaactcgaccctctccgtatttttcaactatccgtttgctacgaccgttggtactcttggaccatctccgtctcttggggatatactgttcaggttaatacttttttacccttttttgttcaggactccaataacgtaatgttattaattcaaaatttaaatgtttgtttcaattgttagattgatggcaggcatttgtttctacgggatgttttgcgggcacaagagacgttccgaccatggcaaaaatcaggcggattagcaagtgtttacacattcaacacaagagagattcatcgtgatccttgccaacgacctgtcactttctacatgcaacatgtttcttctagtagccatgatggaaccattaaaagtgtttataagcaagcttacgagaattgcacctacgatcctgttacatcgcctcgcaaaattcatgagattagagtgttttcaagaagactcgatcccaatatcagacaagtacttcattctatcttttctatttttttatttttttttaaataacaaaatataggatagattagtagaattttttggccatagtgaaaatcttttttttttttttgacagcaaagtccattagagaaaatcattttctagattagtatatatttgttaaaatatcaattactatggtttctttacgtatagatacttcctttcgattttcgtatagaccaacaaaattaggaatattggggttagtagtggtcaaagttgctatattgagtgaactttttaaagtagcaccctaaaaatatagtatttcgtaagaaaatttgcttcttacttattagatttaagtttgttttatcataacaaaataaatgttttgaatgcggtagttgaaggctcccagaaggcagtgttgtgatatattaccaacttcttcaactggtggcaacataatggaaattggactgcgagagtgcaaagaggatgagctcatctatattcatccctaatttcaccgtaactaattatattatacctttacaatattgccatccattaattttgaacctaaaaatagtttttttttctttcctttttgtaaatttaacattaagttgttaattggctggttgcctttcaacatttggagcatttgagattactttgtgacaaaaaactgaacatgacatgaatataatctagggtggaccttcactgaaattgatgaaaatgacattatacttaaaattaggctacctaccaaattcaccctagatttaatatatttctattggttacatctttactttaagatataaaaactaagaatgataatttacttctattacaagctaagaatcctagatatctcagtcgctcacttttgcagttgattccctttacgattagcgtgctacaatcgtatcaagtcacattcacacactcttgtttattttgttcaaaaaatgaagaagaacaaaatagtaaaccgaaaataatgctatttgaaatataaatgcgaccgtattgatgcgggccaaatacaaatccggttaaaccagttaaagcgaaattggaaagtaataggaagtgattaaggtaaattaattaagtagtattaattagcgtaacattagctgggggattagacgactttgccaccgttgttaataccttccttgccttctttctttcgttaccatttgcgtgatccctatcttctttatcttcgccctccggattcttcaatattactaaatctgccatcatctcctcgatttcgatg

SEQ ID NO: 31984 - DNA, 3003 bp, Unknown; identical to SEQ ID NO: 17701
  misc_feature (1)..( 3003): 2750-1469P.txt file - cDNA_ID_3047941; gDNA_ID_1621201; Annot_ID_174901

SEQ ID NO: 31985 - DNA, 3000 bp, Unknown; identical to SEQ ID NO: 8224
  misc_feature (1)..( 3000): 2750-1469P.txt file - cDNA_ID_3047945; gDNA_ID_1621201; Annot_ID_174899

SEQ ID NO: 31986 - DNA, 3000 bp, Unknown
  misc_feature (1)..( 3000): 2750-1469P.txt file - cDNA_ID_3047973; gDNA_ID_1621202; Annot_ID_174969
cctaatggggcaacgatttttaaagtatataaaataaataaaatcttggaagtttttgttataatgaaagttaagtttcgatgatacggctaagtaaggtattttttgaagagcaagaaagagtgatggcccaacacatctttaattcaatcgggacctctcaaacctaactccttttatcttattcttatgcatctacctatcttccctagatagtttccaatataaatcacacctaactattgtcatttatatccgataattgagatcccatttatgatttgagtaactcgatgggaacttcttcaagtttgaaaacgatattacatgaatacatccaatgtaaaagttgtcacgaaatgttccaaagtcataatgaatgtatggactgagtaattttacggtctcggattttgaaagaagagttcatcaatgtacatgtttttagatcacaactcttaattactttcgatattagttagttattttttttaccttccgattaagatgttagatccaaagatgtatccgttaggtcacgagcttctcatgtatggaccaaagtacatgtgatatgtatgcactagtaagccccaacaattaatgaaacacatgtctttaatgggacgctttacacatccagtgaagcctcttttgaattgttgtaagatctaggtgtgtgatatgatgttggaacaaaagcataattaaagtcactattatcaaaaactttgatacacgaataattatgtatatgaaccgaaagataaatcaatatatagttcaaaatgcatgaaaccttttctttacaacaaattaaattatagtggttcctttaaggaaagatgaagtttctaggtaaggcaccctttaagattcttacaatggttgtagtagtttcttcttttcttttgaaatgttgatatcacatgaataacaccaacaccaactttaagttgaatcaaataagaagagaagaaaaagaaagaaagtgagaaccaaagttattcaaagagaaaagaaaaggataccatacaacaaagtcaaggtgcaatgtcacttgctcttcaatcaaagacgaaaccacaattcaagatttcattttttttttaatggtaagacaaagacatcatatatttttaatagtacatatgatcaaatgtaacaggcacctattacttaatgtctcgttaatgtgttgaaataaacctccttaatgttggtcgtctcgtataatatataacaaattcgaatggagatcaatattgaaatttgaaagaaaccaaacacgtatttaagttgtgcatcatggccactcttttactttacaaagtctactttttttttaattggactttgtaacacaaattaagatggtggaaacttaaaagcttttagaggacaaaggcataatgttttcactttttattgtgtaggaaagaaaatataacaaagcaccaaaaatatgtaaagaagaaggaaaaaaatagagtaaaagagacataaattaaagtaggaattaattcttgtgtgttactttctatcttatatcatcttcaataagaacatgtctccatctttctttcttcacctcttggttctcttaattttatacatctcaggatggatacttcaacttttagtttattttgtttagattcaattcgaggataatggagccaatccaatttatccagtttataagaacaaaactttatctttatcttttattttccatagtattgttctttatttatttatgaaaattgagtataatttgaaaaacaattgaattttatcaggaaataataaaattatcaacattgtttatttactgaaataaatggtttctactaaatttgttagaaatagtttatctttttttggttattagaagaaaaaaaaaaggtccaagaaagggtcaaacagaagtagccaggatgtttcaccacgtggcaccacatggcgccaaactcgtacgaaatagtagtaaaaacagtgttacaaaaaaaggaaaaaagtaagattttacccattttaacggtccgtacaaaagacagtatgtgggtcccaaggaaaagtgttcgccacgctggaatgcttacatggcaatgcgtaggactcttccggaactttttacacgtgtcatattctcattgcatatatcgtcaaaacaaaattaacttctatctttttacggtgatgaatgtcctaaactacccctgtaatggcggtaaattcacagtctaactgttctaacaccatttaattggtacggtgaagttaaaagaaaaaaaccgaatccgagcgttactcctaatagtatgaccagattacaaaagaagcgattcaataacttttccgccaatttcgatacaagttaccacttcaaaattttgtaataataactgaaaatatttgtgtgtttcaaaatcaccacaataaccgatactacaatcaaacaaggattgcaattcaaagcattaggcaacaaaattaccaaaaaaaagtgaattcatatatttatgattgactttgagaaagtgtgtaaagcaaatgagaaaatttaccaaaaagataaatataggcaaaaaatcaaagatatatcaaaccataagaaacatggtaagttaattaaaaaatttccagtatgtaaataaaaatagatttacctttgaacaaattaaagatatgaaaattccaaaaaatgggtaattaatactatttgtttgtccctaaaaataaaatctctcttcacgttagtcgcatcgatgtgtataaataggaaacaaccatttggttgaggttcgtttcgatttggtcttccctcaccaaataaaaaagaaaagagaaaaaaaaagcaaagccatccttcacgcacatcaaagcaccaaaaacaaaaaccgaaacgcatgcatttctaattttctatcttctttttaacttcctcttctcccaccattttcatcatcttcttctctctaaacctctccttcaatg

SEQ ID NO: 31987 - DNA, 3003 bp, Unknown; identical to SEQ ID NO: 17703
  misc_feature (1)..( 3003): 2750-1469P.txt file - cDNA_ID_3047980; gDNA_ID_1621202; Annot_ID_174991

SEQ ID NO: 31988 - DNA, 3000 bp, Unknown; identical to SEQ ID NO: 8255
  misc_feature (1)..( 3000): 2750-1469P.txt file - cDNA_ID_3047988; gDNA_ID_1621202; Annot_ID_174988

SEQ ID NO: 31989 - DNA, 3003 bp, Unknown
  misc_feature (1)..( 3003): 2750-1469P.txt file - cDNA_ID_3047995; gDNA_ID_1621202; Annot_ID_174984
aatcgcagtgaagaaggaaggaacctaaatcggaatttgggtgctccatcaatggcttcgattttggctcgcaggtcactgaatactctccgtgctcgacatctcgtatgaatcttgttcgctcttgttatttcttcattttgtgtcctttagttagagttatttgaatgcctagaaatgggaatgtctcctggagttttgggagcttaagatgattctattcactctctgtgttttgttttgtgtcgacgagattctggattttatctagctgatcgatgaaatcatgtagggagatttgaatttgatcatggttcatcttaagggctttcgttttacttatggtttccttattctttttcgcatttaatttttgtgacgaaagccttttcgcaagtcaatttttttttgtttttttttgcgagctttaatcctttcattagcttgatatggtgtgtatgttctgaatacctctctgattacttctcgacattgataggttttgtcagggcaagctttacagggatctcatctgtctagactgcagtcccgtggtatatcttatggcagcaacaaaggtatattttctgctcttgtttggttttctttggtaaatcaggtttaattgtgaatctaccccttttccaacttgtattacgagattctgattcatatatgacttatggtttgcgtatgtaatattcagatgatgaagaagcagagcaactttctaaggaaatctccaaggactggaatactggtaatccatatgatctagacaattttactttttttctcctttcttcttttcttgtacgtctatcttccttggtgttttcctccccgagtattagtgattcctgatattctcaaatttgtagtctttgaacggagcataaacaccctgttcctcacagaaatggtccgcggtttgtcgctgaccctcaagtacttctttgatccaaaagttactgtgagtgatatcttttctagtcttccaaacttagattgaaagaaatctgtgttactgaagctctttcgtgtatgcagatcaattatccatttgagaagggtcctctgagccctcgcttccgtggtgaacatgctcttcgaagatatcctaccggggaagaacgctgcattgcctgcaaactctgtgaagctgtgagttttgagatcgatatgaatccttcatttaatttaacgttctctttgttctgatatggtactctgagtctatcaaattcatcttagtaattaggaaagctatttgagtatgagtaatatttactgtttagtctctagagttctgatgaaatggtcatattagctgacaatgatctatttagtgtgtataaaagttcaccacggattgtaattcttgtgagggatacttgtccttttcatcaggtatgtccagctcaagcaatcacaatagaggcagaagagagggaagatggaagccgcagaaccactaggtcatcatccctttagttctcatttatcaaccatctgctttctttattaccctttcatgatgatttgagctgtatcgtacaggtacgatatcgacatgacaaaatgcatctactgtggtttctgccaagaagcttgccccgttgatgcaatcgttgaaggacctaactttgaattcgcaaccgagacacacgaggtctgtttttcacattttctagaccctaataattttcgaggcatgcttattgaaatttttgttatattctctatgataggaacttctctatgacaaagagaagcttcttgagaatggagatcgatgggagacagagattgctgagaatctgaggtcggagagtctctaccgctgaaccattctacaacagtctctgcttcattcaacttgtttttcccggggaaacattttcgttgcttctgtttgaaaataaagacgagatcatatgcgtgtgaaaactcttttgtaatccagattttgtgctgtgtaattgaattgtttgtaaccaacctgactttgattttcggttcatgagttccggttattaggtgttttcggttcggagaaagagcatttaatttggtcaaagactgaaaacagataagtcttaagctacaagggtatatctgtacattaagaaatatttgatcggacggacaagatcatgtcttttttttttttacggcggacggacaggatcatatgcttatagtttatcctaatctgtccgatctaaacataatgcttgtcgattttttcatttatttgccttttggttgcgccaattatcgtattcagacagcaaaattaatattttaatgtgtattttttgttgagttactattttagaaaaacaacgaatccctagaaaggaaagaaaaaaaaaaacaaaatccccaaatcgagcgagtccaaagaaaaatcccaaattcgacgaacctacaagcccagaacatcccccgatttgggaaaacctgaattcattcgcttttgatttgccatcttctttctgggatttgtctactgcttgatcctaatttctgacctcgcttttggtttgagttcacacgtgccgcatcggctgttcaccggctttgtttcattgtgcagactccaatcatcgtacaatctgtagcaaccggttggtctccgtcaaatttctccactttgttgccaaattttactcctttttgtatcaattcaaagattgggggtgaatttttagggtttatcattttgttcatttttggtaactattttggggtttaattacttctttagttgatactatgattgatactatctcccaattaatatgagatcaaattgtgacaatttcagttctctgattacaccaagtttttttagcaggacattctctaaggtgctaaatcaggagatgaaatttggatactgtgacttctggaggagaggaaagttatgcagtgtttgttactgttaattaccagaagaactaggacaaggcgacggagactgaagaggtagctatg

SEQ ID NO: 31990 - DNA, 3003 bp, Unknown
  misc_feature (1)..( 3003): 2750-1469P.txt file - cDNA_ID_3048004; gDNA_ID_1621202; Annot_ID_174972
ttcactttcaccaccaaatcaagaattggttaatcagtttgaatcaaaagtatagattagacagcaggttattgtgttgttcttaaaagtaacttacacatatccatcactacaggagccctacttcaagtccctacctttgactagaccgatcagtcacattcgtacgatctaagcagagtaaatgcgagcatgagtctcatatggtcacttcacactttctttatcaggtcttgcgaggtggcggtagttgctactgctgctactgttgctgctgctccttttcattcctctcaaaggcctacgcgtagcaaaatcccacaaggtgattcttttcgctctttaatcagatttgaaagcaaaacattgataggaaattttctagtttggtggaatgatcatccacgttattgtatcttgcgtttgatcgcaaacttatgaactagtagatccaagataacaatgacaacacgattttaaaatgcgtttctatattaggcactgataaaagttgtgatatcagactggaaaacaccaattgcaaaaagatatctagtcaaaagacaaggcctaatgtgaaagtttcactgaatgcttttaagtttcaacaaagaagcatagcagatgaaggggttaaactcaatgttcctacactttactaaaccgggaccttctttttagatccccatgtgttcacacagtaaaatagcttgaccataaaacactatgagaagtatagtgattgtagaacagtcttactggtttgaactgtggctccttgatatcttcctaggagcctattagttgacactagctagaacgtcaacacataacacaacaagggcatctctttatttctttagctgaaaaggggtctgcaacaagccataacttatggggccttggggaactagagtaggaagatgaccttctacgctgccagttaaacatcttcccctgttcagaaccaaagaggagattacagttttaagttttaactataactgagtatgattacaatggacaaacactactcggtaaggagctacaatagcagaatttacatactagatcttggcaattcgataccaaaggccattaagtcatagttgactaaagtttattggagctggtagaccatacgtttctaaatcaaaataacacaaagcaggatcttggatcatacttatgaactaggagtctaatatgtaccgtagtagctgtgcaatcacaacagataatcaaatctaacactgacaaatatacaaaggtttaaccattacctgcggggtgatatcgaccttgaacgcgaacgagcatgctattgcctacaaattggttatcggccacgtctgcggtctgcggattggataccttcttcttggaagggacctgcatgtgtgcattcaagaaataatccatcaaatgaaaactaatacaatgtaggcagaacatctataaaattgaaacactaatgcattgagttgcatacactataaataaattgatctcatcctctaattactacaatgcagctctttaaacacaaatttatcgtcacctaagaggagaacgtcttagagcaggactgccacggatccttcgagggtaaccctccagctgacagataaaaggtgagacagtgaactgaaatggtattgaacctcagacgaggaaactgaaaccgttttggaggagaacggccgctagaagaggacactggcctgcgtatgggtgatccaccactcataggcagaggtgattatcatatttctcaatgtcagtaccaacattatcagattttaaagcatctccctttggatcacttgaaacatacaccatccatgtacagctgtggtttctcagcatcagctatttttgccttgaattcaacatatgcatctcctcttgaaagattagcctgttaatgtcaatcgaaattatgagtaaagtacttaggaaacaaatctgcaaaccagccaagagcaattgataagaaacttacagctcgatctatcgcaagttgaacatgaatgatttcaccaaaatcgcctgcacataaggaaaaaaggaacatcactgaaattggatttaagcgatataacaacattcgagcattgatttgacaatttaaatgtgtaattgtaatgagtccacttcgtataagataaccaaattaccaaatccaatctctaattaatcaaattggagaagaataagaagaagacgacgatgatcttgaactggagcgggagcgtgagcgggaaatagaccacgaaagactcgaatcttcgccatggccagattcagattctagcgcgcttgtaaggttaaccccagacccaaccctaacggctacctgtcgatttacacacaaacacacacgagtccgcacgtgacaagtcatgggttgggtaagttaactataatgaacgacaaataaataattaaacttactaaagcaaattatagtttgacaaaaatagtcttaattttcagattattagttggatatgcatagtttattcaacttttctcttaatatttttattacatgattttttttatttttggagatttatcagttttttttgttttaataatagtttttagataatttggaaaagcaatgatctctgcatcatcaatcataaaaattaaaaaaataaggcctcgtcgctatatcttctctctagggttcgctgttgctttttcatcttcttcttctccttctctgtttctctgctttcgtcacgaaagggcgatatgtattgtttctcagtaggaagctcgttactctgattcgattcgattctcaatcctttcatcaaaccgttttgggacttcggattttcatattaaggtagcgtatccgcttagggatccaattttctccgagaattgtctccttctacaatctgattctcctcgatttttccagttttcaaagcagtcaattagggtttgtagactaattcggatttggagacggtagcggttatg

SEQ ID NO: 31991 - DNA, 3000 bp, Unknown; identical to SEQ ID NO: 8247
  misc_feature (1)..( 3000): 2750-1469P.txt file - cDNA_ID_3048018; gDNA_ID_1621202; Annot_ID_174960

SEQ ID NO: 31992 - DNA, 3003 bp, Unknown
  misc_feature (1)..( 3003): 2750-1469P.txt file - cDNA_ID_3048022; gDNA_ID_1621202; Annot_ID_174956
attgatccttgtcacgcggtttcttaggatcttttgtcccttctattccaaatttttaattcctatgccgtttttttcttctatataagcggtaaatatcatctctattggttgcagatcgtcgaggcaccggaattgctccgataaatctctcattcttctctgtcatcgatttaggtttcgtctgatttctcttgttacatctgttttatctaaccacaattacctctgttctatttcgtctctgctaattgaaggatgtggttgatctgtcgtcgctcccttttactttctggcggtttcttctttccctttgcttcctttttggagttcttagattacctgatttcttttcttttctgaatttctggagaaatttctacgtgttagattgtgtagatgttgaaggcattgttggagggaggatggtttacgtatgagttggtgtttttggtttcttctcttctatacaacttttggtctaattattgttttatttaatattggctaatgttggtgaggtatgatttcgttctctgtgtcttgttgtgttttccagattctcttcatcaatcaattcagtctgtttctcttctgtgtacacattcagatgaaagatgaacatatattccttgcagacgagttttttcctatctcttgtcctttttataagtagttattctattgaagtcttcaagtttctcagtaatgctatgtcttagctcctctcatgtggtttattcaggttttgttcctctttgcctccgggatctgttgcaatctatttgttctaacatacgccctggttaactggtctattcctctttctctctatttatagtgtttgatcctactctcttatgcttgtgacggtgtttttttttatgttaagtgtcccattcttttaggttttttgaagatgcaaagaaggctagttctgtctcagtgtattctgaaagatatctttgatctgtcgtggttcctgttacctttctggcggtgtcttatctccctttgttttctttttaaggtttttaatttccctattacctgatgtttttgtcgttttaaatcgtagaggtcaaggcattgttggagggaaggatggtatgagtttaattttgtgtttctggttacttctcatctacacacttttttccccctaattgttttatctaatattggctattattgtcagtgaggtatgatttgtcctctgtgtcttatgtttcccagaattttcttcaccaatcacttcactacgtttctctgctgtgtacacacttgaaagatgatcatatattccttccaaacgagtttgttcttataccttgtccttttaagtagtttttgtactgagcattttcaaatatcttaggatatctatctctgagctcctctgatggagaaggcttggcctgaggtctggactgtaccatcagggagttctcaacatgacttgatttttgatttttcaggttaaaggtagattttcgtagcgatgttggcatttctgttttaagcctaaggccctgtcttttgttatagatattcaagcttataaaagggaaaaggttcaggtttactaaatggattctttcccctttatctctgttggtgttatctctcatgctacatctatattagtgatggcttgtttttatgtatgtcaagtgctccgctcccctatataggtatgttgaggatgcaaaggtggcaagttctactttgatctatttttctcgaaattttcatctacagtcctcttttcattggagatgtctctatttctggttctatgctctgcattttcctatggtttaaatgctaatcacttcggctcgagatctactctttctacatgaattcattatcttcatataggaatttggatgatgctaggacgattctgtttcgacctgttcgcctagatttattggcaacgagggatggatgtaatcagcttttcttcccttatctgttttccctttctggttatgtaatctgcatcttctctatggtaatctcttctgcttcagatgaaatcattatcttcacataggagtttgtcttcacataggagtttggatgttgcagtggaagttctgtttcggcctgcttgcctacatcgccctatatctgttacatcatgagtttatgaggtggcttatttctattgatatctatagtgttgattgccgaggaaggaaaaacaagtttcaaccgtggaccgtggttgtctcaacagggatgaacttggaggttccatctctggttggattcaggtgttttgagctaatcttcttctgggtttacttctctaccatactttctaccgatttgaagatttgtcttctgtacctttgatgatgattctcagttttgcagcaatgactcagtttttcgccttctagtcattaaactactttcccacaatgagatacttagtgtttttgtaggttctttcacacttgttagcaagggtatatgtatgttgccgttctcagaatttggtaggtatgaatcacagatgtcattgtttattattgataacataagtgattcttgctggtagtgtgacctcttgagggcaggctcatagaagatgaagagcctcttggttttgatgataatgctccctacttctgagttctgaggtttctttattcctgggttgtagctggtttaatggttctgtagacatttgataatgaagtctctcacttcattttgtttgggtgatgtaaaatgttgtcagtggattttaggtgaggcttaatctcatggattattcttttgaaatcccctcaggtgaatcagtgaaaattgagaaagtgatgttcaacttcttatctcttaatccttcatttgctctgtcacacattgaagcctattttcggttgcagtttgttaagttttcatgggaagcgttgtctttggagtgttctgaagttgactttaatcctgaaagaagaaggatatgcttttactgaagttatcatg

SEQ ID NO: 31993 - DNA, 3000 bp, Unknown; identical to SEQ ID NO: 8267
  misc_feature (1)..( 3000): 2750-1469P.txt file - cDNA_ID_3048031; gDNA_ID_1621202; Annot_ID_174949

SEQ ID NO: 31994 - DNA, 3003 bp, Unknown
  misc_feature (1)..( 3003): 2750-1469P.txt file - cDNA_ID_3048035; gDNA_ID_1621202; Annot_ID_174948
tctttctactgacatacctttggtccagacgggttgacaattctgggaccagcaacatgatagaggaaagccaagcagttatttctaaggttcctgctggtgtgtcaggaactgcactagcagcttcactcttacgtgatggatggagtgtgagttttagtcttagtatacacttccagtttacagtgtttcaactctgtttgtggtgtatatatcactctttttatcttgcagctggccaaaatttatgagaagtatcaggaggctgttgatgccatgaggcatgagcaattaggtagaaaggaagctgagatgatacttcaacgggtatgatctatttaacttgttattaccaggtctttgtttaaaatttagatttccaatcttttccacttttgttttgtctatattctctatgtttcactagtgatttttcaactgcagttcactaatgacttgagaataatatttttcttctcctgttaacttactcttggtatcctgctttgtaggtgttatccgaattagaagagaaagccggatttatccaagaagaaagaggtatgatctacttctgtgcttctggagccatatgttttacgctcccaaagatttctttcactagtaatatatttgtatcttgttggagacacgcttaaatctgtttttgttcccaggggagtatgagagggtggttgaagcttattgtctagttaatcaaaaactccaggattctgtatctgaacaatcaaatatggagaagttcattatggagctaaaggtacctgatattgttatagtggttgttcaagatgcgttcttgtgctgttcttatacatttatcttattgataggctgacttgaggagacgggaacgtgaaaacacactattgcagaaagatatatctgacctacagaaacaggtaatttgatgatctattcttcgctgttcagtgttcaccatgtttgttgtggtcttcagtttcttgattaccttaacttgcaatgttaattgttgagactttgtctcactaatgtatgcctggttgttgcccaatcgattgatactgtgtttgtttctactatttaggttacgatactactgaaggaatgtcgtgacgtccaacttcgatgtggagctgccagggatgatgatgaagatgattatcctctgctctctgatgtggagatggaaatggaatctgaagctgataaaatcatttctgagcatcttgtaagtttgtttctttatctcgacgtcatgttttgtgttagattttattttgtaaaataaattgtggatgactaatgcttgtcctcatgttgggatgaatttcagctaaagttcaaagatataaatggactagttgagcagaatgttaagctgagaaaccttgttcgtagtctttcagagcagattgaaagtagggaaacagagctgaaggtatgaaggattttgcatgcatagtttctttggtagggtgtgaagttttaaaagaatttgtgtaacgtcaggaaacgtttgaggtagacctgaagaataagactgatgaagcttctgccaaggtagctaccgtgctaaaaagagctgaagagcagggacaaatgattgaatccctgcacacatctgtaagtatttccaccctccaaatcttttctctatcgcagcacttggtaaattgatgttgggtttcttttcaacggtttatttattttgtacatttttcgtccttttcaggttgcaatgtataagcggttatatgaagaggaacagaaacttcattcatctgattctcgttcttcagatttgtctccaggttctacttctatgcattattacgagtttactgcactatgtgttcttagataccctctattattgacctcatggctaagtttaattgaattaaatgatgtttcagttttatcttagaaccagttcttttcaaaattttaccccaaatgtcatcaaggtttagtgctgttctcaaattcaaacgaaatctatatttggaacagctaccaaagtttggtcttattttcgtatatctcaattgtcagtaatgaaaattaatgctgtacgcacaaattttgaagtgtattctggcttttcaagcataatccactttcctggaaatctcatcttgtttccttaaagtaaagaggtttgcaggctgttacatgctttgctcataaaattgaatcatagtctcagtggcactctagcttttcgaatgggtgacagagatgtattcttgtagctgtagtgccaggaaggaagaacttcttacatctgcttgaggattcagaggtatgacagattgctaaatcattctattctcttctttgttgtccacttttctagggtatcaaatttgttgtttggaactcaccttattggctgaattgcttgttccaggaagctactaaaagagcccaagaaaaagcttttgaacgcatccggattctcgaagaagattttgcgaaggctaggtatatttatcatcctcttgtcttttgtctttcatttcttactgggcaagtgattatttttgtgcaaaaagttttgtttgataaactagggtacctctgggtatgtaacacattttctagttggatagtcaagttgagagctaggacccagactatactagcgaaggaaataaagtgtggaaagcgtagtatctagtgtgaaacgtgtttgcagatgcaggtggattgctgaaaatactaatctgagcttatgtgtttgcaatcccagtgtcgatgtcctatagaagttataatcgtacgtcttgatacatagagaaacaacatgaaaaactggattgtatcttatgcagcatatccatgaaacgtaaactgtagttattgatttttgtcattgtttcctgtaaatttattttactgaacattataaactgcgttgttttcatctttcccctttggatttttaggagtgaagtaattgcaataaggtctgaacgggataagttggcgatg

SEQ ID NO: 31995 - DNA, 3003 bp, Unknown; identical to SEQ ID NO: 17714
  misc_feature (1)..( 3003): 2750-1469P.txt file - cDNA_ID_3048039; gDNA_ID_1621202; Annot_ID_174947

SEQ ID NO: 31996 - DNA, 3003 bp, Unknown
  misc_feature (1)..( 3003): 2750-1469P.txt file - cDNA_ID_3048044; gDNA_ID_1621202; Annot_ID_174940
tccttacccacaaacgattcatagtaacgtcaggctcattatccacagaataatcacaccaatgtcatcactatctaaattagaaaatgtaatatcaaacaaaattggggaatcgaaattggttaaattaacagaatttgcactggtctgattatttatactctgattattaatataacacagaaaagcattactctttttcttacacgcgtttatgttttcaaaaagaaatatttatccgattacaacaattatatggagtcataacactgtaaacaatttgtacaccacatttttagaaaataaaaatttaacttgattacaacgtggaaaagtcaacactttccgagctttccttttataaaaggaggacggaagactcgccgtctcaaatgcttccacaaaacaaaacaaaacaaacaagaaatcccaacaaacaaacaaacaaaaaaagagagaaaaagaaaaaagagaggtgaaaactcgtgcaacatggcagaaccaactcagccgcttctgaccgattccaactcgtcatcaccgagatctctcgacgacacaatcgagagttacattggaagctttgggtgggctcagtttcttcaagcggctttagtctcattctccggtgttttcgacgctcaacaaactttcatctctgtgtttacagactccgaacccacgtggcactgcaccgactcgaactcgatctgccatgaatccatctccaacatctgtatcctccccaaaaccgcatggtcttgggattactctcctcacgtctctgttatatccgaatggggtctccaatgcgccggctctttcgtcaagggcttaccggagagttctttcttcgtcggatgtttaatcggaggtttggttctctcaacacttgctgattcttccttgggtcgtaaaaacatgttgtttctgtcctgtctcgttatggcgatatcaacgatgctaacggttttctcaccaaacatttgggtttacgctgttcttcgattcgttaatggatttggtcgagcgacgatagggacatgtgcgctcgttctttcgacggaattagttgggaagaaatggcgaggacgagtagggataatgagtttcttcggattcatgcttggctttttgtctcttcctttgatggcttacatgaacagaggaagttcttggaggattctctacgcatggacttcgattccaacgataatatactgcgttcttgttcggtttttcgtttgtgagtctccaaggtggcttttcgttagaggccgtagagaagaagctatttcgattctcaaaagggttgcttcgattccgtctactgatgtaagcagtggtggtgcaatatctatgagtttttcgagcttaccttttgaagaagatgaagagaagcctagtactaatgttaacatcttcacgaccatgaaggtgttggtagagaaaagatgggcgcttaagagattatccgcggtaatggccattgcgttcgggattggtttggtctattacgggatgcctttagcgttatcgaatcttgatttcaacatctatttaagtgcagcgtttaatgcgttgatggatttaccagcgaacctcatcacgcttttcctagtcgataaactcagtaggagaaacgcgcttatcggatttacggctttaggtggagtctctagcgttctcatatttgcgttacataatatgagaattggaaaccacggggcgttacagttggcgttagagctaatctcttactttagcgcgtgttcggcttttaacatggagatgatatacacgatcgagctgtttccgacatgtgtgagaaactcggctatcgcaatggctagacaggctttggtgcttggtggagttttcagccctattatggtagcagctggtcggaaaaacgcgttctggtcgttcggattgtttggtcttgctataggtttgttgggattgtttgcagttggattgccagagactagagggagtgatctatgtgacactatggacgaggaagagtgcaaagaccggcggagtaaagtcgccgttaataatgtcattgcatgaaatggtgaagaatttgaaaacacatgtgaaattaatgtagatttaatttagtatttatcacttgattacattaagacttaccacatatctttttttttggttagttgaaaagtgtttctaagaatgagccatcaaagcaccactctgatgaaacaatctcattttacagtttacacctataacacatggatttcttgaataacaaaataattcaaatttgtctcgtttggatattgatgccgatggttaaacgtttggctgtttgatttttgttagagataattgtgtttctgttctaattttcacacgttgtgtgaaaatgaatcgttccaatcccaagaaagtatattcattggggttgttggtagttggctgtttggtaattgaatgggaagaacaaaccagacagaaatttgtacacttcttggtagatatgtttaaaaggtttaatttacaaataggcccatctatcagcccttttgtaacccttttaggcccaactaagtggtctcaaagttcacaaacccaaaacttatgtggatttattattttaagcccacacaaactaacgaacggtgagctggcaagtcacgtgatgacacgtgatccatcaacccatcacttaccattaccccaaccggtacggaagtggttttgtatcttcctacttcgactcctcttgggtaattataattagttttagatgaaccaaacaatcccaaaataatattagaaaaagggaagaaaatctgaaaccaaaaaaaacgagaagggagtcgaagaagaacctttcgcgctctgacgaaattcattacttacactggatttatactttttttgtcttcctctctcaattatctccttcaacgccacaagatcctaaggcctctcacggatctctcttaagatcaatcgccgcggctcatg

SEQ ID NO: 31997 - DNA, 3003 bp, Unknown
  misc_feature (1)..( 3003): 2750-1469P.txt file - cDNA_ID_3048048; gDNA_ID_1621202; Annot_ID_174939
gttttgtcttggactcatctttgttgtataggttatgaacatacgcgaggaggttgtcggattctaagtttctaactttgagtaacaagtttaaagcctttgtagacattaactccgacgacatcactttcttcatcttcatttgtctctctccatactcgtcgaacactaccccattgtacctaccagttttgtaacgtttttacacatggtaatacacaaactcttatacacagtttgcaacatatacgaaacatatatgttaacaaataacagtatttttgtttagtcgagctaagagaactataagcttttctaggaattgctttataatttgaactaattttcaagtgaacatttcagctttgttatcaaattcaaaattacccaattaccccaaaaaaaaaaaaaaaaatcaacattacccgccactaatgtactcggcagagtaagaatctggcctgtccgcaaaaactgcgtctttctctcgaacgacttctcgggcaatcacatcggacgttatgacaatgacgtggacacgaccaaaccggaagcaagctatatccgtcttcatatcgttcattacacgaactatccatttagaggttggtcggttcttgagcattcctactaagttcccaatgatcggaaatccccgtgggcatggaggcagtttcttacgacgaccaagaaaacgggcgacaacgctttttatgagaaacacaatattcagagtgatcgaaaatgtgacaacaactgagaagataacattattcagataataatccattacctctgctcagttggaatatgtaagtaaaagtgtttctcttatattccaatgatatacaaagagagctatatatacaagatgagccttggagattctaggtataagctaactgtaaaatgttccttaaacagagtaatgagatattgagacataattgagaaatcactgtcatatctctaaacagaatacacatatgtaaaaaatgcattatatctgtacaatcttctatatacgttttttttttttttggtaagaatcttctatatatgttaaatagatcttttgtatgatatatgataattatgtaaaatctaaaaatttggagataagtatgtgatttttaaagaatgattactggttgattgatttggagataagtatgctatttttcataaatcaaggtatcaataacatctttacaatattttatttttacaatcggtctatataaaaatataaaattccgtatatcttctattgggcccaaacaaactttgttctcagcccataaattccatcatggcccaacaagtattaaggtcagactaggaagatgccagcagggaaggagtgggcacgtgtcccacatcattaatttgtactattccgatcatttattgggaatttatccttagcccacaccaacgaaaacaaagtaaaccaaacagtactacatcacatttacattgaagaatatacctgaccatataaagaaggaaaacattcaattttcactgtcacgtgaccttctaaatgacgtgttctcttcatctttcatgttgttgtgttcgttgttgcttttaaatactgtatgcatgtatgtagtgcaactagcgaagtactaacttcgaacaaaaaaataatattcttttgcaaaattatgaacatggaattacatttacttcatcctatttttgttaacttgttttatcgattttcttttagtatacatgtatagttttttttattcgaactctagattgattctaatagagatcaggaccaaagctaaccagtgcgctaatcaactcgggatatatcgtattgtttagttcagcagaatcgctattcttgtttacttttttttgcatctcgacattgtcgagtctctgcctcgatcaaagtgtgaatatttgatattgatatgatttgtcttaccagttgccacgttaccatcgtgattaatgattaatactacttttaatcatatcaaatggttttttctcacaacaaaagagacaagtgaagataataatattatttgtatggccacgattcatcgatcaaacgggattagtcagtagatttgattttgctttggacaaaaagtagaactgagaatcggcgaactcttgttttatttattttattatagaacaataggtaaatatgtaaatatcttcaatgcctacttacgtttatattatacgtaataatatattatagtcaacattcaaaagccttgttttagaaattttagccaaatacccgttattatacacttgaatttaaacgtagattattctggaggcggctcttaaactaattatctggaggctctggattaatttattttcttaaattcgtggatattttagatactattaccatcagtcttgtatatatatatatagagaaagcgatgatgataaaagtataaaactattgactccaaaaagagaaaaaatttttaaaaaatgaattagatgttttcatccttacccacaaacgattcatagtaacgtcaggctcattatccacagaataatcacaccaatgtcatcactatctaaattagaaaatgtaatatcaaacaaaattggggaatcgaaattggttaaattaacagaatttgcactggtctgattatttatactctgattattaatataacacagaaaagcattactctttttcttacacgcgtttatgttttcaaaaagaaatatttatccgattacaacaattatatggagtcataacactgtaaacaatttgtacaccacatttttagaaaataaaaatttaacttgattacaacgtggaaaagtcaacactttccgagctttccttttataaaaggaggacggaagactcgccgtctcaaatgcttccacaaaacaaaacaaaacaaacaagaaatcccaacaaacaaacaaacaaaaaaagagagaaaaagaaaaaagagaggtgaaaactcgtgcaacatg

SEQ ID NO: 31998 - DNA, 850 bp, Unknown; identical to SEQ ID NO: 2
  misc_feature (1)..( 850): 2750-1469P.txt file - cDNA_ID_3048054; gDNA_ID_104; Annot_ID_143898

SEQ ID NO: 31999 - DNA, 3000 bp, Unknown; identical to SEQ ID NO: 6232
  misc_feature (1)..( 3000): 2750-1469P.txt file - cDNA_ID_3048061; gDNA_ID_1621084; Annot_ID_170464

SEQ ID NO: 32000 - DNA, 3000 bp, Unknown; identical to SEQ ID NO: 6239
  misc_feature (1)..( 3000): 2750-1469P.txt file - cDNA_ID_3048083; gDNA_ID_1621084; Annot_ID_170469

SEQ ID NO: 32001 - DNA, 3000 bp, Unknown; identical to SEQ ID NO: 6233
  misc_feature (1)..( 3000): 2750-1469P.txt file - cDNA_ID_3048091; gDNA_ID_1621084; Annot_ID_170461

SEQ ID NO: 32002 - DNA, 3003 bp, Unknown; identical to SEQ ID NO: 17282
  misc_feature (1)..( 3003): 2750-1469P.txt file - cDNA_ID_3048111; gDNA_ID_1621085; Annot_ID_170513

SEQ ID NO: 32003 - DNA, 3003 bp, Unknown; identical to SEQ ID NO: 17282
  misc_feature (1)..( 3003): 2750-1469P.txt file - cDNA_ID_3048111; gDNA_ID_2926183; Annot_ID_200390

SEQ ID NO: 32004 - DNA, 3003 bp, Unknown; identical to SEQ ID NO: 17737
  misc_feature (1)..( 3003): 2750-1469P.txt file - cDNA_ID_3048120; gDNA_ID_1621085; Annot_ID_170494

SEQ ID NO: 32005 - DNA, 3003 bp, Unknown; identical to SEQ ID NO: 17737
  misc_feature (1)..( 3003): 2750-1469P.txt file - cDNA_ID_3048120; gDNA_ID_2926172; Annot_ID_199593

SEQ ID NO: 32006 - DNA, 3003 bp, Unknown; identical to SEQ ID NO: 17737
  misc_feature (1)..( 3003): 2750-1469P.txt file - cDNA_ID_3048124; gDNA_ID_1621086; Annot_ID_170528

SEQ ID NO: 32007 - DNA, 3000 bp, Unknown
  misc_feature (1)..( 3000): 2750-1469P.txt file - cDNA_ID_3048148; gDNA_ID_1621088; Annot_ID_170562
atatacatattttcatataacttgagaattactcgagtcatatcattgtggtacagtggtaccgtacgagtagtaaaggtatagctcctaaaatttcaaatttgaattgtggtttaagtataatcgaatacaatgcaaattgcaaagttgtattagtttgaagttaagcattagagattccagaatatagttaaaagtgtaaagagggattttaaattaaatgacggaaacaaaaagtactttagttactttgtacctgaaggttgatgtagtcatgtaacacaaattttgcatacattaaagtgtaaaactaattcaaagaaattgactaatttcatccacaaatttctttctcgattaggctttttggatattgaaaagataaaaccaaataatcttgaggtgtagaaagattgactcgattttcagatcggtttggttttggtttaggcaaattctttaaccgttcaactggaatccattacatcagatcaccaacagcaacaaaacacaaaatttgaaaagccgtcaagttcttacatgatccatgcctactccgatagaaaaatggaaaagaaaaaaaagatcttccatttgtttagccttagagtacgtacatgcagcaaaagcatagtttctcttctgaaacttcttctctcactcaagcttgaatcttacgacgctgtctcagtcttccaccaatactatttgggtttggttcagcagacatctttcgcttgcttcttgtttctcggttctctttgtttgcagagttagccatcctctcagtttcactgcactgagcctcaagatcgatgatcacaggagttgctggatccacctctttcacatctaatggcttgagatcaccatcagtcactgaagtttggttgttcccagacgacaagaagcataatgactttctagctgaatccggattcttgtttgagccatcatcatcatcgagattttcgtcaatttgattgtcctgaatcccatcagttatgagaaggagatgatctccttctgaagcttgactatctgcaggagcatcagtttcatcatcctcacttgtttctgactgttggttggtttgaatcagataatgtgcaacagacttatacccgagtttatgtatctgagaacaaaagaaattcaaagggaaagccattaacttttgaatctatccaaggactcaaaatcagaattttcaccatggatcatactaatcgaaatagctaccttcctgtaagctgcaccagttgggagccaccctttttttgtacgacagaaactgcagttgcagatatcgcgacagactggacaaatccagtccggattttccagagcttcaagaacatgttctccatatctgttcaatcaccaaaacataacctaaaacattcagttccaatcctcattttgctgagcaaagcaagctactcaattcccagttgattctcacaaaaggaattactcaaaaacacagaaacaaagaaggttggaggctaatgtacctcatgtataaacaatctccacagaattgacctcgaacagaatggttacactggctgcattgggtatgataacctagcgtcttctgcctgtaaaatccacagtaaccattaaacacattagcctcaatcctaaccgaatcaaactacatcttcagagataaagccaagtgtacaaacctgcactggtggcaacactttcctctaacagggtcataaatccgtttcccatttttgtcacaaccatcaacaaaaagctcccaagttcgttctgtgttacctaacagtttctcatgctcctcagtgtaaatctctggccttacgccttctcctacccacaaaacaatctcttctttagacactttacccttcttcagttcaggttcctctgcgtaggaaactggtgtagcgttcttcaatctaaagaccacaacagagaaggcaataaaaatcattactttctattaaaaatcctagcttcctgttaaacccttgattttgaacagaatccaaagaacgaaacgagaaccacagagattgaatacgaagagattacctcgaggatctccgagaaactggcggctcctgcttcaatctgattataaaacagcgaaatgatttctctaaaaaccctagatttctctaaaacccctaattttggaagattgaagcaatgtgaacaaaatcgagagaagtcagtgactgaaaacgaagagattaccttgaggatcgtctagaggagacggaaagctgaataggagatgtttctcgacccggattggcattagagttaccgtaacgccttttggcgggtcggatctcggatttgagtttgagagagagatccatgattccgagattcttcatcctctgaagattctccttgatcctgtcttctctgcatttctcgtagatcgagacgtttgagtttcctcctccgactgttggattagggtttgtgacgggaatcgaacatttcgctctcgttctcaccacaggcattgtgagagattgatgaactgattttggattcaaagttccaatctttccctctttctctctttggatctctggataagaagaagaaatgaaagatttttttttaactttttaagtgagtgaagcggaacagcaacggtctggtttttttactctttttaaaattcaaaacatttttcacctttttaggtaaatgtgcttaatttgccaactaatgaaaacgttgattggtttgtcaaatggaaatcatatttattatctatcatacatctgtaaatttatttttcttaaagggcctttaggctttaataacggcccataaaaaatcccaaattgtactacgaagaagaataagccgccattctttatctttccattccttcctggagattacgcattaatatatttagatcttaggtcttattagcttctttattcgcacttttttttttcctctactcgaagcttaacgatcgtaacaatcatg

SEQ ID NO: 32008 - DNA, 3003 bp, Unknown
  misc_feature (1)..( 3003): 2750-1469P.txt file - cDNA_ID_3048148; gDNA_ID_2926212; Annot_ID_202716
taaatatacatattttcatataacttgagaattactcgagtcatatcattgtggtacagtggtaccgtacgagtagtaaaggtatagctcctaaaatttcaaatttgaattgtggtttaagtataatcgaatacaatgcaaattgcaaagttgtattagtttgaagttaagcattagagattccagaatatagttaaaagtgtaaagagggattttaaattaaatgacggaaacaaaaagtactttagttactttgtacctgaaggttgatgtagtcatgtaacacaaattttgcatacattaaagtgtaaaactaattcaaagaaattgactaatttcatccacaaatttctttctcgattaggctttttggatattgaaaagataaaaccaaataatcttgaggtgtagaaagattgactcgattttcagatcggtttggttttggtttaggcaaattctttaaccgttcaactggaatccattacatcagatcaccaacagcaacaaaacacaaaatttgaaaagccgtcaagttcttacatgatccatgcctactccgatagaaaaatggaaaagaaaaaaaagatcttccatttgtttagccttagagtacgtacatgcagcaaaagcatagtttctcttctgaaacttcttctctcactcaagcttgaatcttacgacgctgtctcagtcttccaccaatactatttgggtttggttcagcagacatctttcgcttgcttcttgtttctcggttctctttgtttgcagagttagccatcctctcagtttcactgcactgagcctcaagatcgatgatcacaggagttgctggatccacctctttcacatctaatggcttgagatcaccatcagtcactgaagtttggttgttcccagacgacaagaagcataatgactttctagctgaatccggattcttgtttgagccatcatcatcatcgagattttcgtcaatttgattgtcctgaatcccatcagttatgagaaggagatgatctccttctgaagcttgactatctgcaggagcatcagtttcatcatcctcacttgtttctgactgttggttggtttgaatcagataatgtgcaacagacttatacccgagtttatgtatctgagaacaaaagaaattcaaagggaaagccattaacttttgaatctatccaaggactcaaaatcagaattttcaccatggatcatactaatcgaaatagctaccttcctgtaagctgcaccagttgggagccaccctttttttgtacgacagaaactgcagttgcagatatcgcgacagactggacaaatccagtccggattttccagagcttcaagaacatgttctccatatctgttcaatcaccaaaacataacctaaaacattcagttccaatcctcattttgctgagcaaagcaagctactcaattcccagttgattctcacaaaaggaattactcaaaaacacagaaacaaagaaggttggaggctaatgtacctcatgtataaacaatctccacagaattgacctcgaacagaatggttacactggctgcattgggtatgataacctagcgtcttctgcctgtaaaatccacagtaaccattaaacacattagcctcaatcctaaccgaatcaaactacatcttcagagataaagccaagtgtacaaacctgcactggtggcaacactttcctctaacagggtcataaatccgtttcccatttttgtcacaaccatcaacaaaaagctcccaagttcgttctgtgttacctaacagtttctcatgctcctcagtgtaaatctctggccttacgccttctcctacccacaaaacaatctcttctttagacactttacccttcttcagttcaggttcctctgcgtaggaaactggtgtagcgttcttcaatctaaagaccacaacagagaaggcaataaaaatcattactttctattaaaaatcctagcttcctgttaaacccttgattttgaacagaatccaaagaacgaaacgagaaccacagagattgaatacgaagagattacctcgaggatctccgagaaactggcggctcctgcttcaatctgattataaaacagcgaaatgatttctctaaaaaccctagatttctctaaaacccctaattttggaagattgaagcaatgtgaacaaaatcgagagaagtcagtgactgaaaacgaagagattaccttgaggatcgtctagaggagacggaaagctgaataggagatgtttctcgacccggattggcattagagttaccgtaacgccttttggcgggtcggatctcggatttgagtttgagagagagatccatgattccgagattcttcatcctctgaagattctccttgatcctgtcttctctgcatttctcgtagatcgagacgtttgagtttcctcctccgactgttggattagggtttgtgacgggaatcgaacatttcgctctcgttctcaccacaggcattgtgagagattgatgaactgattttggattcaaagttccaatctttccctctttctctctttggatctctggataagaagaagaaatgaaagatttttttttaactttttaagtgagtgaagcggaacagcaacggtctggtttttttactctttttaaaattcaaaacatttttcacctttttaggtaaatgtgcttaatttgccaactaatgaaaacgttgattggtttgtcaaatggaaatcatatttattatctatcatacatctgtaaatttatttttcttaaagggcctttaggctttaataacggcccataaaaaatcccaaattgtactacgaagaagaataagccgccattctttatctttccattccttcctggagattacgcattaatatatttagatcttaggtcttattagcttctttattcgcacttttttttttcctctactcgaagcttaacgatcgtaacaatcatg

SEQ ID NO: 32009 - DNA, 3000 bp, Unknown; identical to SEQ ID NO: 6287
  misc_feature (1)..( 3000): 2750-1469P.txt file - cDNA_ID_3048164; gDNA_ID_1621088; Annot_ID_170538

SEQ ID NO: 32010 - DNA, 980 bp, Unknown; identical to SEQ ID NO: 6306
  misc_feature (1)..( 980): 2750-1469P.txt file - cDNA_ID_3048168; gDNA_ID_1621088; Annot_ID_170536

SEQ ID NO: 32011 - DNA, 3003 bp, Unknown
  misc_feature (1)..( 3003): 2750-1469P.txt file - cDNA_ID_3048179; gDNA_ID_1621089; Annot_ID_170645
gattttacaagtttggagttccacctaaaatgttgttgatcattgtagattagcagagttgaatatatgcattcaagggggtttcttcaccgtgacatcaaacctgacaatttcttgatgggacttggtcgcaaagcaaaccaggtgcttgtttttatgttctttctgttggtagattgtttcccacaaataacgttatgttagattccatcctcttctttttagtttactgttggtatggtactatggttatgaacatgagttcttgcttttttttttctttccatcgaatatttgttcatttggatgtctaatagtgtaagaaacagaatttcttagctgacctggatactaaattatgttctgaataatgtgtatctaggtgtatatcattgattttgggcttgcaaagaagtatagggatctccaaacacataggcatatcccctataggtgatttatggtgctttcatgttcctgtttatctacttcttttattttgttttaacttaaattcttacagatactcatgttgttttctttgcagagaaaacaagaaccttacgggcacagctcggtatgctagtgtcaacactcacctaggagttggtaagcaatacatagaaccactcgagaatttgctccaaagtcatatatacaattcctaaaatgtgtggatgtttgcatatctgttggcagagcaaagtaggagggatgatctggagtctcttggttacgtactcatgtatttcctgagaggaaggtttgtgcatacagatccgtttttgtctgactaaatctttggacatgtttgttctggtctaacttttctggattttcgggttcagcttaccgtggcagggactaaaagctggcacaaagaagcaaaagtatgacagaattagcgagaagaaagtatcaactcctatagaggtaaagacataatatggcttagataccattgactgaagttagatcagccatctcattgtcacataaatgaagggttaattgttctaccatactttaacaggtcttgtgcaagtcatatccacccgaattcgtatcatactttcaatactgcagatctctgcgattcgaagacaaaccagactactcatatctaaagagacttttccgagacttgtttatccgtgaaggtttgcatttgctctgttttggttattttttccctaagggacttcacagtacagttctgtgttgtgacattttgttataccaatgctttttttttatgcctggaattgctttttatctttgattgccctcactagttactgtcaaattttctagatattgaaatcttccttgatatttctataaatgtttcactcttttaacgaatggattcgcggtatcaggttatcagtttgattatgtattcgactggactgcattgaaacaccctcagagtagtgccaggtcccattccagtacacatgaaagggtgagtacacatgtctgtagatttttctatcgagtatgactatacatactcactttcgtttcgtattgatctcttcttcagcatcgtaccggtaaaccagggatgggtgcgggaccgtctgctgaaaaacctgaaaggatttcaggtaacccttgacttttttctacagttaagaatcatataactcttcttcgctaaacggtggtcggttctgattttgtgatcctgtctatgtcttacagtagggaacatccgcgataaattctcaggtgcggtcgaagcatttgcgagaaggaacgttagaggacccagtccccatcaaaaccataccagacatcgaactcttgacgaaattccttcaatgaaacctgctgtggtaaaaaataatatcatcatcttatatatatcaaaattttgatatattgttattacattatagaacgtgcttagtgattttaacacttttcaagaaatcaatcttgctcgttcttgatatatcaatttatttgatattgtcagaatatggtatctgagaaaggaagaaacacttccagatacggcagtgcttcgaggagagcagtagcctcaggaagtagaccaagctcatcaggtgaacaaagggagagccgggactcgagccgcgtagcctcaagcggtggcggtgtccgaccatcagtcttccaaagaacccaagcagcagctgctgtgagtggatacgagtcaaagacagcatctgcctttaaccgcgaccgagtagccgcttcaagaacagcacgagacgaggctctcagaagcttcgagcttctttcgatccgcaaatgaagccttcatcaattggctctttgctgtaaattggattcttctttacatatgttgtttggtcctttgtttccacgaaactcccaatttttcatgtattatcaaattctctggattttgtatcaatttttacacactttattgtaatcatgacaatttgttgagtttaattcaatgttacagttttaattttgtgttacatatgaatttatacctttaaattcgacgacgtcgtttccaagtgtataacgtgtacgccaactatcgtcgtttgaaaccgtcaagtttaacggcagcctccgtcggtgaccttgtcgtgacgcagggccttttcctcgctccaacatttaaattctctgaatttcgattgatcaatacggagtacgaagcacgaagatcgatttagcattctagttcatgatgttgaatccgacaaggtacaaacttgattgcttaaaggttatgtttttgccggaactgggacaatgtttagattgtattctcataagtctggtacttcctttaaaattggagtttttgtttgttggagaaacttgacttttagctacataagatttttaagggtcaattttgattgttgttagttgttttgatgaatttgtacagggatgatagtctataataggtttgctctgaatctggattgacccagagaaaaaaaagtgaagctttgtatgatttgttgtggatttatg

SEQ ID NO: 32012 - DNA, 3000 bp, Unknown; identical to SEQ ID NO: 6338
  misc_feature (1)..( 3000): 2750-1469P.txt file - cDNA_ID_3048184; gDNA_ID_1621089; Annot_ID_170632

SEQ ID NO: 32013 - DNA, 3003 bp, Unknown
  misc_feature (1)..( 3003): 2750-1469P.txt file - cDNA_ID_3048192; gDNA_ID_1621089; Annot_ID_170624
tgacacatttgaagaccaaatcttagtgttggacttagatcactcattcgcttacaacccaaggaaaccgaatctgaattatacaaactttcgcataaccatacatttaaagttcttttgatctctcagcttatgttgactttttaactgataatattcactaaaactgttttaactacaaaaaacataaacatggtattggttttctttgtatttattcttttgtcaacaaaagtcatagaagtatagaactaagacaaagggccacaacttgacagagacactctatattctaaaagcaacatttatacgaacggacacactgctttattcattcacagacctcaagggctattctttcatcatcctcatcgtttagccaccaccagagccatacttcttacccaacacaatgagctggagcttgtcatagccggccagtacaccagcgcctgcaaccgcacgaaggatgttggcacctgcacccttgaagagtgacttggccccttcgttcttgacgatctgagagaaggcctgaagagagctcttgtacttcactgcttcacctgacgtcatcatcattcttctgcgaaccgtgtcaattgggtaagacgccaatccagctccaatggtgattccccatcccagtaagaaactagcaaggaagctatcctgtacagattatagcaatgagtaaacagtaacagaggactcaatatgttgaagtgaggagttttctttgttttttacctggagaccatcaactagaaccacaggcttcaaggaatcatacaatccaaagtaaagcccccggtacacgacaattccaacgcatgagatgttgaaaccacggtaaagcccgacaatgccatcagaggctatagtcttcttgtacacgtcgaccatgccattaaactgccgctgaccacctttcttggccgccttcgcatcattggctaaacgggtacgagcgtaatccaaagagtacacaaaaagcagagatgatgcaccagctgcaccaccagacgccaggttccctgcaaaccacttccagtagccatctttttctttcttgaagttaaacagcctcttgaagtaatctttgaacgcaaagtttaaagcctgcaaaacaaaactatttgcttagcatacccatctcgacgtctatacaaataccacgtcaaagaagagaaaacaaacctgagtggggaagtatctgataacattggcagtgtttcctctccaaagagcaagcattccttcgtctttgactgttcgagcaaaacaatcactgattcctttatatggctcagagagacgcccagctttgatcatttcatcttgattctgaatcaagagcttcacacgctctataggcgcggctgccgtcttcgaaacagcagctgagactcctcccataaggaaatcgatcaagaaaccagtaccagttttctcactaggagcgtgagctaatacaggaaatgaaccatgaggtataagagacgagccaacgccatggctagttggctgcaatagactctgcaaacctccattgacataagcaccagagacacagtaaccacgagcttgcacactcggagaaagtctattgatcaagtaagattgtccatgtagcttctgaaagactgatggatgctttgatccatccattttttgtacaaatcagtaaaagctgactctgaaaaacaaaacaaaacaaaacaaaacaaaaatacaaattaaacaccacaaaatcttgctttctcgaaaatttctatatttgcatgcttaaaaaagaatgatcataaccaaaactggaacaaaaacagagaagacatcatcaacacatttcatacgatcctagttagcttcgttaaagacaccatttcaatctgtcaactataatgcgacctaattagcacaaattaaaacctagttgcagcagctcaattaaatcctctgtttctaaaagatcaagcaacgagtggcgtcgagaaaacagaattcacgagaagcagaacaaaaaaacagagagagctaggagagaagcattaatgataaagctagaacttctggagtcgagagcttaccgtggatttttcgccgaagcgttaacgagagagagagagagagctgtggaaaattgcgagaagagtaggtttctacatgattctcgacttctggtcctaaactaaaagacgaaactgagcagaagagaaggtacaattacgaaaatgctactggactcctttgacccgtttctttctgggcccaattttaagggacccgagtcttgacttcttctaaatggacccaaaatttattttcctaggaagataaaattcatacctaatgaaagtgagagacctctttatcattatgtgatatatgtctcatctacctgaaaattaaatatagaaaaatagaacaataatcaagacttttttggtttgccggaaaaatataatagaggcttgttaactaggtcttaaaaaattggatgttacttaagaagcaagaaagaaagttgaatcttttttttcttcttcagccggacagaactttacagatgcaaggaaggtgatgtggttcgaatttagtgatccaaaactagttagagaaatgttctacaaacaatgaaacaaaccgatacgtattgagagtaccagaatataggcaatgatatcggctcatgtattagataacaagacacatcatacatgtcatgcgatataaaataaactcgaattacatgcaataaccttaatatgtgtaggtagattatttcaaaagattcaagaaaactaaaagagaactcagctggaattcatccgagtaagaaggaaacatgagaactacatgtgttcattaaactaagccatgcataataaactccaccttagaaacgaattgattactatatatataatatatagatatagatttctcttcgtacacgaatcatatatatcaccttcgctagctagtgtactgagttcaatg

SEQ ID NO: 32014 - DNA, 3000 bp, Unknown; identical to SEQ ID NO: 6330
  misc_feature (1)..( 3000): 2750-1469P.txt file - cDNA_ID_3048196; gDNA_ID_1621089; Annot_ID_170620

SEQ ID NO: 32015 - DNA, 3000 bp, Unknown
  misc_feature (1)..( 3000): 2750-1469P.txt file - cDNA_ID_3048212; gDNA_ID_1621090; Annot_ID_170660
actgaaatattggtgaagaaaaggagtttcaaatggactgtcataaatttaaataaaccatttaaaatattttaactatccttctttaacacattcatcctcaagccttttttttcttcttctttatcactagtgggatggatcttcaattccaaattattggaggaacaagaaagatgataatctagaccacaacataaactatacaataaaatgataaatgtgttatagtcaatgaataaagaataagagagatggtgtgatgtttacacgtttggggcctaaaccaaaaaaaaaggatgggtccaatatgccaactactactattgtattgagagtaggaagagagagaaaccttaatggagacagagggacagtggggttatgtcaattgtcatattattcaaccactcaccaatcactcactccaaatctatatctctctttttacaaataattatgatagatttgatgataagttggttctcaaatcccagccgttcaatttatccagatatgcaagaaaatattagattttaaggaatcggcctttccttatttggtaagactaaatatctctgttcattctagttccaataggtaaaagagtaaccttttttcttacattattaataacttgcattgcacaataacgtattaccctataattcacaatgataatgtgttttgaagtcatctacacacttcaaagtttattactcaatcgaaaattgaaatattgtctaccactcaaatttcttgaaatggttaaaatacttgaacgtgtactatatgcaaaaatctctgatatttaactgctttgaaatttttatcagaatattactagtgatgggtcaatttctttgttaaccttgtgctttatgcacttatgtttatagtctctattttctacacctaaacaacacaatctatttgtaggttgcaactcggacccaaattttttgctaaattttttgttgaagtcttatattaagctaggattgtgacttaaaatatgaataaaactcatattgttggcttaaaaaacgaattaggatgtttgtatttagtaggaacatagtgttatgaaaccacatctgataaacacatgattttaaagtgttttaaaaactattctagcttcaaaaccagtttctcattcatcccgaatctttttttccatcacatatatagtaaattcatgatagaattttaatttaacctaaatatatatagttcatagttggttatgttcaatcgattagaagggttctgttggatccgaattcgagacctaggaactacaccatgatacatttggggaaaatatgatatacgttagtaggtcaaacacaaatattatctaagattagcctccggccagaaaattatggactttgtatgtgagggagattgagaagcgattgctaagattaataaatatggggcttgttggtagagtagatctataaaaggggtgatagagaaacgagtggaaacgcatgaagcacgttataaaattgaataattgaagattcaaccatattctttgataattggtgggcatttttattttattatttgttgtcaaatctctatataaagaaaaaaaattgttttaacgttttcggtttaatgtttgacgcatatatgtgggaacagttttgggcgacgtggtagcttcccctcctcgtttcccccaaaagccaatgcttaaaatgacgagaataccctctccaaaaaaccatgtgctcctaagtcctgaactagttctgattcttttcttttagctatatagggaagtgagacttgcgagggtgagtatgtgacatcaaaatggaaaacactaagctacataaccgttggactaaaatggtaataaaaagaagcagaacagaagtaggtgaataaaactgagaatggaaacaagaaacaactgaagaaatcggatttatatacgtttttgatcatattctttggttcaaactctataaataagtttcttggcttctttcttataagaagaatcgactacactttaagttaaaagaccacaagcaatacacagttacaagaagaaagaaaagtagttccaagtactctctctactttaagttataagatcacaagcaatacatagtatttaataattaacacaagagtcgagcttggactttcttctttcttgggccttcttctattccgattcatcccattgacaaacccaaagcgttggatactcaaatgctcattcgtaaacacgtatcctcattagctttttctttcccattttgcttgaatgtaactaattaatttggttttttttttaattagtaagtgtagtatgtcaatattgtacaactagatgatactgatccattagagtaacactaaagttaccaaagtttcatacaactccaacgacaagcaaggttaggcctttccatccaatattataatctaagaaggagcgattgcccttgatctgacccaacttgcgagtggaaaatctaatgcttatttgttcattcgttttctgagattctatatcaaataatagtcagtcatcactagaaaatgctcaaacaactaatatgattcatacacatttcatatcatatgcttggcaatattggaccgaacttcatgatttttctgtccatgaatgcaaatgtgttgtgatctctgagttacatctcaaaatgtgaacttgacatcatattctcgttcaaaaaaggaagataagacaaaacatttaagaaacatttcacaatcatagggggcaaaagatcaaaatttaaaatttcggacgagagtggaaactatcaatctttaaggggatgatttggcaaaagtgttgtttttatttttcttttactgttttcgttttatcatctttcaacgtctttctctcccgacggccaaaaaccccaattttgccaaatccaattttacacccagaaaccctaattttccttactttgatttgattttgtgatg

SEQ ID NO: 32016 - DNA, 3003 bp, Unknown
  misc_feature (1)..( 3003): 2750-1469P.txt file - cDNA_ID_3048212; gDNA_ID_2926252; Annot_ID_204403
tatactgaaatattggtgaagaaaaggagtttcaaatggactgtcataaatttaaataaaccatttaaaatattttaactatccttctttaacacattcatcctcaagccttttttttcttcttctttatcactagtgggatggatcttcaattccaaattattggaggaacaagaaagatgataatctagaccacaacataaactatacaataaaatgataaatgtgttatagtcaatgaataaagaataagagagatggtgtgatgtttacacgtttggggcctaaaccaaaaaaaaaggatgggtccaatatgccaactactactattgtattgagagtaggaagagagagaaaccttaatggagacagagggacagtggggttatgtcaattgtcatattattcaaccactcaccaatcactcactccaaatctatatctctctttttacaaataattatgatagatttgatgataagttggttctcaaatcccagccgttcaatttatccagatatgcaagaaaatattagattttaaggaatcggcctttccttatttggtaagactaaatatctctgttcattctagttccaataggtaaaagagtaaccttttttcttacattattaataacttgcattgcacaataacgtattaccctataattcacaatgataatgtgttttgaagtcatctacacacttcaaagtttattactcaatcgaaaattgaaatattgtctaccactcaaatttcttgaaatggttaaaatacttgaacgtgtactatatgcaaaaatctctgatatttaactgctttgaaatttttatcagaatattactagtgatgggtcaatttctttgttaaccttgtgctttatgcacttatgtttatagtctctattttctacacctaaacaacacaatctatttgtaggttgcaactcggacccaaattttttgctaaattttttgttgaagtcttatattaagctaggattgtgacttaaaatatgaataaaactcatattgttggcttaaaaaacgaattaggatgtttgtatttagtaggaacatagtgttatgaaaccacatctgataaacacatgattttaaagtgttttaaaaactattctagcttcaaaaccagtttctcattcatcccgaatctttttttccatcacatatatagtaaattcatgatagaattttaatttaacctaaatatatatagttcatagttggttatgttcaatcgattagaagggttctgttggatccgaattcgagacctaggaactacaccatgatacatttggggaaaatatgatatacgttagtaggtcaaacacaaatattatctaagattagcctccggccagaaaattatggactttgtatgtgagggagattgagaagcgattgctaagattaataaatatggggcttgttggtagagtagatctataaaaggggtgatagagaaacgagtggaaacgcatgaagcacgttataaaattgaataattgaagattcaaccatattctttgataattggtgggcatttttattttattatttgttgtcaaatctctatataaagaaaaaaaattgttttaacgttttcggtttaatgtttgacgcatatatgtgggaacagttttgggcgacgtggtagcttcccctcctcgtttcccccaaaagccaatgcttaaaatgacgagaataccctctccaaaaaaccatgtgctcctaagtcctgaactagttctgattcttttcttttagctatatagggaagtgagacttgcgagggtgagtatgtgacatcaaaatggaaaacactaagctacataaccgttggactaaaatggtaataaaaagaagcagaacagaagtaggtgaataaaactgagaatggaaacaagaaacaactgaagaaatcggatttatatacgtttttgatcatattctttggttcaaactctataaataagtttcttggcttctttcttataagaagaatcgactacactttaagttaaaagaccacaagcaatacacagttacaagaagaaagaaaagtagttccaagtactctctctactttaagttataagatcacaagcaatacatagtatttaataattaacacaagagtcgagcttggactttcttctttcttgggccttcttctattccgattcatcccattgacaaacccaaagcgttggatactcaaatgctcattcgtaaacacgtatcctcattagctttttctttcccattttgcttgaatgtaactaattaatttggttttttttttaattagtaagtgtagtatgtcaatattgtacaactagatgatactgatccattagagtaacactaaagttaccaaagtttcatacaactccaacgacaagcaaggttaggcctttccatccaatattataatctaagaaggagcgattgcccttgatctgacccaacttgcgagtggaaaatctaatgcttatttgttcattcgttttctgagattctatatcaaataatagtcagtcatcactagaaaatgctcaaacaactaatatgattcatacacatttcatatcatatgcttggcaatattggaccgaacttcatgatttttctgtccatgaatgcaaatgtgttgtgatctctgagttacatctcaaaatgtgaacttgacatcatattctcgttcaaaaaaggaagataagacaaaacatttaagaaacatttcacaatcatagggggcaaaagatcaaaatttaaaatttcggacgagagtggaaactatcaatctttaaggggatgatttggcaaaagtgttgtttttatttttcttttactgttttcgttttatcatctttcaacgtctttctctcccgacggccaaaaaccccaattttgccaaatccaattttacacccagaaaccctaattttccttactttgatttgattttgtgatg

SEQ ID NO: 32017 - DNA, 3000 bp, Unknown; identical to SEQ ID NO: 6369
  misc_feature (1)..( 3000): 2750-1469P.txt file - cDNA_ID_3048227; gDNA_ID_1621090; Annot_ID_170680

SEQ ID NO: 32018 - DNA, 3003 bp, Unknown
  misc_feature (1)..( 3003): 2750-1469P.txt file - cDNA_ID_3048244; gDNA_ID_1621090; Annot_ID_55485
gttcactatatcaaacagtgttttgaaaacctgcaaatatttttacttgagtactgaaattgttttaactgtctcttgtaaaccaaaaaaaaacagatcgctgtggatgttgaccgtacagtagtggaactgtacaaattcctgaagaagcacgcatcaatcccatttaaacttgagaaaccggcgacacctgaaccggtgatctcgaccatgaaatctgatgagaagatcgagggtgatagttccaaggatgagttgtgatgatcggaacagagtgtgtaacaaggctatagatgatgactcttctataaatgatagaaaatgttttgccctttgtttttttccattgttgtatgctatgaaatgaataattaaagaagttttggtttctcaagtttttggatgtaactggaggtttgatccacacattgagtgttgatttaatgcgacttgtggttcataacaactagcacaaaagatttcttacgaagcgtagagaaaccacacaatttctgccaaaaccattgttatcatagatcttatggtttacaaaaatatgcaccttcaaagttcatatagaatagacgtaaataaaaatccataagagatgtacgagtttcatatggaagagacactgtttattagtctagatccaacgtgttctctcgtactatggattagtagagaataattcgttctcttttaacgagatatggttgttatataagatatagaaattgaaaaaagcatggtaaacaattaaatccatgtttttctattatgtgtcactgcggtccataggctggtgaacacctaatagtgtagcattgtcaatatttttctttaccattggttttaaagcttccccaccaaaactcgtcatttttacaaaaaagttgcacaacatgtaggcatctgctttattacaagttcatggcggcactagtctgcttcgaaccccttaacattgcttacaatgaggcaaagtttctttttttcccccttgtttttcctaatatgacaaaattgatcaataaaaaagtagttacaattgttacaactttttattgcaacttttagttaaaatagttataatttttattgcaattaaaatagttacaatttttttattttggttatgtttttttatcgcatattttcgttaaactaccgcatagtttggtaaattttttgtaatgattcaaatatttaaatatataattataataatttagtacataaatactaggccagagcattcatttatattcggtttgcttctttcggttctaaactctgaagatccataagaaaccgaaaaagttatggttcaactcgattcggttctaattattttatccaaaatattttctaaaaggactgtatctaaatatcggaaactttttttgacaaaattataataaaccaaaatatcagaaaaattaacaaaaattaattagattagaggtaaaaaaaaaatgtattggacttagttttgtaaagggttgaccaaacatttttttgttctattcgggtatctaaaacagaaccagaatccttttttggtttggtttagtttggtttttcaatttcggtttttgttcctagctcaatatgcaaaatcaatattattttgtagtttaatatataaatacaaaaatttgtcgaaaatgagtttcagggtggagttcatatcctagttccacataatagtagagaacacgaaagaactttgacttatcaaactttacatcaacatataaatctaatatcatataatatactattaaaaattctataatttatttctagagtccatccacacacgtttctgatatttgttttttgtttgtaaaagaaaaaaggaaaaaagaaaagtactagacatctcttttccgtaaaatatatactaaaaatataaatattttattagcatttcattatcttacctgcatttcaactatggcaaaagaaaaaataacagatttgaaaagaaaaaaaaaaggaaaagcattcaacgttgatagtatgtaaactaattgatgctctaaattagcgttacatttgttatgtaaaataagaaagtcaaagaagcagagtaaagattaggtgatacttgcaaagttacctttcttttccaaatgtaagtaacgtctcaagtttatcaaactaatagtttatgctttacatattttcccaatctataaattttatttgtaaacagaaacaaatgccttcgaaactcttgtatggaaaaattaaatccaaaaagttagtatattattagagtaaacactcataacagaaagatctttttcatactccaatatggaaaattttagcatcaaaaataacatttttttgttgttgttgccaatatatcagcatttaaaaaaaaaataaccattcgcaagtatagaaataataaagtctcagtaaaagtgaatgcaactacaagtctctgggatggcaaaattgttagcaataattctgtgtttgtagtacataaaataaaattgattaattgctcgttcttcttttattaataatccgtgttttgttttgtcctttctcttcaatctgggtttggtggggaggttttaagtcaagcgtgcgatatatatatcatcaaaacagacatcctctgttcttgcctcttcttcttcttcttcttcttcatcttcttctatatattggtgtttcatttgttctgctttaaaagtacacaaagattcatcttttttcggtcctctgattgggcaaaagactagctcggtcgtgttttgaacaagagatacatgttttgaaaaattcctcgcaaaagaagagaaagaaagactcaaacttttgtttgaatttgataccattttttatatatataccaaaagtccaagactggtttcatttttgggtttggtctgaaacctctcttcgtgttgtttgttcatggtatgtcttaattagggtaaaaaaatacttgattgttttctctcaatcatcatg

SEQ ID NO: 32019 - DNA, 3003 bp, Unknown; identical to SEQ ID NO: 32018
  misc_feature (1)..( 3003): 2750-1469P.txt file - cDNA_ID_3048244; gDNA_ID_1621090; Annot_ID_170666

SEQ ID NO: 32020 - DNA, 3000 bp, Unknown
  misc_feature (1)..( 3000): 2750-1469P.txt file - cDNA_ID_3048244; gDNA_ID_2926252; Annot_ID_204398
cactatatcaaacagtgttttgaaaacctgcaaatatttttacttgagtactgaaattgttttaactgtctcttgtaaaccaaaaaaaaacagatcgctgtggatgttgaccgtacagtagtggaactgtacaaattcctgaagaagcacgcatcaatcccatttaaacttgagaaaccggcgacacctgaaccggtgatctcgaccatgaaatctgatgagaagatcgagggtgatagttccaaggatgagttgtgatgatcggaacagagtgtgtaacaaggctatagatgatgactcttctataaatgatagaaaatgttttgccctttgtttttttccattgttgtatgctatgaaatgaataattaaagaagttttggtttctcaagtttttggatgtaactggaggtttgatccacacattgagtgttgatttaatgcgacttgtggttcataacaactagcacaaaagatttcttacgaagcgtagagaaaccacacaatttctgccaaaaccattgttatcatagatcttatggtttacaaaaatatgcaccttcaaagttcatatagaatagacgtaaataaaaatccataagagatgtacgagtttcatatggaagagacactgtttattagtctagatccaacgtgttctctcgtactatggattagtagagaataattcgttctcttttaacgagatatggttgttatataagatatagaaattgaaaaaagcatggtaaacaattaaatccatgtttttctattatgtgtcactgcggtccataggctggtgaacacctaatagtgtagcattgtcaatatttttctttaccattggttttaaagcttccccaccaaaactcgtcatttttacaaaaaagttgcacaacatgtaggcatctgctttattacaagttcatggcggcactagtctgcttcgaaccccttaacattgcttacaatgaggcaaagtttctttttttcccccttgtttttcctaatatgacaaaattgatcaataaaaaagtagttacaattgttacaactttttattgcaacttttagttaaaatagttataatttttattgcaattaaaatagttacaatttttttattttggttatgtttttttatcgcatattttcgttaaactaccgcatagtttggtaaattttttgtaatgattcaaatatttaaatatataattataataatttagtacataaatactaggccagagcattcatttatattcggtttgcttctttcggttctaaactctgaagatccataagaaaccgaaaaagttatggttcaactcgattcggttctaattattttatccaaaatattttctaaaaggactgtatctaaatatcggaaactttttttgacaaaattataataaaccaaaatatcagaaaaattaacaaaaattaattagattagaggtaaaaaaaaaatgtattggacttagttttgtaaagggttgaccaaacatttttttgttctattcgggtatctaaaacagaaccagaatccttttttggtttggtttagtttggtttttcaatttcggtttttgttcctagctcaatatgcaaaatcaatattattttgtagtttaatatataaatacaaaaatttgtcgaaaatgagtttcagggtggagttcatatcctagttccacataatagtagagaacacgaaagaactttgacttatcaaactttacatcaacatataaatctaatatcatataatatactattaaaaattctataatttatttctagagtccatccacacacgtttctgatatttgttttttgtttgtaaaagaaaaaaggaaaaaagaaaagtactagacatctcttttccgtaaaatatatactaaaaatataaatattttattagcatttcattatcttacctgcatttcaactatggcaaaagaaaaaataacagatttgaaaagaaaaaaaaaaggaaaagcattcaacgttgatagtatgtaaactaattgatgctctaaattagcgttacatttgttatgtaaaataagaaagtcaaagaagcagagtaaagattaggtgatacttgcaaagttacctttcttttccaaatgtaagtaacgtctcaagtttatcaaactaatagtttatgctttacatattttcccaatctataaattttatttgtaaacagaaacaaatgccttcgaaactcttgtatggaaaaattaaatccaaaaagttagtatattattagagtaaacactcataacagaaagatctttttcatactccaatatggaaaattttagcatcaaaaataacatttttttgttgttgttgccaatatatcagcatttaaaaaaaaaataaccattcgcaagtatagaaataataaagtctcagtaaaagtgaatgcaactacaagtctctgggatggcaaaattgttagcaataattctgtgtttgtagtacataaaataaaattgattaattgctcgttcttcttttattaataatccgtgttttgttttgtcctttctcttcaatctgggtttggtggggaggttttaagtcaagcgtgcgatatatatatcatcaaaacagacatcctctgttcttgcctcttcttcttcttcttcttcttcatcttcttctatatattggtgtttcatttgttctgctttaaaagtacacaaagattcatcttttttcggtcctctgattgggcaaaagactagctcggtcgtgttttgaacaagagatacatgttttgaaaaattcctcgcaaaagaagagaaagaaagactcaaacttttgtttgaatttgataccattttttatatatataccaaaagtccaagactggtttcatttttgggtttggtctgaaacctctcttcgtgttgtttgttcatggtatgtcttaattagggtaaaaaaatacttgattgttttctctcaatcatcatg

SEQ ID NO: 32021 - DNA, 3003 bp, Unknown; identical to SEQ ID NO: 17829
  misc_feature (1)..( 3003): 2750-1469P.txt file - cDNA_ID_3048248; gDNA_ID_1621090; Annot_ID_170664

SEQ ID NO: 32022 - DNA, 3003 bp, Unknown; identical to SEQ ID NO: 17830
  misc_feature (1)..( 3003): 2750-1469P.txt file - cDNA_ID_3048252; gDNA_ID_1621090; Annot_ID_170663

SEQ ID NO: 32023 - DNA, 3000 bp, Unknown
  misc_feature (1)..( 3000): 2750-1469P.txt file - cDNA_ID_3048252; gDNA_ID_2926252; Annot_ID_204400
tttgaattcgttctatgttttataaaattgacaaaaacagaaggcccttcttagtttctttacagaaagtctatagagtctccctctttcatgaataacaacatttatactacaaccgtgcaaaatgaaaagtgcacaccttaagcagtcatattatcggggtctcacgaaaagccaaagctaagtcatcagtcaataatgtggtctggttttggcagactacaaacttgctgcacgtacaggttggaggtttccgacttgcccactaactagaatatcaaatgtagcaccatcgggtaaaatacccttgtcaagcatctcatcgtgaagtctaaaagcctcatcgagatttccttctctataatgtccggcaatcaccgcgttgtagataaggacattcggagtgacattattcttcttcatctcctcaaacatcttaaccacttttacaaactgccccttcttgctaagaccgtttacaattactgtgtaaatgatttcatcagggacaagacccaccgcctgcatttctgtgtacaactcagaggccaggatcaaatttccatctttcaacaatccatcaatcagtgttgtatatgtacccagatcacatcgtagaccgtctttcaacattttcttgtacaaatcaagggctgctaccatgtttcccagattacgaaatccagaaatcaagctgttgtatataggttggcttggattcaatccttcttcaaggagttcagagaacagagcagatgcgctttccatgttactccttttgcagaacccatcgataagagcaccataggctggaatatcgagtttgacacctttgttcttcatttcgtctctcatttccaatgcttgatccattctgttatttttgcataacccattcatcaagctggtataagttatgacgtttggagaaataccattgccacacatctcttcgtatgctgcaaccgcagaatccatttcaccctctttgaaaaatccatctataatgctattgtaactcatgcaactaacacataaccgtttttcttcgatcatatttgccaacaattctcttgctttggatgtctgaccaactttgcataaaccattgataattgtttggtatacaaccccgttgacttcaatattggaagaagtcatatgattgacgacttccaaagcgttttgttcatcatgattcctgaaacatccatcaatcagaatggaatacgtgtagttattcggctttagacccttttccagtatatttgaaaaaacaatacgagccaagtccatgtttttctgtctgcagtggccaagcatcacgttattgtaagaaactacattcggtccaatacctctactttccatcttgcttaataactctgtagcttcgtctgtcttaccttgcttgcataaccaggataatatagtgttacatacaaacacgtttgcaagaccggtttcaaaagactcgtcaaagagtttcagtgcctcttcatgtttctgacctttcaaccacccttgaattatcgtgtggacatgaaagacagaaggagtaagacctaagacttccattttcttgtaaaattcaagcgccttttccatttccccgttcttacgaaaccattctatcagaaccgaaaaagtaacgctgttcggagaggggccttccttttccatcttatcaaacaaaaccaaagcactaaccaagtcattgttcttgcagtgtcccgtgatcagactcgtcgcagcaactacattcatcgatatcccatcactcaacatctcatccttcaatctaattgcatcatccatattaccttgcttcacagaagccaaaatcacagaagtataagtttcctgcgacgggacacacaacttcttctccttcatctctctcaataaactattagccatagccaaatcaagcgtcttgcaacaagcctgaacagcaagactatacagtaaactatccggttctgctcctctctcaatagctctacttaaaacctccaaagcctccgcaggcttttcttctctcaaactagctctcattaacaattgcgttgttacattatcaccatcaacaccaatggcaaccatcctactgtagagttccttagcttcagttaacgaattcctttgaactaaagcactcaaggtcctattcacatatggaaaaaatggaatcacatctagttccaacatctggttgacgatatccaccgcatgatccgtttgcctatctttagaataagcattcaataagtaattaaaagctcgtgaattgacttcaaacccaaatgatttcgccgaatccaccaatttactgaccaaaacacttgccattggagttggattgctcgtagaaacgtaccgtatgagcaaatcacttgcacgtccataggtctcaggagaactgaccagaatatgaatgagtacccagaagacgtcaccatcttcaaaacttccacgccatggtctagcccaattatagaaacgaagagcagcttctgggttgttcctgcgattgagaagaacatcgattacagatgcatcgtccttctgttcaggcttcgcagacaaaagactcactttggaggtaactgggttttcttcagaagtggatccgtaaactagtagtctctgctcttgacttggattctcagattctttgggaaactgagactgtgaacaaaagggtttattgtttctcaagttacgaagacgaatccgtgaagggatttttctaaaaaccaataaagatctcatctttcgaggttcttctctcaactatcttcagcagagaaaagatgatcggagaaataaataaaagagacaacttgaaatcccgaagatacaccaaaaaaaaaaaaaaagaagcttaaaccctaattatgtctattaaacggcgtcgttttggggattattcctttttaaaaacgttctcttttcccgttttatctaatttcctcaaggaagagagaagcaaaaatg

SEQ ID NO: 32024 - DNA, 3000 bp, Unknown; identical to SEQ ID NO: 6365
  misc_feature (1)..( 3000): 2750-1469P.txt file - cDNA_ID_3048256; gDNA_ID_1621090; Annot_ID_170659

SEQ ID NO: 32025 - DNA, 3000 bp, Unknown; identical to SEQ ID NO: 17831
  misc_feature (1)..( 3000): 2750-1469P.txt file - cDNA_ID_3048283; gDNA_ID_1621091; Annot_ID_170738

SEQ ID NO: 32026 - DNA, 3003 bp, Unknown
  misc_feature (1)..( 3003): 2750-1469P.txt file - cDNA_ID_3048291; gDNA_ID_1621091; Annot_ID_170724
ggctttggctctggacctgaactagagaagaagcttaagtatgctgaacatgtttcttatggcgttattttcgggaaagaactcgttaattctccagccaatgttctcactcctggtgaggattgtttcttgagcatcagtcttagacttttcattttttttttttttaataatgtgagcatcatgtctgttgaagtttatttcaaacatttttctctaatctgctttgtatcttacagccgtactagctgaggaagccttgaatctggcttccatgtacagtgatgtcatgactgccaacatcttgaacgaggagcaatgcaaagagttgaagatgggttcatatcttgctgtagctgctgcttcagctaatccacctcatttcatacatcttatctacaaaccttctagtggccctgttaaaacaaaacttgctcttgttggaaaaggattgacatttgacaggtactagagctgttggcttctgtttgccgcatcaatctctttatttaatacttattagttattgaccagatggtttttgttcacagcggtggctacaacattaaaaccgggcctggctgcttaattgagctcatgaaattcgatatgggaggttcagctgctgttcttggcgctgcaaaagccattggtcaaattaagcctccaggtgttgaggtaagtttatcacacggagcttgcgtttctgagttaaatgaatgtacctaaacaaatgcttcgttgcacaatcaggtgcactttattgtcgcagcttgtgagaatatgataagtggtactggaatgagacctggagatgtcctcacagcctcaaacggaaagacgattgaggtatcataacaccgtttccatatgaattcagcttcaaaaggttcgagctttccattgttagttttacgccaaactaattgtgggtggtattgcaggtcaacaacaccgatgctgaaggtcgactaacacttgcagatgctttagtttatgcttgcaaccagggtgtcgataaggtattgtttcaaagattcttcgacttattaatacattctttctgttggtttttctctcaagtctcaacttgtgaattacaatatttgcaggttgttgaccttgcaacattgactggggcttgtattattgctcttggaacatcaatggcaggtacatagtcttgtgttttaaataagacagaataaaattctttcgtgatggttgactattggtttttctgcaggcatatatacacctagtgataagcttgcaaaggaggtgattgctgcatcagagaggagtggagagaagttatggagaatgcctatggaagagagttactgggagatgatgaagtcaggtgttgcagatatggttaacactggaggccgtgcaggtggatccattaccgcggctcttttcttgaaacaggtgagtatatcataagagtggaaacaaaagaacacatttcaatactgacgctattgttctctaacgaagaaccgggtttggttaatggttgcagtttgtgagcgaggatgttgagtggatgcacatagatatggctggaccagtgtggaacgagaagaagaaagctgcaactgggtttggagttgcgacactagttgagtgggtacagaaccattcttcttcttaagatgaagtctggtgatctctgactgatgtgaactagttgtgtttttgctttgtgtggtgggacaagttttttttttttgtgcaactaagtatgacaagttaaatcaatcagaagattagttttgttgttgtatgcttacctagtctaaacttaaattcaacaaccaccgtgagagacacagttgagccaccgttgttgctgtgtcccgtcatgttgttgtatttgaatgggtccgtgagttgttgagaaggagagatagtcgccgttcatcaccactacagccaccgtgtgtcaccggagagtgacaccacgagtcacaggatgtcaaccgctgtcaccggagtagtcgtagtccatcgccaaggccgttaagggtaaggaaaccctagatctattatgtaacttgctcaggaagtttttggctttctcttatgatctgtgctttgttttggttttgattgttgagctatgagaccttactgccgtgagcttaaaccgcctcatcgagccccgagcagatccaccgagagtaatcgccgagaaaggtaacggcgaaccttatctcccgtgtttgttgttgattattgaaccggatcttaaccagtctaaaccaatgactcttaatttagttaagaccagaaccgaaaccaatgacaatttgcgttgttggtgtattattacgtctgtgtggtgtaactagattataagaatttggtttggtttaattattaaaccaagtctaattaatttaattggaagaataccaaatcaattaatcgagatttctaaatttggtttggttattagattaaatcatgtatttttaattggatttcacctattgatccacaaatgagttacaaaagtgataatactgacgtgtttttcaatttcttttatcacttcgtgtaagaatgccttgaaatatttgaatttctataaatagtatcaaaactatgttttgtataaacaactttaaatttgaaggcaacaaataacagtagtaagtatttcagatatggttatcaagataagtttagtaatagtgaaacatgatcacattaaaatttgaaaagaagtctacagctaatcaagattgttaagatcgggtcggataatagcaatagtgagtgagtcaagtaaaagaataatcatcgtcaacaagacacgacggtcggacgcgggcggacgcaagaagagactgggccactctaattttctaagataactctaatttcatactatatatatatatatatatatatatgtctgcatcagccactctgttcttctccttataaataaatataaagaagctaagctcagtggagacttctcaaatg

SEQ ID NO: 32027 - DNA, 3000 bp, Unknown
  misc_feature (1)..( 3000): 2750-1469P.txt file - cDNA_ID_3048291; gDNA_ID_2926199; Annot_ID_201683
tttggctctggacctgaactagagaagaagcttaagtatgctgaacatgtttcttatggcgttattttcgggaaagaactcgttaattctccagccaatgttctcactcctggtgaggattgtttcttgagcatcagtcttagacttttcattttttttttttttaataatgtgagcatcatgtctgttgaagtttatttcaaacatttttctctaatctgctttgtatcttacagccgtactagctgaggaagccttgaatctggcttccatgtacagtgatgtcatgactgccaacatcttgaacgaggagcaatgcaaagagttgaagatgggttcatatcttgctgtagctgctgcttcagctaatccacctcatttcatacatcttatctacaaaccttctagtggccctgttaaaacaaaacttgctcttgttggaaaaggattgacatttgacaggtactagagctgttggcttctgtttgccgcatcaatctctttatttaatacttattagttattgaccagatggtttttgttcacagcggtggctacaacattaaaaccgggcctggctgcttaattgagctcatgaaattcgatatgggaggttcagctgctgttcttggcgctgcaaaagccattggtcaaattaagcctccaggtgttgaggtaagtttatcacacggagcttgcgtttctgagttaaatgaatgtacctaaacaaatgcttcgttgcacaatcaggtgcactttattgtcgcagcttgtgagaatatgataagtggtactggaatgagacctggagatgtcctcacagcctcaaacggaaagacgattgaggtatcataacaccgtttccatatgaattcagcttcaaaaggttcgagctttccattgttagttttacgccaaactaattgtgggtggtattgcaggtcaacaacaccgatgctgaaggtcgactaacacttgcagatgctttagtttatgcttgcaaccagggtgtcgataaggtattgtttcaaagattcttcgacttattaatacattctttctgttggtttttctctcaagtctcaacttgtgaattacaatatttgcaggttgttgaccttgcaacattgactggggcttgtattattgctcttggaacatcaatggcaggtacatagtcttgtgttttaaataagacagaataaaattctttcgtgatggttgactattggtttttctgcaggcatatatacacctagtgataagcttgcaaaggaggtgattgctgcatcagagaggagtggagagaagttatggagaatgcctatggaagagagttactgggagatgatgaagtcaggtgttgcagatatggttaacactggaggccgtgcaggtggatccattaccgcggctcttttcttgaaacaggtgagtatatcataagagtggaaacaaaagaacacatttcaatactgacgctattgttctctaacgaagaaccgggtttggttaatggttgcagtttgtgagcgaggatgttgagtggatgcacatagatatggctggaccagtgtggaacgagaagaagaaagctgcaactgggtttggagttgcgacactagttgagtgggtacagaaccattcttcttcttaagatgaagtctggtgatctctgactgatgtgaactagttgtgtttttgctttgtgtggtgggacaagttttttttttttgtgcaactaagtatgacaagttaaatcaatcagaagattagttttgttgttgtatgcttacctagtctaaacttaaattcaacaaccaccgtgagagacacagttgagccaccgttgttgctgtgtcccgtcatgttgttgtatttgaatgggtccgtgagttgttgagaaggagagatagtcgccgttcatcaccactacagccaccgtgtgtcaccggagagtgacaccacgagtcacaggatgtcaaccgctgtcaccggagtagtcgtagtccatcgccaaggccgttaagggtaaggaaaccctagatctattatgtaacttgctcaggaagtttttggctttctcttatgatctgtgctttgttttggttttgattgttgagctatgagaccttactgccgtgagcttaaaccgcctcatcgagccccgagcagatccaccgagagtaatcgccgagaaaggtaacggcgaaccttatctcccgtgtttgttgttgattattgaaccggatcttaaccagtctaaaccaatgactcttaatttagttaagaccagaaccgaaaccaatgacaatttgcgttgttggtgtattattacgtctgtgtggtgtaactagattataagaatttggtttggtttaattattaaaccaagtctaattaatttaattggaagaataccaaatcaattaatcgagatttctaaatttggtttggttattagattaaatcatgtatttttaattggatttcacctattgatccacaaatgagttacaaaagtgataatactgacgtgtttttcaatttcttttatcacttcgtgtaagaatgccttgaaatatttgaatttctataaatagtatcaaaactatgttttgtataaacaactttaaatttgaaggcaacaaataacagtagtaagtatttcagatatggttatcaagataagtttagtaatagtgaaacatgatcacattaaaatttgaaaagaagtctacagctaatcaagattgttaagatcgggtcggataatagcaatagtgagtgagtcaagtaaaagaataatcatcgtcaacaagacacgacggtcggacgcgggcggacgcaagaagagactgggccactctaattttctaagataactctaatttcatactatatatatatatatatatatatatgtctgcatcagccactctgttcttctccttataaataaatataaagaagctaagctcagtggagacttctcaaatg

SEQ ID NO: 32028 - DNA, 3003 bp, Unknown; identical to SEQ ID NO: 16945
  misc_feature (1)..( 3003): 2750-1469P.txt file - cDNA_ID_3048294; gDNA_ID_1621091; Annot_ID_170723

SEQ ID NO: 32029 - DNA, 3000 bp, Unknown
  misc_feature (1)..( 3000): 2750-1469P.txt file - cDNA_ID_3048333; gDNA_ID_1621093; Annot_ID_170809
gaacaagcatttgtcaaatggttccaatgatctcccttaaaactctcattcgcttttttatagataattaacaaggtgccaaaagaactggagatggtactacgggtcaaaaggcgggaagaacaatttcatgttcttataacatgttagccatgtacaaaaagaaagaaagcaaacaatgaatgttctcgttcattgtggaagaaacatgggttaaagatttgagctggatcagtgcgggtcttgtatggttttgttttttttacgggttgcgtccatcttttttggtctgtagttttgagtaggttagagagacgcgagagagagagagaggatgtggcggtttgtattatgtaaatgcttgtcttataatgagagagaccttattgatgataccaatctttgaggtccaagtaacacaacttctttgtgattgatatgtatgagataattaatttgtctattttcatggcatgatgtatgtgatatgtctgagatttgcaacattcttctataaagttgagaaataagggtagtttagtctttttaaccaaagatttttatttatttgatcttttccctgttttaaaaagaagaatcgagtaatcgggtggttttgaagacgaagaaggactaagacatcacgaggaacacgatgggtgaagcggtcaaggtatgtttttatctttgtctcctctgcttctgatctgttaatgccaatcgataattcctagttttgcgatgcaagcatgaatcgtcgattgttatctgagtgatttgattcattttcgacgattttcgaatcatcataactacttcttttgctcaaatctcgcagtcagtttaatgcctattcgtattcaatttagttatgcaattgacgatttctcgaattgtctgaagttttgaagctaaaatcagattaaatataaaatatctgaacattgcctcccaaggaatctaatcccatcttgatgtgcttttgcttaggatgggagagaagaagtgattcaagcttggtatatggatgatagtgaagaggatcagagacttcctcaccacaaggatcctaaagagtttgtatcgttggacaaacttgcaggtccccctctttgtgtgtttcaattcaatgttgttctctctgcttctctattttgtttcacatgtaatgtttgtgtgcagagctgggagtacttagctggagacttgatgctgataactatgaaaccgatgaggatttgaaaaagatccgtgaatctcgtggttactcttacatggtttgtggtctttatttatttactatcccactagacttgaatggtagatgtttatttttgtccaagtcttattttaactctctaggggttttctcaatcttggtttgatgattaaaaagtgttcaaaatgcaggacttttgtgaggtatgcccggaaaagcttccaaactatgaagtgaaagtgaagagctttttcgaagaacatttacacactgatgaggagatccgttactgcgttgcaggaactggtaagaacttcttttactggcggctttactcgtaaacttaaaatttcgatatagtagtcatgttttattttcttgggaaaaaggttactttgatgtgagagatcgtaatgaagcttggattagggtattggtaaagaagggaggtatgatagtcttacctgctgggatctatcatcgcttcactgtggactctgacaactatatcaaggtgcaatgtcagcttttcttctagccatttattttatagtttgggcttgcttagaaaattgaaatatcttgttgaacaggcaatgcggctattcgtgggtgaaccggtatggacaccatacaatcgcccacacgaccatcttcctgcaaggtacaatgtcctgggttttccccttttgtttgttctcttatgcaaacaatgggatatataatcaagcaagaaattctgttattttacgagaaataaattctgatattttacaggaaagaatatgtcgataacttcatgatcaatgcctcggcttagagagcttcctctctctatatctggctttctgaaacaaggatctataaacaaggcctacaataaagaaagctttcctgtcaagtattggatatttatatgtattcctgtgtagaatgatggcttttggtatgcttgagttgttgtaaacttagttacactctctgatatgtctctctttaccatctttgtcgtatcccatatacgaaaagattacattgggattcatattgtcttacgttcgttcctatgtgcaatatgttgagtttttacacaaatctctattcttttttatttgcttttcaaaaaccaacaaattagaagaaactaataagaagtaatacgtccaaccgcgtcaacttctttggtttaatctaaaccatggttcgtttggttgttgttgtgtatcttaacatgctgacggttttaaggatggttcgtttggtggttgttgttatcgaacatgttcacggttctaaggaagaaaagtgtggttttgtgtatttgtggttggacataagattttcgttttcgtttacatttgtggctttcttttgtaatttccttttagagtttggaatctccttaaatccgacctacattaactctatagtctatagaattggagtaatcattttattctcctatcttaatggattacaataaacagtagttgaatggaagaaaaaggggatataaaagtaaacttagcaagtttagcagccatgattaggcttataataatttatgtagacgtggagcttacgtggcagtctagggagtttccctgctccgggaacaattcccccaaattgactcccccataggaaaaactattcgacctcactctctctcgccactgttccgctctctctcattcttcctaattttacccccaaaacctccgattattactgaaacgccactgctctctcgccgggattccggtgaagaggaggagatg

SEQ ID NO: 32030 - DNA, 3000 bp, Unknown; identical to SEQ ID NO: 32029
  misc_feature (1)..( 3000): 2750-1469P.txt file - cDNA_ID_3048333; gDNA_ID_2926160; Annot_ID_198716

SEQ ID NO: 32031 - DNA, 3003 bp, Unknown
  misc_feature (1)..( 3003): 2750-1469P.txt file - cDNA_ID_3048337; gDNA_ID_1621093; Annot_ID_170791
ctcccactaagacttggcatattcgtcctaactacaccgcactaatataagcccttatttaaagaactatttaagcatggaaaaagttttctcatataatttatatggaatccttttgatttatagtcaaaaatatctcagaaattgtattatattgatagtggaaatagtattttctttgattttatataaatatactttatgcgagaattgaaggtgagttggtcaaattcattttgtgatattacaacttttagttggatgcagatgattgaatataggtatatagtataagagatactgagatagtagtgacaactgacaacctataaggagttatgtagaaactttaatatatgaaatgtgacataagaaataagaaaaggtctattacaagcgttataggggaaaatattgtgtaaagggctgcgagcatgttatccttgtcctcgagcctaaaagcatgcatcgtcgaagaaggtttttaagtcgaagcaagttttgtagtgcaaatagataacatttatcgatacatgtccaaaataaaagtatagctatataacacaactttaagaatgatttcttcttttattaaaaatatttgtttaataaaataatatttaaaaactaaaacatgtaatctagctatttcttttagtattgccgatttaaactttatgtaatgcatgctagctattggatattgagttattgacataaaaaactaataaaacttgatataatgaattaggcagagcaaatgattacttgaaagattaagaatcatttttaaaatttgttttctatcaatgcattgtggttgtatggtgtgtgtgttgttgtcatatctcaaatcatgtaggtggagaaggtgaaacgtaaggcgccaatgaaatggtacgtccgacatatatatacgttataacatatgatttgtcaataaaacaatcatgtaatcaaaattgtgattattatttcataagacaagttaggcgaggctgttcatggacatttggacatctggagatcacaacccgaaagttgggctttcatttaattggtgggacgccatataatcatatgtcttaaatggaatagtggtgagacttgattgtttatttttatatatacaattttttacagagaacaaagacaatacaaagaatacaaggagccaatgttactaaaaagacgacattacaagagaggccacaaaaacgagaactaaacaatgggaggattacactttggagaaagacaaaaaaaaaaagacgacatttgaatttgtgaagaacttttaaattttgtttggtaacagagataatagaagtaattacttagaccgtttttacctacaagaaattgatttatttgttttattatgtcaatggaatatgatgtaatattcaacaaatttgatacttaaaagaaaacattatttttaaatattagtagggttatgagacttgactatatatttggcctatagaattaatgaagatggttgacaaaaaataaataaaaaataattaagatgtcagagaaaccattaattccttaaatatgtactaaataaaattaataatgttacaatcatatgtgttagtagaatattagtgagacttgactatacatgttttactggcctataaaattaactaagatgtcagagaaacaagaattctatggactacaaactataaatttcggtaagattcaaatatcttatgactttatgacagtattttataaattatattgctcataaattctgtaaatgttttgcttttatataaaagttggagtcgcacattattcagtttctctaaaaataggcaaacaaattaagtgaaatcgatggatggacttggattctcttatttaattctgaaagctacatggtcgtgggaatgttgccttcataggtggttgatgctccatcaccgttaagagtcacaatatgtagttgttattcaatattttgtcgataactaagatcaaaaatgggacaatactatataatgaactcgtctttccgagtcctttggtctcttctactgacaataatatttaagtgtctttgttaaaaaattcaattcttcatcatatcaataattgagtatgattttattagcaacacaaacaaacaaaattctctaaacttattatattctcagagaaaacgacagataagtaaaacattaaatgtttttctttttcttgacgcccaacatcagctgtgtttttgtatttaggttaaaatgttacatgtatttataggatataaacgataacttaaaacatgtgattttgtgcaaggttttccgaaaattctgtttttatgtttacgaaaaaaaaataaaatctcatatttaaaaagttttctgtttttatcattgtatttacttgatcttgttgacaaaataactattttacttattatttataaaatttaagttaattaatttgtttaagtagtgattaacttactgatatgaatatgattgccactagtatgcttttcttctcaagtcaatatgaaaaatgtgaaattgttagccctaagcatctaacggatactgggaagcatacggttcatgtttgtcactacaacaacaatttttattagtcccttataacatatctcttttactgatcttaagcatcatccatagacaattgcaggatcacaccagttttggatcatctaaattttttttaattttactaaaattcctccagatctaaatttcattaaatcctaagtctaatacattcggtatttgagaaccccgcctttgttttaagatttttaatcataactcataagcgcgtatgaattcggattatccaaaggctaaactacagaaccaaaacgacatagttttttgtcgtttagaatctataagcgcagacaaaagtcaactttagaatcaacccaaaaatagaagtcaaaattaaaaaccaaaaccctaagattttagagtagactctcttcgaatg

SEQ ID NO: 32032 - DNA, 3003 bp, Unknown; identical to SEQ ID NO: 17877
  misc_feature (1)..( 3003): 2750-1469P.txt file - cDNA_ID_3048351; gDNA_ID_1621093; Annot_ID_170766

SEQ ID NO: 32033 - DNA, 3003 bp, Unknown
  misc_feature (1)..( 3003): 2750-1469P.txt file - cDNA_ID_3048356; gDNA_ID_1621093; Annot_ID_170764
tttttttgtgaatgtataaacattcttcttcatagataatttcacttctttttttttgtcaaagataatttcacttcaatgtaagaaaaaaatcattttatttgcaattaaaaaaaaaaggtatattagaaaagtaatataaaaagaagcaagaaaaggaaaagtacagactaagttggacccagaagaacaaattctaatttaagcttccatcacaaataatgaatcatgatgatacatgccaactaattccactctcacatcatgtaattaaaaaggtactataaactcatatgatcatatagtttttcactttttctagacatagcttaagatatttgataaaagcctcactgcaacttcataataatggatgatataaagctggcagattaattcctagattacttagatagattcagttttgttctaggatgcacaaaaaaggttacaaaattatttgttttcttactgtttctggcaccaaaacagaaaatgccttagatgagtgaaccatggccatacatattcatatcaggatcatcttcatcttcataatctggttctgtagatggtctgcttctctttgcctctcttgctattattgattgtcctctccctttcttcggctttcccctgtaattttatcacattggtcaacaaaccaaaaccatgtatcagagacatacagggcaggtacgaacgaggtaaagtaagctaggtcgggaaactaactgtgtcgacaaaccacccttggatcgccctggccctaattcagctcgtccatctatatcatacagagataaagtgtgtaaaaactgatccaagatttgcaaaagtgaattcagtgtagttgtttgctgcagggcttaccttctcttccaacaccaagttcttcagcctgaatacatttcagggaagatcaacataccagtctaaaaacctttctctctaatgaaggcagagtaataaactaacaaatgacagtcacaagaaaagacacaggcatttcaaagaactccagtctctagctatttgacatcatagattcagctttcacttaagtttgaagctgctagagatattagccatgtagtaatcaaccatatctaaagaaactatattctcaaaccttttttctaaagaaggccgagtaataaactaacaaacgacagtcacaagacaagacatatagtcacagaactctagctctttcacaatcatagattcagctttcacacttgtttgaatctgttagagatatttgccatgtagtattcaaccatatctaaagacactgattctcaaaccaaactacctactagaaagggaaccatatgttctttcggcagttgattctattgcaaaccaacacaacaaaacaaaaaacgtctttgcatatgaaagaaggtgataaaaattgtctaaaacatacagctggtgatgtaactgaggacaatgagaagactctgtcttcaggctgaaacttccttgaccttttagcactgcagaaatgggttcataacttcatatcaaactcaatttctcgttccacacaacaaaatactaaaactgagaagttaccacattctctaaagtgtatgaagctgcaaatagaatccaaagtcaatgttttttcagaatcaagagaagaggagaatgagagacctagcagtactcttggaggaagacaaaaacccttcaaagcctttcaaagcatttccaatatgactcgattcttgaagatagcttgtctccaattcataaacctaagattacaaagaacccaagatttgaagtatgccccaaacaataatttctctatgaaatcgaatttcacaattgaatcgactctggaccattggtgccctaacctgtttctcgatgcttcgtaactcttggcgaagcttctctcgcttgttcagaagagaagtgagcatcgcaccaggatccgtcgaactcttttgccctaacgacattttctgagaaagaaatccacaaattgcgcagctttttcccttcccagaaatgggtggtcgctgaaattcgacgcggaggtaaccgttgcctgatttgagtcgattacgatggagacgatgattctggaattcgatttgggggttttcaccaatggtccggtttgatgtcaacaaaaataaaaatggtccggttctcttttctttttataacttttttttatgggtcagagattttattaactcaactagcaaattgaccaaatagtctacggccaaatgtggctacctgctttgctaaagaaagaatcagccaaagagttggcattgcatggaataaacacaagtaaagtgagaagcatggaaaaagaatattgaaaaatattctacctcttgtaagaatattgaaaaatatggtggtatttgcgatcccattgaatctaatgtttaatataaaatgtagtgatgtgcaacaaaataggtaaaataagaaatgctttgttaaaagtcattgatataaaaaagtttgatgtccatggaaaaaaaaataagtttccagtataacgcttgattggttcgatacttcaatttgaagctgttgaattattttacagtagaacgtgcataaggtccaaccaattactcagcaaactataataaacgagtgatgaacttagatttctggtagcctaaaatcactagcttctttataaagtttccactatgtcacatattctcggtgttttatgttaggaataggagcatctccgctgaaaccccgccgcaactttctcccaacaaaatagacatttagactttattaagagacgacgacttcaaagtctttaattataacttaatgacttaataactcgggtcattttttaatctttgtcttgaatttttctcctaattatttccgactaaagaaacactttcccttaatttatatataggtgacctgaccaccactccttccgatcatcatgactcgacgtggctcgagacaaaacttttaatataaatg

SEQ ID NO: 32034 - DNA, 3003 bp, Unknown; identical to SEQ ID NO: 32033
  misc_feature (1)..( 3003): 2750-1469P.txt file - cDNA_ID_3048356; gDNA_ID_2926159; Annot_ID_198664

SEQ ID NO: 32035 - DNA, 3000 bp, Unknown; identical to SEQ ID NO: 6422
  misc_feature (1)..( 3000): 2750-1469P.txt file - cDNA_ID_3048360; gDNA_ID_1621093; Annot_ID_170759

SEQ ID NO: 32036 - DNA, 3003 bp, Unknown; identical to SEQ ID NO: 17893
  misc_feature (1)..( 3003): 2750-1469P.txt file - cDNA_ID_3048372; gDNA_ID_1621094; Annot_ID_170899

SEQ ID NO: 32037 - DNA, 3000 bp, Unknown; identical to SEQ ID NO: 6483
  misc_feature (1)..( 3000): 2750-1469P.txt file - cDNA_ID_3048376; gDNA_ID_1621094; Annot_ID_170897

SEQ ID NO: 32038 - DNA, 3003 bp, Unknown
  misc_feature (1)..( 3003): 2750-1469P.txt file - cDNA_ID_3048384; gDNA_ID_1621094; Annot_ID_170888
aagtctttaccttttcttatatcttcttcctcttgaatgaattagatggatgcggaattagaacctgtagctcttacacctcagaaacaagacaatgcatggaagcattgtgaaatttacaaatatggtgatagacttcagatgcgttgtctctactgtcggaaaatgttcaaaggtggtggtataactagggttaaggacatcttgctggtaaaaagggacaaggtactatctgtgaccaagttcctgaagatgttaggctctttttgcagcagtgtattgatggaactgtgagacgtcagaggaagagacataaatctagttcagagcctttgtctgttgcttctttacctcctattgaaggagatatgatggtcgttcaacctgatgtaaatgacgggtttaagtcgccgggtagttcggatgtcgttgtgcaaaacgagagcttgttgagtggcagaacaaagcaaaggacttacaggagtaaaaagaatgcttttgagaatggtagtgcgagtaacaatgttgatttgattggtagagatatggataatttgattccggttgcgattagtagtgtgaagaacattgtgcatccttcctttagagatagggagaatacaattcatatggcgattggaaggtttttgtttggtattggagctgattttgatgcagtgaattctgttaatttccaaccgatgatcgatgccattgcctctggaggattcggggtatctgctcccacgcatgatgaccttcgagggtggatactgaagaattgtgttgaggagatggcgaaagagattgatgaatgcaaagcgatgtggaagaggactggctgttctattttggttgaggaactgaactctgataaaggctttaaagttcttaactttttggtttattgccctgaaaaggtagtgtttctgaaatctgtggacgcatctgaggttttatcttctgctgataaattgtttgagctacttagcgaactggttgaagaagttggcagtaccaatgttgttcaagtgattacaaaatgtgatgattactacgttgatgctgggaaaaggttgatgcttgtgtatccttctctatattgggttccttgcgctgcacattgcatagaccagatgctcgaggagtttgggaaacttggctggataagtgagactattgaacaggctcaagctatcacaagatttgtttataaccatagtggtgttttaatctgatgtggaaatttacttctggtaatgatattctgctaccagcatttagctcttctgccacaaattttgctacattgggaagaatagccgagctcaaatccaatctgcaggctatggttacttcggccgagtggaatgaatgttcatattcggaagaaccaagtggattggtgatgaatgctctcactgatgaagccttttggaaggcagtagctttggtaaaccatttaactagtcctcttttgcgggctttgagaatagtttgttctgaaaagagacctgcaatggggtatgtctatgcagcattgtaccgagcaaaggatgcaatcaagacacatctggttaatagggaggattacataatatactggaaaattatagatcatggtgggagcaacaacagcatattcctttgcttgctgctgggtttctttcttaatccaaaactcttttataataccaacgaagaaaatccgtagttagcttattctatcggtgcccgattgcatttgagagattggttcctgacgacaagattcaagataaaatcatcaaggagttaacctcccacaaaactgctggtggagtttttggaaaaaacttggcaataagagctcgggatacaatgcctcctggtatggttaattttcctgattttcttgtataaatcttttcgcttgtacttctcttacttgactctcgttacattcttgtttcttagctgagtggtggtctacgtatggagaaagctgcttgacctctcacgttttgcgatacgcattcttagtcagacgtgcagttctcagttagctgcaggagaaaccagatacctgtcgaacacatataccaatcaaagaactccattgagcaaaaacgactcagcgatcttgtatttgttcagtacaacatgcgcctcagacaactgtaagtcttagatcttgtcccatctcagccaactgcattgtttccaaggaataagaaagtatagaaataatggttctatgtcttctctaggggtcctggaagcggagatgacacactagacccgttgtcacacaacaggatagatgttctgaaagaatgggtttctggagaccaagcttgtgtagaaggaaatggaagcgcggactggaagtcgcttgagtctattcataggaaccaagtagcaccaatcattgatgatactgaagacttgggttcaggtaaaaagatttagcatcctcggacaactttttttgtgtgtttcgaagattttagattttaaaagttgaaatgaatgtgtacaggtttcgatgatattgagatattcaaggtagaaaaagaagtgagagatgaaggttattatacaaacacatcggagaagttattcacgtaagattgatcatggttggtttaagcttcttcgtcgatgctttctgacttacatgaagctgttgtagtcataggtgtcgatttgtaacattagagtcttccctttagaattatctcttctacaagacgtttcagtattcttattcttcttactctgcattgtcctattaggtttccatagagtttgggttttataatcaggttctgtccagatttttaagttgtttgacaaatatatttaatatggtcatgaaatctaaatgcctattttctttcatatatatatttgatggctttgttagaccatctgttttattactagcataattactccttaattcttgtcaagtttttgaccgatatctaagcatacacaacagaaggacctctcacaatg

SEQ ID NO: 32039 - DNA, 3003 bp, Unknown; identical to SEQ ID NO: 21262
  misc_feature (1)..( 3003): 2750-1469P.txt file - cDNA_ID_3048432; gDNA_ID_1621095; Annot_ID_170974

SEQ ID NO: 32040 - DNA, 3003 bp, Unknown; identical to SEQ ID NO: 21262
  misc_feature (1)..( 3003): 2750-1469P.txt file - cDNA_ID_3048432; gDNA_ID_2926163; Annot_ID_198915

SEQ ID NO: 32041 - DNA, 3003 bp, Unknown
  misc_feature (1)..( 3003): 2750-1469P.txt file - cDNA_ID_3048448; gDNA_ID_1621095; Annot_ID_170936
aaggcttgcctttggaaacaacattgctcgtattggagaaacccttcacataatctcactcgcatagtcttcatattactcaattctctgttatgtagccttctcttctggcaaaaagctaaggacatgtaagtctccgctccccattttgaagtatgattgtttgcaatcaaattgtggaatcactggctttctttttttttctggggtaaagctcgaaacttaagttctttaactacgattcagtaaacgtaacttctcataaattagagagtatgctgtctttttaatagaattagttttttcatgatgggtgaaatacatatcatagtaagacacccgtaccaaaaagttcaggttccaaaactcatcttgttttctgaatctcacggatatgcaataaacaaggattaggtactagaaggtttcccaaaatgttttgcttactaaatctacacaaccttagtttgatattctatggttgtaagtcttcatcaatactaccaacatttcacactgatcaaatgttaattaatatgagtgtcactttactttgcagaaataatcagcaagatctttttagcatatttggctcaatgtacactatagtaatcttctcgggaataaacaactgtgcgacagttatgaacttcattgcaaccgagcgcaatgttttctaccgtgaaaggtttgcgcggatgtactcctcatgggcgtattcattttctcaggtttaaattttttccatttgtaactttggttttgtcgacttttaagaaaaaccttatatagctcgtctcttaggcttccactcatattggatggataccatccactggccaaatttctctatacatgattcaggggcctaatgtttttgcaggtcctagttgaggttccatactcactactccagtctctactatgtacgatcattgtatatcctatgatcggctaccatatgtctgtttacaagatgttttggagcttgtacagcatcttctgctcgttgcttatcttcaactactgtgggatgcttatggttgctttgacgccaaacattcacatggcattgactttgcgctcaacttttttctccatggtgaatctgtttgctggctttgtcatgccaaaacaggtaaccccttatctctggctcttcttttacatacagccaaaatccaaagtatatatcatggaacctgtggtcttagaaacttattgcatcaataaccaagagatatgtcaagtcgagctaagtcagaatgttgttgcattgcatggaaatgagaaaaatgtaatgttttccgcagaaaatcccaaaatggtggatatggatgtactacctgagccctacatcgtgggtgttggaaggattactgagttcgcagtatggagatgtcgagaaagagataacagtatttggagagaagaagagtgtttcagctttcttggaggattacttcggctacaaacatgactccttggctgttgtagcgtttgtcctcattgcttttcctatcatcgttgcttctctttttgccttcttcatgagcaaactcaattttcaaaagaaatagttctttttatttttgtcagttaggcttttctttctcttatgatatcatcataaacgttttacattttctctatctggtctcaaaaatgggcaattgtgaagcacacaaagaacaagttttgagaattgattccagcagcaaaagatgatcttttattacatataacaacataactagaaaattcttgagaggtggcttggttttgttgtttattcaaaatgcggtatggaccataccgtatggtctaaaatgttcgacgtaacgattccaacggaattggctcgagaaagcaacccctatttgtttattgattacttggcctgtgttattcagttgcaccatgcctataaggacggacttgtctaacttttttttttttttttaattttattttgtaaagttgaatctttttatttttctaatgtggtttccaataatgaaaatgcatcaagacggatgaaatttagtatgatgacttgatgatgagattaccaaattttaggtaatttgtcatcggaaaaacgtgttttcttttctcaaaagaattttaaatttgtgtgttgctctcccaaaaaaataaaacattccttacactgttacacataccaaataggcaaataaaaccgaactctgctgtgtaagatttggttttaaccaaaaaaacaacaaagaaaaaactatttcttggtggaatttgaagattccattggttaaatgatctactaactatcctcatccatattttactaataaagtaataatcatgttaatttatgaaagaactaaaaattgtcactgtttggaggattaaactcctctgacatgtttttaaaaaactatatacacacagttatttgaaagttaagttttgttgcgtcaccacttctcatattgtaaacgcgtttgcaagctaaggttttttgattaaacaaaaccttatctcattaaattctgacaacgaatcaaatattcaatcttcgtgctgatgttgaagataatatcacgtctctctcactgcagattcgatctcagggaaatataatacttttacagagttacgtggtcaaagtgttcgacgaaatgcctcacagaaagccaataagttgcgttcaagtatgaatactcttgcagatagtgggatcattgtcaataagctgattttcgaaaagatttcgtcttgataacattttgtcaacgcttaccagatttgtattagtttattcgatctttttctcccggattctatggatatgatcacgtgaagcatgggagatgataatgtatgcgtaatgtttgttaaagttattataattacaaacattcttccttcaatagttcttcattcatttgacgtttgcttcttcttgttcttgttaagtttgttttttgttgttgagttccgttggcattttaactgaaaatg

SEQ ID NO: 32042 - DNA, 2435 bp, Unknown; identical to SEQ ID NO: 17937
  misc_feature (1)..( 2435): 2750-1469P.txt file - cDNA_ID_3048456; gDNA_ID_1621095; Annot_ID_170924

SEQ ID NO: 32043 - DNA, 3003 bp, Unknown; identical to SEQ ID NO: 17938
  misc_feature (1)..( 3003): 2750-1469P.txt file - cDNA_ID_3048456; gDNA_ID_2926162; Annot_ID_198853

SEQ ID NO: 32044 - DNA, 3003 bp, Unknown; identical to SEQ ID NO: 29102
  misc_feature (1)..( 3003): 2750-1469P.txt file - cDNA_ID_3048459; gDNA_ID_1621096; Annot_ID_171008

SEQ ID NO: 32045 - DNA, 3003 bp, Unknown; identical to SEQ ID NO: 29102
  misc_feature (1)..( 3003): 2750-1469P.txt file - cDNA_ID_3048459; gDNA_ID_2926164; Annot_ID_198951

SEQ ID NO: 32046 - DNA, 3003 bp, Unknown; identical to SEQ ID NO: 17943
  misc_feature (1)..( 3003): 2750-1469P.txt file - cDNA_ID_3048467; gDNA_ID_1621096; Annot_ID_170996

SEQ ID NO: 32047 - DNA, 3003 bp, Unknown; identical to SEQ ID NO: 17943
  misc_feature (1)..( 3003): 2750-1469P.txt file - cDNA_ID_3048467; gDNA_ID_2926163; Annot_ID_198924

SEQ ID NO: 32048 - DNA, 3000 bp, Unknown; identical to SEQ ID NO: 17953
  misc_feature (1)..( 3000): 2750-1469P.txt file - cDNA_ID_3048493; gDNA_ID_1621096; Annot_ID_171048

SEQ ID NO: 32049 - DNA, 3000 bp, Unknown; identical to SEQ ID NO: 17953
  misc_feature (1)..( 3000): 2750-1469P.txt file - cDNA_ID_3048493; gDNA_ID_2926164; Annot_ID_198987

SEQ ID NO: 32050 - DNA, 3003 bp, Unknown
  misc_feature (1)..( 3003): 2750-1469P.txt file - cDNA_ID_3048500; gDNA_ID_1621096; Annot_ID_171043
attgcataactttttgggaaagatattgagggtgttctttgaataaatatgttgtacactgaaaatttcccacattaagagtaggggattgatattcatcatcttttcaaacgtaatcttgtaaagttcaacttcaacccaaagtcttggcctttgtacgtttgttcctcacttgggaattgggatgcaaagctgtgttgcaaaatgtttagaaataatatttactgttatatagtttttctggtatcattagtcacaaagcccgtctagctcagttggtagagcgcaaggctcttaaccttgtggtcgtgggttcgagccccacggtgggcgctttgtttttgtttttttaatccaaatttgatcatattctgattttagttttgagtaccttgactagtgactcttgagcatgtgttttatgcaagttttaagatatcctcgcctttaattacgctacgtagaatatgtgaattagtatggtacacccaaagaaagaacacaaatactttatataataatacaacatccaaagtcaaaaccttacaatacatatggtaccattttgttcccctctctctctctttactaatctctctactgaagacttttgtctctgtttgtcgcctgtctccgccaaaagctctaagtctctaaccatcacgtagagtaatttgttgtgtcttcaatccgtgcaattaaatccatgacaaaccgatatccagattatgagaacaagtagtagcaagatcccaagaacccaccagttttatcttcatgttctggtaaccacaaatttcctcctccacctgtgtcccttggttttcttgtattcccgcgccttaaagtatacaaattaacccttacattaaaatggctatcacggaaggtctatgaatttaatgtttggagtcaagtttgcctttacctgagagcgtagattctcggtcttgtcagtaagaactgttagattttcccctctgtcgattgcctgaaaatggatcaacaatattggaggtgtataaagcacagtgatttttgcagacttatcattgtaaaaggtaaagcaaaggagaatgatttgttgcttgtcttaagtgtggagaaagacataagagagtcaaatgatgagcattaccttgtcaatattctccaacattatacttttaacttctgaaacctgagccttgacttttattagtttttcaatctcctctgcatggtcaacaatataattcatgtgttccttcatcaccggcctgcaatattttaattttaccattaccttgtattcaatatattatagaacattttcctcaaatattgaaatgttttctaagtacccgaactccttgttgagacttttggcgatagctgtacttgcttttccacctccatatctcttcttgaaatcagctttcacacgctccagaaatgcgatcgagatttgcttgctaagagaatctttcgccacaacacaatatgctgaataagaaatttcaaagagccaccatatataagtgaaatgcaatccaaaccataacaaattattttgaaacacatgtgtgtagtttcatctccaaaccataacaaatacaactacatacagaaagaaagacacaaacatctccaatccgcatcacgtaaaggtatcaccaataataagacgcgtaatgtattcatcataaaaactaaactaccaaacactgaaagaattttgagactgcttagttactaattgaatctcccaagagaacaaactccacaaaaacatatcaagattcatgattagataacactttacttaatttgttgatggaaaaaattcttttttgattagatatatgtgcttaattggtatttacaaagtggaaaccaaacaaaatcagtaaaaaagttaaatcaatctaagctcaaatctcaatggaactaatacacaaaacactgttgtatcgccaagtaatgcgaatccaatctatgaagatcctgaaaatgccttaagtttcagatgatgcatatcagctaaccctgagctagatccatcaaaaccttaatggcttcaaactaaaaacattgttcgtttccagagaagaagatagagagagtgaccaaccgtaggcatcttcgacaaggaaattgaaggtatggtgatcgcagttgtaagtgaacttgctgttgctggaggacggaagcttctggagacactgagcagcaatagacgggaaattgcctgtgaattcggtatactcggcgaggatcatagttcctctggcgacgaagctatagataaacgattcttgacccattttgagtcgccaccgagtatggaaccgagttggctcagacagagagaaagagaaagagaaagagagtctttttattctttctttacctttgctgcaaagaaaccaagtactttgcccgtgactcaactcaactacatttcttagtttttatttttaattttcctttttgtatactaaattaaataattttttctttttttggtaggaaaattaaatattttttttcttcatattaaatttgtgttattatttataaatctaatacaattcaaaaaagcgaagatgcatcttaaatttcggcaggaaataagtgtgaaatactcacaaagtcaatatcaatctatgaaaacaatagtattttgatgctttttaaaacacaaaaaaatgtaaaacttatgcatagtgaataaatgaaaaagaaatgaatatacagaataaaataaattctggggaaaacaaccctatcacataaaataaattttgaaatgttgtcatattttattaattttttgttttttgaaattttgagtgtggctcgcaacgacatcactaatttattctcatgtttgtttgtttctcactttaccaatctcacttacagatcttccttcttcttcctcttcctcttccttcttccttaaaccctacaagcttctactctattgacaaatttgattccgagtttacatcgataatg

SEQ ID NO: 32051 - DNA, 3003 bp, Unknown; identical to SEQ ID NO: 32050
  misc_feature (1)..( 3003): 2750-1469P.txt file - cDNA_ID_3048500; gDNA_ID_2926164; Annot_ID_198982

SEQ ID NO: 32052 - DNA, 867 bp, Unknown
  misc_feature (1)..( 867): 2750-1469P.txt file - cDNA_ID_3048541; gDNA_ID_1621097; Annot_ID_171151
gggatgtgaagaaagaccaaaaccctttacaagatcattcatacttgattcttatcttcttctccattactctattacaaccctcctctttatttttaataaatacgttctgaaagcagcattacctcacatgtttgtgtatccgcaaacttgttcggtttatcttatctgttggagtgtgcaaattgattcttttactcggcattagttttattttgttgcttcttctttctttctatctaaatttgttagttggagtaaaatccggacaaccatattttacagggaacccaaatggcgagatagttttaacatgagaaaggaaagattcatgtgaatgagaaactggttaacttgaatctcatagatcattgtatacttggacattttcccaagattagaacaaacaatactagatctctcgaaaatatcttcatcacagttgcaaagagccgtggagaacccaactcttgagctcaaaattgtatcagctagtgacgtcaaccatatcgaatatgtcacggacaaaatggacgtatacgccgtcgtttcaatcaaagacaacacaactcaacagcaacaagcggccaaaactcccattgatatataacggaggttctaatccgacttggaatcacacaccgttaagttctccgtcaacgagagagaagccacgaagcccaataattatgttaaccagtgtaacgttttttcacccacttaattttttggctgggtctgcctaacattctaggcacaagttaaagaggtgatcaatttttagaaattataaccctaatgctaacatgaatgatatataaaaaggccgcaatggtagactataatggcaacaactctgaaacaatg

SEQ ID NO: 32053 - DNA, 3003 bp, Unknown
  misc_feature (1)..( 3003): 2750-1469P.txt file - cDNA_ID_3048545; gDNA_ID_1621097; Annot_ID_171147
aagatacatgtactaaaaaattacccaaaagcaaaaatatggcttcaccatccaacttcccattttcttgacaatacatcttcaccgctcgctgaattccaaagataaaggccatcagtttttgcagtccaaatgcaattcttccaaccgcatctatggaacaagataacatcatcccaaaacacgtttacattcatatgaccattatctttgttcatatagcaccaaaaaaaagttgagtgaagcatattttctccgaagttccaagaaaatctatttctaaacttcagattaatttcacctagatcatcttctttagatttacaatggatgaaaagagtttcaccagttgtcaaaccgttaacaaccgtgacttgccactcagaaatcttcgggactataatgtctctcgtggtggtgccgccgactaagacatggtcttgacatgttagggccagagaaaagcaaattgccaagagaaattgtttgatgcaattcatacttttttcaggcaagcaaaatctttagggagaacttttttgttacttctttttataatggaagagtgaaacggtaattgacgtttaattaaattttgatgttattacattgcattaatgaagagtcatgctgcaaatcatttaagtgattgcatgttaattagaaatgaagctgaaaggttagtacatataataatccaagtacgtagatgattgtggcataatatattaagattaaaaaatactaatttatattgtggtgtaagctattagttttgaatttattatgtgaatcaattttaaaagttattagtttttagatttagattatgacccaagaattcgaagtatataatcgaaaaatttaatgtataaaaataataattcaacatggtcgatcgggtatttatttctagtaaaatagtatttcataaacctaattttagttaactatataaattataacactagtaaagtattctgccttttacgttactttattgggattaataaaaatatattggattcgttgaaatccaataacaaattgtaattttgatctttgattcatagaaacaaaaagttacgaaattaaagaaatttttaaacaaaagagtactcgaccagaaaaatatgtttttttttctattttctcactcatatttttcagatagagaaagcaattttcagtacaccgaaattaaaatccgacgactaaaaatagtttcttctctctctcaaatccttctgagaggagaggtttcttgtcgatggagtttgatttcggttttgtctggaattttatatatttccgtgtatatacaaacaaaataactgccgaccttttatcggatttccgttattagctttgttcgatttatcaaaattttatatacttttgtgtatatacgctctagcgaaattgatctctcttccatctgtgtccgttgatgtctccgtttttcttctaaatcttatacgatctctccaattttttcgaggagtaacatctttgtcacttccttttgctaagttcatactacatcaagttaggtgtatatagtggtggagtttcctcggagtttggtgttgttcgaagaatttcgaacaatctctttcaatagatctagagattaattgacggttggtttggaactgagatcgttagaaaggaggaagtttctcaaaatgacttcattaagcaaatgctttttctttgcattcttgtgtttcattgctctcttgactccatgaatggcaaaattaaattacctaggtgattatttacgctatcctacagatattttcgattttttttgttttgttttgttttattaaatattatgttttgataaatttagtttctaatttactaagcactcactcatccattcaacaaattcaacaagtattcttatttcttagtgtcaaagtacttttcttatcaaccttatcaacaatgtatcacactcacactcttcagaaataaatttctatcctaaaccaagtttaaagatgataatgttgagattatataaaccagtaagtatatggttaaagtgaaaatagtgctatatattatttccttcaacataataccgtagtttctaatttgattttctaagtaaatctaaattgaataaaaaatttacttttatcactaattttaattttaactttttataaactagatatcttttttggtaatatatttttaattgtaaatcattgactcatattttcatttacctaaatactaaaccaaaacaatcttttcaactatatattttccccatgtacttaactaaaatatcataaacaaataccatacgcagcgttttgaagcatacgtcgcatttctctttaatcgttaatttcctgatttaggcttcaccaattttttttttttccctgataaaaattttagcttcaccaccaccattgttcgtttgggtgttttgaacattgatgaatcgttgcttctgagatctcgacgaagataaaaagctcttcggctacttcaggtaaatttcaatttcgatttctgtatcaccaatctccttgcgaatgaggttttgtaaaccctaaatccagttttgaacctctttctctcttccctagtagctctctttctctatccactaattctagcattttgcatcagtattcctctctgcgttcatttctgttttgatgtatgtgattgccctaatcgtcttggccgttactcatttcgttttccttttactctggttctaggtttcgagctcactctgctagaaaccctaaaaatttgattttgtgaacttcccgtggtaaatttgaaagggagatatctcagaacccctaccaaggacgaatcttgatcagagcagacttgatttttgaggtgagaagcttagggaaagttttgttaattgtgcgttcgaatttgagagttttgatagacagtgtttacattggaggttttagattgggtgtaaggaataagtagataggtatg

SEQ ID NO: 32054 - DNA, 3003 bp, Unknown; identical to SEQ ID NO: 32053
  misc_feature (1)..( 3003): 2750-1469P.txt file - cDNA_ID_3048545; gDNA_ID_2926165; Annot_ID_199081

SEQ ID NO: 32055 - DNA, 3000 bp, Unknown
  misc_feature (1)..( 3000): 2750-1469P.txt file - cDNA_ID_3048551; gDNA_ID_1621097; Annot_ID_171144
tcacggttgttaacggtttgacaactggtgaaactcttttcatccattgtaaatctaaagaagatgatctaggtgaaattaatctgaagtttagaaatagattttcttggaacttcggagaaaatatgcttcactcaacttttttttggtgctatatgaacaaagataatggtcatatgaatgtaaacgtgttttgggatgatgttatcttgttccatagatgcggttggaagaattgcatttggactgcaaaaactgatggcctttatctttggaattcagcgagcggtgaagatgtattgtcaagaaaatgggaagttggatggtgaagccatatttttgcttttgggtaattttttagtacatgtatcttgttgtttttggcaaaaaaaaaattgaaataataaaaaacatttgttttaactttctctcttattttgtgtatttttcatcaatgatagattttttgttttagttctttatttataggtcatttaattattagattaatttcctgagataataagatcatagattaaataacaatattgtgtttgtgatatatagagattacattttacacttatatatagtggtaagatttctttttgctttcaaaccattaaaaacctgttaaacgattaacttgactcaagacaaagccattgattattgactcatgaatctagtgactcatgatgaaggagacgaacagtaaatattcatttgattattttaggtaaaaggtagttcagacctagtcatatatcctctaaattcatatagtgatgcaagtattttgcattacttagaactttatattattgatcacccaacacatgatttaataaacgccatgaaatgcatgtactatatcaaaatgtttctgaagcatatagttgacatgagaattttggattggacttaagaatgtgagagttacctgaaatgtcaatttttttccctttgttaacgaaaactcattggaacaattgtatcccccttttggcagtatataaatatattgatggcccaagtagctgtattttccgttatcagccaagactcaataaagtctaccggtccaaatttcaactgaatcaccggtccaaccactattaccgtaactagaccgctttttcttttttacattcggacaaaaaaatcaaaatttcgagcaactaaattgatctcatcttcaatcaaattcatcatcttcgatactcgtttcttctctctttggtttcatacagatcccaaatttctagggctcctagtcctttgatttcttcgactggaatcgcaattccccactacgtcaagctggacagacaccgaagggatcgccatgagagtggcggctacgaggattcctaccataaccaccgagcccatcccagaggtccatctcgtccctcagattcacgcttcgaagaggatgatgatgattttcgccgccaccgtcgtcgtcgtggaagcagccctagcaattatcgaattggaattgggggcggaggaggaggtaatggtggtcgacgctgggaagatgacactcctaaggattttgatggtcccggagatggaggtttccggcagatgaatggtcccccagatagagtagattttaagcctatgggtcctcaccatggtggaagttttcggcctatggggtttgcctacgatgatggttttcgtccaatgggtcctaacggtggtgtgggaggagaagggacacggtcaattgttggagctcggtataactatcccgcgaagtatcctccttcagagagtccagacaggaggagatttatcggtaaagcaatggagtctgattattctgtaagaccgactacaccgccggtccagcagcctctttccggtcagaaaagagggtatcctatctcagaccatggcagctttactggaactggtaagcatgagttcactcttctttcttctatgtatatttattcttgtagtctgttaaggttcctgagtgtctcttatttttgtgggaatcaatgattagagtattgaaaggtagtatggttgttatgttactgtattgttgaaggtttttcatgggatcgactctagaggatcctttcgattttcccatgtatgtgataatcaaaactatatgccatcttcatgtgtatccttatctggttaatttgatttgcagatgtctctgatcgtagcagtacagtcaagctttttgttggatctgtaccaaggacagctacagaagaagaagtgagttaatcttggaaatcattgttatctatatactcattactgagaaccttttctaaattttttctgttggttttcatattgtagatccgtccctatttcgaacagcatggaaatgttctggaggttgctctgatcaaggacaagagaactggacagcagcaaggtatgtcaatctccattttattaggaaatagtcgtgaattatactttttaaaatttcaggtctccctgaaaaggctgatgggaagcaaccccagtctcatcattggcctccaattgtttgcaacaattttcgggcttattgcttatgcttgccagcgtcttatctgtgttcgattctgtcacagaagaaggctacctgtgctaagaaagggtttatgtacttatgttgggcaaatagatttcgctacttgtgtgtattctagaactttagatgtgtttgaaaagtgtagaatttattgagggtgttttagagttggagttaatgtacagagaactgaattttgctgttgcctttatagtgggaattggttataagaacatcgctattttcctctcctattgaaattcattttctttactcttcctctagatggattgaagatgttgtgtatggtcttgacaggatgaatgtatttttttaagttggtagtttgataaggacatgaggttcaaaagatggtttcttgatttgccactcctgctggtcaaagatttggccgtctttctaattttatcatg

SEQ ID NO: 32056 - DNA, 3000 bp, Unknown; identical to SEQ ID NO: 32055
  misc_feature (1)..( 3000): 2750-1469P.txt file - cDNA_ID_3048551; gDNA_ID_2926165; Annot_ID_199078

SEQ ID NO: 32057 - DNA, 3000 bp, Unknown; identical to SEQ ID NO: 6559
  misc_feature (1)..( 3000): 2750-1469P.txt file - cDNA_ID_3048559; gDNA_ID_1621097; Annot_ID_171140

SEQ ID NO: 32058 - DNA, 3000 bp, Unknown; identical to SEQ ID NO: 6559
  misc_feature (1)..( 3000): 2750-1469P.txt file - cDNA_ID_3048559; gDNA_ID_2926165; Annot_ID_199074

SEQ ID NO: 32059 - DNA, 3003 bp, Unknown; identical to SEQ ID NO: 28108
  misc_feature (1)..( 3003): 2750-1469P.txt file - cDNA_ID_3048571; gDNA_ID_1621097; Annot_ID_171131

SEQ ID NO: 32060 - DNA, 3003 bp, Unknown; identical to SEQ ID NO: 28108
  misc_feature (1)..( 3003): 2750-1469P.txt file - cDNA_ID_3048571; gDNA_ID_2926165; Annot_ID_199065

SEQ ID NO: 32061 - DNA, 3000 bp, Unknown; identical to SEQ ID NO: 6562
  misc_feature (1)..( 3000): 2750-1469P.txt file - cDNA_ID_3048577; gDNA_ID_1621097; Annot_ID_171125

SEQ ID NO: 32062 - DNA, 3000 bp, Unknown; identical to SEQ ID NO: 6562
  misc_feature (1)..( 3000): 2750-1469P.txt file - cDNA_ID_3048577; gDNA_ID_2926165; Annot_ID_199060

SEQ ID NO: 32063 - DNA, 3003 bp, Unknown; identical to SEQ ID NO: 17970
  misc_feature (1)..( 3003): 2750-1469P.txt file - cDNA_ID_3048581; gDNA_ID_1621097; Annot_ID_171124

SEQ ID NO: 32064 - DNA, 3003 bp, Unknown; identical to SEQ ID NO: 17970
  misc_feature (1)..( 3003): 2750-1469P.txt file - cDNA_ID_3048581; gDNA_ID_2926165; Annot_ID_199059

SEQ ID NO: 32065 - DNA, 3000 bp, Unknown; identical to SEQ ID NO: 6564
  misc_feature (1)..( 3000): 2750-1469P.txt file - cDNA_ID_3048585; gDNA_ID_1621097; Annot_ID_171122

SEQ ID NO: 32066 - DNA, 3000 bp, Unknown; identical to SEQ ID NO: 6564
  misc_feature (1)..( 3000): 2750-1469P.txt file - cDNA_ID_3048585; gDNA_ID_2926165; Annot_ID_199057

SEQ ID NO: 32067 - DNA, 3 bp, Unknown
  misc_feature (1)..( 3): 2750-1469P.txt file - cDNA_ID_3048593; gDNA_ID_2926112; Annot_ID_196673
gaa

SEQ ID NO: 32068 - DNA, 3003 bp, Unknown; identical to SEQ ID NO: 17977
  misc_feature (1)..( 3003): 2750-1469P.txt file - cDNA_ID_3048593; gDNA_ID_1621097; Annot_ID_171115

SEQ ID NO: 32069 - DNA, 3003 bp, Unknown; identical to SEQ ID NO: 17977
  misc_feature (1)..( 3003): 2750-1469P.txt file - cDNA_ID_3048593; gDNA_ID_2926165; Annot_ID_199051

SEQ ID NO: 32070 - DNA, 3003 bp, Unknown
  misc_feature (1)..( 3003): 2750-1469P.txt file - cDNA_ID_3048597; gDNA_ID_1621097; Annot_ID_171114
cattggagatctctgcatattcttaggcaataatgagcccttttgtgtcaaggcaagctcattccctggtctaaaccctaactccatctattttgcaggcgatggcttcggtgtttacgatatcgccactagaaaaccacgttccttccgtcccaagtctccctcagccttctcgtcagcatcactcctcccttactggatccctccaatgtctctttagtttacttgttcttcactagtcatgttctgtaacttttgttttttatgcttataattgttcttttgcgagcccttggacgttggccgccatcttcatacgagttaataaattttggtgtgaggaaatatacgagtcaatttatgaaacgaaggtagtaactttcgtaattccttttttttttttttttttctctggttgtatgaatcattcatcatcgatatcttatacttttgtatcatgatcgtatggatcattcatcatggaccttgaggggttactcaatagagagcagtagtgtggaagaccttcttggtatgactaagctcagaactctcacggtccattcccttgatggttgtacgttagaaactctgtctgcatctctctgtgaatcgagagaactcgggcagctttcattgtacgaggtcatgcatgataggcataatgaaggaaaattagttcttgatttgattcaactcaaatttttaacggtgggcatgcatatgcctaggttgcctgatcaacatcgattccctccaaaccttacgaacatatgtcttcggtattgttgcatggaagatgatccaatgccgattctagagaagttgctccacttgaaattggttgaattatcatatggtgctttcactgggaagaagatggtgtgttcaaaaggtgggtttcctcaattgtatgagctaaatttatgatttggaagagtggatagtagaagaaggctccataccatgtctccatactttgactataaatgaatgcagaaagttgaaggagcttccggatgaggtcatatacataacatccttaaaacaactgacaattggaggaaggaatagtgaatgggtgtggaaattgtctgaaagaggacaagatcactacaaagttcaccacattccttgtgttcagtttatttactagacctttgtctaattttatgtataaaaattataacaatgtagaaaactacaacacaaatgagatcaaattctgatttttaaaatccggttgtgatgattattaatcgtggaaaaaaatcagggattataacttttgttaaattgtgaacgtacaatattgaactgaaaatgccaaatgaattggttattattactttgatgaaaatgaattgatcgtttaattttttttatatttataacaaaaatgcgatatgctctttttaattctttatttctatttttgcttcagaattttttttcattttatttttggtcaaaaaggttattaatttccttttcaatttgtacgaatttaaacggtgacgtttttgtttaaattatcaaacaaatcaaaacaaaatcaataaaatctaatctctcatcatgaggcatctttgactgctctttaattcactaaaaaagtctaaaaccctaaccattgccctttttcaaacgaagaagaagaagacgaaacgctaccatcatctacacacacacacccaactacttttttccatcgccggcctgtacaaatgtcgactacccgtaggatccgcggcgagaatcggttttataacccacctccgatgagaaaacttcaacaagagcgtgagaagaagagacttgaagcggaggagatagagaaagagaagaagaaggcaaaggagattctcgatcgaaagattaaagtcgaggagaaggagattaagcaacctgaggagtgctcgacctccgattgctctgtgccgagtcgggtctcctccaccaccaccaccaccggaactacttcttccaatttgggccggtttctggattgcaccactccaattgtttctacgcgcacttgcctttggtaattactccgattttgaagttttacttgaatcgacgactagggtttgggcagttttagaatgagaacattagcatcaagcgttgaaaatgggaactttttatcaattcttgggaacgattatgatctcagtctcttattgaagatagaattggtttcaggttttagaatttatcgctatttaggattgtagatttgagaaacagattcagttagtagaacaattgtgatgttgttgtggtcagtcatagtttctgtgtttttgcttcagacaagtagtaaggggtggagaactcgtgaaccagagtaccgtccctatttcttgctgaatgatttgtgggattcatttgaggaatggagcgcctacggtgtcggggttcctcttcttttaaatgggatcgattcggttgttcagtattatgttccttatctctctggtattcagctttatgaagacccatctacgagcctgcacaactaggaggtgagttcttacattctgcttatatttttgattgtttcctatcaaccattagcagtagtgatcgggttctttgctcgttgattggttcttcttctgatagaaaaaaggatagcagttggcttttttgtcaatttatatattttgagatgaagccacttctttcttgggttgttcttaatcttcggatgcacgttctttaggagataggaaaaccaacttctaagcgttctctgctacaatatctagagatattcatttggatgactaatacacaacaacttttatgctctcaaatactagtcagtggttcaagtttatcatggtgttgaattccaaatttgtttcatctcgttggttttctctttaattcccaattcgtttctgctttctagagtaaaattcgttgttttgatgtttgttcttaaacaggagagttggtgaagaaagtgatggtgattcgcctagagacatg

SEQ ID NO: 32071 - DNA, 3003 bp, Unknown; identical to SEQ ID NO: 32070
  misc_feature (1)..( 3003): 2750-1469P.txt file - cDNA_ID_3048597; gDNA_ID_2926165; Annot_ID_199050

SEQ ID NO: 32072 - DNA, 3000 bp, Unknown; identical to SEQ ID NO: 6549
  misc_feature (1)..( 3000): 2750-1469P.txt file - cDNA_ID_3048610; gDNA_ID_1621097; Annot_ID_171109

SEQ ID NO: 32073 - DNA, 3000 bp, Unknown; identical to SEQ ID NO: 6549
  misc_feature (1)..( 3000): 2750-1469P.txt file - cDNA_ID_3048610; gDNA_ID_2926165; Annot_ID_199045

SEQ ID NO: 32074 - DNA, 3003 bp, Unknown
  misc_feature (1)..( 3003): 2750-1469P.txt file - cDNA_ID_3048679; gDNA_ID_1621098; Annot_ID_171230
agaagatgataacagtaataataaaagcaaaaggcaatcaacggtaacgacgaaggctgagagagttgtttttcttccatgtagccctgcgagatggacggttcttgtggttgttgtgaccctttccgcggagacctctgttcttctttccctctgaggtaagtcctctgagctcacggtgcttgtgaactgggttgcagatccagttgattctcgggtcattacgcacagcattgtgtgctgggtcaaccaagatgatctcgtagtacttgtaggtcgaatcctattaaagaaaaatggacaagttaaaatatctaaccagaataatcacctaaacgaaagagtactgaaagaaggtagtaaatgtacctcattgagccagtaagagttgacaactctgagaccacccaatttcctgccagcacgctcctcagcaacagaacgcttgctacgctggaacttgagttgtgtcactccctggtttgttggcttaccatacacaatacccttaggcactggcctcttgcgtccaccacgtctcacacgtacacggtacacaacaaagccctgacatacatcaacatctcaactagatttgtaacagaatttgagactagattaaaaatgattcaatcatcaaacaacgcttccatatttctccactaacacagcaaaaacatcaaaatcaaacaacttaatctagatcatacacatatatcacagcaatatcaacaaaaacctcactatctacaacactccaagatctcattttcaccaataacaatcaacgtctacaaaactcattatacagctgaacagcagtgatcaccaatatgaaacaaaatcagctaaaactcaaatttagggtttaaagagtcacctgcttggccttgtaacccaaacgacgagccttatcaggacgagtaggcctgacgagacgaacaatcgaaggttgctgtctgtactcccagcacctaaccctctggaggaatctcatcacatcggactgtttcttcctccatagctcagatacatacttgtacgcacctatatcaatcaaatcattaagctaagtagtttgcaataacagatacgtaacagaaacatcatttgaacaaacaatggagaagctgaatcgatctaagaaacgagaggatttgatctagaagaagggatggagaagaaggatttacccattttcgaagattcgcagagccgcacaacactggcgcagtgaagggtttgttcctgatttaaagtggaagattagggttttatctccaatggacctttatattatacgaaattgggctacttgaattaataaataaaggcccataaaagacttccactattgggctttgaaattcggattaaggccctttaatttctttttcagacgaacagacacacacacaaaacaaaacttgtattgagtacaaaaaaatatttcatcatttgacaaaattagaaaaacattattatgtataaatagtaaactattttctgcacaaaaaggtaaactattttttcatatgatgatcgattaaaagttcactaattttatccttttttttagagtgatgcaaaaaatcattgtcaaaggaatgaaaggaaccaaagaagacacggggagagcccatcccagccggagagacttataagtttgatagacaaaaacgtcagaaatcgtttgactacgatgagtggtggtggtgttctgaagtataaggatggaatgagagtttggtttgcatctcgtgcttagaggagagaagtttctttttcataaaagtttcaatcagtttgcattttagtgtaaagaacgttttatttctttgaatataatttagcattaaattcaaaaaaaaaaaaaaaaaaaatcattgtcccaacgactatagttggtcgttggctttgacacaaacaagtataaatgaatacaacgatcactagcaaaaaagacatgtttattgtgaacaacgagagttaccgaaactaagacgtaagtaacaagtaacaactcgacaagtatgttttagacttttctagttgaatatgcaaaacagagtatacgctttttgttttttgtttttgtcatggagaatcaaataaatacgaaaccatctggttcaaacttcaaaggttgtaatcttaaaaagaatttggcccgtattttgtcatatttccgaatcatttatttttcgttttttgcattggtataatcatgaagtaattttgtccactgaagtcttaatcttcttaaaatcgttatccttcatagttattgtagtgaccaatcgaattcatatttggtgatggatgtgatgctttcagctattatcattggttaatggagatatactttgttttcttaattatatcgatttatgacctaattttcaatgttatatcaaacaaaataggcatgatcatgttttaaacgtgtctcaaattacagtgtatgtgtgtattttcttattaatatcattttcattgttaaatatgatgaacataaattttaatattgtttggccaaaaaaaatgaaaaaatagtaatatgttaaatatgatgaatacaaatgtaattaaccttattgtatacctcatgtgaggaaatcaacctttctaaaaaaacttaattagaaagtgagagatatctaaatcatttgttttatattagtaatttttaaaatcagaacaacaattgatttaaatggtataacttcttatcggcctctacgtctataaatatgtacatcaagtgtattgtttgacagagtgacaaaaaataagccaccaaagtgtttgtgttttatttatcagctccattaacctttacaaatatatggctgctcataatctatgcttcaattcagcttttgtttgcaacgttcatcatcaaaagactcagcattttccttgtaacgctgtctccaaaacgacctcgacccatgctgtcaccttccaccgccgttccgccaattatcgtccacctctatg

SEQ ID NO: 32075 - DNA, 3003 bp, Unknown; identical to SEQ ID NO: 32074
  misc_feature (1)..( 3003): 2750-1469P.txt file - cDNA_ID_3048679; gDNA_ID_2926166; Annot_ID_199160

SEQ ID NO: 32076 - DNA, 3003 bp, Unknown
  misc_feature (1)..( 3003): 2750-1469P.txt file - cDNA_ID_3048683; gDNA_ID_1621098; Annot_ID_171225
ttttgtagttaattacttcaaaagttttagttacttgtttaaaaaataaagttataagattttgttagagataaaatcataaaatatacttagtctagcatatgatagatttattgacaaagaaaccaagaatacaatttgaagtgagtaaagagagtaacctcaagaggatttcgtaatatattggcccaacaccaagctccgtgactggccctatgaacaaacacaaagagaattacggactcatcaccaccgtaacctcccatcgtaatctcaatcaatgtgtgtgcttattaatgctaatccactcaatttttaacactaaatgtatgcagtttagtccacatactggagatatcataacgttacacgtctatctgtgttggacaaaaccaacatatgtactctcttttcttgctagctgacaagtctttcaaacaagctagtgttcactcaaacaatttcaaggaaaaaggcagaaaaaaggaaaaagagacgtgaacttaatctcctctctcgtctgtggtccaaatacgttttgaggttatccgtaaaataacgtacacatgccttatgaataataaaaacaaaattttgctttaggccatcctgttatataaatttcggatctctacacttttaataatatatatttttttaaaatgtgaatctaaactgaaccaaaacaaaacaacaagaactatacgctaaggcatcgaagggtcacaaaaattgttaaaagcttgaggataatgacatgtcatagtgttgagataatgagatgacatgtcatagtattcacctcatgttgtcgttcaaggatatctttatcacctcatccatcaaaaacaaagatagcaccatatagtttttctccatgaaacttaattaatcttagctactatgatagatttattgacaaaaagaaaccaaggatacaaataacattcctttacaaggagatttctatctctcttaccctggattgcttcgcatgtaaagcttattcaaactcaaatcaaataacataaaggaaattacttaatagaatcataatatcatatcaatcaccttccaaacaaatcatctaattattcccaattagtttgttatctagatcggaatgtatgaaggataagttgaagtttatcgttgaagaaaagaaaccgcacggaggagatacgcgaataaggtagttgggacagagaagaaagcagaatggtcactatcctccaagacatacagctgagaaggtggccaattctccaccaaaaggtcttgacgcacagaatcaaatagattatccttagcagtcttgatgtaaactcgaggaactttctcggcctcgggatttggaggtagcttatcaagatcttgaaaggccctcataggagcaggacgcaacagcttagatgacaaagttacgtcctacaatataaccaattttatttatatactcaattcaccacatattaacaaaaacaataataataatactatagtgttgaaatataatttatgtatactagtaattaagagattaacctcaagagggctttggctatagtaataatggcgtataaactccggtttcatgaggactccggtgggtggtttatcggtaccttcaccatatgtgtactcccatatatcttcttctcccacatgtatctatcaaatactcacaagagttaaatagctagcgagtggttctatatatcttctatacattacaaaaaaaaacgaagaagaagagaggtgagttagtaaaagagtcacactcacgtttgaaagatgcggagaagggatggatccgggttgaaccatggaagccgcgaggtaaatggccatggagattttgtcagtgaacttgcaaagagcttcggtgacacttcctccaccgatgctatgtccaacgagtatgactttgtggtgaggagggagatcggacaagagagagaagagaggacggttatattggtcggagtcgaagacgatgttagagtctatgaggctgatgccagcgccggtgagatctacggaggttgatttgaacccggcggcgtcgagaagagtggtgagtttataccaacaccaagctccgtgactggctccatgaacaaacacaaagtgaattacgggctcagcaccaccttctcctcccattgcatgaatcttgatcaatgcttttacactatctcaccttttaacacgttatgcagttttggtccacagtttggagataacaacgtaacgtacgatcctttttttcctttttcaaaagggtctaatgtttgtatttaattttgctaccagctcaattttccattttttcattttaaatttgtaaaaaagatattgtaaagcacacaaaaagaaaattagatgttaaggtaaaaagaaatatttaaatttcagataattaagattccaagtatctgagcaaaactggaatcttaattatctgagtattattttcttgaaatgcctaatatattctaaagctattaactatgggatccctaataattattttggtacttattaacttatatgaagattctaattggagaacttgcttgctattaaaatatgtgatttatacatagatatatttaacggagattattgaaatatatttttatcatatgaagtttaatgtggttattatgtggttaactattctactagattaatatgataaattttacgagtatgacacataatcgaatgacttgtaattagtgtcatgtcttctttagttctctaaatttaaatttaaattgggccataagcagaggcccattaaatttaggtaaggttttaggctcagtaagcaataaattgggccgtaaagcaaaggcccattataagtagtgaggaaccagaaacagaaaaaaaaagagactcacctgacgaatctcaccggagagtctagatctcttctcttccacaacgaagtttggttcatcaccggcgaatcctttctccgacgtcataatg

SEQ ID NO: 32077 - DNA, 3003 bp, Unknown
  misc_feature (1)..( 3003): 2750-1469P.txt file - cDNA_ID_3048685; gDNA_ID_1621098; Annot_ID_171221
atagtaataaaattttgtgaggcgatattgaatgctaattagttagagattaattaatgatagctttttttggtgactatatatgttgattaaaggataaaataccacaaaatataatttcaaataaatgaaaattattggattgatatgtctactacatcacatcatactgtatatcggacataaaagcaagtacgtaattaatggattgatgatattcgtgagctaattaagctatgagtgtgacatagataatatggaacgggttcgttggagtatagttgaggtagctaatgagtttgttgaccagaattaggtaaatttcaatttcaataatatatccgatccttttttaactggagtattatttaagaataatcaagaccttctcaaggtttactagttcagattcttcgttattgggaaagtttgtctgaagaagaaatccttagaatcatggagagggttacgtgtgagaggagacaactaacagaagagtctcctgttgaacaagatagggaggttgaaccaaaaggataaacaattctaccaattagcttcaattatttaattagttttgtagattagtcctatcgtattcaaactctcttaagcataccattgttttcttcgttggaggctgcctatgtttatctactattattaaaaactatagatacgtcacataagaaataaacagatgtaataagattaaccaactagatgaattacctttggttgttgaaagggagataaattataactgatggtgatgtaatgcattcggagaaattctgagagagacatggacaatggcactagaggtgtcccaacaaattatatttccacacattattattcgattagggttccaaattccaaccacttgttttttttatccatattgatttattcatataaaacatatcattatcgtattttatagcgataaaaacatgtggatacttttaaagaagataaaaagattaaaataaaacgttattcagtatatttcgtaattctttgtagtactagggacttacctggacgggatcaactcgtgatcaataagacaagtggcctaggctagtgatcgcattgcacatatcgtttgggtgctatgcttaaggttttcctttaaggaagagtatgtgtcattatttgtgacagaggagatttgcattcgcgcaatgctactgattttcaattttccactcttgtcacgagtactgttgagagttaaaaggttcattgtcaagaacataatcggcattttagtcttttggactcaacatttgcattaattgtattcaatatagatggaccatggaggcgtgaatattgttctaactgctaaggacatcatatctcgatatactagcttgaccaaatggttgagctctttacatactcttcctcaatcactcgtaaaattgaacaaaaaaatttcaaatcccccgtttcaaggaaattatttaatattctttcatccttatttcaaactcactatataaattaaaatattgcttatttataagctcattatacaaattccatatagattctcgtccctttgattaataaacgtcaactaattaacggtaataacttattatatagtaccttacaaatctctagattggtggtccaacggtatttggatcaacaccattgaaataatttagtttattgccgatttaaagtagattaattatcctaatgacaaatatgattttttttttcttctttttgtcatcacaaatatgaattggtatcctcattggcctgattaacatttctaattacggatcttacctcttcgtgccaaagaagacatttggaaatatatgacccccataaaccaaatatatgtttcttattaatgttgtggaatttgggacattttttaaaatggacaaaagaagacagaaacaattttcctacccaaaatggcgtccttaattttttcattaaattgtaaagcctgtttcaaaagaaaattgactttttgttgtgatagtataaaaaatgacatttgactttttaagtgacaccaagattctgacaataacgaattatatccatgctaattaattgatagcttaattaacaattgcgcaacataacgtgatcaaattaattaagctacatatcaggccttgatccgtggtccaaataatcatcctactaaagaaaaccagcttgttatagtaaaaagccgaattcgtgtaaaaatcggtttaaaatattcggtatagactctaatctcgatttactccggtttggttatcgtgtgtgtgatcgtaacttgccggtggatttgcgacggacacgtgggatgttgtaattgtctcacgtgactcatcgtaactacctttaaattcgctactgtgattttccagattcttatgtacatttgtgacttcttcggtctatttttgttatgtttccaaaaagacatgaatgaagaaacattattacagtttcttttcttcccttaagcctatttaaaattgatatttctaaattcgaactatttattcactagtcgaagccttttaacgcaaatctgagctcttaagtggcgcaaaaaccggtttaatatgtaaatagtaactcggtttagattaatttcgggttatttttgtgattagtgtagttaactaattaattcaggtgaataattatattagagagaaataaatttcaggacaaaaaggcaaagctttggtactgtctcttctcttctccgtcttcttcaccatttcgaaaaatctcaaaactttacagagagaaagagagatcctttacatatacttcactgtcttcttgaaaaccctaatcctccgatctgtttaacctccgatcaagagagatttcttcagcttgtgtgtatcagattcctttggattccccgattcttcgtcgtatcgaatcgggggatggcatttccgtgaaatcagtgatgaaattggaggtgagaagaagttatttctatctatg

SEQ ID NO: 32078 - DNA, 3000 bp, Unknown; identical to SEQ ID NO: 6606
  misc_feature (1)..( 3000): 2750-1469P.txt file - cDNA_ID_3048697; gDNA_ID_1621098; Annot_ID_171207

SEQ ID NO: 32079 - DNA, 3000 bp, Unknown; identical to SEQ ID NO: 6606
  misc_feature (1)..( 3000): 2750-1469P.txt file - cDNA_ID_3048697; gDNA_ID_2926166; Annot_ID_199137

SEQ ID NO: 32080 - DNA, 3003 bp, Unknown
  misc_feature (1)..( 3003): 2750-1469P.txt file - cDNA_ID_3048699; gDNA_ID_1621098; Annot_ID_171201
ctcaacttgcaaccaacaatttacatcaacttcgttttggtaaaaaaaatatcgatcgaagataggtgtttttgaccaaactgatgaatgtatcaattctaatcgtaatacattttcgacatttaccacactgatgaatggtttttactgttagggtcgaacaaaaaaaaaatccaaattgatgttagctgttctgatgtctctaatttcgattaattctaccaaaacattaataacttggactacattttagttgaaatttaccccttaaaaacatccaaattgggtgatacattggtgagagagaaaccaaacctcatttaaagtcataagttataataatgcagatgaggacaaatatagattaggatatggtgttgctggtaaaggtgtgaagcgactttgcctccttggtaccttgagaaatgtaatgatgaagatgatagtgttcgtggtgaggatgatgatggtggatatagaggttatgaagctgagtgggaagaagagttattggcccataattctaaaaatatacgacagccattttgaatgatttcaactaaacatacggttagttccggtttatattcagtttcgtaaccaaagaaaaacgcaaatcccaaattttccggaaatggaggaatatttgaatcttatgttgaaagcgagagagattcttgttagtgaaagccatgaagaagtagcgatggtcatcgatcatctctttaagcgtcaagactccgaagagtataaaacatcgcgtgcgctgtacgacatctgcgtttcttgtaacccaggttgcttaaccctaaagcttcttaaagtctatcaatcttcttccagtggcattctcagactccgatcaatctctcaactctctgagaccctcacctatctgaaaaatcaaatcgtattttccaaattctctctcgactctctctatgaaatcaaaccccttttgattttatgccttacaatgcaagaaaccaaagaatctgacatcaagatcctcaggaaaatcgtgtcttttgtaacttacaatgtcgtggagttgcataaagacaaatgggacgagctcggtgattgtatcttatccctagcgagtagcaaagaacctgtcaaggcttttcacgtcttcatcgatctgccaccagtctacaagagtttcatcggcaagtttttggacaaaattttagaggaagctagtaatgtctttctttatccttatagagttgaagattggagcttggctttacaaacttttgttaaaatgtggattcagcttgagaaaacaggggtgacagtagagttactaatggcgttgatggagatttggatttcctctgttgtgaattcagtaaagaagctagtggagatgaaaaaagaacagtttttggtacgagggcttgaagatttcgagagtttcttctcaggagacatgaatctgtatcattacactaaagaccaattccattttgtgttggcttccatgaacgagatcgaaggagtagtcggaacagagacaaaggagattgtgaggaagatcaaaatgttggtgacagaaccatatgatgatcttaagaatcgtagagaagagtttgaacgtggctggtatgacattttgaaggatttatcatcactggaagtgttaaagattcttgcgtcctctgaacttgaagataggtccaaagagatagcaatcagacgactcaatgtcttactctctgatcacacttcaaagaaagtgcagatagacatttcagagatgagacaactccaaccattgctcatctcttgcttaaaggaagaaggactttcctttaacagtatgttcaaagtcctaggtgaggtggtgaaccatgttgcatatgagatgttgatctaccaagaggagacatggtacgagctacgagattatattgcatcgagtaaaacagagtttcatagagcggtttatatcttccagtgcttaacaatggcacttattgacgacgattttgtgattcctgtgatggagaatcttttcctagagataatcacaaggctagacccaccaagagagttgttggtagataacagtagctgggtcttggcgtttatgggtggcttttgtttagcaattcacttgatagagatgtcaagtaaagctgaatccgttaaggagattgcacataagatgatagattctataagagagctaatggaaagagaaatggaagttgggcttgtgaagagaggtttcagagatgtggaaagcatcgtgaagaaacaattggaatggtatagtacgagccaatacaaattcattaagggtctgctttggagactgtatgcaatcaaaaggcatgaaatgggaaagtaagattgtgttgtggagaatcaacgtcattgtggagagaggagtcaaagaagaggaaaaagagctaccagagaatgagtttgattggctcaaccttaatgctgaatagaaaactagtttttggtgttcactatctgatattgtgcagaatcttgtttttggtgtatatacagtttgcattgaagaaggaaataaatagataagagttttggaacatgtacttagtagttcttaaagcactttaattttgagagttacttaataatctttcatttactagcacttttatcttgatgctaaaacaaattcgtagcatcaacaatactacatgtgtcacagattttctcaacaagaatctgaaacagagattcattactgttgttgacgttgcatcagtctaaagcagatctattgggcctttgattattaaaatatcacttaatgggctcaatgggctcaataggcctcaaagttaactatatcaataattaggcgattttctctaacttctctgccaaaattcaattttattccgatcaagtttttattttccaattcgcttcgaagttctctcatccatctcctggttcgattcaatctcatcgtttgaaaaccctaattttgtttggtaagattaagccatg

SEQ ID NO: 32081 - DNA, 3003 bp, Unknown
  misc_feature (1)..( 3003): 2750-1469P.txt file - cDNA_ID_3048701; gDNA_ID_1621098; Annot_ID_171185
ctgtagtgctcaagacactgttctttactcttcgttcccacgtgctccgcaacctctgcccagtttcccaagccataaatttcaagtccctgaataaagacattaaaagaaattacttttcactgaaagaatcagacattatagacttcatatcagtacgataaaagaagtagtggtacctccaggagaagcatttcatcatccgcactccagtcaggacaaataagcgggaaagttagatttccctaacaaagcaaatgaaacatatattaagctttggtagaattcaaccaaaagatattttcgctaagtataatgaatcaaactctttccaaactaaaaggtaagaaaagtaaatgaaaactaaccataactcggtatgggtgatcacatttgtgaggagtgatctctgctccaacagacatacattctatacagagatcaaaatctggacagacagcacactttatcctaatttttccagtaatgtctttctggcaataatcgcagttatacttccctcctccctcagcacctggtactgtctccacaaataaaaaatgttgagtaaaagaagaatcttgacaggagaaacaaaaaaaaaaaaccttgataagtatttttttacccaaagaagtagactcaaagttctccacattagccgcatttttctttttcctcgttctgcaacaaacgcataacacgattctttcatgtcagcttcaacagtgaaaaaacaattacacagatgaaaacagagaagagactacatagctactgaaagttttcaaaagcaacaaactttaagcgatgctcattgtcccaactgaaaaatcaatgattgttgcacaaagcagatgcaaagaaacttcaaaatcaatcaatttcagcagaaattggcacaattacatagatgaagatagaggagactatagctactgaaagttatcaaaagccacaaatttgaagccatgctcattgtcccaactagagatcaatgacaattgcacaacacagactcaaagaaacttgaaattcaaatcaatttcagcacaaattggcaattacaaaagagaaatccacaaaaaccccaaatcggaaattagagtagtgaattaggaacaaacctctgagtagggtcttcgaaattttggaagttccctcgagagcgacccattgatgcccaagtagaaaattggattattgggttatgcgaaaccacagagaagaagaaccctagcgtaatgccaacatgggagactcaccggagaagatggaatgggtacttgggggggtttcgtggaagaaagatctaatcggaattcaacaaaactcggtcgaaatttgtgaggttttggatctctactaatattattcagaagttccgaccgagaagattaaaattagggaagtcgaggtaaaggaaatttctaaggcactgtactttttagattttttgggattagacggtcatgcttattactaaagcatatgacttaaactaaattgactcttataacttcaacttaaaaaactattattttttatgttaattgttgaatggtggttgagggaaaaaaaaatgaagaaaaaaaagctaagatagaccatttttattggtaattttttattattaaaataataaaaataataaaaggaaaagaaagagagtgtagaatgtttctcgttaaactatgaaatactttatacaaaccatcataatatttttctcttttcaattggttcgctaaaataaaaatttaatcatatataaaattataataaaatactaatattctttttgtttgaaaaactgtttgggtttcttcttgatggagatgtctttaatatttggttgggttatggttattcgtttttaggtattttgttcatggacattttcagtaaatgaattagcaagtaaataaacttgtataggaataaatggttagtgttgtcacacactatcggaacaacattatgatgtattttaaaatcttattgatgctaatttgaaaaattgatttggaagaaggttaagcaaggaaacaaccatataagatagtttgatgctaatttaaagtttcttattttggtcgaaaatcgaattattagaaatgtttgaaccttttttattagacatctagtgataaattttataagactcatgtcaatcgaataaaaatatcgaattgttgttttgctgaacgaataagtttgtctatattagacgcgattagttcttctaaaccacattatccaaaaaaatcgtgattgactacatggtgtaatgatacctatcataccatctcaagaatatggcatgactcatccaattaacaattgtatttgcgcataattgtaagatgtgtaaattccttttccgcttattaacggtgatttgcgataagttaattcagaagacgagtttcgattctcccatcataataggttgtactacgaaataatttcccaacatgtacacataatctcgacaaaaatccagtgatatgggtttacttgtagttgaatagatattacaccacaatgacttgtggtttggtatgtaagaaaaggcaaaagtatagtttgcagttaaaaaactgaaggaaatgatgtccttggtattaaattacgattaaacccatattctctctctcgcatagtctcttcctcttttcttctttcttcgtcaatttcagaacaagtcactacagatctgaagtgaaccaagctcaggttttgtcttctctttgatcattcctttctcagcaatataaattagagttatatcctttataaaggattttgctttttcaccaacaaaccctaaattcggtgtctcagcaagaatcacgtgattctcgttcctcttcctcacgaaacccatcatcttctatctcatttgtaagcagcgatctcaatccaaatacctttaattttatttgattccataccctaatttttgtatattccatgtcaatgaacgtttcaggagaaatg

SEQ ID NO: 32082 - DNA, 3003 bp, Unknown; identical to SEQ ID NO: 32081
  misc_feature (1)..( 3003): 2750-1469P.txt file - cDNA_ID_3048701; gDNA_ID_2926166; Annot_ID_199117

SEQ ID NO: 32083 - DNA, 3000 bp, Unknown; identical to SEQ ID NO: 6612
  misc_feature (1)..( 3000): 2750-1469P.txt file - cDNA_ID_3048705; gDNA_ID_1621098; Annot_ID_171184

SEQ ID NO: 32084 - DNA, 3000 bp, Unknown; identical to SEQ ID NO: 6612
  misc_feature (1)..( 3000): 2750-1469P.txt file - cDNA_ID_3048705; gDNA_ID_2926166; Annot_ID_199116

SEQ ID NO: 32085 - DNA, 3000 bp, Unknown; identical to SEQ ID NO: 6581
  misc_feature (1)..( 3000): 2750-1469P.txt file - cDNA_ID_3048711; gDNA_ID_1621098; Annot_ID_171178

SEQ ID NO: 32086 - DNA, 3000 bp, Unknown; identical to SEQ ID NO: 6581
  misc_feature (1)..( 3000): 2750-1469P.txt file - cDNA_ID_3048711; gDNA_ID_2926165; Annot_ID_199087

SEQ ID NO: 32087 - DNA, 3003 bp, Unknown
  misc_feature (1)..( 3003): 2750-1469P.txt file - cDNA_ID_3048723; gDNA_ID_1621099; Annot_ID_171305
atccatatgtagaatgacagtgagcaaattttagcttttacctgttaatcatgggatttcggaagacagttctgacattcaaatgagttgtgcctttttaaggtcagacacaactcctctgtcttggctgcccctttcattgtaaaccacctgcacacagattacagaaagagaatgattcaatcatgcagaagataataactctatgttgacaggaaaacaaaatcgctcatacgttttacggatttttctgacattttatcgtaccttatcaatgatcccatattcaacagcctcagtgggactaaaatatttcgggcgtttcatgtcagcttcaatctgctccggggatttaccaatatgctttgaatacagcttgaccttgagcataacattacatagaatagagacacatctttcagataagtttgaaggtaaaagtgaaaagttgcggacagagaatgatagcatgatttgagatttgctagcatgtgcatactattaatggctaactgatgaatattaagatgtctgcaagtatatacacccattgcctgcaagttccatttatttatatctcccccttaaaagacccaaataacacacacaactggacactgttgcataatgaagatcaaactaagatattctacgtacatcacaagggtttgattctctactatgtgaattcatatcaagtttatcttctcaccatttctgtctttatgtgcttgatttctttccttgcaatttcaacatcagttgcttggccttgaaatcgagcaatgggctacaaagttaacatgcaagagaaaatatattgataagtaaaaaggtgcatgcacagaattaagaatcataaaccttagattcttccaacttgaaaaagaaaaccaaaatcttctagcagggggaaaagacgccacctaatatttaaaagaaacgatcagaaagaacctgctttatcataatagttgatgagggcaacgcagatcgatttccttttgcaccagcagtcagaagcaaagcagcttcaccccaagcattcccgacgcaaagagtaaagattggtggtttgacatacctgaaattcaaagataaggtaagagttgattgttgcattgataattggtcgttctccccaaaatatgctggatatgaaaactgtctccaagtgcaattttgaatatttgggaaagcagtttaagtatccaagtcttgttatcgatgctattacgggaagaagtaagttgaggaaagagatgaagatcaattaccccatgacatcatagattgcaaaagcctcagtatcatagcccaacttttcaccattctgaaaagggagaagataaattctcttaaaaacagtttgaacgataggtaatgatttctaagcttttagtcattcatttgaaacaaaccacagtttcaattttactattcagtatgcgttcttaatatgatggactacataatggaagcccaccttggttgtcccagtcgagtttatgtaaaggtaaataggcttttcctcgtcttcatactgaaggtaaagaaactccgcaagtatcaactcagtaactgaaggtacgagagacattcccaaatatacaattcggttcttgaacaaatatgatgccaaatcaggaggaggttgttcgtgtgcacttccctttgagaaaggtataacctgttgataagacggaagcacgaagataagaatcatataataacaacaataaacaaaagactatatgtgaagaatatagcagcctccaaattctctatcataatcataatcagagcaattgatgcatattataagtggcacacacaatcaagtgaaacctctgccacataataactcaacttcttccttaccagccaaacacacagcataatttcttccgaaactgcattatttaatcttcatactcaactctctaactaaacatgtaccatttccgatcaattaaacaacagaaatgaatgagccgtctttgctatctaattgcatatatcaatagtaactctaatccattaattcgccgtttaaagctaagtagcaaccgttggtaagattcgacccataaattttccctcaattcaccaccacagaagcataaatctcagctatagaatgaatgagcattactcccccttgcaatctaatagcctatatctagagtcaatctaatccattggttcaaaactaaggaacaccatttctcgacaaatacaatttctgaaaattcactaccacagaagcataaatctcagctatagcaacgaaaacctcaatttcaaaatcctaacagaatagggagctcgttaattaagaaactgaaaaaaagtataaattcgagtaccatagtgacaactccgcgtttaggcttggaactggaaaaatttaacggattaagcgattccgcacgaagcttagcgccgcataagtcactagagatgcttcctccggtatacggcgaaagaaagccattcgaaagagaagctctgagagatgaagatgaagaaaatctcggtttagatctcagattacgtgtagaagacgggataatcgctgacgtacgagctcgaagcgttgtgaagctcgtcgcagtcgctgctgctacctccatttcttctttgttgcagagagagagaaagagtgaaagtccctgtgaccccgaaacgataacgatctgtctcaaatcgggcttcataacattatttatgggctcaacaaataggcccaatagttgtagttttttttctctgaaaatattccggtttcgactataatagtaaccaaatcaaaccgaagtaaaaccgggaatttctcatttttcgaaaacgtataatttaatatgaggctaccaaataaataatctactggccactgcagagaatcatctgtcgtgttctgtttgttctcacttctcacttctcagatttttataaacatgaatgaaacctgaattgttccactaactctcagcaaaaatg

SEQ ID NO: 32088 - DNA, 3000 bp, Unknown; identical to SEQ ID NO: 6628
  misc_feature (1)..( 3000): 2750-1469P.txt file - cDNA_ID_3048727; gDNA_ID_1621099; Annot_ID_171304

SEQ ID NO: 32089 - DNA, 3000 bp, Unknown; identical to SEQ ID NO: 6628
  misc_feature (1)..( 3000): 2750-1469P.txt file - cDNA_ID_3048727; gDNA_ID_2926167; Annot_ID_199224

SEQ ID NO: 32090 - DNA, 3003 bp, Unknown; identical to SEQ ID NO: 18031
  misc_feature (1)..( 3003): 2750-1469P.txt file - cDNA_ID_3048734; gDNA_ID_1621099; Annot_ID_171295

SEQ ID NO: 32091 - DNA, 3000 bp, Unknown; identical to SEQ ID NO: 6633
  misc_feature (1)..( 3000): 2750-1469P.txt file - cDNA_ID_3048738; gDNA_ID_1621099; Annot_ID_171289

SEQ ID NO: 32092 - DNA, 3000 bp, Unknown; identical to SEQ ID NO: 6633
  misc_feature (1)..( 3000): 2750-1469P.txt file - cDNA_ID_3048738; gDNA_ID_2926167; Annot_ID_199214

SEQ ID NO: 32093 - DNA, 3000 bp, Unknown; identical to SEQ ID NO: 6635
  misc_feature (1)..( 3000): 2750-1469P.txt file - cDNA_ID_3048744; gDNA_ID_1621099; Annot_ID_171282

SEQ ID NO: 32094 - DNA, 3000 bp, Unknown
  misc_feature (1)..( 3000): 2750-1469P.txt file - cDNA_ID_3048748; gDNA_ID_1621099; Annot_ID_171281
gccattgtaaagattatatcattatactagtttacttcgtatttttttcaggggacagaaacagttcttggaatacgtttctgcacagctttccgatcaaaagagctattaccaatagatgaaaaatcgttccaaggcatgcgtaatctccaatgtctatcagttactggggattatatggatctacctcagagcctcgtttatttgccccctaaactcagattgctagactgggataggtgtccattgaaatgtttgccttatagttttaaggcggattacctcattcaactcacaatgatgggaagtaagcttgagaagctgtgggaaggaactgtggtacttaattcttcattgaaatagttgtcaatttttagaacagacctgtggtaaaaattaatctatttgaaatgtttatgaatgtgtgtattatgtttttccctattttgttttcagccacttggaagcctcaagaggatgaatatgcatggttccagatatttgagagaaatttcagatctttctaatgccagaaacctcgaggaattaaatctttcggaatgcagatctttggtgacactttcttcctcgattcagaatgccattaaactgatctatttagatatgaggggttgcacaaagctagagagttttccaactcatctcaacttggaatctcttgagtacctcggtctcctttattacgataatttgagaaaaatttccctgtgtttaaaatggaaacttcaactacttcgccacatggaattgagatccgcgtagaaaattgtatatggaacaagaatctccctggtcttgattatctcgcctgccttgtgagatgtatgccatgtgaatttcgcccaaatgatctggttcgtctcatagtgagaggcaaccaaatgcttgagaagctatgggaaggcgtccaggtacattgttaatattatagcatttgctgatttttgtttaacctctgttgtaaataattacgtataaccaaattaaagttgtcaaaatggcttgtgattccacggtttatatttacatacagaattatgtcttgattataattttgtttaaatgtgtatagttattaaattaaaatgaaagtgattgaagcataacaatttttttttttaatttctgtttcagtcgcttgcaagtctcgtggagatggatatgtcagaatgtggaaacctgacagaaattccagatctttcaaaggccactaatctggtgaatttatatctctctaattgcaaaagtttggtgacagttccttctacaattgggaatctccaaaaattggtgaggttggaaatgaaagaatgcacagggctggaggttcttccaaccgatgtcaacttgtcatctcttaaaatgcttgatctgagtggttgctcaagtttgagaacttttcctctgatttcaaagagtatcaaatggctctatctggaaaacaccgctattgaagaagttccctgctgcattgaaaatttctcgtggctcactgtacttatgatgtattgttgcaagaggttgaaaaacatctcgccaaacattttcagactgacaattcttaagctcgtcgactttacagaatgtagaggtgtcaacgtggcgatgagtgatgccagtgtggaagatcactcttcttatataccattatatgaaaacattgagtatactcgtcatcgtttctgggaaaaccttaaccacaaacatttggcctgtagggcaggttatctgtaacgcccgcgatcctcaataggattgttggctgggacttggtctgagaaaagaaggtggagtctcggacaagtgggaaggagttggccataagctcggacaaagggaaatcatgcgggctaagctaggatcgtaaaggaatcagctgggtcagctcgtccgaagctcaagctcagctggaaggagtgacggttactcgggttgagtgacagtccacctcgagcagctgggcgagtgacggttgagctcgaggcagctggtcgactgtctgaccagctgggcggttacccggacggttacttgggcggttacggtcgaacgggtgctcgcccaaagggtggataagggcgagcagttacggaccgagagatgcaactcttcggaaaggtgcaaggaacggaggtgatccttcgggaagcatcaattcgccccttatataagggagggtgcccaagacctttagaggcaccagaacacacagaaaataccggaaactcactattaaactctcgtcctttcgggagaataaatcgtcggaggaaatcggtagtcggactgtgaccggcaaggaagaagaagggtcggatcgaccgaacatcgtgaaggaaggtaagggaaacctagacctcgagtctaaggattctagaatacgttaattgagtcgagattccttgaaaggaacgactaatgggctgggtagaatcgggtcatgtgcaacctacacaagactcagtccgggcaagggatcggctagggcggggacgcggctcggtggaggaccggagggtcttaattgacctaccgagaatcggctggacttatgcgcgatcttcccctctccaaatcctctccgcggatccgagtagtgtaaggactatggagcattgcatggacttgcatatgactaagtaaatgagattacttatggctctatgactttcaggaaccaatggtgatcgtgggaaggacttggcttaggcgcgagagactcaaggccgggatgatgggtggtgatagtttcggatagtctagggatcaattatattacttgtaatagcttatatgcaaactcataagttgtatcgaatcctttacttaattaataaagtatctgattgtttgtttactctattcgtctcatatattgaatcacagaatcgtatgaaacggattacactagggaatgaacctcataaatggttagggtccattcacttagtgacttgggtcgagagatttgcgagcatg

SEQ ID NO: 32095 - DNA, 3000 bp, Unknown; identical to SEQ ID NO: 6671
  misc_feature (1)..( 3000): 2750-1469P.txt file - cDNA_ID_3048752; gDNA_ID_1621100; Annot_ID_171388

SEQ ID NO: 32096 - DNA, 3000 bp, Unknown; identical to SEQ ID NO: 6671
  misc_feature (1)..( 3000): 2750-1469P.txt file - cDNA_ID_3048752; gDNA_ID_2926168; Annot_ID_199307

SEQ ID NO: 32097 - DNA, 3003 bp, Unknown
  misc_feature (1)..( 3003): 2750-1469P.txt file - cDNA_ID_3048756; gDNA_ID_1621100; Annot_ID_171374
taataattctatcacagaatgtttccccctctctgctttgatctcagaaagccatccttgaacttccttttgtttcatgacattgataggtcacacaactagaatcggagagcttaatgcttcaaatggtatcgtctccttcttgacttccagtttctttcttttttctgttacagtttatcagatttagtagtccatggttatgtatacacgaaattgattgtgtaggtgctgaaacatcagaaactcattgatgaagtaatggaagagaacgaaaagcttcgaaggataatcatagaagatctcaaagtttcacccgaaaaactgaaattagtttcctcttacaattacgaaacaccaccatgcaaagattgctttgagtgtcgtagaaaacagagaagaaatagaggaagaaagctgtaagccaattccttcatttgttatgagataaagaaatttttcacaatatcagacaaaacacagaatacaaagaactgtaagttcctctgcaaactcataattatataacagaacaaaactcttgcgcaaacaatggtttctgttcacactgcctctctcgctgctcccttctccatcatcttctatcggttaacagtggttcagaagcaggaactgcaaagcaaacaaagataaagtcagatcattgtttctgcaattgagattactgtgattagtagaaggaaactcaagagatttggttatttaccttcttcatcaacatatccaagtttctctctaatttcagcaataaccagacgggtcaaaagcaaaccagcacagagagctccaacgaccaacatatagaacacagcttgccaacccagagtagaaagaaaccctgtcaaaagcggacctaaagccgcaccggcagatccagtcccgtcaatgatagcagtaacagtcgcaagcgcccttgaatcgccttgtaaagacttgtgcgttcccagatccgcagagactgcggttgtgatgagtgcataaggaccattgacaaacaaaccagcaaccatcatgaggaggatgttgactgtctgagagacacctccataggaatggtacacaagcattgccggaatcgcagcgtacatgaatgcagctgcagttgtagcccttgctttgaatttgtctgaaatgtaaccacaaagaatccctcctacaatgcctccaacatcaaatagtgtggagagattccctgctgttttcacagacacgtactctccaccaatagctgcaaataagagcaagtaagaacatggtctaaatctggttttactagcagaaaatgacaatcaaaacttacttgtttggctcaagtaaaacggtaaccagtacaagaacgtgtacgcgaccagcttcgagaaaaagagacacaacgcaaacggtataacaccagggatcatacaagcttgcaaaagtccaacacttcttttattctcataccctgaacctgaccctgatgatccctccccatccccttcaacatctgtccctaaatcttcttctacttcctcttcttcctcttcaacatctctcttcctcttaataaacttccctgaattagaattgatatctggaaacccaacatcctcaggatacgcagccaagaacaaataaacaagaactcctcctaaagacatgacaaaaccaggagctataaaagaccatccccaaccatattcaagaacaccagcagcaattaaagaaccacaaatgttcccaacagaagtatgagcattccaaatccccattataagacctctcttccttttcccaaaccaattcccaacaacagccacaacagatggccatcctgtcgcctgaaacaacccagccgccatttgcataaccaaaaagaaccaaaacgcatgaatgttccagaaataacccataccaaacaacccaacaaagaacccactcccaatcattccccaagtcagaaacaatctcagatccaaactatcacccaaatgaccagcaacatacattcctatagagtaacaagcaagaaacgccacatcaatctctcccaacctagacgtcccatctttcccattaaacggttcccatcctttagacttacgatgcaacaaaacctcatctatatcaccaatttctctcttcacaaacacgttacccataggccaaggataaattttgtcgctgttatgttcttgaggtggcttagtgcttgagtctgggtgtaaaacgctcttcactatgctgcttggtttacgagaagcatggtaacaagcatatgcgatgaaagtaataaacaaaatcgcgtaccgaaacgtctttggactccaatttcttcctctgactctcctcagaagcgcaatcccaggtggtgttttcctcttcgaattcatcgccatctctcacaacaaaacaaaattttcaatgataacaaaaaaaaaaaagaatcaacctttacggatcaaaatgaaatacccaaatccatttgttttagtgtttgataaatcagaatcacgaattaatttgattgagagagagcgattagagagaagagaccaaagggagagagatattggcgggagagagagagagacagagagagatagaacacgacataaactgtgaagacgcgacacgtgtcctatttgttacggtagagccaaaaggcagaacaacagttgtcatgccacggtgaccactttggtacgcatgaagcgacggcccacacgaccgacgtggtggtgggcccaaattataggtttatgtaatcataataagactgtgtcattagccgactcttttattgatatttttataaatcatagtactatctatttatattaatattgatatactaaaggcccacaataacaaacggcccataaagaaaattcacacgtgcgatggcatacgtgtgccaaaataggaagcgaaaagcagataaggctcttttccactgtcttccctccattttctccgagtaactgagagtttgctgcagctatg

SEQ ID NO: 32098 - DNA, 3003 bp, Unknown; identical to SEQ ID NO: 32097
  misc_feature (1)..( 3003): 2750-1469P.txt file - cDNA_ID_3048756; gDNA_ID_2926168; Annot_ID_199293

SEQ ID NO: 32099 - DNA, 3000 bp, Unknown; identical to SEQ ID NO: 6681
  misc_feature (1)..( 3000): 2750-1469P.txt file - cDNA_ID_3048768; gDNA_ID_1621100; Annot_ID_171361

SEQ ID NO: 32100 - DNA, 3000 bp, Unknown; identical to SEQ ID NO: 6681
  misc_feature (1)..( 3000): 2750-1469P.txt file - cDNA_ID_3048768; gDNA_ID_2926168; Annot_ID_199280

SEQ ID NO: 32101 - DNA, 3003 bp, Unknown; identical to SEQ ID NO: 22830
  misc_feature (1)..( 3003): 2750-1469P.txt file - cDNA_ID_3048776; gDNA_ID_1621100; Annot_ID_171354

SEQ ID NO: 32102 - DNA, 3003 bp, Unknown; identical to SEQ ID NO: 18070
  misc_feature (1)..( 3003): 2750-1469P.txt file - cDNA_ID_3048784; gDNA_ID_1621100; Annot_ID_171351

SEQ ID NO: 32103 - DNA, 3003 bp, Unknown; identical to SEQ ID NO: 18070
  misc_feature (1)..( 3003): 2750-1469P.txt file - cDNA_ID_3048784; gDNA_ID_2926168; Annot_ID_199271

SEQ ID NO: 32104 - DNA, 3000 bp, Unknown; identical to SEQ ID NO: 6666
  misc_feature (1)..( 3000): 2750-1469P.txt file - cDNA_ID_3048788; gDNA_ID_1621100; Annot_ID_171347

SEQ ID NO: 32105 - DNA, 3000 bp, Unknown; identical to SEQ ID NO: 6657
  misc_feature (1)..( 3000): 2750-1469P.txt file - cDNA_ID_3048799; gDNA_ID_1621100; Annot_ID_171329

SEQ ID NO: 32106 - DNA, 3000 bp, Unknown; identical to SEQ ID NO: 6657
  misc_feature (1)..( 3000): 2750-1469P.txt file - cDNA_ID_3048799; gDNA_ID_2926167; Annot_ID_199234

SEQ ID NO: 32107 - DNA, 3000 bp, Unknown
  misc_feature (1)..( 3000): 2750-1469P.txt file - cDNA_ID_3048837; gDNA_ID_1621102; Annot_ID_171449
gaaccaccagagaaaagaattaagaccaaaagcaaaagaggtacaagcattagatgcctatgttggttccctttaggacttaaagtaatcaaaatcagtaaaacacacaagaagaagcttaaccattttttagcatataccaacacagaggattttaatattcaaaatctcaactttgatcaaaaaaaaaaaaaaaaaaaagatacaatggtctcaggaaagaaaagttgcagaaattggttggctaaaaccacagctggtttcactagacaggtatgtaaagctgattgtatataaaaccccacaagtctcagctaatggggctttaagaaacatcacatgtctaacggtagactgaaacagggatcatctgaaactcctttcacattttttacttattttatcagaaagaagtaaagcaaccaaatctctttctttttttctgtagtccctcaaaccaacttgcatcacttgattagacaataccaactttgagtatctagattctagaagaattaaaaaatgaacaagaaacttcgcatgtctaatggtggcatgaatatagtaccatttttctccccaaattcctttttcgctttccctaggtgctgtgatctttctaacgattcaaacttagccaaatggacaacaaccttgagcattctctctattcatctctcaaagcgtaggtacaaaacttaatatcaggaaaccatatcaaaacaaaaaagaccttgaccctcataagataaagggaaatcagtttgaaaatggtgaatcatgtggcgattggcgaaaacattatttatatccttcaatatctatctctcatttaacacaatcctgatcgagctcttaacattattagaaggtccagagaacaatatccaaagcaaatggaccaaaagaagtaaaagaatcaggacctgacttcttccaatgttacaccctcaaacctcagcaggagtctttgccacaatagagagagcatgtaacccgctcttcaactcatcttgcaacaagtcatatatcagcctatgtctcttgaccaagcttttaccttggaaagcatccgaaacgattcgcaagttgaaatgtgtttccccatcatcaccagcactacctctaacagcggcatgtcctgcgtgctggtaagaaacatcttcaacttctaactcaacaggatctagctccttctccaatttctctcttatcctcatccctctactccctaaagcaacaacatttgacccactctcagaatcatcaatcttttctgttcccaaatcctcaactagatcaggtttagactccaaatccacctccggaacattagcttcgtccttagtctcaggaatagacacaaagctggattctgaactctctccagaacttgaatcttcctcacctttgacttccaaatgaagagcctttttctgcatcagcttaagcatattaagtaatccattgtttctagaaggagacagactctgctgcaacccgagaagaacagcgaaatcaggtgttatcctcaaaatctcagggacaggtcttccagataaacccttgactaatagagcagctaaccctttagtgagaaccgaatcagaatcagcttcatacacaacattacgttcctcatcaaagaaagccctaacccaaacctgagaaacacatccttctactttattctccctcgtcttgaattgagaatcgagaggtgtcagattcttcccgtagaacataagctgctcgtatttagcctttggctcttgtaccgattggaaaagcttgacgatctcttgtagcttcggtggaagctcttcgattggttgaaggtctccatagctcgacggagatgatgaagccgatggtggaggaacaatcccggttgaaattttctggaaagtgatgatcgtccggcgaaaggaaggaacttccgacggttttagtggtcgtagaagaagggttttggccggataatggattgaagaaaacaaggtccgtttgaatgggattaaacgaagcgaggaagcgcaacaagaagaagacatcgctgctgccatagtcgcgaacttgaaacttcgagagagactgagatgatgatgaaagctctccttcttcactttttctgagtcaaaaaccaataccgccaattaggtagtaaccgggaattaaaccgggaatgtaccaaaatccaaaaattagatgtaaaatcaattgtggggttgattatgaataattagaaagtatacgactcttttcataaataaggaaaagaaaaagatatctagattttttttgttttgttttgaagcatcgtcttcctggttcttcgttctcttgcgttcgtcacctcaaacacgtccgccattattatatatcaaatcaatcatgtccgaatccagcttttaccaatgtaagcaattaaattaaattaaataaaaacacttttatcaaatttaatcaaattaaaaaactgtccctttcttatctgagattctattgtttctgtctacttccacagaaagaaactgcatctccgtttttttttctgatttgaggctttccttagatccttgagagcaaaactgaatctgggtaattttaaaaatctcatttttacgacttatctcttttgaacgatctgttttttcatgtaagtacgatttcacctcgagatgatcgatcattgctcttctggttcttccatgtttgattaaatgttataacttgagggttttgtttcttttggattgttctcgcatttgttgatctatggttatcaaaagagtttggatttacagtttttggttgcagctgaaatttttcactcttttcttctctgttttgctggataaagttggatttgattcacattgttgtttagaatctagatgaagttgtaagattccttgtattgtgtttgcttatgcatgattgtgataaagatttaagttattttaccaatgtacaatgtccagaattgtcgtcgggatg

SEQ ID NO: 32108 - DNA, 3003 bp, Unknown; identical to SEQ ID NO: 18119
  misc_feature (1)..( 3003): 2750-1469P.txt file - cDNA_ID_3048841; gDNA_ID_1621102; Annot_ID_171447

SEQ ID NO: 32109 - DNA, 3000 bp, Unknown; identical to SEQ ID NO: 4372
  misc_feature (1)..( 3000): 2750-1469P.txt file - cDNA_ID_3048841; gDNA_ID_2926189; Annot_ID_200881

SEQ ID NO: 32110 - DNA, 3003 bp, Unknown; identical to SEQ ID NO: 18121
  misc_feature (1)..( 3003): 2750-1469P.txt file - cDNA_ID_3048845; gDNA_ID_1621102; Annot_ID_171445

SEQ ID NO: 32111 - DNA, 3003 bp, Unknown
  misc_feature (1)..( 3003): 2750-1469P.txt file - cDNA_ID_3048857; gDNA_ID_1621103; Annot_ID_171501
cttttttagaatggatcttcttctttttttggttgtgagaaacgaatgtaaatggtaaaagttgttgtcaaatgcaaatgtttttgagtgcagaatatataatctttggtctccccataagcaacaaatcaaaatataatactattacgtaattcagtgaattgaaaacaaaaagtttgggctcacctgtaaaattaaagttagatgattctggcatttccgtgtctaagaaaagttctaggcacttatgtaaatagcaaaagttccaggttggttgatagcaacagtttctgcctttctgctaattcagcaaatatcaagactcaaggacgtttggtaaatatccaaagttccgtgagtttttgtaaatatgataaattataggcactatatagatatctaacgtttcaaaaaatgtttgaccccaaaaaaaaaaaaaagggtttcaaaaaatgtctgcaaataaaaaaaaaaggatgcggagacacttttaatttagtcaaagctttaggcagtaatgtaactgagaaacgatcctatgtaaatagcaaaagatacaaaaaaaaaataaaaaaaaaaaaatagcaaaagatacaagatagtgatagtgtataagtagtatcaagagatttatatacagtatttatggaaataacaaatgtttcgagattgtaaagagaaaatgatccatatagtaaaaatctacgggatattttattggtgagtagcagtaaaatccgaacacttgtatatagcaagatacctacccggcaaagcacttcacataagtttcgggtacttcgttgaatatcaaaagatctaaggcagtaaggctctttggtaaatagaaagttgggtaacgctttggtaaataaaattttgggtaacttgggttatattcttctttgaatagcaaaagaagaagtgagcaactggggtaagtagtacagttttgatgatagcaaaagttccaagtgctatttggatttctcaattaggagacatgatgatcaattttgatgacagctaaagtttgcatcgagtccataacccaagaagaactttcacgtaaaccttttcttttggaaaagaaaaaagtgtaactatcatgatttttgtttttctttgttttgatgacaagtatttctcctcgtgaaatcagttttttttttcttttaatgaatataaagaataaatcagattattgagattcacaaaaatccatcatcgcaagttcttacgtattcgaaagacgttactacggttactaacttactgtatatgtatgtgatgtcgaaaaagaagaagagaagacgttacgtcactacttgtatgttcatcgatcagtccacgtggctttttgtaaggtccgagagaggaaagtgaaattcagacgccgcttttttttttttggatgaagttccaaaattagccattttatacagtggttaagctcgttggaccaatatcaatggcgtctgcaacgactcttctcttccaccacggttccactcgagtcctcgtcgctcgtagacggtgccaagcttcagtccttagaccctacggcggtttaaagccctttctttccttctgcagcttacctaactccactgcgccgttccgggattcgttgagagcaaaatccgatggattggctcgggcctatgttaccggagcgccgcctatcgtggaagaaccagacccaaagattgaagaatccaaatctgaggctgaatcgaaggatttaattagttgggggcttctgtggagcttgatgagcaagcacaagctcaggctcagtgtttgcttattgactctccttggatgcagtacttgcactctctctatgcctgttttttctggtaatcggttcttcaatccactctcccaccattagcaaattgtaactgtactctttttttctctttgggtttgatgtagtttaagtttgggtatgatgatttagcttgtcatctgtgtttctctttatcttggtgaagctgttttataatggtaagtgttattgttttgagtaaaggtagattctttgaagtactgattggggtgagaccggagcctttgtggcggctgctgagcaaaattgctgttttgtactcgttggaacccatctttactattgcttttgtgaccaacatgactgctatctgggaaaacgttatggcaatattaagagctcagattttcagaagggttttgatccagaaggtatgttttgtttagtatgatcaaagttcgcttaagctatattgttggctgtattgaaatatcattgatgggtttcttttttttgtcttttatatattcaggcagagttcttcgacaaatacaaggtctgttccttttattcttggtttgctcaggtttgagacattttggcacaaaccttccttatgttagattgagttcatttgttttaggttggagagctaacggggctactcacgtctgatcttggtgctctgaatagcattgtgaatgataacatctcacgagatcgtggatttagggcatttacagaggcaagccatttctttactatgcaaatgtgagatttttgtgtttgtacatacatttttcataatgaatacagatttaatcttagcctggtgttggtgtctgctgttatttttggagttctataaatgacaaagactatcctgttgcatctcaagaatgcccagttctcatggcttatgcgttatcccttttgtaggtttttggaacaatatgtatcctatttactctatctcctcaacttgcacctgtacttggtctattgatgctagctgtgtcagttctagttggtaaattctctatgtctttttcattctcctaaactttttatttttggtaattactttggtcatctttgcttactttgcttacctctacatctactccctcggtcaaatctcaaaagctgtgtacaagagatcgactgttcctgtttataaatcgcatggattagctcaagcaacaatg

SEQ ID NO: 32112 - DNA, 3003 bp, Unknown; identical to SEQ ID NO: 18130
  misc_feature (1)..( 3003): 2750-1469P.txt file - cDNA_ID_3048879; gDNA_ID_1621104; Annot_ID_171531

SEQ ID NO: 32113 - DNA, 3003 bp, Unknown; identical to SEQ ID NO: 18130
  misc_feature (1)..( 3003): 2750-1469P.txt file - cDNA_ID_3048879; gDNA_ID_2926185; Annot_ID_200527

SEQ ID NO: 32114 - DNA, 1554 bp, Unknown; identical to SEQ ID NO: 6785
  misc_feature (1)..( 1554): 2750-1469P.txt file - cDNA_ID_3048898; gDNA_ID_1621105; Annot_ID_171569

SEQ ID NO: 32115 - DNA, 3000 bp, Unknown; identical to SEQ ID NO: 6780
  misc_feature (1)..( 3000): 2750-1469P.txt file - cDNA_ID_3048914; gDNA_ID_1621105; Annot_ID_171553

SEQ ID NO: 32116 - DNA, 3003 bp, Unknown; identical to SEQ ID NO: 18168
  misc_feature (1)..( 3003): 2750-1469P.txt file - cDNA_ID_3048959; gDNA_ID_1621106; Annot_ID_171596

SEQ ID NO: 32117 - DNA, 3000 bp, Unknown
  misc_feature (1)..( 3000): 2750-1469P.txt file - cDNA_ID_3048973; gDNA_ID_1621106; Annot_ID_171589
taaaagtgaaacattgtaagtgtttcaaccaaattatatgtgttatcaagtactgtaattctgtttctctgcttcttctaatgtttttcatatcttgtacttaattgcagattctgtgcctatgatatcttctgtgatttcttgggtaacaacttacattttcttggtgacgtctttcgttgcgggactcctcactctttcaaccacaagcctttattctcttggcgcattcccaagaccatctccttatctgatatcagaccccacgaggaacctttttgtatgagtttttactcctttataaagctacatatatattgcctttgtttttcctgcaagttacataattaatcaaatggtattgtgtgctttgtggttctaatgcagagaactgcctgtcacattcagttttttgcactcacgagatggctaccggtgacattgcctgttgattactatgaacttgtgagagggattcagtggataatcccttattttcctctcccatgggaaactaagatcaaggaacagatcatggtggccacaagtccttacattggtccacactccttcatttctaaaactcataacaacatgattaatcttaagacatcaaccaacgcggagtcagtattcggattgccactcaccgcaatggagtacagattattctttgaggtcaaaagaaacgtttttttcttccctgtattttgtattcttttgatcatgttttaatactgtatgagtgtttacagacttcaaatcttaagccagaagcagaacacgttcttggcctaccacattcaacagtgtaagtcactataatccaagtctatacttctttctatagaaaattttgtgaagattttattgcagcatttgttgcttacttttaatctaattaagaagaagccataaatattcgagtttttcgctttcctgtaggtggagagatttcaataggatcatgttttggatagctataattggaggaagtttggtactactgcatatagtcctctctctgatactgaagttcaagaaagcacacagtgagaagaagaggagttttggtgcgtttgtcttcccaagattcgagctgtttcttctcattctcgccttaccttcaatctgcaaagctgcaaggagccttatacaaggtattcttattaccagccttgagaatatctttaaatttgaacacatacgctaaattctctctttgtcaggctattttaaacaccaaggagctgcagaagccagtgtcattgttggtatccttgtgctttgcgtggtagctattctgcttctggcattgtttctcttcctctcggtcgggataacgtttgggaagttgttacagtataaagagattcatcaagaaggccaaactttccactggtaccaagaactcatccgagtgacccttggtcctggtaaaagaggccaatggacatggaaaacagagaactctgtctatctaactaggttaggtccagttttcgaagatttaaggggtccaccaaagtacatgctcacacagatttcaggaagcaatccactcaagcaacaagatgatcggatcatcgcatcagatgatgaaaacgaagatgctgaagctccttgcatacagaaactctttggaatccttagaatttactacacatttctcgaaactgtgaagagggtgtgtttggggattattgctggtgctttccttgacaatgaaactgcgaaaactccgatagtggtcttgttgagcatcacttcctttcagctgtttttccttcttctgaagaagccattcatcaagaaaaaggtacagcttgtagagatcatctctatagcatgtcaagtcggcgtattcgcctcatgtctaatgctcttggcgaaagactttcccgaggcaagcggaaagaaactcgggatattcatggtcgtattgttcttgattggattcattatgctgatgtgcaacgaatggtactcattgtacaaacaaacaaagcggttagaccaaatcaacagatctttcttgagtggtcttaagatgtttatcattggacttgccgcgttaatcctacctcagaaaatgatcaagaacaagatccccgtggctcaactagaagcacgaagcagcagcaatggaggcacaaccccagaattcaggtatagaaattcttccggaagccgaagctcgggtagcttggacaagccatggttgaaacagattagagaaatggcaaagtctagcttcacaagagataggagcaatagtaaggttcctagtgatccttcgtgtagcaaaagcggttggagcagtagtatttggggaacaaagacaagtggaagctcttctaaggaatcatctgcagattacaaatccagacctaagggactttacaaagatttagaggccatttttgcttcaaagtaagaaaaaatggtcatcatgctctctgtatttactctctattcgacgtaaggactactttgtgatatttaataaataatggggtttagaaggtattgatatgaagtatgagggcttgataagtaaattgtaatttacattatcatctattaaaagtaatatatttacatatttcctctaaaattgattaaagaaatagttgaaattttcagaaatcgtcttgtgtcaatcctgcttacatgattcctaagcctggtcttgtttggctccgagaaaattcaattcgaaggagacgaagaagctccaagcatatagacgaagctaatctacgcatcgtccagctcttatcgtgcacctaaatctcagttgttctccaagttgcttcttctttctcaagtacttggctcgatcaatttcaattttcaaaacccgattggggattttggcgtgcttggatcttcatcaattggtgtgagaatccgtctccgttcgttatccatcgatcggttttgtataatttactgttttatttccggttgattcggttttggttttggtttcaaatg

SEQ ID NO: 32118 - DNA, 3000 bp, Unknown; identical to SEQ ID NO: 6807
  misc_feature (1)..( 3000): 2750-1469P.txt file - cDNA_ID_3048982; gDNA_ID_1621106; Annot_ID_171576

SEQ ID NO: 32119 - DNA, 3003 bp, Unknown; identical to SEQ ID NO: 18911
  misc_feature (1)..( 3003): 2750-1469P.txt file - cDNA_ID_3049025; gDNA_ID_1621107; Annot_ID_171620

SEQ ID NO: 32120 - DNA, 3003 bp, Unknown; identical to SEQ ID NO: 18216
  misc_feature (1)..( 3003): 2750-1469P.txt file - cDNA_ID_3049067; gDNA_ID_1621108; Annot_ID_171658

SEQ ID NO: 32121 - DNA, 3003 bp, Unknown; identical to SEQ ID NO: 21076
  misc_feature (1)..( 3003): 2750-1469P.txt file - cDNA_ID_3049089; gDNA_ID_1621109; Annot_ID_171750

SEQ ID NO: 32122 - DNA, 3003 bp, Unknown
  misc_feature (1)..( 3003): 2750-1469P.txt file - cDNA_ID_3049093; gDNA_ID_1621109; Annot_ID_171745
ggggcttattcctgctcgaaatgttctagttacgttgttcattcattatgtgcaactagaaaagatgtatgggacatggtagaactagaaggaacaccggaagaagaagaaattgcgccattcgaggtggttgatgagaacacaataaagcacatgagtcatgatcatgatttaatattcaacaatgatggtataaatctccatgaaagcaagctttgtgaagcatgcgtctcccagatcaatactgatccgttctatagttgtgagctatgcggttttattttacatcaaacatgtgctaatatgcctaggaagaaaaggcatgttttgtgcaacatacccttctctctacaaacagacgatagcaaggattcttcacgcctaagaagaaaatgtagtctttgtctccaacatttcactggatttgcgtataatctgcatattgcgtataactcgcgtaccgaagttatggatatacgatgtggttcgatatttgaaccatttgttcatgaaaggcatccacatcctttatactacaagttcttcaccttttcggcggttgcgaagtgcgacatctgtcacataacaagaaggcatttgttatgttgtgaagagtgtgactttaggttggatttcaggtgcgcaactttaccaaaaaaagtaatgaagcaaaggtacgatgaccatccacttttcttgtcttatggtgaaaataatgtggatggtgaatactggtgtgacgtatgtgaaaaaagggtagatgcaaagacatggttctatacatgtgatgcttgtggggtcactttacatgtttcttgcgttgtgggtgacttctcctatcatatgccaggaccattatcaaccgtagttagcgaatacaaaatggtaccgcccgcggtagtaagcttatacaaagtggtgccaaacacttcgatttgtagaccactttgctccaggtgtcacactagatgcaaactcccttgcattcttgaaacctccgaggatggtgttaatgtttacttttgttctaatgattgtcataaaaatccttgggagtcgtcgtattattagtagcgcacttggtttatttatttctttctattttcttatttacttttcaaagagtattttactttacgtttattattaataatgataggttttgtttgtgaaacctatctaaacaattgagagcgttgaaggattttatcgggttaggccaagggatagttctcttgggagagtttttctcttgttatattatcgttttgtttatctactatcataataaaagttttggttttgaattgcattctatcttgtacagttatcatctttcttttacccaaaatttgctttgctttcttttcattctctacattttcacatgtcgatatatgaatcccctagtgttatatgtacaatttatacatatatgtatccgacatgcactaaagggtacttccattcatggattcttatctaagaacactaacacttaaaacatagtgttctttactagtagatgttgattgtatatggagaaagcaccgaatatatgctctggtttctccgctgtttcacctctggtagcccaatatttaaaattataaaaatggcatctatgttttgatttcccgagtgaagaaattttttaggtgttcttcaggatgcaagcttccttatattcttcaaatacaggaaacttttgttgtaataagtgttgtgggaacactcacaactattgtggtcataatttgttctcaatagttgtagtgtatgatgatagtaatgttgtgggaacacttaatgtacagtttctatcgttgtttttctcttttgccaacctccgtgaataaaagaatgttttacataaattatagtttttttaaatacttgcatttaatttgatcaaatcagtatagtgctttttatataattaactagtgatcaaactaatttattcaacaattttagttatactgtcttccaaaagcagtgataaatttaatcttatggtactttctttttttgttgctatcggaggtttcttgcttaacaagcaagtagcgttcttctcttaaactatttcccctacgtaagccgccaaacatgtaccgccaaagcagcttcatcataacaatagattcatggtttttccgttttcaaggagtttgctctaggctctagcaaattgtattaatattctacaatttaataaaaggcaaaataacacattcgtcacaaacataggatccgcacaagtggaagttaatataattaagattagagttgtaattgggcagactataagtctataacgtactattaggatccagtgatttaataacagtattattgtgtatttttaatgaattaaaatcggcagaattagctgtctctagtgggatctgcaaccacggaaacagcagagaaactagtggcatcgacaagtaaaaccccgttgctcttgtgttgcttgtatctcaagaaagcacagttcttcgctatttcgcctccgggaacccaatactcacaccaaaacctatatatgtgcaagatgacgatcgttttgttctcccggattaaattggtagccaactagctagctcgtacgttgaaaataaaagtcatgaaagggccaaaaaaaatcttatcactaatcttggatctactcaagtggatgattgattatacataataacataaactataaagtagttgtatggaatttctataattctatgagtacgatcaaaatatttaataacacagataactattatagagacgacttttatttggagtattaaaaatgaataattcccggaaagtatggatgtatgtctataaattattttcttcgatcgagttgagagattgaatcgttacagcaattaaaaatctcattccatttaagaaaaaaaagaaaaaaaaaaaaaaaagtcaccttttccttcaaatcacaagagattaggttgatttggatatcattccgcgatg

SEQ ID NO: 32123 - DNA, 3003 bp, Unknown
  misc_feature (1)..( 3003): 2750-1469P.txt file - cDNA_ID_3049126; gDNA_ID_1621110; Annot_ID_171777
ctgatatacttgtggccacttcatgggacaatcaggttttcttttaattccttggctcctttgtttttccatggcttaaaatctaatttgtttgtcctaataactcttgtatatatattgtaacatgtgagtttgcttcttctattgcaggtgaggtgttgggaaatatcccgtagtggagcctctctagccagtgctcctaaagcatcaatatcacatgatcagccggtaatatgtcattcttcttcttatcttacctttttttttcttttgcctttgaatctgatgcatatacgtcctttcttgtgttgaaggttttatgttctgcttggaaagatgatggaaccacagtctttagcggtggatgtgataagcaagcaaaaatgtggcccttgttgtctggtggtcaacctgtaactgttgctatgcatgagggtcctatcgcagctatggcttggatcccgggaatgaatctccttgcaactggaagttgggataaaactttgaagtaagaatgattgttcattatttcctatgactgaatgtagcaaattatagaatgttgactgattcatttatttgctgccatgaatttaatgatgtatgttggttttccttccagatattgggacacaagacagcaaaatcctgtacatacccaacagcttccagacaaatgttatacattgtctgtgaaacatcctctgatggttgtcgggactgccgatagaaatctgatagtcttcaacttgcaaaatcctcaggttagaatttttccttgttgttccatgttataacttgcgcatgagagttctaagtgctaacaatgctgtcagcatcacatggttttgggaattcgtgatcaatttagcccatgtgctatcttacaaagaatagatgaacaggctttcaccattagattaacagtttctcttgtgtaaactgtagactgagtttaagagaatccaatccccactgaagtaccagacgaggtgtgttactgccttccctgatcagcaaggttttttggtatgtcttcttatttatgttctgttgtgttttggttaattcagttttacaggaattagcttgttcgttagatgcttacattttaggttagacattgcaatgtttttatttgcaatctcgagaagattttatgtatgtcattctagcaaaaaatagagtaattttatatgggagattgttttgctagtcacatctccagatcctatctaaatcacaatggtgttgaatatgaaaaattaaccagatccaatgatctctataggttggttcaattgaggggcgggttggtgttcatcatctggatgattctcaacagagcaaaaacttcacattcaaatgccacagagatggaaatgatatatattctgtcaactctctgaatttccacccggtaagctctatctatagttatactcttatactcgtatgtattctttgaagccttcagcatatgttgagcgatgaaaatgattgtttgagttgttgtggatttaaggtacatggcacttttgcaactgctgggtcagatggtgctttcaatttctgggacaaagatagtaaacaaagactcaaggtattttcctcctgcattgattttttattttgttaaccaagtaattatctaacagttttgtattctgtgtccccacaggccatgtcgaggtgcaatcagccaattccatgcagctcgttcaaccacgatggatcgatatatgcatatgcggtatgatataaatcttatttggtttcactttatttgtacatgctcatgttatatgttgcaaaatcgagatggtcttttacttggaatctaaaaccatcattgtgttgaaaaacctttgagagcatacatgaatgctttctaacatgtattattatataggcttgctatgactggagcaaaggtgcagaaaatcacaacccggcgactgcaaaaagcagcattttcttgcacctgccacaggtgtgtgcgcgtcacagacaatagtaatatcatcatgtttcctaaacattagtgtctgtatctaacggacggaatttgttttaaatgaaattgcaggaaagcgaggttaaggccaagccaagagttggagcaaccggcagaaaatgagcgttgcttagtctgatttcttcgctagtgattttttttttttttttagcttgtggacttcgttgggctttgttatctactttagttcatgacattttgaatatacattaggagtcttgtctaaaagactaaaagtaaatctctaatgtttctagttgggcctaatttggaaccatctcgtctcatacctctttcgtttcatcatactaaggaaatctttttttcttatcaagaatttattttagtacatctgattccatagttaaactttagttattttaataactcaaatcaataaaatcaaccaagaaatgtttatctaaaactagtataattaaaacgactaatgttttcttctctcattgttactgtcggagcaaattttcctaaatttggttattagttaattttttttttggttgtgtgattaaatatggtcattagttagttagtgaagaaagagagagagataacgtggcagtagattagtggaagcaggagaagaaagcgggaatgagcaaaggacctggactttgtccatagccaagaaactcgcgtcctcttcttcttcctcttcacctatataaacactttgtcttcgaccccaattttccttcaattttatataaaaaataatttgttttcgttttttgtgtttctgtttttctcccttttgttcttctgtttcgttagaataacaacagaaaagaaaaaaagatcgtgagaaaatttcactttgaaaaagaaaaaagtgcagagagagatactttggaaaaattttgtcaacaaagaaagaaagaaagaaagaaagagtgaaaaagaaaacaaagaaacacaccaccctgtttctgtaaaacaagatg

SEQ ID NO: 32124 - DNA, 3000 bp, Unknown; identical to SEQ ID NO: 6891
  misc_feature (1)..( 3000): 2750-1469P.txt file - cDNA_ID_3049165; gDNA_ID_1621111; Annot_ID_171806

SEQ ID NO: 32125 - DNA, 3000 bp, Unknown; identical to SEQ ID NO: 6892
  misc_feature (1)..( 3000): 2750-1469P.txt file - cDNA_ID_3049169; gDNA_ID_1621111; Annot_ID_171805

SEQ ID NO: 32126 - DNA, 3003 bp, Unknown; identical to SEQ ID NO: 18228
  misc_feature (1)..( 3003): 2750-1469P.txt file - cDNA_ID_3049177; gDNA_ID_1621111; Annot_ID_171796

SEQ ID NO: 32127 - DNA, 3003 bp, Unknown; identical to SEQ ID NO: 16127
  misc_feature (1)..( 3003): 2750-1469P.txt file - cDNA_ID_3049184; gDNA_ID_1621115; Annot_ID_171851

SEQ ID NO: 32128 - DNA, 3000 bp, Unknown; identical to SEQ ID NO: 6903
  misc_feature (1)..( 3000): 2750-1469P.txt file - cDNA_ID_3049188; gDNA_ID_1621115; Annot_ID_56185

SEQ ID NO: 32129 - DNA, 3000 bp, Unknown; identical to SEQ ID NO: 6913
  misc_feature (1)..( 3000): 2750-1469P.txt file - cDNA_ID_3049188; gDNA_ID_1621115; Annot_ID_171850

SEQ ID NO: 32130 - DNA, 3003 bp, Unknown
  misc_feature (1)..( 3003): 2750-1469P.txt file - cDNA_ID_3049192; gDNA_ID_1621115; Annot_ID_171848
tgaaatggcaacattcatctggttcttggtaaggccaccttataaaatgcatcaatacttaaatcagctatgcaaagtttttcagtttttgagaagatcatcaatttcatgtatcagtggggaatcaaggaaagatcttgcttcatgaagaaccatgtgatgatatcaagccggctaatttctgggtgcgtttcaaatacacaacaattcgcagcaacacactgtctcttaagattttttttttctttctggtgaatgcagggttctcgttcagttctggtgtagttatggcactgtgcctctcaatgtaatcgttactcaggttcgtcaaaacctttcatatatctacaattccacaatcttaagcctatccaagtctgtgactaaacatcgttcataaaaactctatggtttcacctgaatctgaacagatgggatctcggcataagaaagctgtgatagcagagagcgtaagagactcacttcacagttggtgcaagagagtgaaagagaggtctaagcacacgagatcagtgtgttcccttgacacagcaacaatagacgagagagacgagatgacagtggggacattgtctaggagctcatcgatgacttcactgaatcagattaccataaactccatagaccaagcagagtctatattcggagcagcagcttcatccagcagtcctcaagatggatacacgtcgagggtggaagaatatctgtctgaaacatacaataacatcggttcgataccgcctttaaacgatgagattgagattgagattgaaggtgaagaagataatggagggagaggaagtgggagtgatgagaataacggtgatgctggagaaacacttcttgagttgtttaggaggacttgatcttgtttctgcttttagaagcttggttcagttgtaattacttgacatccatacaagaataacaattaacaaagtaaatcttttgttggtccagtaaaaaaaagtattcaatgatcaaagtacatcttttgttggttcagaggtaaatttaaaatataatagcatggattggaacgagatattatggcattaggaaactttttgattatggcagtataaacaaagaccacaaattatggcagctatacatatattgatttcaaaacagagataaagacttgtcacctgtcatttgattatttatgaatttacctctgcagcattttccttcttctgtgcagtcacgcctaccgatggatttgattaatttcctgtcgattattactaagttgtatttctagtaaatacaacttaaaagtagttttgtactcggtcttaaaactagttttgtacatagtttttgagtaagatactttgttttttttgggacaaagagtaagttagtaatatcaaattttatcatagtgattgttaatttatgtcaactacgaaattaagaagttatcaaatctgatttgagttatgataacaatgtcattgatagactcggtcaattatggcattaagaaaatctaaggatttaagtaaccaggtatcaattattaccgccgttggtattgacttttaaataagacttgccagttgtcacacacatgtcataaacaattgtttttttcttcttcttttcattcaaatgataaaattaaacttgcactatacagtttctatagaatcatccatcactagatctggtctggcgatccccaaaagatcaagtcaaaaatgaataacagagaaatgaaacatggtaaaaaaaaagacgagaagatgccggttttagtgatgccaggtttcatagccggagcaacatttctggttatttggatcatacgacgtgagttccttttatcttacttttggtgtaacatagatttccttgcttctgtttatcttttgaataatccatatataggctatagaaagggctccaccaaaactaactcgccgccaccatccgcgcttccaaaggctcgagaatgtggtcctgtggcgtccactaaacctaacttaacacctgcgccgccgctaggtcagccacggctatacgctcaagaatctcaacagtacagtcttgtggcgtccaatgaacctgacttgacacctgcgctgctaggcccgccaccgctatacgctcaacagtctcaacagtttagtactattgtggtgtccagtgaaaccgacataccccagcttctggttcaatgttgtccgccagatggagaccgtggattaacaaatcaatactatgcgggacaagagttcgacttaggaggacacgacaaggacagcgattccgattaagagtagagtacttttttaaacaacttttgattatgaatttacctcatccaccatttttcttctctttatcttgtgtgcaccggcatctttagactataatatatgtcgtaagaagaagaagaagattataattggttgatttcagttattttattatcaaaaaggaaagagaggataatgtaatgttgtaatcttatatatatatatccgaatcagggcgtcatttcagtttactaaatcatttttatttatctaatttatgaaccatagatgcgttaaaacgtctacttaaccttttgtaaacttgagtgaattgatgaatggagtaaaatttcaagtttcatcgcattcgtttgtgttattaagttttgtgctgagagcaaatcttcttttagccaaacaatgggtgttgtggatttctagacttgattttattttctagcaaactaaataaagttttgggcccaatgggcctgactcattgaacaacaaactagccgttggtccgtgtttgtgcatagctcggagacgagaggttgtacgtgtacggaaagtaacagtacggagattagtcatgaaaaacaataaacatggtgcttttatgttttatatactccaaaaaggggtctgcgtgacagtgagatagacagagagagaagaaaaagaagcgagtgagcaaagtttctcaaaaatg

SEQ ID NO: 32131 - DNA, 3000 bp, Unknown; identical to SEQ ID NO: 18235
  misc_feature (1)..( 3000): 2750-1469P.txt file - cDNA_ID_3049200; gDNA_ID_1621115; Annot_ID_171845

SEQ ID NO: 32132 - DNA, 3000 bp, Unknown
  misc_feature (1)..( 3000): 2750-1469P.txt file - cDNA_ID_3049204; gDNA_ID_1621115; Annot_ID_171842
agatcaaagcagcctctttgaccaaaagaatccaacttttttcctcaactttcatggccgccaaaatcaatcactcactttccaccaccaaaaaacctcagattctccaaacccatatcttcgatttcaccataatccaacataaacatgcctaactcgattctctttcttcttctttcattcctgtatctcacaaactgcgttgctcaatctccatcacaaacttgtcctttagatttctctcatgtcctaacaatcccatggaacacaacagattgtcaaaagtccgacaaatcagccgatagcaagaacagttgttgccaatctcttttaactctaatcggaatccctctagctcatcgtctcaaacaaacttccaatttccgtctcccaaatctcgctacttcaatctcttgtctcaacaatctccaaacgaagcttagttcactctctctatcttcgaatctcacctctctctgtttcgatccgaatcagttcgtcatcaataacgaaacctgtgctggaatccaaacgactcaagattgggtatctcgtctcggtccatctacggcgcttgactccgcctgtagcagtggtctcactgatctaacgcgatgcgacgcttgcgtggcggctgggtttagggttcaaaaacagctcatcactttggacggtaatagctctcacggtgtttattgttaccattttgtggttacttacgctgctggtattgttaacaagaaaggacctgagagtgatgatgctttgtcttgtctcttctctttgagtttgagatctccattgaactcaaagaagaaaagacacacggtggctcttgctttagggataaccggagctattttcggggctctggttattgccggtttgatttgtttgtatttccggtttggtaaagctgttaaaggaggagaggttggttgggaggatcaagggtctagaccgaaatggagaccaaacactggctctatctggttcaaaatcgaggaactagagaaagctacgaataacttctcgcagaagaatttcatcggtcgaggcgggtttggttttgtttacaaaggggttttaccagatggatcggttatcgcggttaagaaggtgatagagtctgagtttcaaggggatgcagagtttcgtaatgaggttgagatcattagcaatttgaaacataggaatcttgttccgcttagaggttgtagtatggtggatgatgatagtgagagtcagagatatcttgtttatgattacatgtctaatggaaatctcgatgatcacttgtttcctcgaggtgagactacgaagatgccattgagctggcctcagagaaagagcatcattttggatgtggctaaagggttggcttatttgcattacggtgtgaaacccgctatttatcaccgggatattaaaggtacgaacatattgttagatgtcgatatgagagcgagagttgcggatttcggtttagctaaacagagtagagaaggagagtctcatctcactaccagagttgcgggaacacacggttacttggctccagagtatgccctctatggtcaattaaccgagaaaagcgatgtgtatagcttcggggttgttatattggagatcatgtgtggaaggaaagctcttgatctgtctacttctggatcaccaaacacttttctgatcacagattgggcttggtcattggtaaaagcagggaaaacagaggaagctcttgagcagtctttgttgagagaggaaggctcagggctctcgaatccgaaagggataatggagagattcttgcaagttgggatattgtgtgcccatgtattggttgctttaaggccaacaatattagatgcattgaaaatgcttgaaggagacatcgaggttcctcctattccggaccgaccagtcccgctcgcgcatccttcgtaccgtatggacggaaacggattcacaatatcgcctgcgcttagcggactacaaatacattccggagatatgctcagatgaaaaaactaggctcatgtgagattttattttgtaaatatttgaaagcaacgatcacgtcttttgattacatcatgtaaaacaatttcagaatgttgtagtatatcataagtagggaaaacatatagttcattgtaggattatattctaaatcaaagtagaggcgaaggctgagatgcgggggtgagggcggtagctggtggaagccttccggtacaagtgcaaaagttattaaggcactcacatttggtgcagtggttcacagtcctgcaccatcttgacactaatggtcctctcgcctcagccaccatgtaaaattctgcaaccattcaaatttgtgtttatttttgtccgttgcaaaatttatatgtatataaataagaagaaattacatattttttttttttgtcaacaagaaattacatagtttgatacataatgatttgtcaaagcattttcaacagaaaaaaatcagatacatattttactattaattttatatctggtaaattctatattttacagtatacagtacattacacaatttcctgaatcagttgaatataaaatgctcaaactagcataaatttaaaactttccagcattggtaatactcaaaaaaaaaaatcaataacaaataaatgtttagttgtaattcagacacaacttgaaaccccaaaaatcagactgtgaaaatttgtgtgctctttttaacttttaattgctaaagttagttagtaatttaaaacattctggttactcacttagtattagttattactgtggtaacaacaaaatttaatgataattgtaaaactaacggccaatcgcatttgctgctctcttcttcagctacgcagatcttacgagcacttttatatatttgtctttcttcccgaaatacccttgtttcgattttctcacctaaaactcttccccaaaaatttgcaaattcaacgactcgtctcggcgatgatg

SEQ ID NO: 32133 - DNA, 3003 bp, Unknown
  misc_feature (1)..( 3003): 2750-1469P.txt file - cDNA_ID_3049234; gDNA_ID_1621115; Annot_ID_171859
acctttggagggttcaagtatccggattaagttggttaatggaattttctttggtgtcagtcctatatctctaagctgatttcataaatgttgtaccccacaaactgcaggtgaggtccctctcattagatgtgaaagtgtgggagccaacgatcttggacttatttagaaatttgggtaatgtatactgtaattcactgtgggagggactacttcaccttgacgatgactggtatgatctctaaggataaaacatttgttttgtattttgaagtatagaccaattatcatacactctatcttccaacattctcctgtttcatatatcatgcatgtagctgatgaggtacatcgtgataaacagtgtggctttttgcagcgaagacggatcagcattgtcgcatgcttcagtttcaaaaccatgtccagaagattcctttagtgtgaaggagaaatacattctaggaaaggtatgacattagttgttactttctaatgtccaagttgtgaaatgtatcttcacggggatgattgatcattttactcatttattgaactagattatgctttgtgaaaaggcaaagatgtaaaaagcaactaatactaaaccttgattgatgttttgtgtttgggccagtacctggagaaagcattagtcatcaaggatgaaagtgaagcaaacctttctgctgcgagtagaatatgggaagctgttcaaagcagaaacatacgagaaatctatcgacttatagttactactggggatgtaaatatcatcaataccaagtttgatgatataactgatatcgatgcatatcaccatattgatgcagcagagaaagcagtaaagaaaagacatgatccaactgtatgtcagagaattaaagaatccaacgaaccaagaagctgtcttcaaggatgctccttgctccatgtggcttgtcacattggtgactctgtcttgcttgaattgttgttgcagtttggtgctgacctaaacataagagattatcacggaaggactccgttgcaccattgcatatcatcagggaaccacaaatttgcaaagattctactgcgaaggtatattttaactcttaagaaacgcactcttaatgaatgttaggactcaaactaaaacctcctagctccacttccccttgattccatgactctgtttctttggtagcttggctcttccattgcatttttcttgaattagtcgttggtagttttggctcataatgcggttgtatttatattttcttaaattgtttttgaaaacgcagaggagcacgtccgtcgatagaggacgatggagggctaagcgttctagaaagagcgatggaaatgggagcgataactgatgaagagctctttcttctcttagccgagtgcgcataaaccttcactgcacaccgacatgcacagcttctttagaaacacctttggaagaccctaaaacgcaaaacaaggaggtggtacaagctactagattccgtaaaggcatgatgaaacagccttttgagtcgttgtttgtcaatgtacaagggatatgattttactgacctacagtttatctctactcacttttcaagtttcggaagttttgatttttttttttaaacttcacttttgcatttacatttgagttttacatatgaaaaacaatttcaataaacatcattcttaaatatacaaaaaaaaaaaaattgttaaatatatttctactaactgaaggcagcatattttttttttttaatgcttttgaagagtaagtttacaacttaacaaatttgtttagtaacataaaatagctgtaattggaaaaaaatacatcataacatttttgtcatcgtaaattttattttaaaattggttaatgctaaacacacacaaagaaagaaaaaagaaaaaacgaatcaaaacgtttggttaataatgttcttgagcctgctcagaccgggaagagagctggaacataattgaattttaaacccgcatttaattgagaatccgatcaaaccaaattatatcggattttacccggttaatttgttaaaccgaaccaaaattgagttgaccgatgggcagagagagagccacgcggcccacgcgttattcggcaaaggccaaattgaagaaaaccaaaccctttggaaaaacctccgtctttcgggtcttcgtcgacattgatccgttttttactcaccgtcgccggtaagtcggtaaccgtcaatcttctttctttagatcatctttgttgtattgctctgtaattttggctcttgatcatattcttttgagacaagaatgagtctttagcgaaaaatagaacagaggaatcagatggtttatctgtgattgaaagagaaatattttcctgtggagaaatcgggattttttccaaggatttatcataagtttgagattcttagaaaggggagttctttagattcttcgtgatcatcaaatgaagaaaggaagtattttatgtttattgaaacgggacttttggattgttcccaataggcaaaagcaaagctttcttcttttgtgaagctcaactgcaatttgttgttttgagttcgatgcttgatacttgtgatttctactaagtgaaaccattcatagttacttacacacgtgggcagttgttcgtgtgtttggagggattttcagatgatgtgtacttgttgagtattatactagagctcatttttcttcacaacactcccttttgaggctctgcggtgaagctttgtagtacctcgaaaactaatttgttaagaacatgctctgattcattggttgccttttggcgagattcctggactatgcatttgttgattgtttactgtagatcccatatcttcttgtatcttcataataaatccttgacacactgcagtttagcatcacaatatcctgaaagctcatttcatttgttagaaacatgctctcatgtattggttgcctttttgcatatgaacagttgaaatg

SEQ ID NO: 32134 - DNA, 3000 bp, Unknown; identical to SEQ ID NO: 6909
  misc_feature (1)..( 3000): 2750-1469P.txt file - cDNA_ID_3049253; gDNA_ID_1621115; Annot_ID_171854

SEQ ID NO: 32135 - DNA, 3000 bp, Unknown; identical to SEQ ID NO: 6921
  misc_feature (1)..( 3000): 2750-1469P.txt file - cDNA_ID_3049283; gDNA_ID_1621116; Annot_ID_171878

SEQ ID NO: 32136 - DNA, 3003 bp, Unknown; identical to SEQ ID NO: 18244
  misc_feature (1)..( 3003): 2750-1469P.txt file - cDNA_ID_3049319; gDNA_ID_1621117; Annot_ID_171925

SEQ ID NO: 32137 - DNA, 3003 bp, Unknown; identical to SEQ ID NO: 18245
  misc_feature (1)..( 3003): 2750-1469P.txt file - cDNA_ID_3049323; gDNA_ID_1621117; Annot_ID_171921

SEQ ID NO: 32138 - DNA, 3000 bp, Unknown; identical to SEQ ID NO: 6936
  misc_feature (1)..( 3000): 2750-1469P.txt file - cDNA_ID_3049328; gDNA_ID_1621117; Annot_ID_171918

SEQ ID NO: 32139 - DNA, 3000 bp, Unknown; identical to SEQ ID NO: 6934
  misc_feature (1)..( 3000): 2750-1469P.txt file - cDNA_ID_3049332; gDNA_ID_1621117; Annot_ID_171916

SEQ ID NO: 32140 - DNA, 3003 bp, Unknown
  misc_feature (1)..( 3003): 2750-1469P.txt file - cDNA_ID_3049336; gDNA_ID_1621117; Annot_ID_171909
atcctaatatattaccttttcatacatcttgatggctggtgtgttggaagctcttacaaaaagatccacaaagtaggctttatcactgcaatcaataaccacaagtataataatcattagaagaccagaaattaccagataatatataaaatcaatgaggagaaattcaagattttcttcctttgaaacaatctaaatatatcggttttcaaataaataaatggtccactcgaaagccaatatcaatatattaaggctttcatattttatatcataacgatccatatcaaagagaacactaaaacttgagatgctttgtaattgttaagtcttacatcttatcacttatatcttccagaaggttcatcagtttctttgcaagttgctgcctgcggtattctggagagacagtgacggctgtcacatgaccatgccaagattcaccctgtccttcaactttacccataactgaaaccatgtagaatcttagttagacacatgcttttaaaattatatttataagaacaagttttacatatgtcacttacgttggattctcaagaatatcaaccataacatttcaactatacaaaagaacatttcagtgacactgcttaattttcaaatgtgttaatatccaaaagcttagttttactctcagttctttcaatggtttcactatacttccaaggtctctttccaaactataccacgaaaagggagaaaaacaggtatagtaatagggcaccacgagaacagaacgtcaataatgaagcatatatcgtacttgaagaaaataaagaaagataaagccttgtataaatcacatttcgaaccaatccaataaggtatagcatcattatactacaaacactgaaagacagaaaaatttgagccttgatataactcataactcattctctggacatttagaagttagcacaaacaatcttaagccatgcttcctatgcatcttctaccccatatcaagatttctaaaaccgctaactacagagactaggactaatacaagcagaatttgtttaaacacttatacatcctggtttgtgttaatcagttttcaaacagagtcactcttcctggttttaacaacattcaagctatctccatctgataaccaaaaaaaatcaatagtggcttttacactaacagtttatcatctaagtttcaaccctaaaagtaaacataatctccacgaatttcaaattcctaaaccaacgaagacataaagaaatcaaaacgaagagaacaagaggattacttactataacccatgacacgattgccgggaccttcagcaacatgaaaatagtcaggccatctcgctaaataggtcatgtagaaggacatattgaactgtttcacgaaacaaaattcgaacaaaaatcaacaaaatcgccatagcaaaacaaagcaataatcagacgaaaccagataataagaagaagaaacacgagattactgtttcagtgaggtggtccagattcacggaagtgaatcggagaaggtcattgcagctgaatctacgtatcgtcgtcatctcttctttttctcaaatcccttcgagcttcgtcagattctctggaaaaagaaagaggagacaacaacaaagcaatatacatggcccagttagaaaattaataaagcccatttatatttgggcctataacactgatgacgtcatgtaaaagatgatcaaatttcattatctcccgtcgtcgcgaccttctcagacaacagaaccaaatcctcggcggcgattgaagaaacctttccgatggatctgctcagggaagagattctgaagaaacgtaagagtctagctgaggaatctggtggtaagaagttcttcaagcggtctgagatcgagcagaagaaaatccagaagcttcgagaggaagaacgacgcgagcacgagcttaaggctcagcggagagccgccgccgccgcttccggtggagatggaaaatcatccggctctgctcctggttcttctaacgcagctacgtctgcgtcttccaaatcctctgcatcggacgctgctgctatcgccgattcaaaagccctaaccgacgaaaacctaattctcccgaggcaggaagtgattcgtcgtttgagattccttaagcagccgatgactctcttcggagaagatgatcaatcgcggctcgatcgactcaagtacgttttgaaggaaggattgttcgaggttgatagtgatatgactgaaggacagacgaatgatttcttgcgtgacatcgcagagcttaagaagaggcagaagagtggtatgatgggagataggaagaggaagagtagagatgagagaggaagagacgaaggtgatagaggtgaaacaagggaagatgaacttagtggtggtgaatcgagtgatgttgatgctgataaagatatgaaacgtttgaaagctaactttgaggatctatgcgatgaggataagatccttgtgttttataagaagctgttgattgaatggaaacaggagcttgatgcgatggagaacactgagaggagaactgcaaaagggaaacagatggtagccacttttaagcagtgtgctaggtatctagttcctctcttcaacttatgcaggaagaaggtaaagattcttgctttcgattgttaattaggtgtaaatcattgtttggcaagaaaattgttagggagattatctctgtttatgaaattggagatagattatctcagttctatctaataagcttagagaactatgtttattaagcatagtttgggtaggaagaccaatgtgcagtgtttaggttccattagtttgtgtacttttgattatatggcgacaaggacgagttttctaataagttctagtgctaggtagacaatgagaacgtagaatagcaagttggaatctgtatgcaccttgaatttgccattgaggcctctgttagttatctccatttagctgaagaaaaataggctggaatg

SEQ ID NO: 32141 - DNA, 3000 bp, Unknown
  misc_feature (1)..( 3000): 2750-1469P.txt file - cDNA_ID_3049369; gDNA_ID_1621118; Annot_ID_171949
ggctttaaagtcaagaaatacagaaaacgtaaaatcataaacatataaacaacacaatattaaatattcataaaatcataaatatgcactcgtgcgagcatcaccaacgcgtctcgatttcactttctcatataaatatattcatattttattaataaatattttaggtaaactaattatattaggacatgtgtgagaaacgtttattaaaatctttccctttctcctcattttcctattttttctttataaaacaaaagagagaacatggagttggaaatggcgtacgtacgtgttccgtacacgtgaggggcagttatatattgggtttgtattgccctcaattactttgttttcttcttatacgcttttttgttgtataatactataatttaaagtccacataatcccaaaatacattagaaaaactcaatttatttttgttttctttcttaaaaatcccatatttcatcaaaaaataacattaaatcactttcgttgactttaaaaaactaatcaaatgctttaacaaggttcattttgttaataaaatttggatcatttcgtatttaatattattgcccagataaatttaattcctaaatccgctactgatacatcaatcaaagaactcaataagaaactttggtaaaagcaaaaacactctaacaacaatgttggaatctttacacaaccacaggcctcaaaaatccctacagaaccaagaaatcaacaagaagaagactaaaattagcaggattcaaatggaacatacagaaccaaaagagctcagaaggatttgttataccttatgatgaggcaagcaagtgatgtgatactcgtgcataacccaaggagttctaactccatgaggactcttaccttcatggtacacaagcgtcttcttaatccctatcacaacaccatttcctcttttatccctaattttccgatcaacaccactaggtttccaaaacccagaacctgtcgtcctcttcattttcatcttattcgggttcgtgtactcaatcggagagaaaaagtaccactcaagatcttccgattggatcctagctaactctgcaacaacaacaacaacaacaacagcaaaaaagaacccaaatttagaaatgattgatgatgatacagagagagagaaagagagtgagaaagaaagtgagaaaaagggtgagaaattcagcacaatagcctactcatattaaatgttttcgattctcccttgtttttactttttttggcaaggaacaatcgtttgtattaagactcttgtagcttctacaagccttttcatttaatgaaaattcacatatttatcaaaaaaaaaaaaaaagagggtgagaaagagagtgagagagagaatgagagagagaaagagagagagacacacatagatcgagacagcgagagagaaagagtcacagagagagagagagagattactaggcaaatccttgctgggtttgtgattcaagatgttgatctcgctaatggcttcatcaacgagccaagtcttacccagaattttgttctttaggtaatggtttatcacttcctctcccgtcggactaaatctatacccagtcggatctttcatcatctttttaaaatagaaacagatcgaaaagaaacaaaatgatcaaaattcccgggttcccgggattagggtttgagtgaagttttttcggcttctctctctctgtgtttttctttctttttcaaatacaagtaggaagtgattgatgaaagagatagcgagcgacggtggtatttatagaaaatgattgacggtaatttttttttcagtaaaaccaatttgtagtaatttctcacattttgacggtggtatttgtagtaattgtcgaaaacaattctctctctctctctctctctctctctctctctctctctctctctctctctctctctctctctctttctctctctctctctctctctctctctccttataattattttttagtgtgcgtaagaaatcaacatggatcagcaaaatgcatttactctctttctctccaaagtcagcctcaaatatttttttggacgtttacgtttagtaattaaacaaataatgtaatgatttggaaagagttaatgtttctataaaagtctcttgtaaagcctccaaagtcagcctcaaatattatatgaccaaaaaatctcttgtaaagtactccctagtaattaaaatggaatctgcaactaatgtaatgatttggaaagagttaatgtttctataaaagtctccctattaaagtctccctagtaattaaaattaatttaatattgtttagccatgactcatacacgggccggccctggttgaaaatcaagcctctcctaagtaatatgactcatcactctcaatttcatctcttgcttgggtcttcttaatcaggtcaatttcgtttgttcatttgtggtttatgttagtttcatttccttttcatacctttttagggaaaaatagaaatcctaagtatattcaatggactcacgcactgacgcacatatttgtgattttttttataggagaataaggacttgcagatttgagattgttgaacgtaactactcactagaccaaacaatataaatagtaattggaccaatagaggcttctgggatacttcaacttctaaatttaaggtgattacctatgtaatttccagcattttaggaaattattttctagatcgtatttgttaatttgcttagaatttctataagagtttttactttttccttacaattcctttattcactttgtccatatattttgttttgatcaggtaagccagtggcacatctggagggttagttgaggttaactatatatcatacacattttcatcatatattttagcttcattctcggagcttcgaacgtaagcatacagctctttccatgcagctttattcctatttttgatctttcggaaatttattgcagcgacgatg

SEQ ID NO: 32142 - DNA, 3003 bp, Unknown
  misc_feature (1)..( 3003): 2750-1469P.txt file - cDNA_ID_3049369; gDNA_ID_2926161; Annot_ID_198764
attggctttaaagtcaagaaatacagaaaacgtaaaatcataaacatataaacaacacaatattaaatattcataaaatcataaatatgcactcgtgcgagcatcaccaacgcgtctcgatttcactttctcatataaatatattcatattttattaataaatattttaggtaaactaattatattaggacatgtgtgagaaacgtttattaaaatctttccctttctcctcattttcctattttttctttataaaacaaaagagagaacatggagttggaaatggcgtacgtacgtgttccgtacacgtgaggggcagttatatattgggtttgtattgccctcaattactttgttttcttcttatacgcttttttgttgtataatactataatttaaagtccacataatcccaaaatacattagaaaaactcaatttatttttgttttctttcttaaaaatcccatatttcatcaaaaaataacattaaatcactttcgttgactttaaaaaactaatcaaatgctttaacaaggttcattttgttaataaaatttggatcatttcgtatttaatattattgcccagataaatttaattcctaaatccgctactgatacatcaatcaaagaactcaataagaaactttggtaaaagcaaaaacactctaacaacaatgttggaatctttacacaaccacaggcctcaaaaatccctacagaaccaagaaatcaacaagaagaagactaaaattagcaggattcaaatggaacatacagaaccaaaagagctcagaaggatttgttataccttatgatgaggcaagcaagtgatgtgatactcgtgcataacccaaggagttctaactccatgaggactcttaccttcatggtacacaagcgtcttcttaatccctatcacaacaccatttcctcttttatccctaattttccgatcaacaccactaggtttccaaaacccagaacctgtcgtcctcttcattttcatcttattcgggttcgtgtactcaatcggagagaaaaagtaccactcaagatcttccgattggatcctagctaactctgcaacaacaacaacaacaacaacagcaaaaaagaacccaaatttagaaatgattgatgatgatacagagagagagaaagagagtgagaaagaaagtgagaaaaagggtgagaaattcagcacaatagcctactcatattaaatgttttcgattctcccttgtttttactttttttggcaaggaacaatcgtttgtattaagactcttgtagcttctacaagccttttcatttaatgaaaattcacatatttatcaaaaaaaaaaaaaaagagggtgagaaagagagtgagagagagaatgagagagagaaagagagagagacacacatagatcgagacagcgagagagaaagagtcacagagagagagagagagattactaggcaaatccttgctgggtttgtgattcaagatgttgatctcgctaatggcttcatcaacgagccaagtcttacccagaattttgttctttaggtaatggtttatcacttcctctcccgtcggactaaatctatacccagtcggatctttcatcatctttttaaaatagaaacagatcgaaaagaaacaaaatgatcaaaattcccgggttcccgggattagggtttgagtgaagttttttcggcttctctctctctgtgtttttctttctttttcaaatacaagtaggaagtgattgatgaaagagatagcgagcgacggtggtatttatagaaaatgattgacggtaatttttttttcagtaaaaccaatttgtagtaatttctcacattttgacggtggtatttgtagtaattgtcgaaaacaattctctctctctctctctctctctctctctctctctctctctctctctctctctctctctctctctttctctctctctctctctctctctctctccttataattattttttagtgtgcgtaagaaatcaacatggatcagcaaaatgcatttactctctttctctccaaagtcagcctcaaatatttttttggacgtttacgtttagtaattaaacaaataatgtaatgatttggaaagagttaatgtttctataaaagtctcttgtaaagcctccaaagtcagcctcaaatattatatgaccaaaaaatctcttgtaaagtactccctagtaattaaaatggaatctgcaactaatgtaatgatttggaaagagttaatgtttctataaaagtctccctattaaagtctccctagtaattaaaattaatttaatattgtttagccatgactcatacacgggccggccctggttgaaaatcaagcctctcctaagtaatatgactcatcactctcaatttcatctcttgcttgggtcttcttaatcaggtcaatttcgtttgttcatttgtggtttatgttagtttcatttccttttcatacctttttagggaaaaatagaaatcctaagtatattcaatggactcacgcactgacgcacatatttgtgattttttttataggagaataaggacttgcagatttgagattgttgaacgtaactactcactagaccaaacaatataaatagtaattggaccaatagaggcttctgggatacttcaacttctaaatttaaggtgattacctatgtaatttccagcattttaggaaattattttctagatcgtatttgttaatttgcttagaatttctataagagtttttactttttccttacaattcctttattcactttgtccatatattttgttttgatcaggtaagccagtggcacatctggagggttagttgaggttaactatatatcatacacattttcatcatatattttagcttcattctcggagcttcgaacgtaagcatacagctctttccatgcagctttattcctatttttgatctttcggaaatttattgcagcgacgatg

SEQ ID NO: 32143 - DNA, 3003 bp, Unknown
  misc_feature (1)..( 3003): 2750-1469P.txt file - cDNA_ID_3049423; gDNA_ID_1621119; Annot_ID_171999
tatgcaaataaacaaaaccggtggactgtcacacgtatattcctcaagtggtttgatcacttatcaaactctcaatccatctttaatatcactacccacaaaagttcaacaatagagtccactatctggataattgtagtattcttacccaaagatcatgatgttttcgttatctaacacctcgaaagagctctagaacatttaacaaaccaatttctctttaaatatacaaaagagaaacttttaccttttcatcatcaacactttccacggtcacaaggttaggaacaccagctgatcaaaccaaagaattaagaatagaactcaagtgtggagttttacacccaatttagtaactcaatacaaaaaaactaaagatgaggactttgaaatagcaaagtcaatttacatagcaaaggcttcactttgttgctctgcaaattcccaatgaaatgccactctatatcttctggaagctgcaaatttcaatgtatcaatataaattcagaacttttctaatccaaaagattcaatttttaaaggattcgtagaaatcatagcaagcagagagaacctgaggtgccttctcaatgatctcttgcacataattctctccaaaagacctctgaccagcgtcgtatacttggcgaatcagagaaactggtttcgtcttactcaccgctacgacccgtatctgatccgacccacgacccgctttctccgccgcctggtttacccgctgaaacaccgatctcagagccgccacaccatcaatcgccgccgccgacatagtagaatccgccacgtgttctttgtctggctcctcttcgttcatcgaacaatcactgatcttctggtcacagctttgtgggagagaaagagggaggacagagagacggataatacgctgcgtttcgatgttttaattttcaatgaaaaaaaaaacattcgccacgtttcgaaacagaggaacaatgttgatttttccccaaaaaaaaaaggaacaatgttgatacccgtgagaagttaaacgaatgtactgttgcagatgtattgctaaattatggatgtagattaattatatacgtagttgtaaatactaaatagttttgaaaataaataccagtgggaaatatttttttcataaaacaaaaactatatcctaaaaaaaaactagaacctaataaccccaagcatcatgtgtaaatttgtgtttttgtatataagcaaatggcaattttgatttttttttcttgacaaatgggcaaagtctataaaccatcaaaataagttctttattcgtaattgattccacaaacctttgatattcattttgtcttcataagttaaatttgtgtttttgtacatttattgtcacacatcctatttaccactagtttcaaccatggggactttcatatatttctaaattctaagtctggattttaatgagtgcatggttgaagttgttctctaaatctttcatgctttttaaatccaacgtacatttaacgatccatatgtctctccacttagaaacttcgacactttatcatccctcaacaatcataagaatttcattaaggagtttaaccagtgtgcctatagcgtcacagtccgaactttaaattgcagcaatgtccttcaagttgaagggactttttgtacttgtttaaaatacgcaaatatattagggtcccaaatttattattcattgaatttatcccaccaagttaagtgtcaacgccttacttgagtgctctcagaactgaatttagtcaagtttgaacaaatatgtatataccgtgtattacggaaagtcttgtattgtacatttgtactcgtacctttttctctcctatatatttttcttagttctaaatgtattatttgcttcatggatatgattgatactacaaaaaaactagttgaataataaatatgaacgcttcaaaaaatgtcaatgtctaaccttttgacaaaaaaaaagaatgcaagtttcgtaaacatggcacataaaggctaaagtgtgtacaacaaaaagacttggtttggttcggatagtggagttccattccatatggatacactattgaacaatatctccctaaatcagtaaatctctatatagtatatacttcgtaaaaacattataatttagttgattgtttgtaatcaacctaacaatattacgcaaaaacattatatttttaaagatatattatcataaatcgtattacgttacgtttataattaaatccttaaaaacaattagtagataaatcatttgagctttctgagttaactgatcgtgttgtcaggatcaggaagagaaaaaaaatcactaacggatgcgatcaagacgttactatactagttgcacttttagctaaaagattatttatttttactttgtctctagatattattaaacttggatatctcatggtgttattctttgcaaaatatctagatatttccccttttacttatttaaagtaattaatttccttattttgtctctggatattttggagaaatttttatctccaaatatcgatgatatataccaaatcacaaaaacatctatatatctagagctatatagctaaaaacaatttattgccaaatgatcaaatgaatttcatgtgtcccacttttgttctgcctaaatttagaaatttattgtttttttttctacgcgagcctaactcgttttactcttctgaaatctaaactcttcgaatttaattgaccactccactaaaagagtcttaaaaagtcaaatatttttcttattacgacctaattttgaaagaacttcttcgttgacctatgcatcattctctcgtctataaataccattcacgtcgttcgttactcttcatctaaaaacattcatacacatacaaacacacgaaaatacatcccaattctaaaaaaattgttttttcaatttttctcctttgatttcttaaaagaagatccacaacaacaagaatg

SEQ ID NO: 32144 - DNA, 3003 bp, Unknown
  misc_feature (1)..( 3003): 2750-1469P.txt file - cDNA_ID_3049427; gDNA_ID_1621119; Annot_ID_171997
ttgcactctagtggtttaatcgaggtatgagttgcattcttaacaaaatatgtggtggttgtttatatagatcaagaaccgcaagttcgatttttgttttggtgtgaatagagatgtatctatttgtcttgcagacatctaagagaaagctcgataaatacgaaagattttatcatcttcgcttcttgattgtggcgatgcttcctttcctgaaaaagttatgcaaagcacaagatcaagaaatcgaaaccgaggctaaggttcaaggtatatatggttctcccttttactactaagacaagattttttcttgctacaagataacatattgatatgtttatagattcaatggcttctcaagttgatatatccgagagtctatgctcaaatgaagagcgtgtcttctggtaagtatcatccttttgttgcatgtgtttgaagagttacatgacatctatcttatatatcactgaaatgtctttgttgctctagtaaccactgtgcaacatcaattgttgacttgcatcgaagctgtccaaagtgttcatatgaattgtgtctgaactgttgccaagagatccgtggaggttggctttctgaccgcccggaatgtcagctacaattcgagtacagagggacccggtatatacatggcgaagctgcagaaccgagctcttcttctgtttccgaggatgaaactaaaactccatccatcaagtggaatgctgatgaaaatggaagcatacggtgtgcgccaaaagagctaggaggttgcggggactctgtgctggagcttaagcgaatcttaccagtgacttggatgtcagatttggagcaaaaggcagaaacattcttagcctcttatagtatcaaaccgccaatgtcatattgtagatgttcttctgatatgagtagtatgaagaggaaggcagcttcgagggacggatctagtgacaattacctttattctcctgattctttggatgtcctgaagcaagaagaacttctgcatttccaagagcattggtccaaaggtgaaccagtgattgttcgaaatgctcttaacaacacagctggtttaagctgggagccaatggtgatgtggcgggctttatgtgagaatgttgattcagcaattagctctaatatgtctgatgtcaaagctatcgattgtttagctaattgtgaggtagaaactcattttcttataaagtttctatagctgtataagaggttataaagctcattttgtttcttgttatttcaggtgaagataaatactctatgtttctttgaaggatatagcaaaggaagaacatatgaaaacttctggcctgagatgctgaagctgaaggattggcctccttcagacaagtttgaaaaccttttacctcgtcactgcgatgagttcatttccgcattaccatttcaagaatacagcgatcctagatcaggaattctcaacattgctacaaaacttcctgaaggacttcttaaaccagatcttggtccaaaaacttatgttgcatatgggacttcagatgagctcggtagaggagattcagtcactaagcttcactgtgatatgtcagatgctgtaagtttcagaattgttacttagtactgttaaataataatacggtttctcaggtgtataacggttttttgtttttgtaggttaatattctgatgcatactgctgaagtaacactaagtgaggagcaaaggtctgcaattgcagatttgaaacagaaacataagcaacagaatgagaaagagcttcaggagcaaaatggtttagaggaagaagaggttgtgagtgatgagattgtggtttatgatgaaacaagtggtgcactttgggacatctttaaaagagaagatgttcctaagcttgaagagtatctaaggaagcattgcatagaattcagacatacttattgctctcgtgttacaaaggtaagaaataatccacaaaacgttttcagttccgagtcttagaggttattgtgctgataggattctttatgttaggtgtatcatccaatacatgatcagtcatatttcttaaccgtggagcataaaagaaaactcaaggcagaatttggtatggttacttgtaactgtagtaactgtcacttaccgacattgtattcttacgtttttgtgtttgtttgtttgaactaaagggattgagccatggacatttgtgcaaaagctaggagaagcagtgtttattccagcaggttgtcctcatcaagttcggaatctcaaggttattatttgaatggaagctgtcctattaactaaactttttctcattatctttaacttgtattatggattttgatacagtcgtgcacaaaggtagctgttgattttgtttcccctgaaaacatcgatgagtgtctccgtttgactgatgagtttcgacaactccctaagaaccataaagccagagaagacaaacttgaggtgattctttttctgatattttcaattttggattagcaacttctgtcaatggatacagttttgtttgtagttgaatcttgttttaatctttgccatgtgaacagataaaaaagatggtgatctatgcagttgaacaagctctgaaagaagtggagacattattgctagatcgcagctaaaagctctatagctttgttgttgtaggattaacagcagattttgtagaattgttaaagccatggctattgtagttggcttttgctgtgatatatgtatgtaaaagagacaagtgtctcttgaaaagaatgatttcctttttttcaaatgggattttgatgtaacttttccttttccggtctgttttggcatatgaatgaatatttgatgtaagcttcttttgtatagttttgtatctttacatcattttgagagcaaatgaaagtttatgatatgagagcatcatagattcatagtagcaaatacaattggttcagttgttgcttgcaaatttttactgcagtaaatatg

SEQ ID NO: 32145 - DNA, 3003 bp, Unknown; identical to SEQ ID NO: 18260
  misc_feature (1)..( 3003): 2750-1469P.txt file - cDNA_ID_3049431; gDNA_ID_1621119; Annot_ID_171996

SEQ ID NO: 32146 - DNA, 3000 bp, Unknown
  misc_feature (1)..( 3000): 2750-1469P.txt file - cDNA_ID_3049471; gDNA_ID_1621121; Annot_ID_56287
cagatgttgttgaatcccaccggagtattatcttctccgctgtctctaaatcggaatcaacgccacgagtctccggtgttgccataatcagaatctgaaactggaaagtgttttgacttcacagatcgatttaggtgttttctttttgtttgttcctttgaaatgagatttaggtgaagattatactgagagaactctgaagtctgctttgccaattttttaatgaagaaatcaaaattcgccttctttttttttcggggaaaagagtcaatagactattcaacgctcagctcgtggggtgtgtttttttgttttgttaaaaaaaaactatacaaatatttggattctcgccgacggcgtgaagttaccggaaaacatagattaccttaaaagttctattactactttcaccttggaggtagatttttcgttttcagtcacatgaatttggcaagaaaaaaagaagaagaaaaactaactactttaaccataaacctataatatattttttcacactaaactataaatatataatacctattttaccttttatacataagtaacaacatcatcacaactaccactttcactatcatcaccaccaccgttgtgaccatcatgttattaccatccctccatcatcactaccactgtcatcaacgccacacaaaaaaaaaaaactcatgaaaattattgataataatccataaaaagaatttatacttttaatatctaaattttactcaaatcaaattaccaattttcttcaatgcggatatactaacatcatgttatagcctccatgcagagtttaagatgaacatttttggactgcaagcccatatattttgtttagccgactttttaaagaataaattgaaaaacacgaaagattgacgttgagattcgaatcgagatgcatgattacttaaaaccagctaagtttcataaaaactagaccgattaatatcctctgaaaaccgcaaccaaatacttgttcgcttgttctcatggacgacactacctccatggtaaaaccttaatagagtcttgatgtaataattattagcaacaaccatcataactaagactatctacattggttacatgatgaatcaaatctataagaatgacatttgtgagtatttcgtttcattttttaaagtgtaattatcactatcactaattttggtttggataaatgatagatcataaatctactattctaagtaaaatctaaaatggattattggtatatgtagattttaaatattttattggtttattgattcttaaattccatccaaacttcattattgttggttcaagcttttttatatatttttattcatatattttgttattattgatattctaattttttttaaacctattgttgttacaattctctgtattttggctctctagttataattgatataaaataactttaaatacttaaaaatacaaatctagaataagaatggagaaataaatgttatttatatcaatgagagaagagaagaatgcacaaataaagaacattgatatgttcttttatccacgtgagaaaaaaagaattcattttggagttaaaacatttccatcaatacatgatttactttgaaaataaaatgttaggaaatggttgataaaattccatataaactcactagaaatcatcggtaataatatataagaaaaaattataaattgtacacaatcaacttaccaataagtaccatactgtgaatttgtgaagatatttgatcctttacaagaatcttgctgacgtacaaaacgaacgattaaatataagagataaaccaaacaataaattatataagaggataatttttataatatttaaataatctctcctatgcagtttcagcttaatcgcgttgtaatctcagcttaactagtatcttacacttgaagatcaacaaagacaaacctgcaagatggaaataatcccttgttaaagtgatgaacatatcaatatccgcaacaacatcaccttgaagcacattgcatatcgagctacaaacaagagtttggtctaggtgaggattttcatcatccagatgaatctttaaaaagaggttctttatactcgacttgattttccgattaaacaaacacttcacaaaatcaatgaattccttgatactatcatgttattgtatagcataatcaaggttaaaacgccgaaaaagaacaaacacattctttcactttctggagaatactgtcgttgaaacagtttttttgtggaaagaaaagataaaatgtatgcaaaaacatcgtcttgtaaaaaaaatcttttaaaatttaaaattttctaaatcgtacataatcaacttacaaacttgtgaaaaaatttggtaatatataacttgtttgtgaatatatttgatcaaatactctaaaaagtactaataagtttaaaaaaatcttgccgacaaacaaaacgaacaaacataagggataaaacaaacaatgaattatgtaagaagataatgttttttagtgcagtttcagtcaatcaaagaaaatcaaaatttctaagtatatattagtttgggctgggccgtcaacaattggtcagtcactgaaacgaatttgttcgggccttgggcttgatccgtcaacaacatcaaggttcagaacaaatgattggtcagtcactaaaacgaatatcacagctgccgtgagattagtatacagtctatctctctctcgaagaaatcgtcacactcctataaatggtcacttgtttcgtacggcctttctttactcctttagagagagcgtgccatttttatttttctctttcttctctcatttttattttcttttcttttttttcaccttttttttttcctttttttttctttcttcttcttcttacttgattttgaaccctagcttaaggggaattttctcgggaaacaaaagagatatttttatcgcagtgagaaagaaacacaaaaaatg

SEQ ID NO: 32147 - DNA, 3000 bp, Unknown; identical to SEQ ID NO: 32146
  misc_feature (1)..( 3000): 2750-1469P.txt file - cDNA_ID_3049471; gDNA_ID_1621121; Annot_ID_172081

SEQ ID NO: 32148 - DNA, 3000 bp, Unknown
  misc_feature (1)..( 3000): 2750-1469P.txt file - cDNA_ID_3049510; gDNA_ID_1621121; Annot_ID_56290
aattgggtgggtttatttgacccggaacccaaaagttgactcgttgtatgaaccaaagtcaaatggtcaagttttcttttttctttctttaaagttaacgtccaagggtctggtgagtggtgatacgagctatagatattagatattgtggcttaacaaattgtatgatatagagactgaaataatctttacatgtcgctaatttggtttacactaggaaccattttctatgtgactcggatcaacatgacaaccatgatgaacacacatgtcatggcgaggatcaagagccactggaagcaactcgtctttgagctttctgaataaatctttgtggctcttacggttgcgtgtcctgtgcttgctaagctttgctcaatggcttcctcggtagaatcaagtatctgttaatgtaccatcaacaacaaaaaaaaaacacagaaaatgttaagaacaatgaagccagtagaaacaatatatgaaccgatatagattcttctcttatcccattgttgatgataattcataatagtaagtataatgggttttgtaaggaaaaaggttagcatctcaccttttctgtattttgcacagattggcttatcatttgacttctctccttaagttgtctcgcaagtaccaccatttcatcggttagatcctcttgaagctttctgtcatcaaatgatcaccaatgtgacatgaagtggcattttcaactcgaattcaaaagcatacactcttcacgataattttgtttcattaaggaaagtgcatatacctctgcttgttaacttgcgcttgagctgcggtgtctagttttattggttttgagggatcagcgtcatagctttgctctttggaacttgcaggcctacctcaatcaagaaagcagctaagaaatgaaggcaatatttacaagttgagaagcatgtgaatagtattgcacgtacacgattcttcttctcagctgtggagaattgggggttcgtgtatcgtcttctactttgggagaactatcgttagtagaatcctttgcaaaagcttcatcagatacctctgtgtgaggctgtaaatttggcaggaatcaaaataatttggtattagttacagaagaaaagcttgaattcttgcaactaaaaatggttgtacaccaaaacgtgcatgcctgaaactaaactcatagggaagtaagaaagcaaacttcaaaccattctctcagatcaaatgcggctagtagtaaataggtaagcatcatacagctagagcagaaatatcatctaatatgttcctccaaatttcttagctgtagaatccaaatgaacaatctcgttctagttcaggtgacttaccacttgagcaactattcgtgaaacaacagcttcaatcttctcatagtactcattcaccttagcgtttgtaactctggttagagagatgagcataagtattttggtagcatcaaatagagacactctaattcgccatattaattgagagcatatttcataatattttagtctttcgacaatatctctacttggaactgaatagaataccaagctattcaattagaatctctaaacagttgatcctagtagcaatctttgtgatttcaactcattgaaatgtgaaagatttaaaattacacagctgaaacaaggaagagagtaagtaacctgggaagcccttcaagggtcttctcttccgagagttgttccaactgttccctcaaagtagcaacatactgcagatggttcacacatcaacatcaaaatcaaaattgtaacagttagagaggttataataagcacaaattctaatagtttatacatgaaaatatccaaaagaaggttacatgcataagcttagactggttttgctgattaggtgcagctgaaagtaatctcatgaaattgatttccgttttgccgattcccattttaagatatctgatcataggaatgccacattcagatggaagccagacaccagaacagaaacaaagttgaggtaatcaaagaagccatcttgagagcaaagtggttttgattccaagaactcatatttatcagcataacctctatgttcatgaaacccagaagagcacaatacataactatcaccactcaatctgttattaccagaactagcagtgttcaacttcactcaaatgtggacgaattacagtaaattggctaatcccactactgaattgaccttcaaggtaaaccccaatcatttgccactacgatcaaccaaaaatatagattcttcattcactcttatcaaaagctatacatgaaattcagagtgttctcattcctaaatatggaaagttgaattctatcaacacaatcagatcatgcgacaatgaactagaaaccacgaaccagaaattgttggtaatcgtttagtggacgagattgaatcaaaggttcaagtggtaatcgttttctcctgacgcaaaatcgaaagaaaaaagatcggtagcgtcgcatcctaatcgggtgacccggaaaccaatagttgattcgttttagtggcggtaaaacccggtttgatgaacaaatattaatgggcctggcccatacgaggatgatcgtggcaatgtcgatgataacaacaactcctctattcgggtttatgttgacccggaaaacgaaagcataggacacgtgacacatgtgatgtgagtgaagccaaaaataataatattgggaaaggatgaacacagcagctcagctttcgtcttctccgtcaatccaataaaaaaatcagcaaccgttgtttgtttttaagctttttttacaaaagacgtacacgtctctctctctcactccctctttaagatcagaagctcatttcttcgatacgatcaaccattaggtgatttttttctctgatcttcgagttctgataattgctcttttttctctggctttgttatcgataatttctctggattttctttctggggtgaatttttgcgcagagatg

SEQ ID NO: 32149 - DNA, 3000 bp, Unknown; identical to SEQ ID NO: 32148
  misc_feature (1)..( 3000): 2750-1469P.txt file - cDNA_ID_3049510; gDNA_ID_1621121; Annot_ID_172084

SEQ ID NO: 32150 - DNA, 3000 bp, Unknown; identical to SEQ ID NO: 6998
  misc_feature (1)..( 3000): 2750-1469P.txt file - cDNA_ID_3049514; gDNA_ID_1621121; Annot_ID_56284

SEQ ID NO: 32151 - DNA, 3000 bp, Unknown; identical to SEQ ID NO: 6998
  misc_feature (1)..( 3000): 2750-1469P.txt file - cDNA_ID_3049514; gDNA_ID_1621121; Annot_ID_172078

SEQ ID NO: 32152 - DNA, 3000 bp, Unknown; identical to SEQ ID NO: 6999
  misc_feature (1)..( 3000): 2750-1469P.txt file - cDNA_ID_3049518; gDNA_ID_1621121; Annot_ID_172076

SEQ ID NO: 32153 - DNA, 3000 bp, Unknown; identical to SEQ ID NO: 7001
  misc_feature (1)..( 3000): 2750-1469P.txt file - cDNA_ID_3049521; gDNA_ID_1621121; Annot_ID_172072

SEQ ID NO: 32154 - DNA, 3000 bp, Unknown
  misc_feature (1)..( 3000): 2750-1469P.txt file - cDNA_ID_3049525; gDNA_ID_1621121; Annot_ID_172071
gttgaacgaattggctagaacagctcctgcatcagctcctttccaattcaccgtctttgatttctacaacgcgattcttactaggacgcagaggaaccaaaacttccgtgagttggttaattatcatggtttaatttcatttttaaatttttttataacttctaataccatgtgtttaatatttgccattcttaggatttttcgttacgaacgcatcgtgctgcggagttgggacacatgatgcttatggttgcggttttcctaacgtacattcgaggctatgcgagtaccaacggtcttacctattcttcgacggacgtcacaacactgagaaggcgcaagagatgtttggtcatcttctttttggagccgatacaaatgttatccaaccgatgaacatccgtgagcttgtcgtttaccctgccgatgaacctatgcgtgagtcttgggtgcccccaacgtcagccaccgttcaactcagggagagccgcggttacgagtattactgagtctctaaaatcaatatttagggatcgatcggggtttctataagggttatgagtcaaattataactggatcaatatcggaatcttgagtagttttaatttccaatgttttcatgtttctctagtgagttttcctccataataaaagattgatctctgcaactcttaccccttgcaaatcttttatttaaaagaaacaaaacttttacataaatttatttcttttttttgtcaaccacatattaaaaggtaattccataattaaaaaaagaaggcacaagaagcgttttctcatcatcttatcttttggagcggacccaaatgttatccaacctatgaatgttcgtgagctcattgtgtatcctgttaatgagcctatgcgtgagttttgggaggatccaatggatgagaatatcatcgttagtccatgacgtcgacgtcgatgctagtgaatctatctaactcgtttagttcttgagctcactattttccatctctataccatgaacgagctcttggaatttgaaatgcgctgttattaatttgttgagatttaaaataataatgtaacctcaactctgttttttccataagaaaaatctcaatgagtaacgtgataaacctgacaatatgaaccaaagcgtgtccaatgacctgctttgtgctcagattagacaagtttcgggccacatgcactccattagaacaaaatgataaattttggtggaatcaatttaagaaggtagtggattcaatttgagaccttttttaccctctttttttgtttgcaattattcttgcaaggtaatattcgaaatgattggcaacaaagaaaataaaaagtagaaattataaagttccagaaaagataagtttatacatctggctttggggccggctatatttacagttaattttcatatgaaataaaaccaaaaatcatatatatagataatagatgaaccaaacaaatgaggcgttcttcatataaaacttcatcttcacgtaagcaaatgtgttttatttttatctagtttctgcactcttttagaaacaaaattgttcacctttctgtcgttctaatgattccaatcaaattgataattactagaacttacaaacgaataaggaccaactcttctgtatttgatatagacactctctcaaaacttaatcttctctaatcttcactgtaaatcttaaggaacaactctccacaagtttttataatttatatatacataactaagctattacctatactattaagattgtgtcaacgcaaaattgagttattctttcttatttaaatttgaactattaaaaatatgtaaataattaacgaaaatctttgtcaaaacactattaagaaaataatttcaaaaattaacatgatgataaaatatagattgttaattgttttttttaattgttttcaagtaatttaatcaataatatgatgaggatgattaaggaaattactataatttatcttttaaagaatatcttagcataggtatgagttgtttttgcaaaattttaataattgatttaagttatctaaacgttattaaaattattatccaaattatctataattatccgaacatattcgtctcttgtctattctggtagtgatattttatgtatctatattattcatatatcgtatcagtataatctgacttatttaaaaatatctatttgatatgtattttgatattaaaaatattttaattcgagttgtgtactcgtaaattatccaaaagttttagcagaaataaacatatctacgtatatgttggtgttgaaatttttttgttgaatttggctagtcagcaaaatttagttttatgcaaatggttactgcagaaattactgaatctggtttagtgttaccatttacaccctatatttccgtgaaatttgtatgtttaattctacttcttgcctctaaatgcacgatcttttcagcacttcgaagaggttaaagtgacttttacccgatgagaagggaattgtgtggcagatagaattgctagggaatctctttcttttctgaattatgatcccaaattgtattctatattgccggattgggttaaagcttatgtgtattcagactcttgtgtaattgtaagttgttgttgaaccaaaaaaaaaaaagcacgatctttcttggtactcgtagtaacaatagatattttgttgagaattaaaaataaagtagaagagaaaccagtaatgcgtcagacgtgattaagcgaactatataatataattgatcgataatcgtttgctagtgcgttaaataggtgtatagtaaaatgaacctcgcgctacacgttattatttgtatagtaaaatgaactattattttcattgccaaattgtagtacttgcaatataaatataacgaatcggtctacgagctaaggcacaaaagcaatcttcttctcttttcacagttctgtttctccctctctctaaatg

SEQ ID NO: 32155 - DNA, 3003 bp, Unknown
  misc_feature (1)..( 3003): 2750-1469P.txt file - cDNA_ID_3049532; gDNA_ID_1621122; Annot_ID_172118
aggatatatggtgagacggtttggatcaatattaatacggaatgatatactatggtaaaattctaaaattaaacaaaatttacaatattaatacaaaaaataacttaaaatttcagaaatttagttatataaatcatttcgagatgtatcatacataaaaaaaagcaatagcatatatctataaatcatctttaaaacaaaaaaataaaaatttttgagaaaaatataggctcgttgtgtacttcttaatatgtttatcatttataaatactattaactaaaataaaatctttaacttgttaacaaaaatataaatacgttgtgtacccggatgaatatctagttattaacaaaactgtaccatttgttttgtagaattttacttattattttattttttggaccaaaccaacttattatttattggcatgtctagttagggaaaatgtttcaattgaacatgtaccgtatgtgtgcatgtataaatagaaattttatgattggattttaataatgcaacgaatcgatgtgaaactattagtgtaaaaccacaatcgacgtcctttgagaatttactggtaagaagaacacagaaaaggatagaaaaggatctggatggatccaagagaaaccctcgcgtgagtaattaaccctcacttaaaccccaatcaccatttcaaggcgagaaagcaagttgtttcttgagtaatccaagttgtttctattttgcgattttaacgggtcaaagatttgctctaagggaaggaggtagaacagttggagccggtgtggtatcaaaagtgatgagctaagtcgctatagcagatttaaaagttcttcaaacgaaaaaacacaactgttctctagtatctaaagattcatctctcatgagatttctactactttgagagtttatatcaaataaacgagagattagtgttttaaaagaaaagcttctcccagtgtgatatcttcactttattctacaacctaacattgacaaattaacctttaagcaagccaaagaatggagttagaaactagactccaaatcatcagcattccaacattcaaccaaacctaagtgcaaccatggcaataactgtggcagctctgaagtaaacttctttgattcttctttccactttatttgagacttcttcttcgttgattgttttcctattgaaattaacaagggcttccctgagtctactcacagaccacgagagcaataccaaactcaaactcattgcaccctcgaagaattggtttgcgcaaaagggtacctgcctggaagcaacattacaaacgagaaagaagagcacagccataccagtgccagcaaagccaattgaacactgagtcaaaagctcgaagagttctccacgtgatttctttagagatagcattgtggtttttctatgttgttcattgcctatcatcagagagagaaggctctcacacgcatgaagacggtttcgttcgtagaggtcatattccttatctcttatcttcggattttgtttctttggtgaaggcttgagcctggttttcttcggactgttggaaatcgaaagaaacgttttttaaagatgcaaaagtaccaaaaactagttgatgatattagatacctctttggaggagctagtgtaactgcgtcctcgggtagctgcagagtgtctattggtacttcactgtcgaatctgcagaatgagaggagagcaaaaacttaatgttaaacccaaaaggatgagactcataggtatgaatcaaacttgcagtgaagaattaactaccgctgaaactgcgggacaagccgtgagagctttctccatcttgttgagttccttaatctatgaaactcagctgccgtagagaccaaatcattcaattcagctctgctacttgagaacagaatgttagcatccaccatgagatccaataacggctttgcatatggttgctgagaacttgatcttaaagcatctagacccatcaattcagataggagagacaaatcgaatccttcttctttgagttcttcttctgatctagacaaaaggaactctaacacctcctcttttcttgcatactgctgagtgatccccaagcttaaacacacagggtctggtccagtttctgttaaccacagttcatgtcagtcgaaaaaagggattacaatttggtgaattcaactgaaatttgatcaaagtcacataccatgaacatccatgagtctatgcttcatcatggttgaatcaaactccaaaaagtggttagacttactaaaagaagaaaaaggtttcaatggctccaagagttgtgatttcaggttaaaggagctctccggtaatatctcatattttcttcctccaggattcaccagataagcccggcttgtctgaatcattcatagacataagaaccaaacaaggagaagacagaaccaggacaagaattcaacgagagattctaaacccaagtgttttaaaacagagaaagtaaaaaactgaccttgatgatctcgttgcttcttagctcttgaaggagactaaacctaagtgttgaatagctatgagaagccattgagaaaaaactgacttcttatttttttttctcttcttcgtcacaaaaccatggaaacaaaacgaaaaagcttatcgtcagcaatctcgcctatatatgcgtcagatattataagatttgtgtaaatcttttctttattcagttttggctggtgaccaaaacacactttgagtttttaaatatttaccctttgaggcacttattacttaaattaccaagaacatacccaatcttttcaataattacataaatatacctttggtttcttatattctcgaaattaacccaaagatcattagggtacatacattctttactcgagagagagaagttctaaagtcctcaaatcccgcaaagctttttcagcttctttgttgaattgcgagcagaggtagaaatcagcaggaaacaaaaatg

SEQ ID NO: 32156 - DNA, 3000 bp, Unknown; identical to SEQ ID NO: 7017
  misc_feature (1)..( 3000): 2750-1469P.txt file - cDNA_ID_3049545; gDNA_ID_1621122; Annot_ID_172133

SEQ ID NO: 32157 - DNA, 3000 bp, Unknown; identical to SEQ ID NO: 7024
  misc_feature (1)..( 3000): 2750-1469P.txt file - cDNA_ID_3049549; gDNA_ID_1621122; Annot_ID_172131

SEQ ID NO: 32158 - DNA, 3000 bp, Unknown; identical to SEQ ID NO: 7020
  misc_feature (1)..( 3000): 2750-1469P.txt file - cDNA_ID_3049554; gDNA_ID_1621122; Annot_ID_172123

SEQ ID NO: 32159 - DNA, 3000 bp, Unknown; identical to SEQ ID NO: 7013
  misc_feature (1)..( 3000): 2750-1469P.txt file - cDNA_ID_3049558; gDNA_ID_1621122; Annot_ID_172122

SEQ ID NO: 32160 - DNA, 3000 bp, Unknown; identical to SEQ ID NO: 7010
  misc_feature (1)..( 3000): 2750-1469P.txt file - cDNA_ID_3049566; gDNA_ID_1621122; Annot_ID_172113

SEQ ID NO: 32161 - DNA, 3000 bp, Unknown; identical to SEQ ID NO: 7037
  misc_feature (1)..( 3000): 2750-1469P.txt file - cDNA_ID_3049604; gDNA_ID_1621124; Annot_ID_56347

SEQ ID NO: 32162 - DNA, 3000 bp, Unknown; identical to SEQ ID NO: 7037
  misc_feature (1)..( 3000): 2750-1469P.txt file - cDNA_ID_3049604; gDNA_ID_1621124; Annot_ID_172210

SEQ ID NO: 32163 - DNA, 3000 bp, Unknown; identical to SEQ ID NO: 7040
  misc_feature (1)..( 3000): 2750-1469P.txt file - cDNA_ID_3049617; gDNA_ID_1621124; Annot_ID_172196

SEQ ID NO: 32164 - DNA, 3000 bp, Unknown; identical to SEQ ID NO: 7041
  misc_feature (1)..( 3000): 2750-1469P.txt file - cDNA_ID_3049621; gDNA_ID_1621124; Annot_ID_172194

SEQ ID NO: 32165 - DNA, 3000 bp, Unknown; identical to SEQ ID NO: 7035
  misc_feature (1)..( 3000): 2750-1469P.txt file - cDNA_ID_3049625; gDNA_ID_1621124; Annot_ID_172192

SEQ ID NO: 32166 - DNA, 3000 bp, Unknown; identical to SEQ ID NO: 7033
  misc_feature (1)..( 3000): 2750-1469P.txt file - cDNA_ID_3049633; gDNA_ID_1621124; Annot_ID_172184

SEQ ID NO: 32167 - DNA, 3003 bp, Unknown
  misc_feature (1)..( 3003): 2750-1469P.txt file - cDNA_ID_3049650; gDNA_ID_1621124; Annot_ID_56326
ttttcaaactttataatagatatatttaaaatcgaaccgtgaacatgatattattgtagtgaatagaaaatttaggaaaacataaaattttgtcttatttcacttaaaataaataattgcatacagaaaaatatattttaaggattgttttgataatgttttgcaattcaagtgtaagaactggtggagcatgaatccaatagattccaatggagttatgtataaatcacaatgagattaactatatgaaatcatagttagggaaattaaagattaaggtttataaatgtattttggacaaaaagaggaataaaatacaagtaattaatatctttgcctagataacctcaatacaatttgaacttcaaatgaacttggatggtaagatatattatagaaaaagtttggagtagaaaattttgaattataattcctaatatttcaataatatttttttgcctatcattgtttcagtaatatctacaatatattctaaagataatttttggaaaaaatcttcattgatattatatataaatcacatcccatatttgaatgaacaaatatttttctacctatgaaaaattcaaaattttgactaataatatgcataacactactttatatacatttaaagtctcatgtttttctaaaataatatactatttatagtaattggaataaattcatttgaccctcgaggagatatattttaatataaattataaatattattattttggtactacaacaaggattaaaaccttattatgatattttgacatgtcgaaacatgttgatttagttaaaattgtgtggaaaaatttttgtttatgatatatcgtgggctaattaaatttcggtgtgttgcaatgtatcatactcatttcagctttcttagctaaatattacttgtacttcaatgactagtacaaaacacccaaataccatgaccttgcttgttttgatattctctaataaaacccaacttggtttaaacatctctaaaatctgacttagttccaagattgaccaatcatctaccttcttgagatgcagcctcgtgattatacttcttgactcttcatctagtttctttagatgtagtcccatgatctttcaatgacgtacgacttctctccacatatcatttagaatcttcattagatacctggagactcctcctctatgcaacatcgattgaactcccttgaagtaaagtctcctcctttatcggtacaaaaggttttaatagacaagccgacttgcttctctaaaactcttgaaaagcttttgaaccgatcaaaacttgaatgaatatgtcaacaaggaaccatcttgttcttgttgactgattcaaactcctcttcacatctttcctccattaaagcacatctttagcctcttggctcattacttgttgaaagttgacgtctcttacttttaacataagcttggtggaacaatccataagttgtttcggactgcataacatagtcttcaaggtaccgcgactgacttatttgtcgacccgaccttctcagttgtggtactccttgaactacttcaccaacctcattatggtattttttagtgatatcctccatgccatcatcttcttcatgtacttctccaacatcttctctgtgaatcaactccaatatgatataaccgagcatgtcatgtccttgtagcttcagtagaaagtccatcgacaagtgatgttggataattcctaacttgaagagcaagatatctccttttagtagatggtagaagagatacaagaaaataaaatacaaataacgtcaagttggacataatttgtaactcttccttttcaaatcatgactaaactctaaatttagatgtaatttagcttagtggtaggtcagagcaaatggatttggtttatacgtttgcaattatgtaattccatggatgtagtttgaaagaccaaacttcattacaattatgtgtatcaatttattttgcttactcgtatctattttatcactagaatacaaagattttgctaactccaaatctattattttcagacaagcatatcctgtaaatcttcaatcatccaaaaagtgatgttgagtttagatccaactccaaaatgtatttatcttatttttaagtaaaaaactgaagaaatgagtttgcgaatcttttaaatagttattttgtataatgcatattagagaaagaacaaagataaatttttgtatcaaatatttaaactgagttaatggtggtttatgaagggtgttatagtgcattcactcccttatataatcgatatctctaatcccttggtaaaattaaattgttgtattgaatttttttatgaaagagtaaggtgagttgcaaattttgcttggcctcaaaaattcttctctctattttttcatttacatgtttgaagtgttactttttactttgctaagatatttcagtgttactttttaatctacatatttcattgttattttttaatttacatatatcaatgttatttttccactcagataaggtgaaatatttcagctaacttaaagtgattatgatcatcaacacctatttcatgtcaattttttgctaaaaaataaacaaattggtcataatgttcaaaaacttgacctcaccatcataatacttagtacttactggtcaaacaaacatatgttcagaacttttgtattgatggggaaggttacttttgtcgtaatgttacaaaaaaaaaattgttactgttgagaccattataaataatcatgtcatgttctttaattatcaactttgattgtcatttaattgtaaatttcgttagttaatctgtcctcttcttgtaattaaataaaaatttgtttcaataccaataaagttgtcctaaaaaaaaccacccctctaaatagggagtgagtgagagagagagtgatagtgagaacaaaaaaaaaacatcatttcttctcgcactcttcacctgctccaatg

SEQ ID NO: 32168 - DNA, 3003 bp, Unknown; identical to SEQ ID NO: 32167
  misc_feature (1)..( 3003): 2750-1469P.txt file - cDNA_ID_3049650; gDNA_ID_1621124; Annot_ID_172167

SEQ ID NO: 32169 - DNA, 3000 bp, Unknown; identical to SEQ ID NO: 7071
  misc_feature (1)..( 3000): 2750-1469P.txt file - cDNA_ID_3049654; gDNA_ID_1621125; Annot_ID_172267

SEQ ID NO: 32170 - DNA, 3000 bp, Unknown
  misc_feature (1)..( 3000): 2750-1469P.txt file - cDNA_ID_3049664; gDNA_ID_1621125; Annot_ID_172251
acagatgtccaaagagtcggtttagtattagagcatctgcaacatcagttacctataataacagaaacagtagccgaaaaaatcaagatgtgttgatccaaagatgatcactttcaagaaaataaatatatgaaatagtgtacataccatgaactcatctagacatagtaagattgcatcatgagctatctcttgggcaacaacttcaagtggatctgataaacccttgtgcttctgcaaacattatgaaccgaaatcaaacaacgtatctcaaaaggctaaagcttttcctactaaaatcaatagagaaacaatggaaactcaattatccatacttgcaagcggctatgaacactcaacatgaaatcatggaaatgtatcctctgcttcttccaagtacaaggcctaatgaaacaagagaattgtcatgaaaccgcaatgctcgaaaaaaaaggataagaatttgatcatacaaacttacagttgatcaaagaataagtccatcaacatggtttttcctgtacctacacctccataaaggtataatcctttgacgggtgagtaagaagtctgtggcatgagccgagaccaaaaccaacgacttctgtattacacaaaaacacagttgtgtgagactcaagttctcaatcctaaacagagaaggaaaggtgtcaaggctaagagaacagaacaatcaccttgaggatttatcagaagtattataccgatctaaacgacatgtatctactgaatccacaagctcatcatatagtctctgaagctctctcaatgcactaatctacaacatttcaaacacaaccttaagccgcaagtaacacgaatcacatttaatcttatagctcaaaagcttcaatgaagtaaaaaagagtggctattatttttatcatacttggcagatatcaccagtcatgagttcaccattactgattcttctctcatactcaacaagaggacctgttctattcacatctgtcatcattcaacaaatatcagcaaaccaataaacacgaactctgagattgatagaatttctttgcaaagagaaacaaaacctgagacggtgaccctagtagtagcaggatcagctgcttctactgcttctgctgataagcctctaaagatacttgaccttgaatacaaacttgaattatcagtgtttgtattcagcagagcttgattttgattgacaccgatcaaaagtttgcggcttttggagtagaaagttgaagaataacgttcttgattgttccttagagcccatctaattctactgagagatgataacctaatgattggtctcatctacgatcaatgcaaattcaattcagcagctgaaactttgagatacggaaacagagcaagaacaataacccaagaagaaaaacagaatctttgtatgagagaaatcggatccggataagaattagagcacaagaggaaaaagtgaatgagaatattgaaaagttaagtttgatgtttatatgtaatgacgatgataaatctggataagagagatagagagagacccaagaataaacggagatgtagtcaaataaggaagatagagaagaagatctttaactgttaaactcttaaaacagagagatagaggcgtgattaatgagttatttatcaactaagacacgttttttatttttttatttttatatactttcaattttttaaccaaaattgattgtgttgtacttctaattacatttgttaatgttgattgcatagttgttttccaggtcattagaggattgtatttgtcccttatttaagagagttgactatttttattcctatgaaaaaagtaatttcttgatatatctttaccctaatgatgtctacaagtcaaattacaaattttataaacaatttttaacatttgtaattatagtatagaatattggaaacggaagcttctcgatgttgcgtttgcgtacaggatactggtggacctagcgaatgtgtcccatacataggctaagcatattccaagtgggagagagatacgtgaatcagacatggtccttaaagatgatccaacggtctataatttttctagttttgttctcaatgggtaagttgaacaatggaccttaatgatgacatgttgcattgcgtatgattccacgtgtccacgtcatttcttacactgcaaacatgtctttttctgaccaacccctaacgctacttttctttgatacatctttgtttttgctataatggtgcttgttgacaaaataatactatgttgaattgacctaaaaccatactcagattgggatatccgagaaccattgtgtaagacgtgatgtttgatccaaatatgggctacactcaaatattggatataggcccacaagatatgatatcttcatttttttttgtctatagaacaacataaaacagggaaaaaaatttacactacttttgttcttgttccgttataaatatcgttttaccgattgatcatagaaatggtatactttttagtttttggaacagcggtaaaaggttttatgttgatgtcttctccgagcgccggtgattttcacacagaccttgttattggaaaactgaaataatgcagttttctgttgataggccttaagatgtcagattttatgggccttttaggttgttctggcccatttagatagaactgtttcagttttccaacaacaactgataaggatagacgaaagcccaaattaagaatctttgtcctaaacccaaggaaaagcgtaattacgacacgcagccaaacaaaacatttcctgcgtgaaaaaagtatttgagaaaagaggacgacaaaaaggtacaggtgtcaatatataattggattaaacaagcttagacacctaaaagttttctctcacaccatttgtgaagatccaaagcaaaagaagaattacagaaactgaaaaaactatcttcctcgtctctttgatcattctcttttaactcatg

SEQ ID NO: 32171 - DNA, 3003 bp, Unknown; identical to SEQ ID NO: 28968
  misc_feature (1)..( 3003): 2750-1469P.txt file - cDNA_ID_3049664; gDNA_ID_2926198; Annot_ID_201600

SEQ ID NO: 32172 - DNA, 3003 bp, Unknown
  misc_feature (1)..( 3003): 2750-1469P.txt file - cDNA_ID_3049668; gDNA_ID_1621125; Annot_ID_172249
acgattttgtcataagttttatcaaaccatgtgtgcgaataacatattatgaaagttaattagggcatttatgtaatatatatgtgaaacaaagtacacagatgcatgcatgatgtaaatggatcattgatataatgtgacataaaaaaacaaggtaattggttacaaagcatctcgatgcttacctcatcttgctcaacctaattcggcattttttgccactttcaactccgtacttctttatggtttgtgacattttaatgttgtcattcactaacattttcggtgaacacaagattcattttctttataaaaagccatacaaaatttccaataacacttgttttttgtagtcaagacctttttcttttccttattgactacgagtttgagtgcaccgttacgcacgatgcaaatgggcaatgcatgattgattatttattagtaagtacattttaacaaaaacttaaattcattttctagcatatttaccgaaaactttatcaaaaaacatacattcgaaacgtgggggtcatgaatgttcttgcagtaaagtaagatgtgattgaaagggaaaaagatagaaaagtaataaaataagataaaaagacaaagatgtaattattagacccttcaattaaattaatacgaaagtaggaggaggtgggccaaaataatgacaaagaaattagaaaggcgaaaaaggaaagaaatcaaaagtatagggacttatcataaataatgtaacaacacaacctcatcagggcaagtgtgtggattcacctatttcaggcatttgttacttgttgcaagtttctcttcgtatcactatctcatgttgtttcgttttgacatatttatacaataatttctttatatgcgaatcattaaatatcattatcattaaagttcaaatttaggtagggagatatcaaatatcaaatttcatcttatggtgaaatactgttttcattaagatggatttctttagagaagaagacaaaagaggaaagaggatgaagctattttagagtgcatcagtcctctagcctgtcactggtagtcctactacattacatcaatgttctccaatttgttttataaaatataaattatttttttacacataataaaattagaaaattattgaatgtaaacccaagtcgattttggtcaattcatcgtccatgtacaatatgcagatgtttctttttaaaaatctttatatataacttctatgtaaatttttttttaccccttctgtaccatttgctcttatcatagtttagcttaccgtttaaccaatccattttaatagaaataatagatctatcatgccggtaaaaattaccaaaaaatattgggtttagttgttaactaaggccctgtttgtttgatcagttagcatttgcattctaatgatccatttacatgattcatttgaatggtttatttgaatatgtttgtttgattatttgatattttttctaaatgatgcatttaaatgaatatttttttatttgattattttgtaattcatccacattttcatttagataaaaataactaaaatactcatgctttcactttgacaaatgaaagtattttacggttttggcgggaaaaatgattctacggttttggcgggaaaacaaaattttgcggttttagcgggaaaacaaaattttgcagttttagcgggaaaacataattttgcggttttggcgggaaaacatgattttacggttttgacggaaaaacatgattttgcggttttgacgggaaaaataattttacggttttggcgggaaaacatgattttacggttttggcgggaaaacatgattttgcggttttggcggaaaaaataattttacggttttcgcgggaaaacaaaattttgcggttttggcgggaaagtatgaatttaacgttttggcgagaaaaatgattttatggtttttgcggagaaaatgaatttacaattttgacgtaaaataatagtccgcgatttcatgattcttagaatgtttttttggtttaatatgtaattaaaatttttatattaaattagaaagttatagaaaattaacattattaaaagagggtatatttgtcatttgttgtttttgagtaaaccatctccattcaaatggtcctatcaagtctatccaaatgagtttcataattttgcttaatttttaaaaatcattgagatggatcatccaactgattcatccaaatggtctcttaaattgtcaaaagcaaacatcatttttcatctccatctaaataatccatctggatgaagaaacaaacaggccctaagtatcgtaattatataccgctttttttttttttgcgttttacatctattaaattttttgtactgttttaaaacttagtctaatttagttttaaaatttatatgtaatttagtctaatttagttttatatctattaatcggacttattaagactaaattagaaaaacatatatggttccaaatatacaaaaaaattggcattaagaagaacaaaaaagacaaagaaaaagagtgagagagagactggagtagaccagcatccaccatcccgggtccgacagtccgtatcagcatcccctgattcactctctacaaatgtcactctcttgcctctctctccctctcatttaaacgtttttcggcttaaaccttttctcagcaacaaactcatctcctctgagagagactgtttgtttgagaagaagacgaacgtaaagacttgtttactaaacccgagatttctttctttcttgttttcaaaataaaaaagcagagatctcttctccttcttcttctttttgctttgtttgcttttgctttctcttctttttctatgtgtgtttgtggtcactaccccgaaaaaaaataaagtaatgctgtctctcttctcttcaaaattattgttaacctctcgtaactaaaatcttccatggtagtagtaacaaagaagaccatg

SEQ ID NO: 32173 - DNA, 3003 bp, Unknown
  misc_feature (1)..( 3003): 2750-1469P.txt file - cDNA_ID_3049718; gDNA_ID_1621126; Annot_ID_56367
gctaatatttttgtcgtccgacttaaaactatataagcatcaatgttttggtgattacgaattagcaaaaacacaattttcaagaaggaaaaaaaaaatatttcacagtaatacattagacactcaatgacagctaactgtaaacaaaaatacaaaacacaaaacagtgtaatacaaaagaatttttatgtataaaatatgtcggttattaaatatccaaaaatgaaaatgtacttggatgttacagctatgagacaactactaagataaagaagaaaaaaaaaagggaagcttcgaaggtgggctttggctttgatacagacgtgcacagatcctttcccatgtaaaaactttgataattctgacgtgtaatttttccattggtaaaacatgttttgactttttacttacgtaagtggaaacgcattttgcaaaaaaatatcatatccctcgaaacacttatccattcacagaaacattctgatcctcgtttttagttaattcgtgtcgaactctcattggttcatatttacgagtccccacacctttagccgacgttggtgtctgtctggataaagaaagaataaataaaacgtttattttctataaaaatgttttgtttactattttcacaattttacgaaaataagagaaaatggaatttttttttttcgtgtggcggaaagtattgtagtattattttttctcttttgggggaatattatcaaagattcaagaatgtatttatttatggaaataaagaaggtgtttgctttttttgtgtgttcttttaaaatctttatataaaagaaaggtatctattgtttggttggtataaatacgcatgcgcattggctttttcgagtagaggaagagactagatagagtcgtgattttttttttcttttttaaattatcaaatggacgtgaaattatttattgaaaaataaacaaaaaaaaaaaaaaaagaagaagaaagagtctatcggatacgtcggatccaatctcccaatccgcattggctgtcgagacaacgtggatgtaaaataaggctttaagttcaagatcatttacctcaaagccactgagcctttaggttaataacgtcctaaattggctaatgtcttcttatgacatactcaaaatctatttttcttggtcgtcaaaattcaatactaatgatgtatatagatgcatggttcattcacaatatagtgtacttggttttttatgcctttccagtttcctataagtatgtatctatatagtatttgattttctaatccttcatataatcttaataaataatattgagttcaaacataagatatttctttatatatggatagagtctctagttgatcgtgtgtaggtgtttcatctttgaccagtggataacgatcagattatttaatttgaaacgttgtttccactttgtagagcttagactctatgtcactatgaaacgacttgtcaacaaagcattttgagccaaataatttaacatataacttggttaaaagacgagtttacgattattactattcttaaagttaaattatgtaatattttcagatttagttttcagtagtcacatgcttaagaacattaacatcagaatacaaccataatgattaatgagagatgtatgcaaaatatatcaactaatcatgttaaaaagggttgtaccattaattagtgatgcttatctgcttcattaagataataattaattttcaggaaaataaaactattgatttgaaattcttttacaaaatatcgatgaaattaaatcggcaataataaccaaaaatatacttttaattataaatgtgaaaaagggggacctcattatatccataaaaaccccagacaaataggtaagatacaagttgctaaatttaattaaaatcccaacaacaacaacaagattatctttaaaatacaatccatcctaaaccaaaaacaaaatttggtccaccatataaaaaaaaacatcatatgctaatatatagtttccatctaccaaactcaaaataaaagataagaagataagaagataaaaggacattaacgtaattttaatcacagcgtcccaagaaactaatccaaaacattatcgcgataaaaccgtacagagcaaaaagctactaataatattattattgaaataaaaatagatagaaaaaatagatcgttagaaaacgtgtatatatatatatatctgtgtattttgcaatatatcgtttttttttcttcgttatcgcattaatctctctctctgtatcttctcttgagtggagcgaatatccaaaagagttccgagtttctttcatccttcacgagcttatactttttcttctccattcgtttgtttttaacgatcaaaaacaacggcgaaggttagtctccggcggtttcttcgttgagatgtgacgacttttttttttgaacgtttataaagattacatattcatgtatttagatttcttttgttatgttaactgtttcattgatgttcgagttaattttaatttgactcaaacacggtaatttttttttaatcttgatctgttttgttacgtaatttttgggttgattttagcctgaaatgatgattttttttctttctagcttatgtttttcgtgaatcaatctttttcaatataaagattagtattttgttgaaattcattttttatttgattggctatgaggaatcagtttcttgaaatggaaatggtgatttgatttgatatgttcacaatatgaatgaagaagattagggttaatttatatatatgaaacaagaaagtttgtttatttaaggtaattgatatatttgttttgttgttattgccatttttaaggtattggaaataagacagaagctgttagctctgtttctccatggtgtcaagatcttgtgctaattttctagacttatcatcttgggaccttttagattttcctcaaactccacgaactcttccacgcgtcatg

SEQ ID NO: 32174 - DNA, 3003 bp, Unknown
  misc_feature (1)..( 3003): 2750-1469P.txt file - cDNA_ID_3049718; gDNA_ID_1621126; Annot_ID_172319
tacaaatgtagtctggttggtataagccttgttatgtatgtacgattgatgtcgtagtcaatgtagttgataccgtacaattcgatctaagctaatatttttgtcgtccgacttaaaactatataagcatcaatgttttggtgattacgaattagcaaaaacacaattttcaagaaggaaaaaaaaaatatttcacagtaatacattagacactcaatgacagctaactgtaaacaaaaatacaaaacacaaaacagtgtaatacaaaagaatttttatgtataaaatatgtcggttattaaatatccaaaaatgaaaatgtacttggatgttacagctatgagacaactactaagataaagaagaaaaaaaaaagggaagcttcgaaggtgggctttggctttgatacagacgtgcacagatcctttcccatgtaaaaactttgataattctgacgtgtaatttttccattggtaaaacatgttttgactttttacttacgtaagtggaaacgcattttgcaaaaaaatatcatatccctcgaaacacttatccattcacagaaacattctgatcctcgtttttagttaattcgtgtcgaactctcattggttcatatttacgagtccccacacctttagccgacgttggtgtctgtctggataaagaaagaataaataaaacgtttattttctataaaaatgttttgtttactattttcacaattttacgaaaataagagaaaatggaatttttttttttcgtgtggcggaaagtattgtagtattattttttctcttttgggggaatattatcaaagattcaagaatgtatttatttatggaaataaagaaggtgtttgctttttttgtgtgttcttttaaaatctttatataaaagaaaggtatctattgtttggttggtataaatacgcatgcgcattggctttttcgagtagaggaagagactagatagagtcgtgattttttttttcttttttaaattatcaaatggacgtgaaattatttattgaaaaataaacaaaaaaaaaaaaaaaagaagaagaaagagtctatcggatacgtcggatccaatctcccaatccgcattggctgtcgagacaacgtggatgtaaaataaggctttaagttcaagatcatttacctcaaagccactgagcctttaggttaataacgtcctaaattggctaatgtcttcttatgacatactcaaaatctatttttcttggtcgtcaaaattcaatactaatgatgtatatagatgcatggttcattcacaatatagtgtacttggttttttatgcctttccagtttcctataagtatgtatctatatagtatttgattttctaatccttcatataatcttaataaataatattgagttcaaacataagatatttctttatatatggatagagtctctagttgatcgtgtgtaggtgtttcatctttgaccagtggataacgatcagattatttaatttgaaacgttgtttccactttgtagagcttagactctatgtcactatgaaacgacttgtcaacaaagcattttgagccaaataatttaacatataacttggttaaaagacgagtttacgattattactattcttaaagttaaattatgtaatattttcagatttagttttcagtagtcacatgcttaagaacattaacatcagaatacaaccataatgattaatgagagatgtatgcaaaatatatcaactaatcatgttaaaaagggttgtaccattaattagtgatgcttatctgcttcattaagataataattaattttcaggaaaataaaactattgatttgaaattcttttacaaaatatcgatgaaattaaatcggcaataataaccaaaaatatacttttaattataaatgtgaaaaagggggacctcattatatccataaaaaccccagacaaataggtaagatacaagttgctaaatttaattaaaatcccaacaacaacaacaagattatctttaaaatacaatccatcctaaaccaaaaacaaaatttggtccaccatataaaaaaaaacatcatatgctaatatatagtttccatctaccaaactcaaaataaaagataagaagataagaagataaaaggacattaacgtaattttaatcacagcgtcccaagaaactaatccaaaacattatcgcgataaaaccgtacagagcaaaaagctactaataatattattattgaaataaaaatagatagaaaaaatagatcgttagaaaacgtgtatatatatatatatctgtgtattttgcaatatatcgtttttttttcttcgttatcgcattaatctctctctctgtatcttctcttgagtggagcgaatatccaaaagagttccgagtttctttcatccttcacgagcttatactttttcttctccattcgtttgtttttaacgatcaaaaacaacggcgaaggttagtctccggcggtttcttcgttgagatgtgacgacttttttttttgaacgtttataaagattacatattcatgtatttagatttcttttgttatgttaactgtttcattgatgttcgagttaattttaatttgactcaaacacggtaatttttttttaatcttgatctgttttgttacgtaatttttgggttgattttagcctgaaatgatgattttttttctttctagcttatgtttttcgtgaatcaatctttttcaatataaagattagtattttgttgaaattcattttttatttgattggctatgaggaatcagtttcttgaaatggaaatggtgatttgatttgatatgttcacaatatgaatgaagaagattagggttaatttatatatatgaaacaagaaagtttgtttatttaaggtaattgatatatttgttttgttgttattgccatttttaaggtattggaaataagacagaagctgttagctctgtttctccatg

SEQ ID NO: 32175 - DNA, 3003 bp, Unknown; identical to SEQ ID NO: 18299
  misc_feature (1)..( 3003): 2750-1469P.txt file - cDNA_ID_3049724; gDNA_ID_1621126; Annot_ID_172314

SEQ ID NO: 32176 - DNA, 3003 bp, Unknown; identical to SEQ ID NO: 18300
  misc_feature (1)..( 3003): 2750-1469P.txt file - cDNA_ID_3049728; gDNA_ID_1621126; Annot_ID_172313

SEQ ID NO: 32177 - DNA, 3003 bp, Unknown
  misc_feature (1)..( 3003): 2750-1469P.txt file - cDNA_ID_3049743; gDNA_ID_1621126; Annot_ID_172303
ttcgcaagtgtaaacgcagataattcaccgataaccgcagatgaagcattcgaagacggtcagatccgaccggtttatcctctgtttaaccggaatattttcttcgatgatccagaggaaaaaactttacgttcacctctcaagaaactcttcgttgaatccacaaccacagaagaagaagaagaagagtcagatacggtgggtccatattgttcatggacaaatcgtacggtggagcaagcatcaccagagacttgtcggaaaagtaactcaacagggttctcaaagctatggagatttagagatcttgttttgagaagtaacagtgatggaaaagatgcgtttgtgtttttaagcaacggctcttcatctacatcgtcgacgtcgtctacggcggcgagattgagtggtgtggtgaagtcgtcggagaaagggaaagagaaaacgaagacggataagaagaaggataagatgagaacgaaatcggcacatgagaaattgtatatgagaaacagagcaatgagagaagaagggaaacgaagatcgtatcttccgtataaacatgttgggttcttcactaatgttaatggtttaaccagaaatgttcatccctattgattaaaccgatctgtcgtaccaaaatctctaccgacaaatctttgccttttgtatatatctaaccttttttttggtttctgtgtattataaaaccttctttttgtaagtaaaagtgaaactttacttattaacttttcgtttgtatcatttgattagttttttttcttctttgatgtaaagtattttttgattttgaaagtagtagagaaaagattcatcgatcttttttggaatttaagtttgtcaataatatattttggtatatcaaaatttgtccgcacgttaatttttttattttttttattttgaaagtaggaattaattttttactggaataaagtaaaacttgttcttttaggcaatatattatctctatctaattgattaacgatggccgcagatatgtaaacacacatttttagagatggctataaatgatttcctgaggcatttatttttgatagcttagtttttacaacttctgtttaccgacactattaagttaggtatcaaattatttaaacatagtaaaagtacaaacctgtattggtagtgacaagtgacaacacattacacattatacatcacaccaaactcaatatgcctcctaatacaagagtacatacagctatagctttaaaagtgcttatattatatgtaagagggccagataaatatttgggccaaagtaagaatgataggcctataattcgggtccaggtgactaacaccattcagaaatagtcatgccccattcatcatcgaaaggtatttgaagtcaagtgagagtttatgctgatgaatggggcatgaattgaaacatcaagcccaagaaaaagtactggttgtgaaaattagcaattttggttgttttaaatctaatagcccattacatgaaaatttgtagtgtcgctaaagttatctttggtttgggttgttttaaatctaatagtccattacatgaatgagaggtgcaacttgcaagccctattaacggctagtcatgaaattacaacattaccataaatttatgctatcctgatctgaatttatatagtctaattttcgaagcgaaacagatttcaggtcttggataataatttcatcactacttcgttcatacattagtttagatccaaaagatatacaaaatttatataattagtagaactgttgacaaataattattaaaagtaataaatggtctgttatagaaatttgattttaacttttgttatattagtgaatttactttaaatagtagaacaagttataataaatatgaaagcatataaaaagaataaaatctcatgagattatcttctagcatagttttagtgttttctcataatgtcaataaatatttacaggtcttattatgatttttactaaataaacagcagaaacaaataaaaagaaaaaacatggaagaagaagaagaagaagaagtccagcttcactcacctttcgctttctctatcccataacagaaacccccacattgctcgaacggtcgtcataattccttgaaacctcgaaaatccaaaaacccatatccaatcttcttcccatataaattaagatttttatttatttatttgtttacttatttcaattcccaaaatcctctgcctcatcatcttcaaactgttaccacgtccatagggttgtcgaagagctaggaagagccttaccaagagcttcttcttcccctaacatttaggtatttcattcgtaatttatcttctttttaatttaattattgtcgattaccaaaacccttttttatactaaaaaactgaatccatttttccacactaaaaggagaacacaaaaacttcatttcaagttcatgtttgaaaaactaagaagtgtatggtttgtttgttgacaattaatgagcatttttttcccaaaatacgttagaacttaatatgatagaataaaacttgaattattcatggcaatgagtatagtcatatacaataatggttgatggaaatgaaccttacggtccaatgaaaagccagcttgcgttacttgagcatttttaagccccaaaaaagtttgaaaatatgtataaaggaatattttatatatggaactaaagagtcagagaaccattccggatttagatcatccatctattttaatttgttgtgattcagccatcgcattattagtcttcagaatataataaaattataattcagttatgaatttaataaattgaatgccgacgtgagtagttaataatgtagtcgattgtaagtaacaatgagaaaactcctatactttatttttagatgtatttgtaataataagattacgggtttggactggacaggttggtaggagaagcaaaggaagagatcatttataatg

SEQ ID NO: 32178 - DNA, 3000 bp, Unknown; identical to SEQ ID NO: 7101
  misc_feature (1)..( 3000): 2750-1469P.txt file - cDNA_ID_3049760; gDNA_ID_1621127; Annot_ID_172360

SEQ ID NO: 32179 - DNA, 3000 bp, Unknown; identical to SEQ ID NO: 7103
  misc_feature (1)..( 3000): 2750-1469P.txt file - cDNA_ID_3049763; gDNA_ID_1621127; Annot_ID_172356

SEQ ID NO: 32180 - DNA, 3000 bp, Unknown; identical to SEQ ID NO: 7098
  misc_feature (1)..( 3000): 2750-1469P.txt file - cDNA_ID_3049777; gDNA_ID_1621127; Annot_ID_56380

SEQ ID NO: 32181 - DNA, 3000 bp, Unknown; identical to SEQ ID NO: 7098
  misc_feature (1)..( 3000): 2750-1469P.txt file - cDNA_ID_3049777; gDNA_ID_1621127; Annot_ID_172341

SEQ ID NO: 32182 - DNA, 3000 bp, Unknown
  misc_feature (1)..( 3000): 2750-1469P.txt file - cDNA_ID_3049834; gDNA_ID_1621128; Annot_ID_172382
cacacgcctaaaaacacttagtcatagacacacgcctaaaaacacttagtcacacgccaaaaaaaaaaaacacttagtcataaagaactcacgcctaagaaaaacatacttggtaaaacactatatatattcaaccaaatcactttagtaacaattagtcattaccttgcgtctaaaaacgcactttacaatttacactaaatcaattgaacaaattcactttagttaacaattagtcgaaccacttagtaaacacttagtcaatatccatttaggggcgacacatttaaaatttttttaactcaggcacttattctttttactcgtaacatttgaatacctaatcgtaccacttggtaaacacaaaatcaatattcatttaggggaaaacattattttcctactaaacgaaacttagtggaaggcttagaaatatgataaacaccctttggaagaaatgtaacgctagtcacttccaagtccactttcataacatgttatagtacttaataaggcaacaaattattagtccgaccactttaatcaaaacacgagtgatttaaactcaagtagtcaaacaaattagtccgaacattttagtcaaaacacaagtcgaaacattttaactgaagtacatttcagcattaagatcgtaactgtagcaaagaaaataaacaccttaatcgtaataacaagttgcaactgcaaacaataaacacattcgtcaaaatactattgtcgtaccacttttaaatcatttcatttgattatcagtcgaagcgctttgctcaatgtagtcgaaatgggagcatgcgttcaagcagtcaaaattcactccaaatcgtagcactccagtcgtaacacctccgtcgaaagaaagtgaagggtcgaaaaagggaagctatttttagaaacactttgaagtaaatatgtaatgtcgttgtttcttctttcatttccgttgtagactttcgttctcctcctttactgttttgttatgttatggcctgtctttctgtagatttttgttaagaaacctttcaataaattcgatttcttgtgttttaggttacaactctcgacccttatatatggctgatgagcttcaaaatagagtaggaccctaatacacgttttagaccgttattaacttaccagccaatttagcttgatctttttccgtttttgtattctttgtaatttttgacgcaacttcaatatttcactctttgaattatgttgttcattagttgaactattttacatagataaaattaataatattttaagatagaaaaatttatagcaaataatttatgtgtccaaacctagaaacattagataaaatgaaatagaatgagtaataaacaaaaacccaaaacaagaaaactatgttagttttagaattgaactaacacgttaacaaactttattttaaaatcaagaaactttttttttaaaatcactgtctttaaaaatcaacagattttatttgaacttatcactgtctttgtcaaaaaaaattgatgtaaactttattttaaagtcaacaaacttttttgtaactttaaaaacaaaatatatttttcttttaaccaaacagtgtattcgcatggaaaattattctaattatacaaaatactatataggaacggaggagaacacaatttaatggtcagatctagatctcgtcggtcatccacctttcagttttcacgagtgtgtcgaacgaacgatattaattaaaaactaatcaataaactgaataagtacaagttgcatggttaatgaagtaaatcaccgatttgaagtcattaaaccgaccgacacaatgaataaaaacgcgttcacggattttattccgtgttgatgggcagtgacactgacttctcccattaggcaactgtaattttttctcgtcactatttttcatagcaaatctaaaataagttgcaagaaattaatttgatatacaaaaaaaaagaaagataaacaccatgtgggggttgttgttaatggtggaattgaaaacgcattaagtggaaatctaaatacaaagatcatgaaaaatctaataaaatatttgtaagttgtaacaatctatatgtatatctttgctccaaatattaattactagacaaataaaaataagggaaacaaaaagatttaacagcaagtcgacagtgtggacatggaaagagacctttacaacgaaaacaatgtacttatcttccaattataggaataaacatttcgccagtgaaaaaaggtctcattccttccttacttgtggagatggagatctgaatctctaaagtttcgatttttatttattcacttttatgcccaaaaagaaaaatcgttactttaaagccaaaaagaagaatacacaaacttcattcactctctcccattctcggatctctctcagtgcacagtggttgtcactcttctcctttggtcggtgagttttcaatcttttttcctttcttctgcgattttcattcgttgagattcgtattttgcttccttctcattctctgagatattcgttaatcaatgagcggtttttttacttttcctgggaaattgagtgagacttttcattaaaagctctcccgataaaatggaaactctactctcagatctactactactttctatttaattgcataaagatccaatctttgacaaaaaaaataattgtcggtggccatttttataacacttgtgttacttacttggtttacacttaacttgggttctgaatcaagagtgagtggtttctgacccaataaacacggatctgactctaccaagtctgaatttatcatgttctgtttattttaagtgccagtggctttttaccaaactctatgcttaaagtcatattctttataagtgttctgttcttgatttctgcagaaactctttcttggaaagagcattttgttatcaagactctgaagagctcttttgggaggatagtaaggttggatg

SEQ ID NO: 32183 - DNA, 3003 bp, Unknown
  misc_feature (1)..( 3003): 2750-1469P.txt file - cDNA_ID_3049838; gDNA_ID_1621128; Annot_ID_172374
cattagttaaactatgtatgttcgttcattctttctgtctgagaaaagaaactcgaaagtataattcttacccttttttttgtcattcttttcttttattttttctgattacaaattcttttaaagtataaggtaggacaacgatgtacgggccattctatttgcacgtacgatagatgtgttctttatgaacaaaaattagtcatagccgaaaagtagtattctcataaaaagcatatttagtattctcatttctcaacaattaacatagccgaaaaaagaaccttatatgaacaaatcattggtcatactatattttcattttttattaaaaaaaattagacttccgatttatataatattgtctgagagtttggtattataatatatttgtgatagctctgcaaaacttaaatcatctcgtttggaaaatgcgtgtgtgtaacactgcactcaaaggccaaagcttttgccgaagatgctcatatatatctccaaagtatcgattcatcaaatcagctttgatctcaagctgtttctttttccttttgccaccaagttgctatttttttctttctcttcattctgttctcgttaaatgatttcttgcaacctcattaatttccaattcttaaacgtatgaccatgtttattttatcacatactgtatataagtttaaaaaattgcctgagtggtgatatgtattttatataatacatatagtatatgtacatattgttaaacaatttgaatgaaataaaattttggataaatatcaggagaaaaaaaacttagatagtcatgctaatgatttcaaataatgcttcatagagttggggaccaaatagaatgttgataagtgatgtgatgatgtcccgttcccaaccatgaccaaaacaaataaactaaaaaaagctagaggagaacgaaaaaaaaatcgtcgtaattacaatagtaattaattaatgcgtatagtcaatgaaagttgtttttagaagttttgaagtgaagggatattttgaacttagctgagtaatagtccatgaaagttagattattcacctagctgacattttttcatagtttgggaattctttatacgaaaaaaaaagataaaataaaggtaagaccatgttcgtaaaaaattgtagtttcatatatggtgtttttttgttaaagtttcatatatggtgttgatgactatataatctataaatcacattggtgtacctttatttacgttatctaagtcgatatatattccgatctataaaagtatcttttcatttgtatgatcagttcattatttggttatggttgtaaggaaaacaacatatatagaaaacgacaactcgaagcatggtatgctaaaactatcactgtaacgaatttttatcgagagaaaccatcttgatatgaaatttgtagtttccgaatttaactaagcatcacgtaacattttttttcccctcgaaatttccataaaataaatacatttgacttagtacgatctttatctcttattttcaaaattttcactgacctggtctctttttctccttctcttcttttccacttcttaccagcatttaaaaaacccaaccaagtaaataaatagaaaatgaaaaattaaattgctaaaaataaaatagaaaagccaaattctataaatagaaggcttaatttagcacaagtttcagtcagaaagtcaaaaatcatcgcgacaaaaagaattgggtcaaactcctttaccggtcaaccaagtcatcacttaggtgggactattttctccacgtcaactaattattccaatcgttacacgccacgtcacgagaataagaaactccaggaccagcgcgtttaacgtcaattgccacgctggcatttttcttattacattttgcatacatacacatatagatacacatttaaaccataagtataaataaattggttacgataacttccataaccttcattagtttctccagaagaaacctgtaagaaatttctttctcttctctgtctttaaacagatttttattctgttctgtttgattaattattatctcttttgttccagtattttaattctttagattttcttgttcagacatcactagctccactaccacattcaagaagcctccttcaataatctttcccttttcctggggaattttctctctggattcattcccggaaaatcattcacaatttggagaccataaagaacacataaacatgtcgcaggacgtaatttcgtctcatgagcagctctccatggtacgtaataatccgtgcaatgtttattgtttgtcctcgaatctgtttttatgcccttgaatggtttctcttctttgggtttcctcttttctatcatacattgcttaaatgattaaaagcatgaacctttttttcctgaaaattttgcatgtatatatctatgatttattcgcaaggaataaaattattttctgaaatctttgtattttgtaggtaacatcgttttcttaattttcttagttattcgattttatcttttgtcaaattgcttcattccttttactttcttttctgtttctggttattctagatacaattcagttcatattccaaaagtctgaaacgataattagtaaagcaaactttttagtgctaactcttttgtacggtgttcatacgtagttacgtaccttctcgctagccaaccacaaatcgtcacaatacttaatcagatagaatagaacagtttatcagaattcataagatgctacatctcttcttttagtaattccagtaattaaaatttgaacttttatttatactttcgaatagaatcacacgaatttttattagaaatatataatgagtgtatcaaaagcaatgattcttgctcttacctcggcctttatttgttgttaaaaaatcagatgttagtttaaattagggaacgttttggttctaaagaaacgcaagaatccaaaaactttcctgttatg

SEQ ID NO: 32184 - DNA, 3000 bp, Unknown; identical to SEQ ID NO: 7110
  misc_feature (1)..( 3000): 2750-1469P.txt file - cDNA_ID_3049843; gDNA_ID_1621128; Annot_ID_172372

SEQ ID NO: 32185 - DNA, 3000 bp, Unknown; identical to SEQ ID NO: 5042
  misc_feature (1)..( 3000): 2750-1469P.txt file - cDNA_ID_3049857; gDNA_ID_1621129; Annot_ID_172437

SEQ ID NO: 32186 - DNA, 3003 bp, Unknown
  misc_feature (1)..( 3003): 2750-1469P.txt file - cDNA_ID_3049861; gDNA_ID_1621129; Annot_ID_172434
ggagaagaagaagaagaagaagcttcgagttctttggagggagagggacagataccggttatttcctctcgttaaccgaataccggtttaatactattgtcccggtttgatctcaatagctatcatgagcctcgattgtgtgtatatgagagagtattatgggcccaaatttaacacacatgagatttttttttttaaagtgaaatttctgagtcgaataataaattccagtgacagtgagactgagacaccggagtctaaaggaaaggtgagagcgggggacaatgtaagaaaaaggtcggtgagaaataaaacgacaagtgatagaacttttcttagtaccatagttgaatttaaggtggtgggccattcaatgggcctaacttggcccgtacaatctgtaacatcatttagtattgaattcacattcaccaatcaccaatcaccttaccaaaatagtgcgataggaattaaattgtgtttggcttggtatttgttaaatcatcaatagacaataatagtttgataagacttacaacaactgaatatttataactcgcaattagccctgttaacattccaggcagtgcctgcgtttaagcaacaatacagaggcttcttttaggtcatatgtcaacacctaaaacaaatagataacatgtgagagaaatgtgttaggtatattacactatgattagttcttttgttaaaggaccacgcaccactatcattatccacgttacacacggtttgaacttaaagaagatcgcatgttccactatcttttttgttgttgtttgtcctcctcaattgaacaatttgcatacgtaagcgacatttggttcatatacagtgttcatgaactgagcaacatatatactgtttttttttcatctaagaaaagctacctttttgaaatttgtatttatgcaaacgaaagataatggaaagtgagctggcatggaccgaaagtggtacaaaaaaagtttgaacaaagccattactataccaaacaaacgcaaatgacaaaaactacgcagcattaacaactatattacaattgtcattatttatgtataacattataatacactatcaaggcttctagattgttacatcatctccttaattcttccaagttacatcatcatatatagttgaaattaatttctattattcgtgagaatataagttgattggaagaaggaagattcagtctatatatatatttgaaatactatatgtggaagaacgtagaattccctattgcgaactagaaatgtgttgacgtaccgtgtataaccaaatgtaatatattaatcaaaggacatattaacgtacacattttttactgcatagtcagcaataattgacatttaatcatacatgtattagaaaatggtatgccacgtaagacgcattaccttgcatgaatggcatgtgtagtaagtcgtcatccgcatattgtccaaacaaacaaacaaataaacacatacgggcaagaattaaaaaaaaatcatcttttgttggtcttatatagttgcttatctgaatagtctcacactctctcacttgagagcaagagtgcatgtaattatactatagtattagtacatacgaacaatttggtggtgagtataagtttggatctttggactatatataaagtcattaatttcatactcttacgctattcttttatatcttttaatcaagttgacacatttgtctcattgttttggtgcagagatgatagattggttttctttcttttatatatatgtattgaaacgataacgtgtatgtctccactttctacaaatgaattttaaaaagctcaatgtgtatacataggaattgataaaccagtgattatatagtattttgtaatatactgacacctatacagttttattttagtaatatttgtagccttgtagacaatacataatactcatcacgtcacgtgtagaatattccatggaccgtataaggttcctcctccattgtatcccacaattaattagacacagcttagattagcaaaatggtaatttctttcgtttgagttatgattggcgatttcgtataaaacgaatcgagagaataaaaacgtaaaagaatcggaatatgattcattgcttaccatggttaagtttaatgataagtgcttttattgataacatatatggtcaaataatacaataatttgatcataaagagtaaagacaattgaaaaatgaaatcaccaaaaaagtcagatcacatacagacacattgacgcatcgacgtcaagcatcgtgagcgcacaaagagcttacggctttattattaacacacacactaagcaaaacagtaagtccacgagaaagcatccaaaaagcccaaaggaaccacctttattttttattttattttaggcaaaggaagctcctttattaaattcccaatcttcttccactactttgcacaatctttaatcgatccaaccaataaattttgcattttttttcgttggcgaatgaaggattagagagaaacagaagaaattgttaatttttttcttgttgattttaattaaagagaagagagatctctcttctcgattgctctcaagaacccaagtgacgtctggtttcagctgatttgtttcttctcattctctatcttcttctctgggaaatatcgattttgatctattaagagctggtgagagccaaagtttcctttttgtttgtttgtttgtttgtttgttgtttgtatttttgtatctctgtgatcgcttctacgtgttgggtcatgcagagaaactcattttgttttgatttgcaatgtgtcaattccactttgaaatataagattcatcgcctctctctcctttgttttttttcttcttctgcagctacgagctttgggatgtggtgagatgcttgttctatctcgaacaatccgccggttgttgattttaaacaaactctctatcacaaatctttcccgatcatg

SEQ ID NO: 32187 - DNA, 3000 bp, Unknown; identical to SEQ ID NO: 7147
  misc_feature (1)..( 3000): 2750-1469P.txt file - cDNA_ID_3049865; gDNA_ID_1621129; Annot_ID_172433

SEQ ID NO: 32188 - DNA, 3003 bp, Unknown; identical to SEQ ID NO: 17129
  misc_feature (1)..( 3003): 2750-1469P.txt file - cDNA_ID_3049869; gDNA_ID_1621129; Annot_ID_172432

SEQ ID NO: 32189 - DNA, 3000 bp, Unknown; identical to SEQ ID NO: 7144
  misc_feature (1)..( 3000): 2750-1469P.txt file - cDNA_ID_3049877; gDNA_ID_1621129; Annot_ID_172424

SEQ ID NO: 32190 - DNA, 3000 bp, Unknown; identical to SEQ ID NO: 7162
  misc_feature (1)..( 3000): 2750-1469P.txt file - cDNA_ID_3049885; gDNA_ID_1621130; Annot_ID_172449

SEQ ID NO: 32191 - DNA, 2838 bp, Unknown; identical to SEQ ID NO: 9511
  misc_feature (1)..( 2838): 2750-1469P.txt file - cDNA_ID_3049893; gDNA_ID_1972139; Annot_ID_179206

SEQ ID NO: 32192 - DNA, 3003 bp, Unknown; identical to SEQ ID NO: 17091
  misc_feature (1)..( 3003): 2750-1469P.txt file - cDNA_ID_3049893; gDNA_ID_1621130; Annot_ID_172480

SEQ ID NO: 32193 - DNA, 3003 bp, Unknown; identical to SEQ ID NO: 18333
  misc_feature (1)..( 3003): 2750-1469P.txt file - cDNA_ID_3049897; gDNA_ID_1621130; Annot_ID_172478

SEQ ID NO: 32194 - DNA, 3003 bp, Unknown; identical to SEQ ID NO: 18334
  misc_feature (1)..( 3003): 2750-1469P.txt file - cDNA_ID_3049917; gDNA_ID_1621130; Annot_ID_172467

SEQ ID NO: 32195 - DNA, 3000 bp, Unknown; identical to SEQ ID NO: 7198
  misc_feature (1)..( 3000): 2750-1469P.txt file - cDNA_ID_3049956; gDNA_ID_1621131; Annot_ID_172508

SEQ ID NO: 32196 - DNA, 3000 bp, Unknown; identical to SEQ ID NO: 7191
  misc_feature (1)..( 3000): 2750-1469P.txt file - cDNA_ID_3049964; gDNA_ID_1621131; Annot_ID_172501

SEQ ID NO: 32197 - DNA, 3003 bp, Unknown; identical to SEQ ID NO: 18341
  misc_feature (1)..( 3003): 2750-1469P.txt file - cDNA_ID_3049968; gDNA_ID_1621131; Annot_ID_172497

SEQ ID NO: 32198 - DNA, 3000 bp, Unknown; identical to SEQ ID NO: 7229
  misc_feature (1)..( 3000): 2750-1469P.txt file - cDNA_ID_3050027; gDNA_ID_1621133; Annot_ID_172570

SEQ ID NO: 32199 - DNA, 3000 bp, Unknown; identical to SEQ ID NO: 7218
  misc_feature (1)..( 3000): 2750-1469P.txt file - cDNA_ID_3050035; gDNA_ID_1621133; Annot_ID_172566

SEQ ID NO: 32200 - DNA, 3000 bp, Unknown; identical to SEQ ID NO: 7219
  misc_feature (1)..( 3000): 2750-1469P.txt file - cDNA_ID_3050039; gDNA_ID_1621133; Annot_ID_172564

SEQ ID NO: 32201 - DNA, 3003 bp, Unknown
  misc_feature (1)..( 3003): 2750-1469P.txt file - cDNA_ID_3050047; gDNA_ID_1621133; Annot_ID_172560
ttgtagctccctgttcttgtagcgtttgtcttgtagaaccttcttgatggcaacaacctccccagtttccctacatttagcctaccaaaaggaaacataaatgtgcaggggaatggagccaaatcaatagaacgaacatcatgggtcttatgttaaattagctcacttggaaaaccatgccaaaggaaccagtaccaacaacatgttctgatatgtaactgactgtctgccaatccaaaaaaaatctatatgagaaacagttagataaactacattaccaactaacacatacaattatccataaccatccaacctgtcttgattgaccatttcgaccacggagtgtggttctaatcacatgaccaggctcagcaccagccccatcaataatatctggttcactatcctgcaacgtaacgaaaacctcagacactgtaaccaactccataacatatataagctcaggataaagaagtgaagctaaaaaacagttgaataaacatgaaaaaaagaagaagcaatgcaagacttactctctcatcatcggtctctactttgtcccttatcctcgtctcagccaaatctctggtcaaccaatcgacagaactagaagagctctttaaacctttggcagatctcgaagtgcctactccatttcccagtccagaggatgccatgatatatattcagaagataacacgtactactagtaattgatagcatcataaacccatggtgatttcttggtgtcccatcccatcaaagagccgatcttcctagtagaatttgtaggcccatttgcattaaataaggtgtgttattatatctcaagtatcttgatcattagctaaatcatgaacacatacaaaaaaaagtaaacttgtgtaagcactgatgaactttgaactagtggtgaattgatacactgtaaaacctagcccaatagagacagatcagatctactgccgactagaattgatttgaaatcgacaaggtttggtttgaaaactgaaattctatagccaaaagcagctcagaaaatcagcaaaacagttactagtacccagaagaaccctagttcaacaacaactcagaaaaaaagcacattgagagaataaagagcgaaactttggaaaagattcgcagtgatatgattaggtagaagagtaaaataaaaatgatcatcaccttgagctgtcgtgaagaagaactgaaaccaaagtcaagcatttgacgattgtcttttcttcttctttcttcaattgaagagcttcacataaatatataaaatagaatatttctcggtgaatgatcggattgagaaaaaagctaaacctttagattcttcaagcgttaattttgttttcccaacttcttcacaccttctttgtcgatttctatcgttttgaatcaaacgagaatatgagacgacagctcatcattataagcatcatatattaatctttttcttatatttatgtttctataagatttttatttatgcttagttatatattttttccttcaaaaaattaattagaccttgttaaaatttcatactatactttttaatggatgtccccaaatatcataacaactggaactcaattttcaaacctcagcctacctaatttttgtaaccggatattcaaactttttggtgtacaacttatttcaactatagtggaaaatttacaaaagaaaacaacattttgtgattactagaaatcgcttcaaatgtatgtttttgtcaacacattcgagcctccactccaaaatgcatctatatgggatttatattctaatatgtgccttttgatttttgagatacgataaaacaacaatatattcttggaattttctagtgaattaaaatactgttgtagggcaaaaaataatttcaaaaaaataaagccactttcgtatttgctggttattatatagtaaaagtcgcctttacttgtcgacagttaggtaaggcttaacacatcacacttctttttgtgtgtgtggcgatggagattttgtatcgggttttattagtgatattaaagcttaaggatgtattttttttatctgcaattggttttatcataatataagccttctaaatacgaaaagattgatcaaatacattcccgttttcacaaaagtgaagttaattatttttgctttggtgagctctctcgaaaatacacgttaggcatgcacattgctttggttactactactctctggtctccgcgtgatcttatttactaattagaataagcaaaaaagggctaaatgcaataaagtcgtaagtaggtccaaagtgtactgctcatcagcctacacaaatagggagtggtggtcttataacctaaaaaggctaaagttgctttcttttgcttaataaagtatcgtagatatattacccatttaacaatgattttagtgttgaccaaacaacaacaaaacaatgatttacgatagtactgtgtgtatgtagttggattggaagctaaatgtgttaggcttttgattgccattggcctctccggcccggtcctgagcccgtgaatgatgaggataatactgacaagtccgcattttttttattaaacaaacattcaaattttgataatgatcgtttttttatgttaaaaggctttcatgataatgaacgtacttattaacattacattatgtttgtaatgcatatttcacaatatgtataattaaatttagcaatttaaaattttctggtggcaaagttgtggataattctagctacatccctcctatttacacacgtggttcacttcttctgcctcaatcattttgttcggcaatttttcaacgccaaacgctttttgtttaaaacgccaacgcaaaaccagcgttttgtaatcttattggctaaatctcaaaagaaatgggaaaaaacaaatctccaggctattccttatttctaggccaaaactatctccacgattctaacaaacaaaaattacagaaatg

SEQ ID NO: 32202 - DNA, 3000 bp, Unknown; identical to SEQ ID NO: 7222
  misc_feature (1)..( 3000): 2750-1469P.txt file - cDNA_ID_3050051; gDNA_ID_1621133; Annot_ID_172554

SEQ ID NO: 32203 - DNA, 3000 bp, Unknown; identical to SEQ ID NO: 7223
  misc_feature (1)..( 3000): 2750-1469P.txt file - cDNA_ID_3050054; gDNA_ID_1621133; Annot_ID_172553

SEQ ID NO: 32204 - DNA, 3000 bp, Unknown; identical to SEQ ID NO: 7212
  misc_feature (1)..( 3000): 2750-1469P.txt file - cDNA_ID_3050058; gDNA_ID_1621133; Annot_ID_172551

SEQ ID NO: 32205 - DNA, 3000 bp, Unknown; identical to SEQ ID NO: 7233
  misc_feature (1)..( 3000): 2750-1469P.txt file - cDNA_ID_3050062; gDNA_ID_1621133; Annot_ID_172545

SEQ ID NO: 32206 - DNA, 3003 bp, Unknown; identical to SEQ ID NO: 18365
  misc_feature (1)..( 3003): 2750-1469P.txt file - cDNA_ID_3050066; gDNA_ID_1621133; Annot_ID_172543

SEQ ID NO: 32207 - DNA, 3003 bp, Unknown
  misc_feature (1)..( 3003): 2750-1469P.txt file - cDNA_ID_3050073; gDNA_ID_1621133; Annot_ID_56485
tcctttcaatctttcatcaacaccacacaacatgtttagttagttatgataagataaagaaaccatacatagataacatctttcaaactctttagattctcaagagtctaacctttgttaaaaataagaaaactatatgataaaaacaagggatgcaaaacaaatatattgaaaattttcttcaaacgagattattatttggcttagcttgtgccttctcgttcgtcttgctcttaccatcttctttcactggatccttcttctccaaagttacagaagacgacgctttaccatcttcttctatctcaagaggtttcgagcaccacctatcgagcaaattgcataaaaccgtcaccattattattcctgcgacgataatacaccatccccagattgggatctccatcttttttatgtatttgttttcagtgacaaagaaacaaagtaaattgtttgttgatgattacaagttgcttaaaagttgttgatattataggaggcgggaactactcgaaagacttggaaatttaccattttgacaaaaaacttgctagaaaataactaaaataaaagtaaatcattcttctaatttttttcaatttatcaactttaaaagtatatttccttttcttcataaatctcataaactagcaaaaagataatgtcataaactaatactataaaatatatattttgttttttttgttccgtcaaatatatatttttggttttgcctgtattcttgttgacttccgttttttttttcccccttttttttaattaacttcctttctttgcttttccatttcttcttgattgaaaaatgtatattgtgtgattttgtctactttatttaaattatctttgaaatcgaagaatttctgctctattaaaaattcaaactatagtctacgttggtatttgtttatttcattttatactctgcttatttttctgatactacattacaactaccactcaaaactacaattaattccctaaaaatatttttcgtttccaaaatttgttttgtgtgaacgattccgaactccacaattgatataaaaaattatctttgagttatattatcaacaacagaaaaaagaaagaaaacaaatacaacgcaagccttgaaataaagtctcatagatatttggctttttttaagtgcaacacaaacaaagcctttcaagacgatgagcaacaaggcttcttagcgtttgattcagaagtagcagccacatcaattgtttggccttccttgatgttggcatttgcagttgtctggtctgaagatatcgacttcttgctgatgatcctataaacctccgagagaatcgtctgaaaagccttttctacgtttaatgcctcgagagccgatgtctcgatgaaagataagccttctttctctgcatagctctgagcatcctctgtggcaactgctctgagatgcttcagatctgtcttgttcccaatcaacatgatcactatattggaatctgcatggtctcttagttcttttaaccacctgcttacattctcaaacgttgttggcttggtgacatcatagaccaaaagagctccaagtgcacctctgtaataggcgctagttatggctctgtatcgttcttgcccagccgtgtcccatatctgagctttcacagtccttccttccaccttagaacaaagatcataggttttttaataggttaattcagatctaatgagcagcagactctatgattagtgtgtctgcaacaacaaaattagtaacttcgcagctaaattccacaaacaacccagtaagaaaactagaaactgtgaaacaacaaccatgattcatacttcaaaagaaaatcatgttcgagatcaatttcagatgaagagattcttagatctgccttaaacaaggttttagatctgacatgtgagggagccttacactaccacgtaccagagtatcgacaaatttgggaacattatcaataaaacgcttaaattaagagataccaaagcaaaaatctcgaccaaatgaaaaaaacaggcaccacacatgtaaacatcaaaattcaaaaccaagcccaaatgttcctacacacaatgactgcttccgagtattcatacgaacacagatacggatcgaatcgaaaagcaccggatgctgcttaacttagaactaaacctagatccagcaacatttcgattacactatatactatatatatagagagagatgtgtgcgtacttggagagtacgagtagcgaattcgacaccaatggtggatttggattctaagcagaactcgttgcgagtgaatctagagaggagattagacttgccgacaccggagtctccgatcaaaaccactttaaacaagtagtcgtattcttcgtccggtcttctcgccattgttacacttttctcgaggagtgctttagatttgggattttgaaatagaaaaggagaagatgacagaaataaataaataatttaatttctctttccccttggatcttctctattcaaccttctcggcttgttattgcccaacgacgaagaccttttcttgtcaagttgggcttactaaaaaagcctacatatatgtaattcatttatacatgctaataaaagggaaagtaattagagcttaaccggaaaataaacaaaaatcagaaataaaaccaaacaaaaccgagccaaaccagaggaatacactcaatacagattttaaaaaccctacttcttcatcatcatcccttcaacactcctttatagcttttctccgcctcaactttttgcttcttctctctcgatttgctctcacggaagattcttcagaatatctggtaagatccatcgatcgaacaatctttttttctccagttagctcatattcatatttatgatcatgtcaattgcgagctcactgcttgattttttttccttggaaccagatccgatatcagaagccccaagttcgcttgaattccgtctgagcaatg

SEQ ID NO: 32208 - DNA, 3003 bp, Unknown; identical to SEQ ID NO: 32207
  misc_feature (1)..( 3003): 2750-1469P.txt file - cDNA_ID_3050073; gDNA_ID_1621133; Annot_ID_172533

SEQ ID NO: 32209 - DNA, 2300 bp, Unknown; identical to SEQ ID NO: 18370
  misc_feature (1)..( 2300): 2750-1469P.txt file - cDNA_ID_3050080; gDNA_ID_1621134; Annot_ID_172612

SEQ ID NO: 32210 - DNA, 3000 bp, Unknown
  misc_feature (1)..( 3000): 2750-1469P.txt file - cDNA_ID_3050090; gDNA_ID_1621134; Annot_ID_172595
ttgggatctgtgtaaataatgacattaatcaataaattaataagataataatttttttgaaagtcctatgtaaatctatggtctcatcaatatcataaattaataattatataaatatatcaactatatatatatattatatgtaaaaaaattctttataatatatttataattttttttgcttaaattcatatttgttttttgtttgactatagttttcatattttactgtatcaaaactattggtgttgttttctagacattattattatgttttacttgtaactggttctagaaagatataatctataatgaaggaaatcttattgaaatttttaaaaagttaccaaattagtaaaatctctctataaattgataaatattatttattgataaattaatacctctctaaaataataaaattttgtagtcccaacattattaatttatagaggttttactgtatactctatgttccttattatttgattttctataaaaataattgcttttaaaaaattgatttttttaggttttttatgcaatattaattggttgtaattgatgaatatgaaacttcaagataaataattaaatatcattggtttagaattataaaaatatgtaaatcaaaaaaatattacatttataatcagtttttaatacgttttattaatatgtgtattttttctagaaaatcaagaattaagaaacaaagagagtaataaactataggtgaactacttcaaaattgcaaagtaacatacttttactcatgaaaaaactactcttgttttttcttttgttactataattaaaaaaatcacactatagtttttatgatggatgagaagaaaatagtccaaaccacaaagtgtttaccactatattattttttcttgtttttctttaatcttcataattgctccacttttactagaattaaaaaaaaaactaactaagattaaaaacataatcaaataagttcttcaacatttcaacacttttatttaatattttaaatttttatatacttgtatattttaccaaaaaaatttcatatttttttcatacttaattcatcaagtgatatagaaacaaaattaaacgtcaaatttgagttaatttaaaaattctacttttggtaaatacaaataattttactttgcaatgttaaagtataataattttgttttaagtaaataagtggcaaaacaaattttgtaaatgaagaatctatttctttactcaaatccatactattgatttagaaataaaagcaattcatacaactgaatagaaattatgtcatcaaaaattattttgtccttacaaaacaggaatataatactagtattttataaatttacattagtaagcaccacttttcttcctcgaactcaataatccaaatgagacactttcaaaacttcatctattcctttgtaaattaacttttaacactgtttctaaacttgcgtgtcatcttctcgatattgtcaagaaaagttatcatgttagattcactatacccaaaaagtttccattattcttctaagaaaatcatctcttcaatatttttttcttcctctttcatgggtatcaatagtttcatttctacatagttttactcctatctttatcttgtcagtcatgattaaaatataataaaaataaatttcatgttggtttttgtcgaaaatagtatttatccaagcattatcgccatcacttgtcaacataaattttttacatggatcgttaatttataaaataaataaaaaaaaatataataatctcttgttaaaaaattagacatcacgtttcttagttttctctattgctcatttttgatctattacatggatgataatcaacatttagtctaacaagaggatcttattcattgccatttattcctaatttaccatcaattacaattctattaccaccaatcatctatccagaaatcgaaacattcgtataaaaataactaaaaaaccttaaaaatctaatatttaaagcaaaacaaatgtcaattgagaaaactccaaaacggatgggaaaacagattttaataacaaacaattccattttaatacaactaaaaccatattatatacactacaatcttatctcattctttattatgaaaacctgttttaaaacaaaataaatataatacacaattttacccaactaaaaaacaatatttgaacataatatgacattttcaactttatactataatattcttttacttcaaaaaacaaaaacattacatctgtaatgtaacacagattataatctagtttatgtgtaaaattttaaatataactaaaaacaattaaaaaaataataatattaaatgtatatatagagtagaacatatattcacattctaaaattataattcttctgtttcatattagttgtagtttaagatttttacacacatattaagaaattataaaactatcatttaatctacatcttttatataaaaacattatttattataatcaattcaaccaataaaaaaatatataattaaaatagaattaattagaaaatattaaatatatttatttatttgtatagaaagttaaaaacaatagaaatagagggagtagtatttatgattcgctccgtttttatcgaataattagtattgctatttagaattaggattatctagatttttcaaactgaaatggataaaagaattcaagtacaatctgattattattttcaaatcccagatgcactctttcgacaattaagtttttttttattattattgtgtaaaatctaaaattaagttaaacgaagattttttaaaattctctcgtagttcataatggagacgctcatttaaaattgtcaactttgacgactaattacaatatctaagagtaattaattaaagagaaaaagagtcttcattgataacagaagagagagagaagaagaagaagaagcttcacaatcgtaacaatg

SEQ ID NO: 32211 - DNA, 3000 bp, Unknown; identical to SEQ ID NO: 7243
  misc_feature (1)..( 3000): 2750-1469P.txt file - cDNA_ID_3050096; gDNA_ID_1621134; Annot_ID_172589

SEQ ID NO: 32212 - DNA, 3000 bp, Unknown; identical to SEQ ID NO: 7260
  misc_feature (1)..( 3000): 2750-1469P.txt file - cDNA_ID_3050109; gDNA_ID_1621135; Annot_ID_172644
